United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 12

SEQ ID NO: 33423 - DNA, 1433 bp, Triticum aestivum
  Clone ID: PAT_TA_33423
atgagacaccggtgcgccccctcgtgcaagaggcgagggtgacaacaccttgtagttcttcagagaaaagtggcacttcatcttcagcgcccaagaggaggggaaggggttcttttctctatgataagagtgttctgtacagcgaccagtgcgcttctcagagggatctgggtgacaaagggtctgatccagctcatgcgcggtcacagcctcatgcggatgagaatgatcacaaggatgctgcaaaacgatttgggacaaggcacgcccttctccttgatgacttcccacctaggtacacgcacaacagatttggaaaggacgtttgagaagtttggagaccatggagttgccatccgctggtctaatgattctgttgcacttgcagttttccggaccccatgatctgctaaggaggacacaaggcatgcgtccctcctacgtcccctgatgcaagaggcgagggtgacaacaccttgtagttcttcagagaaaagtggcacttcatcttcagggaccaagaggaggggaaggggttcttttctctatgataagagtgttttatacagcgaccagtgcggttcagagagggatctggatgacaaagggtctgatccagctcgtggtggatcaaagggtcatgcggatgaaaaagataataaggatgctgcaaaacgatttgggacaaggcacgcccttgttctttacgacttcccacctagcacacgcacaacagatttggaaaggatctttgagaagtttggagaccatggagttgccgtccgctgggtcaatgattcagttgcacttgcagttttccggaccccgtcatctgctaaggaggcacaagcttgcgtgcctccaagatacaaagtacggtcactaaaggataatgacgatctcttggcaaaaatcgacggtacagacctagaaccgccgaagccaagaccaaagacgtccgcgagaacggcgcagaggctgatcgcccacgggatggggctaaagcagttcacgaccatcgatgcaggcgagcggaaggagcaggaggaggcgaggaggagccggatcaccgcccggcaagctgcgcgcgatgatgcctggggtgaggactgaggactgcctggctgtccgagaactgctgtcgctggctggcgtgcgcggcgccgcctcctgccgggctgctcccagtcaaacctctgggtttgtttcacacgtatcacgggggtgtttaaattacatgttgatggtgttgtttgagtggcggtgatggtatccctggtttcattggattttactgtggtttcccactcccaggattgtaatgtcagaggtgcagaggctgggaggctgttgtgggaaagaaaaataaaccttgtttaccacaaattaatttaagtgctatgtgcctaaagtgatttacctgaaaaaaaaaa

SEQ ID NO: 33424 - DNA, 845 bp, Triticum aestivum
  Clone ID: PAT_TA_33424
ccgcccgggcaggtcgcaggtcggcaacccggagttcaagaagcggttcgacgagctgcccggcctccgcgcgctgcacgtcaggaacaagcccgacctcatcccgctctacccgagcaacctcctcggctacgccaacgtcggcgacgagctctccgtgaactctaagaagtctccccacgtgaggccggacaccaccaacgtcggcgactaccacaacctgcagggtatcctgcacacggtggccggatggaacggcgagaagggcgaagttcaagctgcaggtgaaccggagcgtggcgctggtgaacaagtcctccgccttcctcaaggatgacaacctcgtgccggagtcgtggtgggtggaaaggaaaaaggggatggtgctggggccaactggtgaatgggagctggagcagcccgctgaggagaacttgcccgtcccgccggtcgtgaccgggaaggtcatcgacgacgatgtcgctgccaccattagcagtaaggagcccaagataccagaggatctaggcaagaagaagaccaggggaaccaagtttctccctgcatgctttcaaggggttaattagtttgtgaatacgtgaatgattgaacgatcgtgtgatttttatttatttttactactgtgaataatggcttttgaaatttgctggtttggtacaaatgtttatgtgtggtgtgtcatgtaattaatatcagttttgataagtcttagtcgactgagacttcgttaaaaatccgtggatgctatattcctttgatcttgcatggagattcgtataaaaaaattctttcctgtattttttttttatactaaaaaaaaaaaa

SEQ ID NO: 33425 - DNA, 790 bp, Triticum aestivum
  Clone ID: PAT_TA_33425
aagcctgtacaaaaaacgtgtttatttctagctttgcagagattccagggtcattcgtgtcgatcatgatcgtggatagaattgggcgaaggctttcaatggcttcgatgctcttcactagctgtgtctttttattcccgctagtgttttcccgcactgaaatactgacaagaatctcattattcggtgcccggctctgcatttctgcgagcttcacaatcgtatacatatatgctcccgagatctacccaacctctgtgaggacaacaggcattggcgtcgccagctcggtgggcaggatcggcggcattctgtgccccctcgtcgccgttgctctggtgcacaactgccatcagacgaccgcgatcctcctcttcgagctcgtggtgttcctctcaggggtggccgtcatgttcttccctttcgagacgaaaggctgtaggctcaacgacaccgaggccgatatgcattgatgcggcgggttatatcatagcaccaattttttgtgtcctgagagcagtggcggcatattatcgaacattttttttccaacatgataccgataccgatattgattatagtgatcttagataccggggaatcctttcccctaggagtgatccccatccacttgtcggcggcggcggtgcagaggggattgcagagtataagaatagttgggtcagactgtgctcggttctgttttgtaacctatactttggacttttgaatgatgatcgttggaataaggaaatatgccagttgggcagaatctggcttttaaccaaaa

SEQ ID NO: 33426 - DNA, 973 bp, Triticum aestivum
  Clone ID: PAT_TA_33426
cacactcatttgcgccccctcccaaccgcagggaagcaaaaacagagcgaggaacgagcggcggcggggcgcgggtgggtggatggcgcggcgcgggcgtgtggagctgcggcggatcgaggaccggacgagccggcaggtgggcttctccaagcgccgcgcggggctcttctcgacggcgtccgagctcgcggtcctctgcgacgccgtcgtcgcgctgctcagtcttctcgccccgccgggaagctctacgagtacgcctcctccagcatagaaggtacatatgatctctatcagagatttgcaggagccggaacgaacttgaatggaggcgatgcaagtaacaacaatgatggtgatccttcaaacatacagtcaacgcttaaagacatcgcttcctggtctattcaaaataatgctgatgtctcagatgctaataagctagagaaactggagaaactcctgacagatgctttgaggaatacaaaatccaagaagatgtcggcgcaacaaaatagcggggcaggcacgagtggcgaaaacgccaatggtcctaggggaaacaagaagcgaggaaggactttagagcaaacatgtaggtgtgtctgcatttggtacaagctatgctctgttcccgatgcaacattgtttctcaaaggggtatcaaagacatgtcagggctgctgctataaaagggcagtgggttaacggcaaattcatttgaagggttgtgtgctaactctgtttcaataatatgatgtttttccctttgcttttgtccaactataagggtgtttgatgtgcaccgattaacatattaaaaagttgtcagtcttatatacgcagctgagtgagaaatcaggttatgtggatgcaactttatatataacctgacgcagatgctacctttcagacttgtttctaattccatcccatattgctgatttatcaaaaaaaaaactcgagtagtata

SEQ ID NO: 33427 - DNA, 731 bp, Triticum aestivum
  unsure (1)..(731): unsure at all n locations
  Clone ID: PAT_TA_33427
gcagnacggttctcgcttggtcgctgctggntatgtcctgtattcatctgctaccatcttctgcatcagttttggtgcgggaacccatggcttcactttggatagatcaacaggagaatttgttctgacacatccatccatgcaaataccccctagaggacagatatattcagtgaatgatgcgcggtacttcgactggccagagggcctgaagaagtacattgacacgatcagacaaggcaaggggcagcatcccaagaagtactcggctcggtatgtgtgctcactggttgctgattttcatcggacgatcatatacggtggagttgcaatgaacccgagggatcaccttcggttggtttacgaggcaaatcctctcagtttccttgccgagcaggcaggggggcgaggctcggatggcaaaaccagaatcctctccattcagcctgtgaagctgcaccagaggctgccattgttcctggggagcatggaggacatgcttgagctagaaagctatggggatgtccagcagaaggtcaatcctggatacgatgtttaaggtgaaatattcaggtaaccaatgtatatggtaaagtctgtatttgcaagaacaatgtctctgtgtcttacttcctttgcttttttgcctatgcatttgcagagtactccatagcgggagtccgcaaaatttgccgtagctcactgtgaaaatgaaagatgcaatatgtctc

SEQ ID NO: 33428 - DNA, 1226 bp, Triticum aestivum
  Clone ID: PAT_TA_33428
gagattcgagaggctagacgaataaaaatgctacaccagccaagcaaggtaatggacatgcagtttgagcttcagggactgcgtacacttatatcagaaaaaacacagctttgcaatcagttaaagaaagagcttgccatgatcaagaggcttgaacaagatagctctaaactctttgagcttgaaggttctgatactcttggatcacagttccgtattgtccctcgagttgatggtgctccagacatctcgagcggccccccgcgctggtaccgtgtaatttccggaggccacagagagctcgtatcgggtgcaacgagacttacttatgctccagagccatttgatgttggccaattgttgcaagcagagataattttgaaagcagataaagttacggttcagacagatggccctataaatcatgcttcaggactggaacattatgtggaatcgctaatgaaaagggcggatattgagttcaatgtggtagtaacccaaatgaatgggaatgactacgcatcaaaatctgtccatgtatttcatattggaaagctgagagtgaagcttcggaaaggaaggtctacaaaagcaagggagtcatattccaccacaatgaagttgtgtggaagccgaggtggtggtaatgctgcggcctgtgcagtcttctggcaaactaggaaaggcctatcctacactctagctttcgagacggacagggataggaatgccgcgattatgcttgctcggaaatttgcttccagttgcaacgttgttcttgctggaccaggcgatcaagtccacggtggtggctgataaagtaaccgtgcccggtttgacggcgctgcacatattattaggttgtgaatttgggtgcttgtgtattcatatttgtgagagtaggaggttgatcaagtccacgaggtttttcccctttggacacgtcctgtgaaggcaatctttttatttgcctgcctgcagctgttagcaaatgctctaaagatgtgcagcacacgccgattgtatcttgtgtatttacatatttgcaacatttgagagagaaaaaggaaagaggccttttagtgtagtgcccaggggctttccttgagttatcaagaaatgtacagatgagagaaccttttcatctacgctgtaattcttgtccttgctgcgagtataattaatgacttgcacattcttattaaaaaaaaaaaaaaaaaaaaaaa

SEQ ID NO: 33429 - DNA, 1152 bp, Triticum aestivum
  Clone ID: PAT_TA_33429
ccacgcgtccgacggcatcgtccgcagcatggccatcggcgcggtcttcaccgactacgccgggaagataagctgcctcgacttccaccgcaaggaggacctcctcgtcacctccagcgaggacgactccattcgcctctacaacaccaccagcgccacgttgtcgaagacaacttatcataaaaaacatggtgctgaccgtgtctgttttactcatcatccgagttccatattatgttcatcaagatacaatgtggagtcaggagaatcacttcgttacctgtcattgtatgacaaccgttgcttgagatatttcaaaggacacaaagacagggttgtttcactatgtatgtcacctgtcaatgatagctttatgtcggggtcacttgatcacagtgtcagaatatgggatcttcgtgtaaatgcttgtcagggtatactgcgtctgcgtggtaggccttctgttgcatatgatcagcagggacttgtttttgctgtagcaatggagggaggtgctattaagctgtttgattctcggtcatatgacaagggtccattcgacactttcttggttggtggagatacggctgaagtgtctgacattaaattcagcaacgatggcaagtctgtgcttttgactacaactaacaaccatatatatgttctagatgcatatggaggggagaagaagtgtggcttcagcttggagtcatctcgcaacatagcaactgaagctgctttcactccagatggtcaatatgtaatttcaggatctggtgatggtaccttgcatgcttggaacatcaatacagtacaggagattgcctgttggaacagtcatattggtcctatcactgctttgaaatgggcccctcgtcgagctatgttcgcaactgcatcgacagcactgactttctggattcccaacgaatccagttcgagttaggtctctgaggaagggagatggaacatggaatgcgctaacttaacaaaaggcttgtatcatgttctttccttgacaggacaggtactatgtatgaagtatcacttgctttattaccatatatatgtggaaacagtgatgttggttccctgtagaatgtattgaagtgctccctttatttcttaagtactatataatattgcacaaaa

SEQ ID NO: 33430 - DNA, 1500 bp, Triticum aestivum
  Clone ID: PAT_TA_33430
gcacgaccgaaatcgaaagaaggcgcccagagaatataaatcccccccacccccccacccccgcaccacctcctcgtcctcccctcccagatctgccgggcacggccctcgccggcggcgttgggtccgcgatgcctcggacggcgcggggggcctcgcccctgctccgcgacaacgccggcgccctcaaccccccctccgcctgctgctccccccccctccccaccccctgttcttgcccccccatcctcccctcttcctcgcgccccccccccttcctcccctcccttcccttccccctcccttcctactcccgtagctgcgcttcttcgcttctcgtcggccttctcggccctgcccctgcgggttggattcgccggcggcggctgggacgggtgtgtctagcgcgtgctcgtcgttgtatggagttggtttcttgatggacagtccagcctgcttgcttgagagtgtgccagcagtgccttcgaatggttcgggtacctcttccgttggcgccggaggcgccgacatttccccagggaaacagtccgccctggatggagcttcgcggcagggggaggatgccgattgttcatcggaggctggaatgtgtgcgggtttctccaagtcggccagctctggcttcaagaaggctctccagaagtgcgcaacgtttccgccgtctgccgccgcggcagaacaggacgactcatgttgtgccgccgatgacgatgcgctgccgaaggatgcgcacacttaccagcgctctgtttccttgccttcaactgtgaagctcatccctgctatcaaaggaagccgcaaaaagaatgggattcctttaccagcagtgcctcgccccgccgaggatcgccacatcaaatgggcggccgacgtgtatgacccccctgtttcatccgtttctcattctgtgaacaacagttaccagcgacggcccaagccccgtaagaaggacaagagcaaacagaaagagaagcggaaggccaggaacaagaaaaaaaccagcaacgcttcccaaaatcaagctgtgctccagacttctgaactggaggaccttggcacctccattggtagggaggctccagccgaccccggcaagcttgagaccgagatgttggactatggcatcaagcagccaaagaggccaaatgcggaagcagcttcctgctcgagacggctgctaaaatgcatttctccaccgccgaggcctcctgaatcgcccgcgggagactccagactctgcagtagcatctctgttatgtaaataggatggctgtacataaataaatcatgtgtgttgttatcaccatgtacctcccgttggacgtgatgtgctagagaacttctgccctagcgttatttcgtagcaatcgtcatgaattttggactggtttttgtatgtaactatgtatgttctgctggacaaaactaccatcaatctattactacacaacagttgctgccttaaaaaaaaaaaaacac

SEQ ID NO: 33431 - DNA, 559 bp, Triticum aestivum
  Clone ID: PAT_TA_33431
ttcaatgctcatgctgaaacaaaggaagcaaagctacagtcagagttagcagctctcatgtacatgaagactaggcttgtccgtgtccgcggcccaggtggaaagctagcttttggtgcaagtggggaagctgaagttgtcagtgctcgagggagaggaccgggcggacggggtttcatgagtggtgctggtgaaacggaacttcaactacaacgcaggagaatccaagaacgtcgtctaagcttgttagctcaaattgaagacgtacgccgaactagggcgatacagcgttcgagtcgaaagaggcatggtggcccatttggtcaagaccttgtaactgtggcagtcgtcggatatacaaatgctggaaaatctactctagtgaatgcactttctggagctggtctatacagtgatgatagattatttgcaacagtagatcctcgattacgcagtgtgattcttccatcagggagaaaaatacttctcagcgataccgttggcttcatatcagatttgcctgtacagctagtggaagcatttcatgccaccctggaag

SEQ ID NO: 33432 - DNA, 1484 bp, Triticum aestivum
  Clone ID: PAT_TA_33432
tcggcggcgtacgcgcatttccggagaccggccggcggcgcgcacggcgtcgtttccggctggtcacgtccccagcgccctatgtctcacgcgacagcgacggcggatgagtcggtggaatttggccgtctcctcacgggcgtgctactgacctgccacgagagcaatgtctatccaagcgcgacggttgctgacgctgcctctgctctttcctagtcccagcaccagtctcccactctcgcccgactctccactatgcgcagcctccggggcctcctcgccgtctccggccacctcgcggcggcgagcggcgcctcctcgtctccccacagcgtcctcttcgcccgtgccctccagatcctctcccagccggagcccgtccgcctccacaagctctcggcgcccgactccgggatcgtggagctgaggctggagcggccggaggccaggaacgccctcgggaaggagatgctcaaggggctgcggagcgccatggacaaggtgggggccgacccgacggccaacgttgtgttggttgcgagctccgtgcccaaggtcttctgcgcgggcgctgacctcaaggaaaggaggttaatgggcccttctgaagtccgggaatttgttaataccttgagagctacattctcatcctttgaggcactccctattcctacaatagctgttggtgtgccagctgcctttggcggtgggcttccgggggctcgtgcgtgtcagcgtcgtatatgtggggagagtgcaacattcagcttgccagtgacaggccttgcccgtagacctggtgcgacagcagctgtaaatatgggagtagagatggagggacacagcgtcttccaaggattgttggaagggccagagcaaaggaattgatatacactggccgtagcatttgatgcgacaaaggctgtaaatgccggggatagagggatggaggtatgacctgtcctctgcgttggctgtcgaagaagggtgcgacgagcaagttctgcacactcaggatcgccctcgaaggtcgtagctgcatttagccgagaagagaaaacatttgtacctgtcctcttgggtcgctattgaagaagagtgctatgggcacgtacttcacacgctgtatcgccttgaaggtctagctgcatttgcagagaaaagcaagacctttgtacacaggaaagtgaggccgtactgaagtcagccctgttagcctcttatgtcttatctgctgtataccctgaagaatgtgtccttagttccaagaacaaaaaaaaaccaaatgaatgtgtctgcggtgctcgcttatttgctgttgtatgtgctacatcttttcattggcatgatcgcctaaaactgaaatgaaccgcacccatgtaactgtaaggtaggaaggctcgcatctggagatgctgcggtttggtttcgtcaaaaaaaaaaaaacttggtgttgaatacaactaataacccccctgccaaca

SEQ ID NO: 33433 - DNA, 1208 bp, Triticum aestivum
  Clone ID: PAT_TA_33433
tcttcgccacccctcccgctccaactcctgaaccccttccaacgagaccgaagcgcaaaaagaaactcgaagcacaggaacaggaagcaagctgccccccctcctcacctccgactcactcacgatccgagatcaggatggccggatcgatggaactccctaccaagggcggcttcagcttcgacctgtgccgcaggaacgccatgctggagaagaatggcctcaagatgcccgggttcaggaagaccgggactaccatcgtcggcctcgtgtttgcggatggagttgttcttggggcagacacaagggcaaccgagggtcctatagttgctgataagaactgcgagaaaattcattttatggcaccaaacatatattgctgtggtgctggaactgctgctgacacagaggctgtgacagatatggtcagctcccagctacaacttcaccgttatgctactagccgtgagtcaagagttgtaaccgctcttacactactgaagacacatctttttaactaccaaggtcatgtcagtgctgctctctgttcttggcggagtagatgtcactggaccacatctgcacactgtttatccgcatggctccaccgatactcttccttttgccacgatgggttctggatcccttgctgcaatgtcagtgtttgagtcgaagtacagagaaggcctcacaagggacgaagggaattgcacttgtagctgaggcaatccgtgctggtatcttcaatgacttgggaagtggcagcaacgtggatatttgtgtgataaccaaggggaagacagagtacttgagaaaccacgagttaccaagaagaggatacagcttcaacaaggggcaatccgaggtattgtctacaaagatcacgcagctgaagctgaagccagaggtcgctgatggtgatgcaatggaagagtgatcttgtgtgcttccgttcggacaagcagccatgctaagaatttgcgccatttcttcttttttctcagcgtgggtgctagaacagaaaattggtgctatttcagaatacttcatgtattttgttgtacttgctgaatttgatgcagacctttatgttaaactgtctctgggctgttggtgttatcgtctattaatctaaaattcatattcccgtttaactatggcaaccaaaagatgtgatatgtttgttaactcatttcaaatcaccaaga

SEQ ID NO: 33434 - DNA, 687 bp, Triticum aestivum
  Clone ID: PAT_TA_33434
gctgccctcgctggcgcggggacgccgccccacggtagtcccgtcgcggcgaagagggcggccgccaccgcgtggaagcgcccggagaacgggcccgtgctggtggcgcccgcgagccccatcatggacgccgactcctggccggcgcttcctgggctggcctctccccagccgcccacaccgcccaaggcgtcgcctaaggccgctcctcccccttccactgtggcagctatcttgcccgtgtccttggacatctccgacgctccggatgctacccctgatcaggatgcactggagacagtgattttaccggtgtctttggacatctctggcgctccggatgctaccactgttaaggacgccgtgaccagtagtccaccagtccggcgtgtgttgatgatgcctgcaggggatgacgggccagagatgcatgctcttattccagagccatctctaggatactctcctaatgcccggagcaatggtaccggcgttcatcatcagaatggccgttttggttcccatcctcatggccgaggtggcagttatggtggggggagcagaaggggtaatggtggaggtggtagtcgccatggtcatgagcaccatggtgggtttgatgggcaacggcgtggtggcggccgtagagatggacatgggccagggcaccagcatcgtgttcaccag

SEQ ID NO: 33435 - DNA, 1300 bp, Triticum aestivum
  Clone ID: PAT_TA_33435
gcaaggggcacaggtccggcccacatggggtggtcagccactcagcccccagtcgacccgcaacaccacgccccacgccacacacacaccaccggacacgagaggagatggcgacaggagttggggaggccaggggggagacggtgctggtcaccggcgccagcggcttcatcggctcctggaccgtgcgcctcctcctcgcccgcggctacgacgtccacgccgccgtcctcaaccccgatgacaaggccgagacggagcacctcctggcgctcgccggcggcgacgagggccgcgtccgcttcttcccgtgcgacctcctcgacggcgccgccatgctcgccgccgcgcgcggctgctccggcgtcttccacctcgcctcgccctgcaccgtcgaccgcgtcctcgacccccagaaggagctggtggtgccggccgtggaggggacgctcaacgtgctgcgcgccgccaaggaggccgggggcgtgcgccgggtggtggtgacctcgtccgtctccgccgtcgtgcccagccccgggtggcccgccggcgaggtcctcgacgagcgctgctggaccgacatcgactactgcgacaagaacggggtctgggtaccctgcttcaaagacactggctgagaaggcagcatggaagtttgcagaggagaatggactggatgtggttgtggtcaatccagggactgttttgggcccgatgattccgccgaggatcaatgctagcatggccatgtttcttcgcttacttgaaggctgcaccgaggagtataaggatttcttcatcgggccagtccacgtggaagacgtcgcattagcccatatcacgctgttcgagaacccgtctgcatccgggaggcacctctgcgtggagcccatctgtcactggagcgatttcgcgtccaaagtcgccgagctctaccccgactacaaggtcccaaagttggccgagggacacgcagcccggggctggtgagagcggagacggtgccgaagaagctgatggcgctgggcctgcagttcactccgttggagaagatcatcagggacgccgtggagagcctccggagcagaggatgcatcgcctgatggtgatggctggattattattaggtgtactgtattgcttcccctctgttgctggctcatgatcaaaccttgcttcagagatgtgttgtgcccagcccagtgctagaccttatagttgcttgctgtatgatttgtgcaataacggctggttgatctgctggtacactgtaatggttcttttggtagactgttccgac

SEQ ID NO: 33436 - DNA, 661 bp, Triticum aestivum
  Clone ID: PAT_TA_33436
gagggatcggcaatgtgaatttgtacgcaaataagctactccacatacataataaaaacacaagcatttggacaagtttttaatagctaaagtgtttaacttggtaacaagttcacaaacaacaattactcgcaagctccactgagttcaaattactgacataaatgaaaacatgtgataataagcagggacatctccactcttcagtctttacatgccgcttcttcatcctcctggattttggaatgtaaggctaagagctcagcacgtttcttgcggagtttctccataaattccacatcgtcaaggtaatcaaaggactctcttatcctttcctcctcttctctcagttcttcttcttcatcgtcgtcttccttgttttgggcgtcgcggcacacctcatcgttacatgcatcataaccaagggagagatcagtgtggccgcaatcaaaatgagtaggggggtgcttcatatgaatacttccattgttcgtacaaccatggcagtgaacgtctaaaggaagacatgagtgagatttgtcatttaagtgcaagatagccagcctggctcagatacacgagaatagctgaataagtggccaaaaaaaagcatgattgcagcagcacatacaactggctgtgcgtgaaccagttagattgc

SEQ ID NO: 33437 - DNA, 1035 bp, Triticum aestivum
  unsure (1)..(1035): unsure at all n locations
  Clone ID: PAT_TA_33437
attgngacggnccccttttaacaanatnagcgggagtnaagtgantatnttgtaaancagcanctgatatgnttatcccnaacngtttngtngcttgggttgaaggaagcnctttganctnngaaaacttttcatnatggtgntaaaccttgnctgantaggaaagaagcagacaattgggcntgacttcaagagctgntgttctcaggantcatatcctggaagttattatagaggagctaacnttacttttcaatatagaaattccgtgaatttgatatctgccctgggatgagcaacccaattgcttcagttctttacgtcagggtcgagaactctactacagaggaaatagatatactcgaatatatatacacaggtaacaagatttgacagtggaaagcgctctgagtatgttttcatcagaagcaagcgcaaaggccatggttaagatgatgtgtccagaagttgctcagcttctcttagcacatgcataccaggtctgcctatccgttgatggtgattctagcgaagctaatgatgcagcaaaaatgatgggagcgtctcttctcgagatatcttgcaagtttgtgttggctttccagaatctgagaaaaatcaacacgaacattcagatttcacagtttgagaaagaagctttgttcactgcagcaacgctgacaagaaaactgcagaatgggtgaagattggagacttgaagtattcattttggattttggagacttggaagcgatgggatcaaatggtttatcttaagagaacgatggatctttgtctcgtctattgtacggcaaagtatgttacctgtgtatatatatttcagttatctatttcctctgtagtagagtatccgaccctgacgtaaagaactgaagcatctgggctgctcatctcggggcagatatcaaattcacttggttttctgctcggcaaatatgtactactgaagaatgctggtttcgtcttaagatggtaaccaagcaaaccagcccgggtgaatctacgcttccaaat

SEQ ID NO: 33438 - DNA, 427 bp, Triticum aestivum
  Clone ID: PAT_TA_33438
aatgctaacaagaagagagtaaaggagctgagattgggactggaaaagaagggctgggcttcagaaagcaccttctgaatatgaatcagcatagctctaaattgatcaattgccaagccaggaggaacagccaggcgcactcactatgcaacaatggaatggggtcaaaaggaggaaccatgcatggatgggcgccattgaggggtcaaacccaacaagatctagtgtagtgtactccttttcttttttgactgcctagtgtgctactactcgaccagctttcatcctgagcactacttaattgacttagtgcattcgtccggcacttggtggctagctttcgtcgaccaggtgtcgaccaggcaggactccaaaaaaaagctcaatatatatttatgtttcattatccaaaacccccccccccccc

SEQ ID NO: 33439 - DNA, 1097 bp, Triticum aestivum
  unsure (1)..(1097): unsure at all n locations
  Clone ID: PAT_TA_33439
caggaattcggcacgaggtcgtccactccngtcccaccccatcctttccacggtggccggagcgagtccctccgtccctgcccaccaccggcgagcaaacgatgaactcgtcggcggtcacctgctgctactggcccccaccaccccacgctcccggcggcaaggcatcaccctctccacgcctcaacaacaagagcagcacaagaatcggacgaagggacctggtgctcaggagcagcgagctcgccacgctcgccgccatcttccacttcagtggcaccaagccgagctaccttggcgtgcagaagaggccccccgccctcgccttgtgcccggcgaccaacaactgcgtgtccacctccgagaggataagcgactccaatcactacgctcccccatggaattacaatcccaaggatggccccaggggtaaacccataagcaaagatgaggccatgaaagagctcattgaagttgtgaccaagacaaagccggacaacttcagtcctcgtgtggtagagaaaggagacgactatgttcgagttgaatacgagagccctatattcgggtttgtagacgacgtcgagttctggttccctcctggcaacaaatcaatcgttcagtaccgatcggcgtctcggtcaggattcatcgactttaatgctaacaagaagagagtaaaggcgctgagattggcactggaaaagaagggctgggcttcagaaagcaccttctgaatatgaatcagcgtagctcgtaaatcgatcaactgccatgccaggaggtcccgcctccccctctctcgtcgccccactggatggctgccggaaggcgggtaattaaatttgcgggccccagcgtggggcctgaccccacaagagcttgggtcgtggacgccttccttccgctgtgccggccctgtgcgctgccacccctcctgctttcatcctgagcactacttaactgacttagtgcattcctccgacacttagtgactagctttcatcgaccaggtgtcgatcacgcgggactccaaaaagaaactcaatatatgtttaagtttcatcaaaaaaaaaaaaaaaaaactcgagactagt

SEQ ID NO: 33440 - DNA, 494 bp, Triticum aestivum
  Clone ID: PAT_TA_33440
gaagtagatctctaaacagctcactatttactatcttgctcttgtatatgcctttgcttgaggacaagcaaagattcgtccgtaagtgtgggggaacttgataagtatatttcacatatataattttggtactcaaatatagcatctaccctgacatatttgtccattcttgccatgattgattgaatattgcatgataataatcaaaaaggatcatttactagtctttggtctatcttgcagaaatgtgcgcaaaggcactaataatcgtcaagattccgtctatgtggctatcgagaagagtgaagaagagaagagaaggaagaagagacttgtgtgagatgaagagaagtaaccagggggctagataaagaagtgggaggaccttcttgtgaagaaagaagagaagaaagagggccaaatcacaaagtgcagatgagaggaggggaacaaaatccctaggcgctggagggatccgatcgggcctggctaca

SEQ ID NO: 33441 - DNA, 650 bp, Triticum aestivum
  Clone ID: PAT_TA_33441
tcgcccacgcgtccggctggagcaggcatggggatagagaagcaaaaagagaagagctgcagtatagagagcgttgagcgagtgctacttcctatataaacccggtgagctgtttcatgacccgaatctgaatatatcatctattgatacatgctgaaatcatttgatatttgggttgcttgagccatttcttaaatatcgtcccactgaattttaccttcgacatatggtgattgatgtgaatatgtgaactgagtgttgaatgccttgtaaactagtgatctatacaatgcttgctttgctgaaagtagtggaagctattagttttgagtgctcaaatccctagtgcactagaaaacttaatcattttttgcatttactatgatacacctagatcaccatgtttagatgctgaatttgtgctaagtgtgttcccattgagagcaatcacctaaccactatggattagcatgctatgttccctggatcggtagcatgtgaaccagacatggagaagtgatgattcctgtttttgtgcttatgcgttgttcatttaagatagctaatactgaataaataagtctggtctacctacagtagcatgtcatgttccctatatcggtggcgtgtgaaatctggtagcttggaca

SEQ ID NO: 33442 - DNA, 2364 bp, Triticum aestivum
  Clone ID: PAT_TA_33442
gctcgagtatactactcgatgggcccctattactttttcattattatctactattcttgcccagtagtctactatagctccgtcctaccctgcccctttgctctgctccataccatttattcgcatgatctgcttctactgttctctatatttattcttctctgttacgttactttatcgattacttacagtgctttgtccctttcctttatattggcctattttttgagtgttctggcaggtttacggttgtgtattattcattacccctcgacccactccgagatatcatctattgtgatctcgttggattcacgccatggttatgaggagatgcaaagagcacacatgaggaagggcgaccatggaggagccttttggctggtgaaacgataggtgaggagcacaatcctagatgggactctatcaatcactacttcatcgagatcggagaggggttgcacgtggcgctgggactatatcaggagttgctcaatggagaagtaaagtgttctttggggttgttcaattgttaagtaattgttgcccgaatgaatgttggctgaggttctatgtttggtgtgctttggcgaaattagtgtaaattccctggttagcttgctatcgacatcaggtctgtgaaatacataatccttttcgccttttaccttgagacacctacatctccacgcttaggtgctgtatttgcgccaccgctcttcccagtggcagcaatcacctaacccctcaggatccggaacctctgttcactgccttccatccacgccaacaccacctcgcgccgctgctccatccgtcagtgccccccctcctccaccatctcttgcgcgcccgaccagacgaggtgtcttatccccctacagtagcatgtcatgttcccgggatcggtggcatgtgaaatcgggttagcttgggcagtaattaacaataataaaaatgtaattgtcgaatcaggtgtataccatgttctcgggatcggtggtatgttcctttggggagacaaacaaaaaacatttcataaaaattggttgagccaggtgtataccatgttctcgggatctgtggtatgttccttcggtgagaccactaaaataatatctgtaattctttcaaattcaatcagtggttcaaccactaagtcctatttctgcaaataagagactttattccagttctttttgttcttgggatcatgctctctttaggaaccatttggcgcagtcatcatttaaatttgctgatccttttttatcactttaatagttcaaaatgattatgcttattagtatcctattgctctgtagcactcctatccattaattttcactagctaagtctaaagcatgctttgtttagagatctacttcactggacattccctagtcatttcactgttcattatcttgcttttgtcatatgcctttgcttgaggacaagcaaagatttaagtgtgggggaacttgataagcacatttcatatatataattttggcactcaaatataccatttattgtgatatgaccatccattcttgctgtgaaatgtgatatatttgaatgaaaatcatataaaagatcatttactcgtcatttgattattttgcagaaatgtgcgcatgggcaccatattcggcgggcttctgcctctctggcgtttgtcttgcgggaagggccgggaaggcactctgcacggaccggagcgagcaagaaaagaagtaaccaggggcatgccaaaaaagttggagggaccatcttgtgaagaaagaagagaagtagaagggccaaagagcaaagcagcagatctgatcgaggggaacaaaatccctagaatgcctctattccccaaggggcctggcacatctctccatctcatctcttccccgcctccttctccacctccggccgctgccgcagccaggccatcgtggtggtgcgccacccagacaacctccttcctccaacaccatcatcgcctccagctaccacgccatcagcacctgccgctgcaccattaaccgtgccaccagctccaccgcgccaccgcatcaccggtgggccaccaaccagcgcacctccctcaccctgctgctcatcttcttctccccaccatgtccaaactactgccgctcttctctccagcctatactgctgctgcttcttcccctcgatattctgctgctctgctctctatactctgctgctgcccctgtctcctaacaatactgctgcacttcttctgaagcttttctcaaacccaagaatctgctgctgctcctcccctaacacggctgcttcttctccatccccacgctgctgctttttcttcaagtcccctgctgcttc

SEQ ID NO: 33443 - DNA, 668 bp, Triticum aestivum
  unsure (1)..(668): unsure at all n locations
  Clone ID: PAT_TA_33443
accggccctgcaccacctgctcgaccgccgcgcgggaggcccagagggcgacgcccgcgatggacgggactccgccgcccaagcccgaggcgaagctggcggccggcgaggccgggtacgtcctcgaggacgtgccgcacgtctccgactacctccccgatctcccgacctacccaaaccccctgcaagataacacggcgtactcggttgtcaagcagtacttcgttgacccggatgacactgtctgccagaagattgttgttcacaaggatggcccaagagggaaccacttccgacgtgctggacctcgccaaagggtctattttgaacctgacgaggtccatgcctgcattgtcacctgtggaggactctgcccaggacttaatactgttattagggaaattgtatgcggcttatctgacatgtacggtgtcaccaagatacttgggattcagggtgggtatagaggtttctacgctcgcaacaccatcgacttgactccaaagagtgtaaatgacattcacaaaaggggcnggaacctattcttggctcgtcacgaggaggccatgacaccatgaagattgttgatagcattcagtaccgtggtataaatcaggtgtatngtattggtggtgatggtagtcaaagggtgcaggagtgatttttga

SEQ ID NO: 33444 - DNA, 798 bp, Triticum aestivum
  unsure (1)..(798): unsure at all n locations
  Clone ID: PAT_TA_33444
ccggngtcgacccacgnncgtccgctccaaaatcccaccacctcgncaccaccgggcgccatggcgcggcgtcaccccgcggccacctcagctaagcgccgcgccgcccctccaaaccctagcccgacccctccggccgccgacggatcgcatccgctcctccacgcggctcgccgcggcgacctccgcctcttcaagaggctggtgagagatctggataagggcaggggccgccacagggaggtggtggatgcggccaaggaagaaggtctcggggcgctgcacttcgccgccgggaaggggaggctacgggtgtgcaggtacctggtcgaggggctaggggtcgatgtggacgccgtcgatgacgcaggtcgaacgcctctgcttgtggcattgcttcgtggaatcatggatacagccagttatcttcttgatcatggggcagatccaggcaaggctgacgacgaagggtttgccccacttcaccatgctgctacagcaggagaccgtaaaatggtggaactcttgcttgcaaagggagtctctgttgacccagtatgtgttgatgggacaccactgtatgccgctgccattgaagggcatgatgaaatatggcaaattttgttggagaacaacgcggattgtaacaagaaaatacctggtattgacacccctcttcttgttgctataactgctccctccgtgaaatgtgtcaagctcctggttgagtattttgtttgcaggctggtgcggatgtcaatgacggtattctagcccctttagttgttgctgctgaga

SEQ ID NO: 33445 - DNA, 811 bp, Triticum aestivum
  unsure (1)..(811): unsure at all n locations
  Clone ID: PAT_TA_33445
tngataattagagtaataattaacaacacttggtcggaaaccacacggagttgctacacaccacagggaagaagaaatcggccgatcgagatacacaaatcgtagggacgcacagcagtggagcaagcaaagtacgtgccaccaacgccactgcctccgccgtacgtgccaccatacgtcccgccgacgccgccatacactccgccctacgtcccgccaactccaccatacacgccgtcgccaccctacgtgccgccgacaccgccatacactccgccctacgtgccgccgccgtcgccggggccggggaggaagacgtgcccgatcgacgcgctgaagctgaacgcgtgcgtggacgtgctgagcgggctggtgcacctggtgatcgggcgggaggcgcggagcaagtgctgcccgctggtgcagggggtggcggacctggacgcggcgctgtgcctctgcaccaccatccgggcgcgggtcctcaacatcaacatctacctccccgtggcgctccggctgctcatcacctgcggcaagcacccgcccaacggcttccagtgccccaccgtgctcgacgcctagcctgcgtggccgctcggctcgccatagctttactatactagcgtgagtggtgtggatgctacagtacttgcttgctccagtgctgtgcgtcactacgatttgtgtatctcgatcggccgattttcttcttccctgtggtgtggagtacgagtgtagcaactccgtgtggtttccgaccaagtgttgttgaataattagagtaattaacatgtgctattcacaaaaa

SEQ ID NO: 33446 - DNA, 1671 bp, Triticum aestivum
  unsure (1)..(1671): unsure at all n locations
  Clone ID: PAT_TA_33446
ggactgcattggcattgggatcgcgcactgaccggacgccccggcgccatggccagccttgccagagtctgttccctcctgcttgttggcgtcgccgtcgtcctgctcctgccgggcacgtacgggtcgtacagcaactgcccgccgggacatggcggcggcggtggtggtgatcctggacaccaccacccgccccaccacggcaagccgcccaagcaccaccacgggccaccgtcgggccacaaatgcccaccgtgccacccgccgccgacccgcgcccaccccgccgactccgccgtacggcgccccccgacgccacggccaccgcgttagtgccgcccaggccgctcccggccccccacgacccacccatcgcctcgtgcactccaccgcagcccgccgctacgggcctcctacgccacttccaacgccgtacgtgccagcctacaccccgccgacgccgccgtacactccgccgtacgtggcggctgctacaccccacccgccgacgccaccgtacattcctccaactccaccgtacactccgccgtacgtgccgtgggctacgcaaaggacgggaacaaacaccccgccccacccccgcgctgatgctgtacgcctgcggcgacccgcgcggcgggccgggccacccggcgagcgcgcgggggccccggagcccgtgcggcccgcgcgtgccgcgggtggcgggccggcccaccgccccgtggcgctgcacccccgacctggcgcacccccccccggacgacggcgcaccgccccgcggccccccccaggcccaccacccgcggcaccctcgcgcaccacgggttccgcggcccccccccgacccccccctacaccccaccgtcgcgcagctacccccacgcctgctgctctactgtgtgccatggggcgcgtcgctgctcccagcactcggcgtgcgccgccgccctgcggccgccacgtttggcgctgtccgcgccgccgatcttcgccgcccccttgagtgggccgcagctcgcctcgggccgcctgcccaggtgtggttggtgggtgtccgcaatgatcttcttgtgctatttacaaaaaaaaaaaaaaaaaatacgtcccgttaattattactctaattattcaacaacacttggtcggaaaccacacggagttgctacacaccacaggggaagaagaaaatcggccgatcgagatacacaaatcgtagggacgcacagcagtggagcaagcaaagtactgtagcatccacaccacaccacaccacacactagtatagtaaagctatggcgagccgagcggctatgcaggctaggcgtcgagcacggtggggcactggaagccgttgggcgggtgcttgccgcaggtgatgagcagccggagcgccacggggaggtagatgttgatgttgaggacccgcgcccggatggtggtgcagaggcacagcgccgcgtccaggtccgccaccccctgcaccagcgggcagcacttgctccgcgcctcccgcccgatcaccaggtgcaccagcccgctcagcacgtgcacgcacgcgttcagcttcagcgcggcggtcgggcacgttttcctgcccgggcccggcggcggcggggggncntagggcgggggcggtgggcggggcccgggggccgccggggggccgcc

SEQ ID NO: 33447 - DNA, 1180 bp, Triticum aestivum
  Clone ID: PAT_TA_33447
ctttcttccgtggtgaacgtgaggttgcgtgaccctgtgaagtttgagtggtctgctgcggagtacaagcagagggagggtcccacttggtgggttgtatcttgacaggaaccgatctcctcaggggggatatgaagggggtgggcggggaggtgcaaggttccgagcatgtttcagcccaatatggaagaggaggcaggtcgcaggggagggggggctagaatggtcctggtaaggagttcattctaattgatggagaatatgttcacaggaatgatccaaatctttcaccaagagaaggtgattggatatgccagaatccgaggtgtggaaacctcaactttgctcgaagaagccactgtaacaactgcaacaaacaccgttatgagtctagtcgcagtcctcacaggggttactttgactctccctccacaagtgcctgcaaggccgcttggtccaccatgtgatcgtgcccctccaagagaaatggccaggtacaagccagcaccccgtgattggggtgtgggtgatcctagaagttatccagctagatcacctccagaacgtgtaggacgatttccagatccgttgcagagggaaaggggtttccgtggtgaacgtgagttgcgtgaccctgtgaagtttgagtggtctgctgcggagtacaagcagagggagcgtccacatggtgggttgtatcttgacaggagccgatctcctcaggggagctgggggagtgatatgcgggacagaagcagatctcctgcaggtaacagaccaatgaagggcgctttcttgggcagaggtcgaccagacctagagtatgctggttcatatgtaggccgagggcggttggatgctgggcgtgggcgtggacgtgggcgcggccgcgtttacaggccaggaggtgatccataccctggcgagggtcgagatgatcggcgtgctgctcttcatggtagggatgatggtcggtactagttcatccttggaactgatgctctggaaagaaaaatctagttaagacggtgcaggtctagcctgtaatattaaactacccgtactgtttcctcaactgtgatgacatttgcaatgttctgaaatgaacaagtccactatacattggatggtggtattattttggttcagtgagcaaaaaaaaaaaaaaaaaaaaaaaacc

SEQ ID NO: 33448 - DNA, 1063 bp, Triticum aestivum
  Clone ID: PAT_TA_33448
cgccgcccgccgctcccctcttccctcggccgccgcagaagaacagcaccgcagcggagaggggagagagagagagagggaacatggtggcgccgaacgtgaaggcggagacgatgaggctgatggaccggcggtcggcgctggaggcggagatggacgccatcatcgcggccctctccgcgccgggcggggcgggcatcacgggctccctcgtcgacgccgagggtttccccagggcggacatcgacatccccgccgtcctcgcccagcgccgcaagctcggtgagctgaggaatgaccacaaggatgttacaaacaaaattgagaagaatctggaagttttacactctacaaaattaacaagaaatgagcaatcaatcccgagaagttctggtatatcagctccactgcatggcggattgtctcaaaatgatcctatggaagaagatctggtgaccagacttccttttgcgatgattgatgacatcgcagatggttctcctgctgctttggatggcttgctgcttggggatgagatagtgaagtttgggagtgtagaggctggcggcagattgcaagaaaggcttgtttctgaagccctttccagtgaggataatcaagtgtctctgctcatcattcgtcagggatcaccaatgaacttgacaattacaccaagaaagtggcatggaagaggacttatggggtgccatttccgaatcttatgaagggccgcggtctatatattcaactgtagaacggggtgctttcacgtctgcacttgtgcagacagctcttgccgccctgcatttcaacatcgaagtaaactgataacctgaacgcatgtacttattttacctgtagccgcgcttaaagcacaacgcaatgccactgtggaacctgtagtcgccttggttgcaggctttatttggtacgttacccttcgttcgcccggataaagaacaatgtctatcacgttttggcaatgatgatgtagaaaacctaaagtcaacatgaagttggatcgtgggacagagagaaaaaaagccgccatccgtatgtgcaa

SEQ ID NO: 33449 - DNA, 726 bp, Triticum aestivum
  Clone ID: PAT_TA_33449
gtatccatctcagacgacgccggccaacactccggccggggggcggactacaactacgagggtctcatacctagctctccgtctgagtttgacatccggtggccggcggacgagctggacccgatcacgctcaactacacgtccggcacgacgtcgcggcccagggcgtggtgtacaaccaccggggcgcctacctcaacaccatcggcaccgtcctggcctacgacatcaccccgatgccgacctacctgtggacggtgcccatgttccactgcaacggctggcacctaccgtggggcgtcgccatgcagggcggcaccaacgtttgcctccgccacttcaccgccgccgtcatcttcgacaccatcgagcggcacggggtgacgcacatgggcggcgcgcccacggtgctcaacatgatcgtcaacgcgccggccgcggaccggaggccgctgccggggacggtgcgcgtcatgacgggcggcgcgccgccgccgccccgcgtcctggcctggatggaggagctcggcttcgcggtgtaccacatctacggcctcacggagacgtacggccccgccaccgtgtgcacgtggatgccggagtgggacgcgctgccgggcgaggagcgcgcgcggctcaaggcgcggcaggggttccagcacatcgcgatggaggaggccgacgtcaaggacccggcgaccatggagagcgtgccgcgcgacggcg

SEQ ID NO: 33450 - DNA, 964 bp, Triticum aestivum
  Clone ID: PAT_TA_33450
taagctcctcgatcgagtaccttgggggctactctctgaacaccctcataattgatgacgagtcatccaagtttatcaattcactggatgacttgtcatcaccaccaaaattccttgttgcccttgagttatctggcaagatggttcagctccccagctggatcacacaactcagtgctctcaccaagctaaccctttcagtaacagctctccggacagataacctgctgctccttagcaatctagatgcattgttctccctcacattctcattcagggcagaaaagcaggattcggagacactgaccattctggcagaaaacaagttgtcctctgatggggagatcacaattccagatgctggttttaagagccttaggcttcttcgcttcgagcggccgcccgggcaggtactgaccttttcgaagaatgccatgccagagctggagaggcttgagctacggttcagcatgctggaggggctctatggcgtggaaaaccttgcgggaatcaaggtggtgcatctgacgttgaaggacaaagacggtgaatatatgacgaaagaggtgcagcacgaggtggagacagcagtgaagaggaggaccgatggcaaggcacccaagataatcctcgatcagtgaccgattcaaaatactttcacgccacgtatgctttactctctcgaagaagcaaggatgatactgtgaaaaaaaggatggtgcttcatccaggtacctcggccgcgaccacgctatgctggatgttatgttcgtcgtgtttgtgtgtgcaagtttgatcttccaattaagaggatcctgtaattctctttgaccgcaaatgttgttgtaaaattcatgcaagacaatggccatgcatttatttgtactcatctctggacatctgataccagactctcgcaaattgttcaaacatgttgtaatgaagatgcagagaattcctgtcc

SEQ ID NO: 33451 - DNA, 618 bp, Triticum aestivum
  Clone ID: PAT_TA_33451
gggagggcactcccgcatagggaggagaagagagggggtggcctcgatgacggcgaccgcgtctccccccacccccacccacgcgcgcgagccctccagatccgcaacttcgagctcctgcagtaccgttggcggccacgagcaggtcctcgagcatgctgctgctgctccggtgcggggcagaagagaccggggcgcaggcgcacgtgccgcagctgtagctggacaaggactgcgcgcgggcggagcagaagccgttctggaagggcagcggcgagcagaagcgttctggaaggagcgccgcgcagcgcagcagcagccggcggcatcgtcgcggctgagcacgccggtcgctaagggggcggaggccaggcaggctgtgtacgcgagaaagaggagacggggatgactcggtcaaactctgcaattcaatacttccaaacagaaagggactataattggttgctctctttagatttcaaattgtccaaacagaaaatcttgaattgcattctatttcaataccttggttgatttggtattgcagctcaattcaactcgttgggctgaatacatacattcaaacaaagcataaaagtacaactcctcccgtcccat

SEQ ID NO: 33452 - DNA, 631 bp, Triticum aestivum
  Clone ID: PAT_TA_33452
cacccaccggccccccccgcgcccgccgcctcggctcgccgcaccaccgccaacgccgtcgccgacgaccgccgagccgaacccaaggatggggcggaagcgcgcggtgctggtgggcatcaactacgcgggcaccaaggcggagctcaagggctgccacaacgacgtggcccgcatgcgccgctgcctcgtcgaccgcttcggcttcgaagacgccggcatccgcgtcctctccgacgccgaccgggccgcgccgcagcagcagcccacgggcgccaacatccgccgcgagctcgcgcgcctcgtcgccgacgcgcgccccggggactccctcttcttccactacagcggccacggcacgcgcctgccggccgagaccggccaggacgacgacaccggcttcgacgagtgcatcgtcccctccgacatgaacctcatcacagaccaagatttcacagagctcgtgcagaaagtcccagatggctgcctgttcaccatagtctctgactcttgccacagcggtggcctgcttgacaaggccaaggagcagattggccacagcacaaagcagaacaaggcgcagcaaggcaaacgggaagagcggtctgattccggctcgggcggcttccgg

SEQ ID NO: 33453 - DNA, 715 bp, Triticum aestivum
  Clone ID: PAT_TA_33453
gcggttcgggtgcgtgccgctggcgcacgtccaggacgcgtgcgacgcgcacctcttcctggcggacgcgccggccgccgaggggcggtacctgtgcgccggcggcagccacacggcggcccacatcgcccggctgctcgcctcgcactactctccgttcaaccccgagaagaggtttggtgatgatctcgacggtgcgagcccggcgtcccaggtgtcgtccaagcggctgctggatctggggttcaggttcgggcacgacgccggggacatcctcagggatgcagttgcgcagtgcgtcgaccacggcttcctggagccgcctggtggatgtgactagtacagtattagtgtaaaaaacgctatcatattatgagctcttatatcatgagacgggaggagtattaactagctagtggcgttttatggaaggctccgttaattttctattacttcatgaaaccgcaccgtggtacactcccgcctgaatgtatttcaaacttgaggagcttttacagagtcgagtctcacgccacacaccggcgtcttcatttaactcatttgattttagccggttagaacgggcggtcaaagcaacgacggcggtcttgatcgtagcaccagtgtcgatgttaagggaaggaaaggcttgctagacaggaatttaatatccgggtttgtacaatagtaagttttaaatatgtactactttatt

SEQ ID NO: 33454 - DNA, 925 bp, Triticum aestivum
  Clone ID: PAT_TA_33454
cgcagcacgcgcccccgcgctcgctcctcctctctgctgccgctcctcgccgtggccgccgaggccgtccctcccacgccgacgccccggtccaaccccgcggcagcagccggcggtgcaggtgctcccccggtgccgacgccgacgccgtggccggagcagttccacgcggtgatgttcaccaacctgaccgagagcggcggccgcctgcagctcatcgacctctactacgactggccccgcggccgcaacctgaacctcatccgcaaccagctctccggcgacccgacctacgacgtggagtggaccaacggcacctcctacatcttcgactccgcctcctgccgcaccatacgcttccccgtcggcgtcctgcccccggactggctccacggcgccgtctacctcggccgcgagagcaccgacggcttcgactgccacctctggaccaaggtcgatttcgtctggtactacgaggacgtcctcacccaccgccccgtccgctggaacttcttcaatgggatgcagcagcatgtgatgagcttcgaggtgggcggggtgctagaggactcccactggcaggcaccctcgcactgcttcgctgacgacgccaccgccgccgccgccaccggaaccgatgcggcgagcagcctcctcaggctcgcacggacgaccgcagcggctgtaacatctgcagcttaaaaagtagagttggattcccaccggtcgtttttccatttcattatgaatctatctattcgataaatcacgagtggacatacatccacgcgaggatgatatctactccctccgtctgtgaataaatgtacatgtaataaatatacatctagcttttgttttaagtcaaagttttaaaactttgaccacctttcaaggataaagtaaaagtatttatggcaccaaa

SEQ ID NO: 33455 - DNA, 1188 bp, Triticum aestivum
  Clone ID: PAT_TA_33455
gagagagagagagagagagagagagagagagagagagacagaggtgtcgtgcgcgactggaccggctggccgccgccagcgccggtgacgacgccgagtgggaggacatacgtctgaagcgcatcctagttgattacatgctccggatgtcctactacgacaccgccaccaagctcgccgaaacctctggcattcaggacctcgttgatattgatgtttttcttgatgcaaaaagagtgattgattctcttcggaataaggaaatagctcctgctttagcttggtgtgcagaaaataagtcccggttaaagaaatcaaagagtaagctcgagtttctactgcggcttcaggagtttgtggaactagtcaaggctaagaacttcctgcaggctatatcatatgctcggaaataccttgctccctgggggtctacccacatgaaagaattgcagcgtgttacagcaacactggtttttaggagcagtacaaactgtgctcaatacaaggtcttatttgagcaaaatcagtgggattctcttgtggatcagtttaagcaagaattctacaaactatatggcatgacgcttgagccgttgctaaacatctacctgcaagcaggcctgacagctctcaaagactccattctgcttcgagggcaactgccccaaagaagaccccttgtcgctggacggcttccggaaactcgcagagcctctgcccttctcaaagcagcaccactcgaagcttgtctgccacataaccaaggaactgatggacaccgagaatccgccgcttgtcctgcccaacggctacgtgtatagcaccaaggcccttgatgagatggccaagaagaatgggggcaagatcatatgcccaaggacaggagaagaatgcaactacaccgagctcgtcaaggcttacatctcatgatcatggtgaccccttcgtagctcgtcttgggtgatggatgattgatgagaattgccagtctgaatgtacatagaatgaatggatggatctgaacattgtcgtgcggttaatttgagttgtagtgcaaagcaaaagaacccaccgaaattgaaactgcagattgcaattttccatcggttaaaatacatagtaaaataaaaaaatttctgccgaaaaaaaaaaaaacaaacagtcgagaactggaaaaaaaccctgacg

SEQ ID NO: 33456 - DNA, 631 bp, Triticum aestivum
  unsure (1)..(631): unsure at all n locations
  Clone ID: PAT_TA_33456
tctctttcctctctcgtgaaaancctctctcccccgcnngactcctcgcnncgccgccgccctctcgtcgccgtccccgattccgaccacgcgactcgacgacggcgccgccactctgatgggccgatcctctcgagttccgacaccgggtgctctactgaccctctaccctcgctctgactcttcctcgcatccctccagacgaggccttcaacgctctgtgtcgaggctcagcccgggctagcgtttcgtccgcggctcgtccttcgtccgcggcgagctagtggcggcctacggtggctggtcccgcccacgtgtggctctgtctcatggacgttcctcccgcgcccgacggccacgggtggtcatggcggacggcctcttcagcggcgtcgccggactagctccacgcacgggaaaggcatctctgccggttccccaaggtgagtgcgaggccgaagagagacgacatcgaggacgacatcctaggacatcatcacgctcaacggcttcgcccccatcatcatcgagttcttcggttactggcaaacaggtgtgcgaccaaccggcaaccggccacgccatctctatcccccgacactggataatggcatggctaatggcctacgcg

SEQ ID NO: 33457 - DNA, 752 bp, Triticum aestivum
  unsure (1)..(752): unsure at all n locations
  Clone ID: PAT_TA_33457
gccggccacggacgaccccaaaccaatcgatcgatcatctccacaaccacaacagcaggatggctaacaccaccagctccaccgccctcctcatcgccctcgtcgtcctggccggcctcgccgacttgcacgctgccacagccgacccgaggcccgttcacgcctcggaactctcggtgccggcatgggtgaccgggcagccaatgacggccccggagctggaagggatgatggagtgcatgatggggtgctggacgacggtgatgggttgcgtattcgggtgcgtggccaagccccccgccgacatgccgctctgctggttcgcctgcgaccagacctacgttatgggcatggtcaaatgcgccttcacgccctcaccgccagcaccggcgccacccaagccgcctgccccgcccgcccggccataacaccgtaccgatcgagacctccacctagtcgccgacaatcaccatgcatgcatcatgataccagtgatatgctatatggattgatcgactaaaaacaagacacatgaatatatcatacgagcgatatgatatgctctatccataactcatcataactgtgtgattgtgttatgcacgttaattagacccatcgaccagttaggttgatcttccaacttcatgtaatccgaccaatgatgggttgcgagtttcacatgtatctgcaatgaaactttatatgtgtatatgcaattttataaaaaaaaataaaacggtaaannaaaa

SEQ ID NO: 33458 - DNA, 1461 bp, Triticum aestivum
  unsure (1)..(1461): unsure at all n locations
  Clone ID: PAT_TA_33458
gcacgaggatcgcttgcaacattcttgaggaggaccccttcatctttttcattccacttcccaagcctgaattcaacttgcctcgggagggtgacccaaagccggttcgggacattgcctgctacaatggtgttatcaagtttgtggagatggatcatctttacagacgtgaggttgttagtattagtaaccgtaataagaggtttaagatgacgaaggatttggatagtgtagacaagatatacgacctggatatcctccttcgcccgcatgaggacttcctagaagcgcccaaagagcaactcgtggacatccctgatggttggaagattcggacatgttataggcatacttcttgggaccattggcgcaaggggcacattattcatgttgatgacatcttggccaacaacccaaatcattctgtcttgttgccaaagttttgggatggttgtggaaaatcaccattaaggaacctgaccacagcccacccgaccctcagcccaaatggtggtgatcttctctacctgatgtcttatgatcagactgcctggatggttgggtgttgaccttggaaagaaggcagttgtaatgcttgaaccatatcatgagagagacggttatttcaaaccggactttctaccatttgcattctctgaatttctgaatgcaacttcaaggtcgtgtgcaggggaagctgcctttgaaccaaatgaggctcagaacaatcaccttttatcaggctctagcggatatgctgaatgcaaagctccaggcttcctatgcagcaacagccagagtcaaccccaagttgctgtccaatcagccacaaccccctgcatctgaatttgacctcgtctgtatcagtgaactcccagttgacgtacccagtgctgaatgctgatgaccacgggccagctgtgcttcgcaaagtcagtggctcgccattggatgatggagctggcagactcgtccttgaccccaccgacgcctcagatagcattgcaggaagtccagccctgcaatgagcctgctaatgtaacgttgatgcctcttgggaagccagcgcacccagctgtccaggcctactgtgggtcttgcagtatcgcgacgatgcctgggatgccagcacccctagccctccagcctaactgttggacctctagtgtcatctcacctccacaaatgccagggccgtccagcaagcaactggatgtgaatgcctcattgccgttggtgcacatcaactccattttgggctcccccaagtcgctgataaggtcaacatcgatttaggagtgtgtgtgagtgtgtgagcatgccgaagaatgggctggacaaatcatttgttcttctttcgtttgactgttggtgtttagctgggatgttccgtgaattacttcaagttaacttgtttatttacaaatttgatggacagtcttttgctgnatcgaagacgtt

SEQ ID NO: 33459 - DNA, 268 bp, Triticum aestivum
  Clone ID: PAT_TA_33459
aagaaagctacatacatcaacatgagcctttgtataactagtgatgacaggatagtcatgttgttctcttcaccatagaattacagtggattaggttgagtttctcaaaaattgaggcctgttccctgcagtattcctctgaagggcagttatagtgctactgaacatatatgcagaagtccagtagcacatgtgttgacaatcatattaccattgtaagatattctcatagatcatgaatcatatcccacgagtataagatattacc

SEQ ID NO: 33460 - DNA, 1220 bp, Triticum aestivum
  unsure (1)..(1220): unsure at all n locations
  Clone ID: PAT_TA_33460
gnaatcttcaacaaatctgtagcgcaggatcctaaactagctagttcagtgttaactgtgtttatcattgcactctgtaaacaggtggcttcaaaacagcattgggtgttatgtcaagtcttccatccaatattgagagctcgaattcacatgttattctgttgaagtgcctaacagatgttgaggaaattgaaatggcttctgaacacataaagtggattagacgctactgcagctctgcttttcagaatataatgaatgaactcgtggcttctctttccacttctgctagccttcaacctgtcaggaaattggtctgttatttacattctcaggggcttgttaatgaagttggcccatggatgaagttgatagaagatgattatgcttgaatcacaggttcaatggtcatatcatatgataccacttgtccattttgccaagaatgcacaaagtgtcttgagactattggaggtcaggcttcagtgcattacttcacaaagcgatattgatacttccctctgatgcatctagttctcagaattaccaatgagaaaatgaccgagatttctgtaaagatctggtttgtgctgatctattctgagcaatcctgaggtttggggccactgttctattttgctcctactgcaaaataaatctggtgtttattggccatatgcttggctggtataatgtggcgatggtttgggattacattgagcgagcataatgaaatttacctttatccaaggaagcacttcattatgatggttctgccgctactgtgggtatgccaattgcggtcatggaggatcagaatgagttatatggtgactagtggattctgaaactgaccaggttcgttgtgttatagaaggtcaaggcaattcttgtccatctgatctcctccccctcagagactgctgaaagttctgtgagggttggtggcactttcacgatggcatcctacactgtatctaaggtccctgttgtggattcagcttgatttatgtcatggaaacaagggcgtaggctgcactccatttttggaattgtacatcgagtttctgtggttgggacagatactctctgattaagggtgttttgtcgacattttagatgcctcggtagattgtccatagatgctcgtaggtgtggttctggattggaccccatctgttactcaagcatgttgtatacttctgtcatcttcattgact

SEQ ID NO: 33461 - DNA, 816 bp, Triticum aestivum
  unsure (1)..(816): unsure at all n locations
  Clone ID: PAT_TA_33461
ccgtcattcacggnaaaggaagagatagcggctgcgtcggcgccgaattccttgccggcgtaaccgcgccggcaattcgcgatgctcgacggcgatgtcgcgtccggcgtcgatctatcccgctgtgctcgttgaggatgtggtgccgccgtccttgaaggcggacgtcctggccatggtgatgggggctgcgtgggccgtcgccattgatggcaggctgcgcgcgctacggtgacggcgggccgggagacggcgtccgcgcggaagacggaggctgagcggtttctgtgtgctggagtttgctccggcggcgtggagaggagctgcagccgacgcatcgcaaagggatggaggcccccttctcccagccagtcaccgattatatgtggtttggtcgatgaggatggcgtgaaagatggctgctccactccgggtatgtttgatgcgagcatacaaaacctttgccgttgcgtcccaacctctactgtatatatgaatggataaaatgttgcctggcgatcggcggtggagggccaacgggagcgggaacgaagttcacaggcggtggtgccatgaccctcttcgagccaggacggcccatcctgggtcccatcggcatgagtgctaagacccgatttctcttctaacacgactcatggttcagaacgcaaggacgtatattgactgatctgactattttcattttcattggcgccaagtaaaccatggtgataggaaaaaggaagtgattgaaagaaggagattgatcaacgtttgattgaaagaaggaaggagatttatcaccatcatgaaaaa

SEQ ID NO: 33462 - DNA, 1332 bp, Triticum aestivum
  Clone ID: PAT_TA_33462
aagcattccgcgctcggcacgtcccggctttccctgctcgcctcgcagccgccgccgccgccagccatgggtcgcaccaaggacgagctcctcgcgcgcctcgaggagcttaagatcgatttcaagcgctacgaccacccggttgtgctgacggtcgaggagcaggccaaacatgtgggaaatttcggaggcgcgttgaccaagaatctacttctgaaggacaagaagcaccggttgtatatcgtttctgcacttgctgacaccaaagttgacatgaaaattctgtcccagcgtcttggtttgggaaaaggtggcgtgcggatggctcctgaggagaatttgtgtcaagtgcttcaggtaccgttaggatgtgttactccgtttgcgctattcaatgagtccgcgagtgccgtctcattattactggaccaagggttcaagtctaaacagagctgctacttccatccactgacaaatgatgtgactattgccctcagttcaagcaacctggacaagtttctcctctccattgggaagcaaccagcttatgtagacttggaggcctcaccagtggtaggtaaagataatccccctgatctagcagatcttgtgccttctggtgcattctgttcctcagaagaatcagttgagaatccgactcctaaagatgctcctcaagtcaacgtacccaaagagaaaacatgtctaccagaagtgaaggctaagcccaaagttcagaagaagggggcagaaagttcagagagtaaagttcctactaataatggcgcaaatgttgagatatttgcaagtgatgtgcttgaggtcatcttcccattgttcctgtctgaggcatcaaagaaattgaatattaaacaggaagagcttactcaaattttaaaattagatgactttaaacgacgagctgctccagatctggagagtgtaacgaatatgttcaaaaacgcagcatacactgcaggatttcatgctggctttgataccatgctcaagtcgggtttaggtgggatgccctcccggaaatagtcggttacattgatataggagacagtgagctgattcagtcgatttttgtatgcccctcggtgtaaaatcaaaccataccatatatacttattatgttgaatgattcgatcgaatgtatcaccttaagcctttgtgatagagaagactgttaggatattcagtcaatttttgtatgccccttggtgtaaagtcaaatcagaccatatagtaccctctacggagctaaaattgaaaatcacaactctttgtatcgtttgtgattgatttcaaaaaaaaaaaaaaaaaaaa

SEQ ID NO: 33463 - DNA, 795 bp, Triticum aestivum
  unsure (1)..(795): unsure at all n locations
  Clone ID: PAT_TA_33463
gcggccgcctgggcagccactcggggggtcgtnngggtgnnccataacagtaccaatggcagccactctgtggccgctctgccgacaagcccgctgctcccgatacgcacgccaagaaagcaccggcggacgatcccacgtcggatggggagcccgtcacgcctactgcgagagggggggggggcatatacatcgtcgtcaccctcggccttggctgccccgtaaacctccccgtcttcagcgccggcatcgccgcccagctcgcccgatacccgcgcttctgcagcattcaggtgacagatgagtccaatggtggcaacccgcggtgggtgcgcacggtggtgaacgtggacgaccacacgatcgtcccgacactggaccccgtcgccgtggcggccgacccggacggggccgtggaagactacttggcctcgctgcccgcgctccccatggaccgctcccgcccgctctgggagttccacttcctcgacttcccgacctccgaggccacctgcaccgccgtgatccgcgtgcaccactccctcggcgacgggacgacgctcatcgcgctcctcctggcgtccgcgcgcagcgccgccgacccgacgcgcctgccggccatgccggagcagcctgcacgcacgggcgccatctacgcgccgcggccacggtcnnnnggggtgtcctgccgttcctcgcgtgggcctggtcgtatcttgtgctcgcgtggaacaccgtggtggacgtcgccctcttcgccgcgnccattgcgttcctgnnngacccgcacacgcc

SEQ ID NO: 33464 - DNA, 503 bp, Triticum aestivum
  unsure (1)..(503): unsure at all n locations
  Clone ID: PAT_TA_33464
ntagggggaantttgggtaccgggcccccccccgtccgctatcggcaagtctttccttcaactcaacaattagctaagatgaggtgtatccaaatgttgctcctgcccatcgccttcctcgtgctatcatcagatgtgataatggaggcgtcggcgggcattggcattgatcccatctcctgtatgtcaaacattattcagccgtcgccaaagccatgtgataaccaaacttgtcgtaaggcatgcgtcgaacgtatagggtacggcacagaaggcaagtgtgttaccgaggggtgcgagtgtacgtactgcacaaattggcctccacgacaatcaacaaatgagccctgatttagataggatgggatgtcatgttgaattgaataatgcaacagagatcataaatggtgtaatagcaatgttgttcactgataagtcatatgaagaatgatgaatttggacttgcttattgaaatattaaaggttaaatcgtcaatgtcttc

SEQ ID NO: 33465 - DNA, 434 bp, Triticum aestivum
  unsure (1)..(434): unsure at all n locations
  Clone ID: PAT_TA_33465
gaatggggacgagagtgagaaggtggggcttggcgacgtgtgtggcgtccctagccagctccaggcggtcggcgacaagcaggaggtggcgtgcggtggctgcgcacgcgtcagtcacgcgcccaacatccttctgtccagaggaaggggatgactgccactgggccagcacagtgttgggcctgccagtgggctgctaggtaagtcaggtgggtttctctctctgctctatttctgtttttcgttttatttttctattttgttttctatgttcttatttagtttaggcactaaaccatttttataaatgttgaaaattattgtggatgctaactgagttattccggagacccacaattattttcaaaacatttcgagctataaaattatttatagattttatttgctccatttcanatataatatggattaag

SEQ ID NO: 33466 - DNA, 886 bp, Triticum aestivum
  Clone ID: PAT_TA_33466
gccggccgggtcccccacgcgtctcgagagagtagagtgcagcacgatggcgcccagcactcgtagggccaatgccatcctcgtcgtggggatgctcctcgcggctgccatggcagcggtggcggccgaggcggcggctgaggtgtcgtgcggagacgcggtaagcgcgctgatcccgtgcgggtcgttcctggtgggcgccgtcgccggggcgccgagcgagagctgctgccgcggcgcgcaggggctgcggaggatggcgggcacgccgggcgcacggcgcgcgctctgcaggtgcctggagcagtccggcccgtcattcggcgtgctcccggaccgcgcccggcagctcccggcgctctgcaagctcggcatctccatccccgtcagcccccacaccgactgcgacaagatacagtgagcggccggcggggcgaaccgatggtgatcgtgcgcgggtggcgtgaagtgatgacacgaagtggtcgacggaggagttcatggccggctgaataaatagtactactgtagctacgatacctgtagttcgcctgccctgctgctacttcagtagtcatgcttgaataataatggtctcagtattaatctttcgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccaaaaaaatttaaagctaaataagggtttaaagaaatttaaaaaccttcaaaaaggtcaccaaaaattaaattaaaggggcgttttttaaaaagtttttagggggaaaaactgggggttta

SEQ ID NO: 33467 - DNA, 725 bp, Triticum aestivum
  Clone ID: PAT_TA_33467
ccgtccgcacacgcgtgggcgagagcgtagagtacagcaagatggcgcctagcactcgtagggccaagtgccatcctccgatggggctgccccgtgggcggccaccgcgtcgtggggctgctcctcgcggctgccatggcagcggtggcggccgacgcagcgggaggccgaggcggcggctgaggtgtcgtgcggggacgcggtgagcgcgctgatcccgtgcgggtcgttcctggtgggcgccgtcgccggggcgccgagcgagagctgctgccgcggcgcgcaggggctgcggaggatggcgggcacgccgggcgcgcggcgcgcgctctgcaggtgcctggagcagtccggcccgtccttcggcgtgctcccggaccgcgcccggcagctacccgcgctctgcaagctcggcatctccatccccgtcagcccccacaccgactgcgacaagatacagtgagcgaccgatcggcgggcgaactgatggtccgacgcgtgcatgcgggtggcgtgaagtgatggcacgaagtgttcgatggaggagttcatggctgaataaatagtactgtagctacgatacctgtatttcgcctgccctgctactactgtagtcatgggtgtataataatggtttcactatttatctttcgcattcgtacgtacaaaaaaaaaaaaaaatgtatctaaaactataatacatcttattacattcacttttattc

SEQ ID NO: 33468 - DNA, 897 bp, Triticum aestivum
  Clone ID: PAT_TA_33468
cggcacgaggcttgaaatgaggaaaggctttattgtgctcggcaaggatgatgatttttgtgcatgagctaggactagcaacagcagttggcggaaccaggatggaagtcatattgcctccttttattgaagctgctatttcaggttttggattggattatagcgagctaatgtagtactaagggatatagacaacaaggtccacctagaccataaatcacattgtttgtgacatcagcacatccaactgtaactgtagtccctcatttgtatgacgttacagccaacatttaacacccactgttcgtactatatacatgatatccactgaccaaattcagatatatggaatcccaaaatcagttctgcaacttgagcaagggagaatttgacaagtaatcaagcaagtcagcactatcatcgatggaagttgtcgtgcggagatggaagttgacaagtaattttctccatgaagttgatctgatgcgaagcttgtgccagataaaaggaccaatgaaggtaagagaagcaaatcacaaccctttagttcatggtctaggagcatgaagttaattatccgctttcaagtattgggcgccgaagtgagcatctaattgcaggacttctatgaggacttctctacaccggttcggtctctcgctggtgcacgatttgaggcataagagggaggggcacgttgcgatgtcggctttggtcactgctatagctgatgagaagaatgggatttatgcttggcagactgccccgtggttatgaagtcattattgccgactccgcttcccaaggtgcctcggcttgctgttggtgtgtgctgcttctgcagcccctgccggccggctcttaggttggctactgctgccactactgaagtttcca

SEQ ID NO: 33469 - DNA, 912 bp, Triticum aestivum
  Clone ID: PAT_TA_33469
attgagatgcgcaatgaaacatcgaaggtatgccctgtgtttcatccagatctttttcaatgcaccctatctgagtgtatgctttagggagaagcctaatttttgaatttaaactatggaatgtggtcacctaaatgggagtattccaattggtcacctcagttcatttttcagtaatataatgtattctaattatgagatatgatgcgttgtcatgttatgcaaagtctaccattatcactgtttaaatatcatgaaccttattatgcatcagaaatgactccgacatcctgctgatctgggcttgcaaatctgttcggcccccctagcagctggagcatcgtcggtagggtgctggtttcgcagttgtgttgctcaatgatgaagataacgagctttttactagccggtggtcgagacacccctgtgagtgggttggtttgtcgtgccgctactagctgctttcttcatttctgcttcagcggcgtttgccttttttcgttgctggcaccagtttcatataattatagttgcaactaataagatcattgattttaacgaggtccataagataataatgtctctatagagatgcgcaatgaaacatcgaaggaccctatccttttgtttgtggatgcacgaagtaatgatgtgtggctatgggggcgtctctttggatgttctaaggcagtttcccgtgtctctgctagctccgattctgttgcaccatattgtccgacatttatttatttatgtgtttgacccatgtggttagttaatgttgtgatgttgtcgaaggacaagcagatgttgcagtctgtatgctaccctatgtaccctcttcgtcatggacagtgctgaggattaatacagacttatatgtaaaaaaaaaaaaaaaaaaaacaaaaaaaa

SEQ ID NO: 33470 - DNA, 780 bp, Triticum aestivum
  unsure (1)..(780): unsure at all n locations
  Clone ID: PAT_TA_33470
aaataggtggnaacataaataggaattttaatttacatcacttgtaatatatgagagcaaagcatgccttctcttaggtattcactaacattctcatttccatttgattcacttcattaacattttcagccttgtgtttatttttatcttttgaccatgcatctagcattctgcagttttgcatgggcagacataggtagtaatacaacatctagcattgcattttgcataattctgaaattttgtgtcttctatttttcttttcctttttacttctctatttttttggacggatgacaaacaactataaattaccttttaaggtagcttccagcttgatgaccaccccgacggcaggcatgactggactacaccttgtgggagtgatttaagcaccgcagcatacaagacagtagcagatggtcgtttcgctttcaacaaggatggccgggaggaaatcctggaggagaactacctagcggttgggagagcggcggtaatcaccatcaggaacaacgcactggacgaattgaacatgatggttgtcttgaaccagatcgaattatgagattgtcggggaataaaggttgttttgagttactgcagtttgttatgctgtcagttatccgtgtcccgccggccaactgacgaactgtgatttgttttttattatcaggtggtatgcaccgtcaaggactatgtaatatagtctgaaaacttcttagcctttttgtgtggcacttgatattaagtnttagtaaccaatttcttcttttaaaa

SEQ ID NO: 33471 - DNA, 850 bp, Triticum aestivum
  unsure (1)..(850): unsure at all n locations
  Clone ID: PAT_TA_33471
cgcacccatccccgtaccagnatccatccacctcctcttctctcctctgccaccaggagacccgcctcctcctctgcctctccgcacctctcgccactttgcgcctcctcctcctcctctctcctcccccctctcgcggacgggggagcggagacgttccgggagggaggggtcgatgtgtgcctggtgggcggaggggaggatggggaatctgcgtgccgacctcgacgagcagatcgagcagctcctgcagtgcaagcccctcgtggagcccgagatttagatgacacttagaaggtgccgctgggttctacaagagcgagacaggcgggtcgtccaagcccgagtcacatgggacgtccgactgcccgcgcgggggaggggggtccagcagcaagtgcacccgcgccgccgaggtgcacaacccctccaagaagtggaggagcaggatcaatgagaagatgaaggcattgcagagcctgatacccaattccaacaagactgacaaggcatccatgcttgacgaggccatactcattgagtatctgaagcaactgcagctccaagtacaggataatgagatgttgaaggggcagagtgaatccatgacactgcagtgtagttgcaccgttccgttgaatattactcaggaataaggacatttcactggcagattagctctatttttcctttcatttttctttattattggagtgagaacaagtagaatgaggaactgtgtaatagtagacacgacaactatgtgatggtagaataagaataaggacatttccatcgctattgtgtttttggaattgtatgcacaaatggaattgatcaattttaaaaa

SEQ ID NO: 33472 - DNA, 1225 bp, Triticum aestivum
  unsure (1)..(1225): unsure at all n locations
  Clone ID: PAT_TA_33472
gcagtggctactttctgttctgtccagtgttttctagccatatcttatagaacttttgatttccttggattacaatgggatttataatgctgatcaaaatgttgatatgttaggactagtttcctagtgcaaatgcaattcggcaaatccactataactcacacaaattgccctattttaagtgtaactgtaagtggttttcactgcaatttgtcaacgaaaattatagtttcttttagtgtgaacagttttttactataaatcttctactaatttactgtgaatctgcttctaatgcaatgtatctctatttctaatgaactgtaaatctactgcaaaatcattgtaaaaactcactataattccacttaggtaaagggtgttctttatcatgcttttcatgtctatgttcatccaacaacccatactctttttctattctggtttcttatttttcttgcaaaggtacagtaacttcccctctcttttcgtgcaaatatnaagaagttgaggggacctgtttctcacagagggagtanggttgagacctcactatctacttcaaccaaaagatttgnaagagttgcacccgccgcgcgcagcgcgcgccgcccccgctgcgcgccccccgcggggcccccgagtttgaggtcactcttggaggggcccccggggtcctccagggccgggccggccgggccgcccagccccgggccacttggacggcccgccgcccgcgccgggggggggggccccagcgccacgggccccccgcccccgccggggccaaacccctccaagaagtggaggagcaggatcaatgagaagatgaaggcattgcagagcctgatacccaattccaacaaggtggcaccacaaaaccatctactgtaccactttgtttttcttcgtccctgaattcggggctactgagtttggttgtgcttgtgtggttacagactgacaaggcatccatgcttgacgaggccatactcattgagtatctgaagaggatgcagagacaaggacaggacagtgagaagttgtgacagcagagtgaagtcgtgacactgcagtgattattactcaggaataaggacatttcactggcagattagctctatttctccggccgttttgctctatttttcctgtcagttctcgttgtttgtggagcgggggcatggtggacgaggaactgtgtaatagtagacacgacaactat

SEQ ID NO: 33473 - DNA, 516 bp, Triticum aestivum
  Clone ID: PAT_TA_33473
caacaatcacttccacatccaaccaccactcttcaaacaatctttcgcttctcccaaagcccaaccaacccaaccatcaacatgcagttctccaccatcttccttgccgctatctacagcgttgctgctctcgccgcaccctcccccgtcgctgatgccaccgccgaggtcgagcgcgccatcctcgagcgccgcgcatgccgtgatgccacctaccgatgcggcaacaacaaccccgaggtgtgccagtttggcatctggatgctggctgccaagtgcggtggcggacagaagtgtgtcattgctaatggcgcgccttactgcctttaagcgctgaatagagcttggaaaggatctgcggtagtccaacactatgcggatgatcagagggattggaggaaatggctggagggattcgagaaaactgggttggtgttgtgatagacaaggattgacgatactggcttgagttagctacagttgtttgcacggaaatgacatttgctgctcacaaaa

SEQ ID NO: 33474 - DNA, 646 bp, Triticum aestivum
  unsure (1)..(646): unsure at all n locations
  Clone ID: PAT_TA_33474
gctgcgccggacggtgctcgtcatgatgttcctggagaggagggctttcgagcggccgcccgggcagggaggcggctggagttgtccgttattgaggaaagaatggcagctcggggagacttgaggcagcggtggcggggagtgtgtgtgtgttcagaacagatgtgttttcagaacttattacttttgatacactgcccctttatgttgagcagatgcggattatatttagggagattaagatgctcaagaccaaggaatgcatactgaaggctgccaatgatacccttcaagaaaggccctaacagataaatggaagcatctattgggtggtactctcactgcttagcaaagagaatgaagggtcaacatttacggtcatgctgcccacgcttcggaaaaaaggcaaaaatgttttacggctcaagcatgggaagtatagaccaaagaatgtggtttacagtttccctattttgttggatcaactaatgtgttgatttgttgcttcatgtcagtgatgtttgtaatcaagaaccaggaaagcataccagtatattgcaatcccaaaacttagaaatatgcccaggccgccatatttgtaattaacatttagcgctacatgtgccatnggtcattctatcatgna

SEQ ID NO: 33475 - DNA, 788 bp, Triticum aestivum
  Clone ID: PAT_TA_33475
cccggccgcgacgggcgccaaaagccttcccactcccttccctaccatcccagacgcgacagccccgacgacggccgccggccggcaagaaggcgtcgtccatggggccccagcaggaccggtcggcgtccaaggcgctcgccaacggcacggcggtggcgcccgagaggaaggacggcaaggtggtgcactacaaggagtgccagcgcaaccacgccgccggcatcggcggctacgccgtggacggctgccgcgagttcatggcgtccgcccccgcgggcgccgaggcgctcctctgcgcggcgtgcggctgccaccgcagcttccacaagcgcgaggtggaggccgtcgagtgcgactgctcctccgacacctccggccggtgatcgccgccgcccgtcgccgcccaagcccgctgttctcttgctggctcgtcacgggtagaccggcatctatcggcaggtaaggcgtggtggacgttgagatgactccattcgatctcgatccatctatcaaatacatatatatggcccggttaatttatcttcttcctcctcctcctcttcctcctggtattgggattaatttggtgctcgattgcgtgtgatgtaattaacatatccgtacgtgtagcatatgcgtgttgatgagagtccaaactggtgcgtgtgtgtgtagatcgatcggtgagatgaacaccttgtaatttgtacagatttgtgtttcttgtttggaaccagcagttaataagatatgcctctgaattatggattgaaaataaaaaaaaa

SEQ ID NO: 33476 - DNA, 2094 bp, Triticum aestivum
  Clone ID: PAT_TA_33476
gcacgagggagccatcaaaccgcggcgcaactcctccccctcccctgctcctgctcctgctcctcccgctcgccctgcccggcagcccctttctgctgaccgctgatgggttgctgccgctcgtcgctgcgggcggtgacgcacccgcacccggagaagccgccgggggcgggggcggcgccagccaggcggccgtccttctcggcgagcgcgcaccgggccgcgccgccgccggcggcggcggcggcggcgtcggggtcgtcctccgaggcggggttcgcggagttctcgctggcggagctgcgcgcggccacgggcgggttcgcggcggagaacatcgtgtccgagagcggcgacaaggcgcccaacttcgtctacaggggccgcctgcagcagcacgggcagggcccccgccccgcgatcgccgtcaagaagtttggcaagatggcctggcccgaccccaagcagttcgcggaggaggccaggggcgtgggcaggctgcgccaccgccggctggccaacctcatcggctactgctgcgacggggacgagcgcctgctcgtcgccgagttcatgcccaacgacaccctcgccaagcacgtcttccactgggaaaaccagactattgaatgggctatgcgtctaagagtcgcttaccacattgctgaagcgctggactactgcagcaacgagggtagacccttatatcatgacctaaatgcatatagggtcctctttgatgagaatggtgatcctcgtctttcatgctttggtttgatgaaaaacagcagagatgggaaaagttatagcacaaaccttgcatacacacctccagaatatttgagaactggaagagtcactccagaaagtgtcatattcagctttggcaccgtactactggaccttctaagtggaaaacgcatacctccttcccatgctcttgacatgatgcgaggcaacaatatccaaatgttgatggattcacatttggaaggaaactactcaacagaagaggcaaccgctttggtagatcttgcctcccagtgtttgcagtatgaagctagggaccgcccccatacaaaaaagctggttaacatacttgagcccttgcaaacaaaattagaggtaccttcctacgagatgcttggcataccaaagcatgaggaagaagtagctccacctcctgctccacaaccaccacaacaccctctttctcccatggctgaggcctgttctaggatggacctgacagctatccagcagattcttgtatcgacgcattacagagacgatgcaggcagtaatgagctatcattccaggaatggacgcagcagatgagggacatgttggaagccaggaaacgtggggatctagcttttcgtgacaaagatttcaagacagccatagaatgctatacacagtttgttgatgtgggcacaatggtatcgccgacggtgtatgcccgaaggagcttgtgccacctcatgtgcgaccaacccgatgccgccctccgggacgcgatgcaagcgcaatgcgtgtaccccgactggccaactgcattctatatgcaggccgtcgcgctttcgaagctagacatgcagagcgacgccaaggacatgttgagcgaggcttcgcagctagaagagaagaagcaaaagaactcgagatgatctcgagagcgtgctctttgtaaagatgtgtcggttcggtctcttttgcggctcaaatgtttacgtcgattgagacgtgctattccgtcctttggggaaaaaactgtgagatattggaggttgagttagggagaaactgcagggaggaagtgccgtagagtcgtgtggttgtaactatttggtttggcatttccgtgatgcactattttttgggtctatatatatgtgacattttaaaagttaatcaggcatagtgcaaggagtttacggttgttaattctagagcttaagctaatgccatagcttccagctaaaaccatgtttttttttgttttctttacgcagatgtatgagtgtttctactcgatttcataagtaaattaagattggggtgcctctactctacaatcagttttgacggtg

SEQ ID NO: 33477 - DNA, 2291 bp, Triticum aestivum
  Clone ID: PAT_TA_33477
cgtccgatcgcactccccccacatccacattaccagattttgccccctacaggaaacaacatcgcactccgctcacagcccagagccaccaacacccacctcttctctttctcttcccctctccctcccttcgcgatctcccttcccccggcgctagctcttcgccatcgccgcacgaatcctcctcccctcgacttcagctcaagggttcgacggcgagccaccggccggagctaccgcgcagagattttcgtttcatctggatttctgggctatgaagatccatgcaagtgattagtgtgtcagattcttcaccgaacaagtatggccgatactccaacctcccggatgatccaccccttcagcaacatgcaggggcagaacccgaagcaagatccaggttccatgtactccgacaacccacagcatccctgccccccttagcagccctctccagccacccacgttcatcccacatgcatcactacatccctcaagtcccaagtcctcacgaagctggcgcatgatgtgagaaccaggttgctcagaagacgcactctctggaccccccgggcgcagccggctgcatgagggatgtctcgccctccagacacagcttcacccctccgcccatccggagcggcggcggcagcccgtcgtctcaccacgacagccactccgactccaccaacgggtctcccgtgagtgcttcatgcgtcactgtgacgaccgaggatccgaacgacctgaagcagaagctcaaggaccttgaggctgaaatgcttgggccggacgcagagacagttaacagcctcgaggcctccgtggcgaagcagctttcgctggagccggactagtgggcgcagatgatggactttcccaggggcgacctgaaggagctgctgcttgcctgcgccagagctgtggaggagaagaacatgtacgcggtggatgtgatggtgccggagctgaggaagatggtttcggtctccggcacgccgctggagaggctgggagcctacatggtggaagggctggtggcccggctcgcccactcccgacactacttatacaagagcctttgaggtgcaaaggagcccaagagctctgacctgctgtcctacatgcatttcctgtatgaggcctgcccctacttcaagttcggctacatgtcggccaacggcgccattgcggaggctgtcaagggagaggacaggatccacataatcgacttccatatcgctcaaggagctcagtggatctccctcctccaggcccttgcagccaggcccggtgggccgccgaccgtgaggatcacagggcttgatgattcggtgtcggcctacgcgcgaggcggtgggctggaccttgttgggaggaggctgtcgcacattgctgggctctgcaaagttccctttgagttccactcggtcgccatggccggcgaagaggtggaagaggggcacctcggggtcatccccggggaggctctggcggtgaacttcaccctggagctgcaccacatcccggacgagacggtgagcacagcgaaccaccgggaccggatcctgcggctggtgaagagcctgaggcccaaggtgctgaccctggtggagcaggagtccaacaccaacacggccccgttcccgcagaggttcgcggagacgctggagtactacacggccatcttcgagtccatcgacctgacgctgccgagggacgacaaggagcgggtgaacatggagcagcactgcctggcgagggaggtggtgaacctgatcgcgtgcgagggcgcggagcgggtggagcggcacgaggtgttcggcaagtggaaggcgcgcctcaccatggccggcttcaggccgtcgccgctcagctcgctggtgaacgccaccatcagcacgctgctgcagagctactcggagaactacaagctcgccgagagggacggggcgctctacctcggctggaagaacaagcccctcgtcgtctcctccgcatggcactagtgttgtggtgttactgctttgtgacttcgctgctcgtagacgaatctagatgcatgctttgttggactctagggtgatgctgctgctgtggagaagaatagctcccaagtaacctgctgttgtaatgccgaacttaggtctaggcctgaataaggctgatgagatgtagtggtacaagttcgagggctacagtatatgtttcagtttcagacgtctaatcttaatgtaattgcatttaattaaaaaaaaaaaaaaaaaaaaaaaaaaaaaaaagtccgctct

SEQ ID NO: 33478 - DNA, 402 bp, Triticum aestivum
  Clone ID: PAT_TA_33478
cattcttacaagaattacaagggtgaccagtgcaccatgtcttcttggagctgggacatccgtggagagaggcagatggtcatatttgatataagagctaaaatagcaaataaattagtacgctgacttctaaaaattatgcaaagaacaaaagaaccaaacaatgtcctccgtcgaagagcacaagaagcaaagggaggtcgtgaaccttgttgtgcaactacatgttattttgtggagcactatgcagaccagaaccttgctgtgtagttgtgtagctgctgcaactacatgttattttgtcgagcaccatgcatatgtgagaaccttgctgtgtaactgctgcaactgcatgttattttgtggaacaccatgcatatatatgtgagaaccttgccgtgt

SEQ ID NO: 33479 - DNA, 725 bp, Triticum aestivum
  Clone ID: PAT_TA_33479
gcacgaaccccaactttgccttcccctcactctaccggtccccccgatgcgcccccagccgccggaccccgcttgctatctccgcagagcgtgcgctttgcgacactcctactggtctccccgatggaatccacagcagccggtaacccgtcagctatctgtgcggagattgcggagctgaaaacacgctgaagacaggggatgtgatccagtgccgtgagtgtggctaccgcatcctctacaagaagcgcacccgcaggattgttcaatacgaagctcgctgaagacaaaagaacaaacatcattcactgttggttctgttgcctctgattttggatgggagtgtgtgcccctgagacaaagctacaatggaagaaatgtattatatacagtacttttaaggtcttatttgtccgttggactttggcttgaagtggtaaaacttgtcgtaaccgtattgagactttagacgtttgagaatccagattatgcatcctgaaagctggatatcgaaaaatggttattattgctattgccagcaataaaatgctctgttggttggttgcaaaaaaaaaaaatatatagtaaaaaaaaaactgtaaaaatgtcttatatttagttatgaaggtagtaccttaattctcctgccatgctctttaattgtgctaaactgagctttgtaatgttttgtgcaattaaggaacctctttccattaaaaaaaaaa

SEQ ID NO: 33480 - DNA, 1130 bp, Triticum aestivum
  Clone ID: PAT_TA_33480
gatgagggggaagggttgcaggtagggcctcggccggagccaattggtttccggccccgaccggagccctcccgacgttttcttcttatttttttttttttggagtcgggcgcatcttacttttctcgtgtgacaaataaagccatgacagcgttaactgagcctaagcagctcaagaagcatctaagccgaattggagcccgaaagctcttgcatcaaaggctaagcatccatagagaaccaggcgcaaaatctagaagaagcacatcaaacctcacatactagaaccaggattctgcaaatccgaagagagaaaattcttgattgcttaaaacaaattcgaagaaacacaaaacatcaccgcgacgcctatctcgcccagttgtttagctcttggtggtcttctccttggtcttctggatcttaagcaccttcttcacaatcttctgctcctccaccaaaaacgccctaatgatcctctccctgactgcaggaccagacagaacaccaccataaggacggttcacagtcctcctgttcctcgacaatctggacctcttgtactcagtaggcctcaggtgtgggattccttggatcttcttgccggtaaccgggcattttggcccactcgcccgcttcttggtgtactggtacacaagcttcccacctggggtcttgacgacgcgagtctgattcgacttggtggcgtagctgtggcgctttcggtatgtcagccgctgcaccatctcgccgccctctcccggagttctctcgccgctcgctctttcgctcccgctgtctgtaacgaggcggcgcggctgacattttgatttttgagtatgtatgatcctgccgatttcccgatttgttcattgtattcacagatattgttgtaccatgtttccttctttttgtaacatagcctcaaagcattagtgtgaatgagaatgattttttcccaaaaaaaaaaaaaacaagcttcccacctggggtcttgacaacccgagtctggttcaacttgggggcgtaactggggcgctttcggtatgtcaaccgctgcaccattttgccgccctttcccggagttttttcgccgtttgctctttcgctcccgctgtccggacccgtgg

SEQ ID NO: 33481 - DNA, 808 bp, Triticum aestivum
  Clone ID: PAT_TA_33481
ttcggcacgaggctttctcagcgtcaatggcgcctaggaatggctacacaggagaaggagggagctcagtcatatccacggatctaagccatggcagtgttgaatcaggcgaatctcttcagcccgtccaacctacggccgatgtacctccagaagagattccggatccagagttctttagcatagatacttccctctccacatagggtgccatcacgaaatgcgtctagcaagaaaagtggctttcgtctacgcgggccacaggcaggaggttccttggatgccctctctcgggacctgataggtgctcctggttcatgtggatagatgaagcatggggtcctgtacttagccgttcattaatacaactctgggatcaggctctcctggactctggaagagcagcaaggttgcagacaaagaaaaaggaaatggagcaagcatacttagagttgtggactgagaggagcaatatggagattgaaaactagcaggtggtcaacaagttgaagaccacaatactcgacactgagattaagatgtcaaggaggttggaatttcacactaagatgtgtggcatttatttcttcagctgttacccttgcttcagtgctcgcttatgtgctgtctgcacactagtgtagtttgttggtgatcatgtatgtgctgaattaggatgtttcgccacattgtatgaccattaagttacaccggtatgttttattctgtatgtgccaactgagttctagtttgcagagcccgaattaagttgttatttatccctaaatattttattattacctcaaaa

SEQ ID NO: 33482 - DNA, 755 bp, Triticum aestivum
  unsure (1)..(755): unsure at all n locations
  Clone ID: PAT_TA_33482
actacatgtccatcgggagcagggtaggagagaagnagagaaaagagcggcgaaagtgacacagtccagtacagatctcgcattgaatcctcccctataagggtttctctgcctacaacctgatgcattgtaaagatgtcgagtacgctaccaccaagatgtggtggtcttattgatgacggcgagctcgcgtgcatgtgagatagtccagtcagcgtgcttgcgacgctaactagacgggtggaaaataatgttgttgtgatagcaatttttatttcttaataatttttaaaaatgaggacatatgtaattaccagttgcatattttgcccagcccttcattgtcaccatggaagcaaattctcgatataattgaagcaatggttcattgtcgtggaagcatatcccgtaacggaagcaacatgtgcttacaacagaacaaaaatttcattatattccaaggagataggagtttgcttccatctgcctattcacaacacaagcagacacaaattattcgacacaaatgatggtaacaatttatattattatggaagcaagttgagtcgatgatagtatattataattgagtcgaatgttgagttggataaatttttttcttacatcgggcttgcttgatttgtatggagacacagggttaatgctctgccgaatatgcatgcaaggcactgttttggattgattggcattttatggcacccttcaaaaaaaaaaaaaaaaaaaaaccacacggc

SEQ ID NO: 33483 - DNA, 1112 bp, Triticum aestivum
  Clone ID: PAT_TA_33483
catacctctatagttgtatccaaatctcaatagttattcactcaaaagagcctcaagtttctaccatgaatccaagagtcaaccaagagtggaccccctttgaggtagagggggcaagatcaatcatagattggctcaagaacaactactgcaatgatggcaccatctatggaataaacaagaagcatgagattgtgggaacgctccaagcatggttccccaggaagaccatgcaacaggtaacagacttgtatgttgatcttgccgcaaagatgcatatgcttcagtgtctagagaaggaataccatggtaccaatagtgaccatggtgtcaattacaccgtggatggccatgcgcataagaacttctggttgcaagaggctgccatgcaaggaacggactttttatttggttgtccattaaagagtatgcaaaccatggacacccaacaggaggtgtcgatggtagagcagaacaaggtggtgttggagaataggatgcgcatccatcaaccagtgcttgcaccatgtgccaaggggttttggaccccagatgaacacaggctctttctccatggcttgagcatatgtggccgtggcaaatggaaggacatatcaaagcacttcgtccctagtaggacttcgacccagatttcaagccatgcacagaagtacttcatgaggctaaagagcaaagggtcgggaagccaacgctaccgcatcaacgacgcggagctcaatgatgccaacccatggaaaatgaagagtaccattaactcctggcaagcactcgccttccaatctacagttggtgctgataaccaaaatccaagctttgacttgcaaactctttcgagtccatttgtcaccatgaacaatatagcctagtttggaccgttgttgttgaagaaaagagttagtagtcaatatggtgtgagaatcatatgatgttgtcggcacagtagggtgccagtgaactttgttcctactagtatacaagtattacttaagctatcttcaaagcattatatggatacaaaatataagatgctatgatttaagttgtatttgcatatgtgttggagagtcaataaattttgtttttctattttg

SEQ ID NO: 33484 - DNA, 728 bp, Triticum aestivum
  Clone ID: PAT_TA_33484
ttttaggcagacgtccaaccatctggccacattattattacaaaagcgcaatctgattgatgtacataagacttatatgatttttgtaaatgagaagaaacataaaaaaattcacaatcaacctcccattgaggctgaatgaaagttgtgaggattgagacttgggaataggtcatggatatgttccgccacaaaatcatgccttgtgagaattccaacaatgggaggcctgtatggggtctttggaacaaccaagagatgtctcaatcctagttctcggaataggagtgcagcttttgctagtgacattgtctcaaccactgtatatggcgaggtgtttgcaattgcatggagatctacatacatttgcatctcctcatcagtgaaatgcagatcctcaatttttaaacccttccctgaccctgccttagcaaaatcaaaggcaccaaatctttccataacaaagctaccactcattttcactggctccttcatgaacatcttgcctttcagcaaaaccaatagatgagacctgatcacaagcccaaccaactcaggcacttctgttagaggtggctcatcaaccactggaaacccattgtggcccgtgatcctcaacgcagtaacaatgtcccctaccttctcaacacctgaaaaggtgattagtgggccagacacgacatcaccagcaaccagatgtctcatgtacctcggccgcgaccacgcta

SEQ ID NO: 33485 - DNA, 712 bp, Triticum aestivum
  Clone ID: PAT_TA_33485
tagtatagtatcaatatacatgagggttgctttggtctacatcattacatctaataggagaagaggaaagtgttaatagacatgctcagcaaagtttggttgcagcaaatatttctcattatattcttgggggcaaaaacttctacaaatttattgcaaaactgatgcatgatagtacaatgcccaaaatttaaatgattgagacgcacaatagaggtggctaatacaatgaaaacaaccaatatgtgttattccctttctcaaaaaaaatgcagctcccttgagagataaaactttgaagtatatggaaaatgcatatgtattctagctaaatgtccacttaagaatatatccatgtttgccgatgaaagcaattgttttctctagatgcactgtgtgcgctaccaatgaaacattatctatcctgcacatatgtcacaactgccaaagcaacatgacatcaaactggataagccgtacttgcaagagaatataacagcagatggaaaaagtacaggaaataagaacatggagacttggtagagaggtcgtcaaactggaacccagctttgacatgagtggccatgaatagcaagatgttgcccgcggtgcaatgtgtgccttgcaagtaagacgacgacaccttgccgaggcaatggaaacttcagtagtggcagcaaaaaccaacctaagagtgcgccggcaggggcta

SEQ ID NO: 33486 - DNA, 774 bp, Triticum aestivum
  Clone ID: PAT_TA_33486
agcgaaaaaagctcctgcgggcaacaacttggttttgtgcatccttgtcacaagaaaagatctgaacactggctggaacaccctttgcctctgggacaaatccagcaacatgagatcctggagcacttgctagctgcaatgcagctatgcctggtaatcttaccttgtacacaatccctttagtgaaatcatttgtgtcaaagaactgcatctcgttggtcgccatccgacaagcgactgactcgtccgcagaaaattgaaccattggccaattggccttagacaagttcttctggtagtgctggtagagcgccgtggcggtgtcaacgtgccagaccgtgacatttttgacctgcggcgaagacgacttctggaaggtctgcaggtacgagccagtgggcgagagcgccgcggaggtgaggcctgggaggtcgaaggacctgatgacggagagcgagctgcagtcgtagacggtagccgaggccgaggccaccgtcgcgaggaggcgggagccgtcgctggagaaggacgtggcgctgcacgccgtcttggggagcctctgcggcgggctggaaccaggcgggtagggagggccgggccacaccgtgaagccgtcgggctcgcgcactaggatggcgagggatggctgctgcgatgccatggccgactgcgcgagaaggtctcggggaccggcggagagatcagaagcggagctgcggtggaggcggcggcgcggcgaggggactttgctcctcgcgccgggtgcctatgccc

SEQ ID NO: 33487 - DNA, 943 bp, Triticum aestivum
  Clone ID: PAT_TA_33487
ggcctgagttctcaaggagatgacatggatctgagtacagaaatgtccttgtacagcaagggaagctcccaaggtattggaagtgaaatactcccaatttcttcttctccgcctgacagtacacaaagcactggcagaggcaacggggctaccaaagagaagcaagatggttccatacgccggcggcagaaagtggaggcggatacccaggacgaccttctgtcggactcgatcaagatgatcaagagcttcctgccgaggccggtctccagcatgcgtctgaatacggacgcgggcagcccggatcccgccgcgaggagcagtggcggctcattcctcgacgggttcaagtccgtggtgcggaggtcgccgagcgccccgagctttgcggactcggagaacaatggggtctccatatggtcgagctccaagtggacattcaaccacgagtccttcacccggccgttgcttgacggcctcccgaaacccgcgacgggtcgcaggatgaaagctgccctagactgagttttagtctccatgccggcgcaacagtagttctactgctgcaaactccatttgtagtcatgtcatccacgcatgtgatctgagttgagagggaaatggaagaggtgacttggtttgccatgatcttctgccacctcaatccttgttcctcatactgatgacgatcacattgacttgcccacacaacaccaatctgccttttctcatgtggcttctgctgctaattcatcattcgtcctgtataattgtatatcacattatatacggagtaaaatgcatgtttaactttgttcagttgcatcccccccaccattgtttttctgatgtggcacctgctgctaattcatcattcatcatgtataattgtatatcgcaatatatacagagtaaaatacatgttaacttggcaaaaaaaaaa

SEQ ID NO: 33488 - DNA, 976 bp, Triticum aestivum
  Clone ID: PAT_TA_33488
gggaaaggggataaggagtttcttgccatatccgtctggagatgaattacaaccctgagaagttcaagctgtcacagccactgatggaggtgcttggggtcgaggtggacactcgtgcaagggtgattgcagccctttggcagtacatcaaggcaaagaagctacagaatcccagtgacccttcgtactttatgtgtgacccccaactgaagaaggtatttggggaggataaaatgaggtttgctatgctgtctcagaagatatcacaacatcttgctcctccaccgcccatcaacttggaacataagatcaagctatcagggaatggagcaaactcgagtgcttgctatgatgtattggtagatgttcctttcccactgcagaaggagatgacagcatttcttgccaatactgagaagcacaaggacattgaggcatgtgatgaggtgatatctgcttcaatcaagaagatccatgagcatcgtaggaggagggcgttcttccttgggttcagccagtccccagtggaattcattaatgcgttgatagcatcccagagtaaagatttgaagcttgttgctggtgaagcgagtaggaatattgaaagggaaaggcgtgcagacttctataaccagccatgggttgaggatgctgttataagatatttgaatcgtaaaccgcctggtggcaacgatggccctggtgctggtggttcttgaggagaagattgttgtagttcccttggtgtagaaacaagtcgtctgtcctgtatcagtataatttcagagatggtagtgacaagaaaattgttagatgatgcggaggaacctggcagttttacctcctttgtctgctcaaatggtttacctattgtatggtgtgttatatgttacccctccttgtcatggtaaatgttgaactggaaaaatcttttagtttgcaaaaaaaaaaaaaaaaaaaaaaaaaaactcgagac

SEQ ID NO: 33489 - DNA, 639 bp, Triticum aestivum
  Clone ID: PAT_TA_33489
ggcttgccgcggctcttcagcgacgacgaggaggtggtcgacggagcggcgaggttggggtatctgctcgccgtcaccgtcttcttcagcagcatcgggccagtgctctcaggtgtggctgttggagcagggtggcaattgcaggtggcattcgtaaacatcggttgctactacttggtgggcattccggttggtgtcctgcttggattcaagttcaaacttggtgcattgggggtatggacgggcatgctaacaggcacgttgctacagatggctatagttcttgtcattatcatgagaacagagtgggagaaacaggccttgttggcagcggcgaggatcaaggaggtcggagggaagaatgaggaccagccattggccacagcggcatgtagagaagacgagcaaatggacactgctaacgatgaaacttatatgcaaacacgcgagagaaatagagagttagagtgtaatgaacaggcactagtatagaagttcatctactttcactgatcattgatcaaatttgtcaaatacggagtagcaagaaagagtaggtggcctcgtttcatcactgtcacggtactattgtttcaatgaggagccaacgtagtacagaggaaggcatcaagtttaaaa

SEQ ID NO: 33490 - DNA, 1095 bp, Triticum aestivum
  Clone ID: PAT_TA_33490
ctcctgccggattcggcgccttgctcgtgccgcagtccgctccaggcgggacgcacgcaaggtggctgccacaagttcgaaattcctagatagctaacttcaacgtcgaaccaggtaggtgactcctttaaatttcatggcgatcctcttatgttgtgttacttccaaagccttggcgccacacactccagtggtttttcggcaacaacggagcactggtatatctgcatcagctcggtccccggcaaatccctatcggcttaaccacgaagtcttggggcatcaacccagccggataagaagagcaacacaaatcccagccgtcggtggaagaccccggagaactgctagtgctaggagccaatctcccaatacccgacttttcttcatgggccagcgtggctggttggtgccttctttcttgcagcacctgcttaactggcgattcaagagcactggagagataaggcggagcaaacagcaggaggcaacaataaagatggtcgagaaggtggccgaggcggcggagagaatcgccgacgacgtctttgaagtgtttcccggcaatgaaagactcaagaaggcagcatccagtgtcaaagccgtggcagatgagatcgaaaaggatgtggacaaagccgaggcactactccataaggttaagccaagtcaactgccaacgatagtaatttgttacttccccgtttagacatccgttattccgaataagctgcaggtttatattatggcagttaatggggtccctagactcgcttaactagctgatgatttttgttgcctgttgttcattgttttatgcaagaattgcaagcctctttgcatggtagataatttggtgtgtgaggtgcgttccaaatttctgatcatttggacatctaagtagctctcggcaaaaaataaaaatttggggtctttaaaaaagtttactattcatgtattgttgtggcccaatttgtcttttttatggttggttgacggtcattcatattgttgtatgttggaaatatgccctagaggcaatcaagtcgaatgattttttgtgtgaaaaaaaaaaaaaaaaaaaccgagactagt

SEQ ID NO: 33491 - DNA, 1172 bp, Triticum aestivum
  unsure (1)..(1172): unsure at all n locations
  Clone ID: PAT_TA_33491
attggtatcagnaccaggttgatccgcggtggcgacggcggcgcggtcggctccatgtgagatcggggacggcggcgcgaggtggaggccggcgatggtgcaatgccgtgggtggccagttgcggtgcgatgccgcaagatgatgatggtgtggtggtcggcgtcacgaggacatcatccacaacaagatggtccatggtgaccggcgctgcgacagtgtcggctgtggcgcgacggactccatgcgagatggaggccggcggcgcgagaagcgggacggtggccatgcggtgccgctaggtggagatggcagcgcgaagctgccgcaagaaggcgacggtgcgatgccgttgataggagacgttggtggtgcgacgccatcatctcaagtagagtcggtgtgatgccaacggcggtggtgcgatgccatcgccatcatgaagagttggtgtgaagccaacaaaagttgcagcgtgatgttgcggcaagacaaggtggtgatcggccttgcgacagcgttgtccacatcaagaggtggccgctgcgtgcggcaagagtacatggtgatggacgccggcgctgcgatgtcgtcggtacacagcaaggtgtgcagcatcgcgatggcgtcgtcaagtggcagcgggtgaacccgcgcgaagattggtgaatcaagattaggaggaaaaatgttaggtttaatcttgattcatgtatctgcatatttagtttgctttcgttatgcatattgcacaggttagagaatagctagtccggtgaagtttcagcggagacatgcggagacggcgagatgtcgggctgccgtgcgatacggcgagcatggcgagatgccgacggcggcgcgaggctgctatgctgcgtgaggtggcagagccgtttgatgcggcaagagagccaagtgatttggttagtttgttagctgcatgtaactagctagttatgtgggcgtgctggccactaatcaggtcgtgtgcggccgtcgagagaatgctacacacaagctggcatgggcatgcatgtaggtagtgcgttagtgcatggaggtcatgctgttagtggagaaatgtggccgccggatgcgtgcatctctgaccctatataagagatgtaaaccgtgttgttctttgagccaagagaatagaaagagaagaaaa

SEQ ID NO: 33492 - DNA, 1004 bp, Triticum aestivum
  unsure (1)..(1004): unsure at all n locations
  Clone ID: PAT_TA_33492
tcccggngttcgaccccacgcgtctcggctcaatggnnagcttttcgccgnaacagtnngcgagcaactgtctgtncnncgatcaacagccggnactanntgggtttcaggnagccagaggacnntactactatggatgagnnattgttctaagaacaaatctacnnaaatcgagaagcacgccagcgaggtgtacacaatgaccggtgtacgaacagtttgtgcaagccatacgcgaatccgagccttacatggtggaggcggtcatccccaacctgaggtacattgcacggcgtcccagcggtgaaaccagggagaaatggtctagggtggaatatgaggtgaatgttagagaagacggtgaagcgttcatgtgcgtgtgcaagcgattcgagcacacggggatgctctgctgccatgctgtcaaggtgatgatccacctgggcgtgcgtgaagtaccaaggttacacgtgatgccacgctggacagccaagccgctccagtgccagatgcactgccgcggtgaacctcggacggacacgtgccagcaatgccggcgctccatgctgcatgaccagttcttatacctagcgcatcgcgcctgtgaggatgaacggtgctacgaggtcgtcgcgaggggcatcagcaagctgagcagagaattggccgcagaagatgccgtgccccgccgacgcagcaccaagccggcgtcacggaagccgaggaggaagcgttgattgcttaccaccggatgtctgaaagtctttttggtttcttctttttgctagtgtgggtaaacctctgaacctgaccacgtatgatctagggtaaaccagtattttttgcatgttcggcgacggcctcgcaggctggcaccatagttgatttctaggggggctgcccggtgtatatatgtttgaggtgaccatgtgtgccagccaaaccaagtggacaaagttcaaacaatgtcaaagttccccaaaaaaatgtccatatttcaaaaa

SEQ ID NO: 33493 - DNA, 609 bp, Triticum aestivum
  Clone ID: PAT_TA_33493
gtcatcagaagagcctgctcgccggcctgacctcgacggcagcagcggacggcggcgcgagccactacgacgtggaggaggtcggggccgagaggtgcgaacagctcaagttcccggcggtggtcgaggtggagaaccacggtcccatggacggaaagcactcggtgctgatgttcctccggtggcccaacgcgacgggtgggcgcccggcgagccagctggttgggttccaaagccagcacctcgaggccggcgagaaggctagcctgacgttcgatgtcagcccctgcgagcacttgagcagggcgagggaggacggcaagatggtgatcgacggagcctcacacttcctctttgttgacgaggacgacgaggccgagatcagcttcgacgcctgaactaactctccgtagttattgttagtctgtttttggcgggggtaaaagatggattgcatagcgggtttgttgcggcgacacaattaaccggcgcctcgaagagctaattgttcgagcaacatcaagaaatgcttgccagcttagtgtagctatgtaatggaattgtctgtttctaaatcctcaatgagaatttcttttacatgatcaaaaa

SEQ ID NO: 33494 - DNA, 1346 bp, Triticum aestivum
  unsure (1)..(1346): unsure at all n locations
  Clone ID: PAT_TA_33494
cggccgcgtgggcttcggcccgccgtgcgagnacatcacgccgctccgggggctcaacgggtacgtgaaggacgtgaggttcgagcccgggtgcatcgatacggcgtgttggtccgccgcgacgggcaaggcggtggcggtggcgaggtcgacggaccacgtgatcctgttcatggggacgagccaggcgcaggaggaggaagggcgcgacaggacgagcctgctgctccccgggcagcagcagagcctcatcaaagccgttgccagcgcggcgaaacggccggtgatcctggtgctcctcaccggcggtccggtcgacgtgacgttcgccaaattgaaccccaagatcggtgcaattgtgtggggccggctaccccgggcaggccggcgggctcgccatcgccaggctgctcttcggggaccacaaccccagcggcaggctgccggtgacgtggtacccggaggagttcaccaaggtgcccatgacggacatgcggatgcgcgccgacccggccaccggataccctggccggagctaccgcttctaccagggccaacgccgtctacaagtttggttacggcctcagctactccaagttctctcgccaactagttgtctccggtaatggtaacaaagcaccgaacacgaatctgctcgccggcctggccgcgacgcgaactgccgacggcggcgcgagctacgtggtcgaggaaatcggggccgacgggtgcgagcagctcaagttcccggcagtggtcgaggcggcagaaccacgcccacgtgcccggcaggcgctcggtgccggtactccggcccccggcacgggaagcgctcggtgctcatgttcctccggtggcccaacgcgacgggtgggcgtccggtgagccagctgattgggttccgaacccagcatctcaaggccggcgagaaggccagcctcaggttcgacgtcagcccgtgcgagcacttcagcagggcgagggaggatggcaagaaggtgatcgatggaggctcacatttcctcagggtcggccaggacgagcacgaaatcagcttcgagtcctgaatccggagctcattctggctctggcacaggtagaagacgaactgcagtgacgttatttatcagtagttacacacaatttaattattggtttaagttataattcagttgcctcagaaatactgtagcattgaggcatgcattaaggaaaggttaagggaaacaccgagacatgttttaatactcccgaattatatatattgtaatttgcacatatgtcgaaaattcaaaatagagttaataaaaaggtatgtctagctctcaaaaaaaaaaaaaaaaaaa

SEQ ID NO: 33495 - DNA, 766 bp, Triticum aestivum
  Clone ID: PAT_TA_33495
tccggcttatggtttagcgttagcgtccctctctctgtttccaatttttttatttatgttcatcttgcaatgcattgttagttatccctaacagtccctcttttccatctcttcttgcagatctagagatttcatccaagtgtgttgagatctagagatccctgctgtgttgtgatttttcatcgtgttgagatgcatcgaccgcgaaacgcttggtggaatagaacagatggtgctgaaactcgtagtacgctcgaaggacagagacaattcaatattaacttgcataaggcgcaacaaagactcagaactgcacgaaacaacgcgccaaacctgacgaagagagtcttgggtgggtttgttaaaaccttcgagtacgagtatgatgatgaagccattggcaatgttcataacggcacgatgataattgcgtacgatgatggtattgagcaacctcatgatatcacagtagtgatcttagaggattgggccaacgctagtgagatcggagatgcaattgtggcgcatactgaaaaactttctagctatggtggtgacttacttgtgcaagcatatttcagtactttttgccacaatgctcagagatacatagtggcctatgagccattcgttcccgcctcaattcagggaataaggagtgaaccattttttgctcatgatgagctagagttgtcagaatgttggcgggagaggatgaggtcattcatagaacttctccatatcgcggcacagtgcaatatcagac

SEQ ID NO: 33496 - DNA, 760 bp, Triticum aestivum
  Clone ID: PAT_TA_33496
tagcgtggtcgcggccgaggtaccggaaaagggtggggaaaggtccactttcacggtccatataattcgtgcagaagctactcatcgtaggggtgttaaaagggttcgctccagccttgattctccggttggcgtataaggaatggcaaatccagatgccgtttaggaatggcaaccggatggatgctcgcaaatggttgggaggcaagcttgtccacggcaacggtctgtgtgctgggacatgtgcctgttcgaactgaagaaaagtgagaggtagcactagtttgtagtagagcagaatggtgggacatgggagctagcacccgcatgctctttctgttggtacttgcccgggcggtggagggaggcgacatatgcatctttgtaccggcaatgggtggggaaaggtccacattcatggtcccatataattcgtgcagaagctactcatcgaaggggtgttaaaagggttcgatccagccatgattctccggttggcgtggaaggaatgacaaatccagatgccgtttaggaatggcaaaccgatggatgctcgcaaatggttggaggcaagtttgtccacggcaacggtctgtgttctgggacatgtgcctgtttgaactgaagaaaagtgagaggtaacactagtttgtagtagagcagaatggtgggacatgggagctagcacccgtgtgctctttctgttggtactttgtgtgtctcgtgggatgttttgtactatgaaatcaagctatggcta

SEQ ID NO: 33497 - DNA, 1095 bp, Triticum aestivum
  Clone ID: PAT_TA_33497
cccttggttccccgctgcgcctcggaggtggggccgtccctgtgtggccgtcgacgctcggggcgcggccatgcccgtggcgtggattctcgttttctggcgcgtcggcctcgacttttggacacattactttttcacagttcttggcgcatcctatacttttccttcatggaggatgaataatgtaccccatacaacatttctcctaactcatgcctgcttcttgttttatcacatggcatcgaatatgacacttcgtagattacgtcattctacagctcacctgccacagtctattcggtggttgtttgaagcggcatggattttagcactctcatacttcattgcatacttggagaccctagccattgcaaattttccgtattacgaattcgtcgatcgggacataatgtacaaagttggatcattgttttatgcaatatacttcctcatcagctttccgatgttctcaaggatcgacgaaaaagcagagaagtgggccctttccagggtagccgtcgacgctctgggcgcagcaatgctcgtcacgataatacttgatttatggcgcatatttctggggccaatcgtgcccatccccgaatcaagacggtgtggccagccggggctagcatggttccatgcgcagaatgaaagcgtctagtccgggaacgatgtggattcttctgttcccacgtgtaccgttggctctccgccagtgccagcgttcttcaagaatcaagactgttcgcctctccattggagggatgaaaattgcaccgtcaaggcgtggttcttgctgattaatggatcgatttcttgtctgcatgttgtatttgcttcgtgcgaatagcgaactggtaatttgtaagttcagcctgatctcagaaaccatcttgagtaaggtggaggcaatgaagatttgatgtcaaccagaaagggatttttttttgtttgttgagaaaaccagaaaatggatcttgacgcaccacggtctgagtgcggctcgacagtacccttcggggtgtttggggcatcatttgttccgtgtgtgtccgtttgggttgaaatgaacaaaaacgacgaatcatgtcc

SEQ ID NO: 33498 - DNA, 1082 bp, Triticum aestivum
  Clone ID: PAT_TA_33498
cgtgcagaaaagggcacccacgccagagacttatcttgcgaagatttatgctcattcatcaattggtcaactccaacgagcttttgggactcttcgtgaatttgaaaatgcctataggaactttgagggtatcgataaagagctcttctcaccatttacttcattgcaaccacttgttgttgcttgctgcaaggatggcttcaccacattggactcggtttatgttcagttagagaatctgagttctgcggatccaccatacaaatctgttgctgctcttaactgtgttatactaggctgtgcaaatatttgggacattgagcgagcatacgaaacttttgaggcaatgaaagaaaagtttggacttacgcctgacatacattcgtacaatgccctgttggctgcattcgggaagctaaaaaagacagaggaagctagtaatgtattccagcatttagtaagccttgaggatgttaagccaaatgcaacaacatactccctgcttgttgatgcgcatcttgtcaaccgagatccaaaagctgctcttgctgttcttgacgaaatggttgatgtgggcttcactccttcaaaggagactcttaagaaggtccgaagacgctgctcccgtgaatcagacttcgacagcgacgagaagctgcagtccctgtgtaaacggttgaacttgcggatgggcggtgaggcccgtagggagttgctgtataacatcgaatacagtgccgagtactgaagcatttgattttgatgatgccggtgttctttcaatcaagtaggcacgtgtagtgtttgccggtactcgaagagcacagaggctgtagtctgtaaattatactttgtaacagttttcctaatcattcttcagtatcccaggcttccttttttcgctggagagacaggatgagattttatttgttaggatttcagaataaggtcctaatacatttgtttctttgctcaacgcgctatcttccacagtcagaggatggatgtaacgttagttcatcataatgttatccttctgcaaaataaaaaaaaaaaaaaaaaaaaaaaaaaaaaaaaaggcg

SEQ ID NO: 33499 - DNA, 593 bp, Triticum aestivum
  Clone ID: PAT_TA_33499
atcaaagcgcagcaatcagcctcaagcagtactcctcttggtgtgtgtgtatgtgtcttgtgttgcactagtgagtgcgtgtgttactagtgagttgagtgcaagtactaccgttagatagtcaggaccctctggtctcagtagttccgggctaacaacgcgccggtgcccaggcgccttgcatccatctacagcgaggtgcagacgagccgcatcgcgcacacgctgcccctcccctccgtcctccgctcccacttcacgctcgccgacgagccggccagcaccgccgctagaagccccgacgagatagccaagctgttctccagcctgcacggccgctgtccacggccgtgctgccgtcggccgagcccgtcgcgacgaagccgctcaagatcggcatcgtgcttcctggtggccaggttccagggggacaatgaatcgacttctttgtgtaacagattacctgcaggagggtgccaaaggcagcaccatgtatggattaagggaggcccgctggtgtcatgaagggcaactacgtcgagctgactgctgatttcgtgtacccctacggaaaccaggtatgtcagcataac

SEQ ID NO: 33500 - DNA, 2052 bp, Triticum aestivum
  Clone ID: PAT_TA_33500
cgtccgcccacgcgcccgcccactccccgcccgcgcgccccctccctccctccgcccacagcatattcctccaaatctcgccaccaccccaccaacgccacctcaccggcgcatcgcatcgcatcgcatggcggctgcggcggtggcctccaacgggggcgcggcgcccgtgcccgggcgcctcgcgtccgtctacagcgaggtgcagacgagccgcatcgcgcacgcgctgcccctcccctccgtcctccgctcccacttcaccctcgccgacgggcccgccagcaccgccgcgggaagccccgatgagatcgccaagctgttcccctgcctgtacggccagccgtcggccgccgtggtgccgtccgccgagccggtcgagacgaagccgctcaagatcggcgtcgtgctctccggtggccaggcgccaggcgggcacaatgtgatctgcggcatctttgattacctgcaggagcgtgccaaaggcagcaccatgtatggattcaagggaggcccagctggtgtcatgaagggcaagtacgttgagctgactactgatttcgtgtacccctacagaaaccagggcggatttgatatgatctgcagtggaagggacaagattgaaacaccagagcagttccagcaagctgaagacacagtcaacagacttgatttggatggacttgttgtcatcggtggtgatgattcaaacactaacgcatgcctccttggtgaatacttcaggggaaggaacttgaagactcgcgttattggttgcccaaagactattgatggagatctgaaatgcaaggaggtcccaacaagctttggatttgacactgcttgcaagatatattccgaaatgattggcaatgtcatgactgatgcacggtcaacaggcaaatactaccactttgtgaggcttatgggtcgtgctgcttctcacattacactagagtgtgctctacagacacaccctaatgttgcactcatcggtgaagaggttgctgagaagaaggaaacactcaagaatgtcacagactacattaccgatgttgtttgcaaacgtgcagaacttggttacaactatggagttgtcctaatacccgaaggcttgattgatttcatcccagagatccaaaaactcattgcagaattaaatgaatttaatgaaatttttgtagttgatgttgcagaggcttggaaaagcaagcttgaaccagcatctagggagttgtttgacttcttgcccaaaaccattcaggagcagcttttgcttgaaagagatccccatggcaatgttcaggttgcaaaaattgaaactgagaaaatgcttattgccatggttgaaactgaattggctgagatagagaagagggggaagtactctgcacatttcagaggccagtctcacttcttcggatatgaaggaaggtgcggcctccctaccaattttgattccagctattgctatgcattaggctatggtgctggtgctcttctccaatttggaaagacaggacttatttcgtcggttggtaacctggctgctcctgtggaagaatggactgttggaggaactgcactgactgcgttgatggatgttgagagaaggcatggcaagaacaagccagtgatcaagaaggctatggtggaacttgatgctgcgccatttaagaagtttgcctcgctgcgagatgaatgggccagcaagaaccgatacatcagccctggtcccatccagttcagcggccctggaagcgatgcgtcgaaccacaccttgatgttggagcttggcgctgagatatagaggcggcagtgtagattgtatttctttcaagttttctacttcttccttgcagttttgagagtggagaacaaactcccatagcggagcggcagtctccgcattgtggaatgtttaataagaggttgagttggagtgggttcagtggatgtcgtaataactaattttagcttttctaatagctccccatacaccaaatatcaaacccccacttacacctgaagtttctttttcctaaaaaaaaa

SEQ ID NO: 33501 - DNA, 534 bp, Triticum aestivum
  Clone ID: PAT_TA_33501
cttgctgattaaactttgcactcacagggatggccttgaggtcactgatgatgtttccatcgtagaatacttgaaacatcctgtttatatcactgagggctcttatacaaacatcaaggtatcatgttagctatttaaactagtatattctgaactttttgaattaactgaacctcaaaatgtgaacttgatgcaggtgactactcctgatgacatgctcttagctgagcgtttgatgagcgataaatagggccaatattaacaatgtttacttcatttgagaggcacctgtatgaatttgtcagtacgacattccattgcctttgccacagttttgtgcctcttgggaactacaaaaataaacatgtactccctccgtcccaaaatataataatgtttttaacactagcatcatgtcaaaaacgttattatattttgggacagagggagtagctcagacacgcagatagataacctgtacgtaacatctttctgtgcgaatgcaaaatacggcaaggtttttggttgagtcca

SEQ ID NO: 33502 - DNA, 1177 bp, Triticum aestivum
  Clone ID: PAT_TA_33502
ctcgcgccgcctcccgcccgcgctcccattgggtcacccaccagcgcctccggcatggagctccgcctctgcctccacctccacctccacccgcacgcccggcccgcttccgccccgacgccgcctccatgccccgcggccgtgctgcttcccgcgtcccgccccgtccgccgcctgcggattggtgggagctgcggggttgctcagcggcggagcacgaggcgttcgcattcagccatctgcggtgccgaaccggacggcgcgcagggcggggaggctgtcaaggagaggagcgtctcggtgatcctcttgtccggagggcaagggaagagaatgggggccaatatgcctaagcagtatctaccattactgggagtaccgattgcactgcacagtttaaagacattctgtggaatgaaggaagtgaaagaagtcgtggtggtgtgtgatccatcctacaaaaatttatttgaaggttctgttgaaaacttgcaaatacctattaaatttactacccccgggaatagagtgacaagactctgtttttaatggacttcaggaaattgatggagaatcagaacttgtttgtgtccatgattctgcaagacccttggtatcctctgaagatgtaaaaaaggtcttggaagatgctgccgtgcatggagcagctgttcttggtgtgcctgtcaaagctactataaaggaggccaacagcgattctttcgtcgtaaaaaccctcgataggaaaaccctctgggagatgcaaactccacaggtgatgaaacctaatttgctcaaagatggtttcgagcttgttaagagggatggccttgaggtcactgatgatgtttccatcgtagaatacttgaaacatcctgtttatatcactgagggctcttatacaaacatcaaggtgactactcctgatgacatgctcttagctgagcgtttgatgaacgataaatagggccaatattaacaatgtttacttgatttgagaggcacctgtatgaatttgtcagtacgacattccattgcctttccacagttttggcctcttgggaactagaaaaataaacatgtagctcatacacgagatagataacctgtatgtaacattcaaaaagtgccaatgaaaatatggcaaggttttctgtttgagttcatacttgacaaa

SEQ ID NO: 33503 - DNA, 625 bp, Triticum aestivum
  unsure (1)..(625): unsure at all n locations
  Clone ID: PAT_TA_33503
ctnaagaacaatccatacttttagaaagtaggctgtccccgaccttaaaatgaggcccttaagttatcacaagattccgagggaccaaaacacatgcgactgagcgctagaataaagccagaaagtagaggtgtaggttcgatacatggtcacatagaaccgatacaagcgacgcagcgctgatgagcggtactcagcgaagatgcacaagtaccaaagagaccaacccaatggctcgagacattgccgtcgatctcacatccatactcaaagaacctccagttgttgaggtcgagcaacttcctcttcctgatctcacatcatctatggatatggatcggtcgtccaatcattaatccaatcatccgtcatgtttatgacggtgtagcaaacactcataaaatgttggaatcgagttctgatctctatgagcatattgttcttatcatgcaattcctgatcgtagtcacctccatggtttatcaggttcttaaccaacttaataatattgagatagcaatatcttgtaccatagttagctgaccaactcccatcattagggtcctgaaagaactcattctttctaaaccgggatccatgcttgaaagctgcaaagtccctgttt

SEQ ID NO: 33504 - DNA, 1985 bp, Triticum aestivum
  Clone ID: PAT_TA_33504
cggacgcgtgggcggcagtttggagtttccgggaggtggggaggggagaggagaggagaggaggcgtgagcactaggaaaagggggagggagggttggatttcttcttcaggttgcgggatcgctaacccaattcgattccaccgccccacgcccgatcgatccgcgccgggttgctcactttcccccttgataggttcctcctgttggggaattttttgttgttgagtcgattttgtccgagggtttcccgtcggatcggagcggatcgagttcggaggagatgcgaatccaggagcttcccggcgattgcgatggcgggggtgggggcggaggggcgggggagctgcagctgcgtcgggaggatggcggggcggacggtagtgagctgaagctgcgtggcgaggatggggttgtcgccgcggcgggggaggagtagggagagggtgcgggtacaatgcgagcctcggcggctttgggtgcgaagcgtgcggcggttggcgtcggcgctcggatgctcttctacccgacgctggtgtacaacgtcgtgagaaaccaatgcgagtctcacttccactggtgggatcaggtcgacgagcatgtgctgctgggtgctgttccattcccgagcgatgttttgcggctgcagaagcttggagtttgtggtgtggtcacactaaacgaatcatatgagaggcttgtttccaagtcactgtacgaggctcatgggattgaaaacctggtgctaccaactagagattacctttatgcgccgtcatttgacaacctttgcaaggctgctgacttcatccacagaaatgcttcatgtggtaagctgacttatgttcactgcaaagctggacggggacgtagcaccaccgttgttctttgctacttggtgcaatacaaacaaatgacacctgctggagcttttgaacatgttcggtcatgcaggccaagggtgttattggcttccgcacaatggaaagctgtccaggaattctaccagcttagagtgaagaaaattcacggctccagttgcatcgacagcccaatcgttaaaaaggttccatctccatctccggtgttgcttgctactcggaacctcatcacttttgatgagaagacgttcgtgatggtctcagaatcagaccttgaagggtataatgcggatgccttggcagttaatgtgggaagtggtttgtgggaaataagcttagtataccgtgttcagtttgccagccaggcagcatttgcagggttttcatacctgtggttgcagtgccgcgcccacaaggacacagaggcacttactgagagcatcggtagtgagagctgctcgctggaggcggagcagcctgcgaatggtcaccactgtctacttcaaggtgtcgtggttaatccgtgaatcgcggagttcctcggtgtctttttgtcttgcacccgtacatatgaagagggcatgcaatgtgaagccccgactccagtctgcagcaaccaaggggttcagttgctcgggtctgtatatatgtgctgtaataagttgactgctacgtgtacaaaggtaaatggatatcgtctcaaattgctgaccttacttgctgaatatgtatatatgtattattttcttgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttttaaagaaccaaattttactacccggggttggaaaggaaaaattttttttttggggcccccaaaataaatttccggggccgggttttaaaaccgtgggggggggaaaacccggggggtacccaaattaaatccctttgaacaaaacccctttttcccaagtgggggaaaaacaaaaaggcccccccccaatcccctttcca

SEQ ID NO: 33505 - DNA, 683 bp, Triticum aestivum
  Clone ID: PAT_TA_33505
aagagcaagctttattttgtttttttagagcaaatcaatatatatagacacacatatgaactatatacagacaggtgctgaacaaacaggtctcttccatttgccaacagccaaacatgcatagaccataaataaaatccagcggcacatcgcatgctgcagttactacatagccatggccataaggataatcagcagcggacagctaatgagaacaacgtcacatgccttgtctattttccgaaaatcttccattatgcttttaatggcttcagtattatgcctggcggcttcattataagaagcttcagctgcgtccatgacttgttgggtcatctcaatcatcttcaacccctcagcgtcctgcttttctaactctatgcggttcttggtcagtctccgcgcgcaggcgatttatttcctcccgaaccctagccatctcgtcttcagaatagatctccgcgcacaagcgatcgattgccggagccccatgggacatgagccgagaacccgccgccggcgacagcgcccggacgggacccataaggttggccgtcggcggcggcctgagacccagggccggcatctttctaacaagagagcgcagcgccatcaggttcgacacggtcattagagccggcggcggcggcggcggcggcggcggaatctagctagggcttcgc

SEQ ID NO: 33506 - DNA, 405 bp, Triticum aestivum
  Clone ID: PAT_TA_33506
cgacggggaagataggattaggaaggttcaggagctgaaggcgaaagcgaaggctgctttggagaacggcgggtcgtcgtgcatgaatctggacaagctggtccaatccgtcgtctgaaaattagcgcagcatgtcggcccagaataaattctgctgctttcgttcattgatggacatattggggccgtttcttgcttgattggaagatcaagactatgttgcaactgttgtttagctgcaactgtgtctcatgccaactcagtctacaagtctcttgtttagcgctgcctgcctcgtaaaaaaagataacgaagccggcaggtgctctaccatttgaataaggaaagtctagagaatgtttacaagatagctgcttcgaacaaagacagaaaaatcacacaaag

SEQ ID NO: 33507 - DNA, 666 bp, Triticum aestivum
  Clone ID: PAT_TA_33507
atcctgtcgcaacccggccgtggcgggctttcatgacgcactccggatggggctccacgctggagagcgtcgccgcaggcgtgcccatggttgcctggccgttcaccacggagcagttcctgaacgagaagctgatcgtgaacgtgctcgggatcggcgtctccgtcggcgtgaccaagcccacggagggcgtgctgaccggtggcagcggcggggcgaaggtggaggtcgggatggaacaggtgaagagcgccttggagaagctcatggacggaggagccgaaggggaagataggattaggaaggttcaggagctgaaggcgaaagcaaaggcggctttggagaacggcgggtcgtcgtgcatgaatctggacaagctggtccaatccgtcgtctgaaaattagcgcggcatgtcggccctgaataaattctgctgctttcgctcattgatgagcagattggggttgtttcttgcttgcttggaagatcgggagtgagtgaaaaacatatcctatgttgtaagttgcaactgtatctcatgccaactcagtctacaagtctcttgttaggcgctgcctgcttcgtaaaaaaagataacgaagccggcagttgctctaccatttgaataagcggcggcttcaaaagtatcaaacttaagttccctt

SEQ ID NO: 33508 - DNA, 268 bp, Triticum aestivum
  Clone ID: PAT_TA_33508
cggacgcgtgggcggacgcgtgggcggacgcgtggggggtttcttcgtgtgcgctctgaaatacgtggaggcgctcggggtttacgtgtgtccacctgtttcaaactagtcccgaagtgtttcacactcggtgcgccttccacctttctactttatatgttgtgccaataaaggaggttatatacttttggtgtaatgctatcccccccccccccaagcgtgatggaaaataaataatgaggcacaggcatgcacatatttttatgat

SEQ ID NO: 33509 - DNA, 1308 bp, Triticum aestivum
  Clone ID: PAT_TA_33509
cacacacaatcctgcctatagccaccatgtctcctcagcctaccttagccaccaccaccacgcctgctactgggcctaacccttcctattaccaaacagctcctgttagccaagagagtatccagcgaacggaggttcttctccacctgtacgcctaccagcacacccaaggaaaaccaaatgctaaccagactgtcatagtggatccaaagctccccgcgtgtttcggtgcccttgctgctaatgactggaccatatatgatggcacttgcaccaatgcaaaccttgttgcgcacgctcaaggtttgcacattggtgctggtatgaccaaagaaaattggttcatttgtttcaacatggtgtttgtggaccgaaggtttatgggttccagcttcaaggtgatgggagattttcgaggaaacgaaggtgaatgggcaattgttggtgggacgggagagtttgcatatgcacaaggtgtcataacctttaacaagacctggtcggcccaggcaaatgtcagggagcttcatgttcgtgctttgtgtctgtccttctcaaaagcaccggaaacaccgtgctcaaggacaccacggcagagctctgtcaccaagatcggcccatggggtaaaataagtggagaatttcttgacgttcccacgacaccacaacgtctagagtgtgtgaccattcgccatggagttgtcattgattcacttgcattttccttcgtcgaccaagctggtggacaacataacgttggcccatggggtgggccatgcggggacaacaaggacacgattaaacttggtccatcggagattgtgacagaagtctctggaacgattggtgtatttggagcagccaatgtcgagtacaatgccataacatcactaaccattaccacaaatgtccgcacgtacgggccctttggagaaccgcagtgtactcgtttcagtgttcccgtgcaggacaaaagcagcatcgtgggtttcttcgtgtgcgctaggaaatacgtggaggcgctcggggtttacgtgtgtccacctatttcaaactagtcccgaagtgcttcacactcggtgtgccttccacctttctatgttgtgccaataaagtaggttatatacttttggtgtaatgctatgccccccccccaagtgtgatggttttcatatcagcaagaagtttctcttgctactatatgcaaaataaggttgtgtctttgtcgaggtaaattttaccacgcttgccatattgtactttattggaaaaataaataatgaggcagaggcatgcaaatattttatg

SEQ ID NO: 33510 - DNA, 364 bp, Triticum aestivum
  Clone ID: PAT_TA_33510
gagtcggacaagctcgcccgctacaacaagaagcccaccatcacgtcccgggagatccagacctccgtccgcctcgtcctccccggggagctcgccaagcacgccgtctccgagggcaccaaggccgtcaccaagttcacctcctcctagactgacgacgcgccgcttgttgtgacagatgtggccgtctgctgtatctgtagtcgctgttgactctgcttatctccatctgcaagtagtggtagctgtagtgcgcgtgctgggtgatgattgccaacgctttgttggctggttggatgtaagaactgaacgtgttgcttttgcaaactgatgaaatctacctagaaaatgtcgcagttgtggc

SEQ ID NO: 33511 - DNA, 428 bp, Triticum aestivum
  Clone ID: PAT_TA_33511
cctgcccgtaccggttcgacagcccgggtcgacggggagtcggccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcctagactgaagatgcgccgcttgttgtgccagatgtggctgtctgatgtatctctgctgttgactctgcttacctgcaagtagaagtagtggtagtagttcgtgtggtagaagattgccaacgctttgttggcttcttggttgtgagaactgaacgtgttgcttttgcaaaatgaaatctatctagaaaatgttgcggttgtggtacttaaaaaaaagaggaaggagaagaaaaaaaaagcggccg

SEQ ID NO: 33512 - DNA, 1071 bp, Triticum aestivum
  unsure (1)..(1071): unsure at all n locations
  Clone ID: PAT_TA_33512
gctgtgccctgctcgagccggccggccatcccagcccccacctcccctccctccagcacactcacctcaccccaccacactaacacgccccccccccccccagacgccgaaccccatgcccccgaggcagacaagaagcccgcggccgacaggaaagccgagcgcggggaagaaggtcggagagggcccaccgggcaagacgcccacgggcgagaaacggcaagcccgagggccggctggcggccgggcaggacggcggtgaaaggaggccgccggcgagggagaaaggcgggaccgcaagaagggcagcgaagacgaagaaagggcgtggagacgtacaagtaacgacatctccaacggtgctgaagcaggcgcacccaggcctcggcatctactccatcgtcaagtacatcatgaactccttcgccaaggagatgttcgagcagctcgccggcgagaccaccaagatggccacctaccacaagcaagcagaccatcacctccctcggcctccccgacctccgtgcgcctcgctcctcccccgggagctcgccaagcccgccccctccgcaggtacccctgccctcaccaagttcacctcctcctagactgtggatgcgtcggctgttgtgatagatgctgttgtcttgatgtttcttccattagaaagtagtagttggtggtagtagaatggttgccgaacgctttggctgggttgcttggttgtggagaactgaacgtgttgctttgtgcaaactaaaaaaattctaaaaaatgttgcggttgagtgttagcagaataagtaaaaaaaaaaaataaacatactaatgtttgctcttcccctcaacataacactgctggctgacgtctcggcgcagaacaccccgcagacttcgtcaacctgcacaaccggcccgcgccgtggacgggtcggcnncgtggcatgggacaacaacgtngccaggtttgcgcacgactgggcggccaccgcgtcgattgcgctgnanactccngcggcgttcgcagaacattttgggttcggantntgacgccgcnangcgtgaactntgt

SEQ ID NO: 33513 - DNA, 532 bp, Triticum aestivum
  Clone ID: PAT_TA_33513
ggatagatttgactgtcttgatgaagcagtgtggctctaggcccggatctggagcttgaggagctcagatagcgttttcggactggaaattgcttcggtccgatgtgattgaaagtttcagatcctgctcgttggagtaggtgcctactgccactcatcaacgctttcatgtgaggggtttcttcacctccaaggttcgaggttgtcgacgttcttctccttctcaggcggtgtgtttgacggcggtggaggtccacatcaagcggtgatctctgtagtggagaggaagaccaaggacttctttgcttttttttactgtgttggtctttttctagtttggctgtggcagatccttcatgtatatcctccttgtctatttgtatttgtaatcgtacatgtactggtttgccgctcgcttgaatacacataagtgtatgccttaaaaaattgttggacatgttcgttgatagctagtcgggcggaggccatccaaccagagtgatcaaataaaagggacaccgatttttcaaaa

SEQ ID NO: 33514 - DNA, 759 bp, Triticum aestivum
  Clone ID: PAT_TA_33514
cttatgccacaagcaaattctcaaacaacacagagaatgagagacagaatacaaactccacccttgctgtttgtttgtttattccttgagaaaaaaaatgcatgtaacaatattgatttcatactgagaatctttatattttcttctataaacttagtcaaagttaacaaagtttcactttggccaaatcttatatgcagactaaaaagaaacagagggagtaccctcttgctccgcaaacgccccgctctgacacgacaaggccgctctcagcgcgcatccgtggcacagtgcgggcgcagccggtgtggatgcgcgttgaactgtggagggacgcacaagagggcaagcgccaccccggcaaccagaaaagggtcgcgggggaagatggacgccacgagaagcactgggccgcctcccagtgcagcgcctaggatcccggcaacgcactgcccggccaccttggggaaagacccgccgaggtgtattggcgcaccaaagcatttgaagatggagagtaggtacgctacacgaagagtgtagagctcctccgccgacgagagaatgatggcaaggaaagaaacggtgtacaccccagtgcacaaattccggatcacgacatccgtcagtttatgaggcagctagtcatcgcccgcacgctcggatacgtgctgtcctgtgcatgttgtctatgaatcgtgttctgctatcagaacgccggtctgcgagatggcaattgatccaatcttactagcaaaa

SEQ ID NO: 33515 - DNA, 1093 bp, Triticum aestivum
  unsure (1)..(1093): unsure at all n locations
  Clone ID: PAT_TA_33515
ctggnactcagcaccgctgcnntcgtcagctctccctttgccccannctcgccgtcttcaatggggaagcgagttgggncccccgcttcgcagcacggccctgctccgcnntgctgctcgccccaggggcgccggtngaggccaaggggcatccagcngaccacgccgccccacgaagggctgcgcggttttgcgccatggccgcggcgaattggcgcaggatccggcgggctttcggcggaggcgtcagaggaagaggcggtgccggaggaggaggtggtgtcgccggtgatgaacgtggtggcgtcgacgacgagccctggtcctctatctcctcttcttcaaccttgatcttgatgttcaagtcggggatggaagggtagccgccggttcccgctgccgccggcgtcggggatgggagatccgggacggggccgtatccaggagggatgaagtgctccggcagttcgtctgatggcgtcggagacggcttccgcggtggtgcgcccgtacgcgctgggcatgattcgaacccgtacgggggcagaggcggtggcgcgagttcgcaagggaacatctcttcttctccgaggaatggcgccgatggacctccaaggagccaatccatcggagggatggtgaagacagatggcggcggagtcattggtacgatgtagtcgtcggcgacggccggagccggagccgaaggcccagcatggtttgcagtggtggtcggagccgagggtctagcctggtgcaccattggtgctcgcccacggagcgggcggttgccttggcgtgcgtacccacgacggcggttctggcggtggttccaggcgaaaaagcggcggcgagggccactccttgcgccaagtccctgacggcgacggcgacttgcagcacggtggcgatgggtgcgtggacagcgacggttctctctctggaggaagcgtgcaatggcgaaagcaatcgacgacaggtccctccctgccattcttacctttcctgtgatggctctctgtcgctctcggcagagcgagtactgataacgtataaagtgaaaaagtgatttttccagaagtaaaaaattctc

SEQ ID NO: 33516 - DNA, 699 bp, Triticum aestivum
  Clone ID: PAT_TA_33516
gccctgtgtaccgggtcctttcactcgcatatatcattactcccacacaacttcctcgctaccaaatctgccggtgcaccaccaacgctattctttgctgaatgccgcaatgatggcactcagactcaggagatgggctggtgctgccctgtcgacgtaccatctccaggcactgaacaagtccgttgcctgtactgtgagtatgccgggagcagggttgtgcatccagcacaggggagtttcgttggacgtggcgtggagcttgagaagatgtggggcggagaagaactatattcagaagagtataccaatgactgcatcatagcgtgcagccgtgagccgacttactgggtggattatctggaagacgattgcatctatcgcagctatcgtcttgatggtagcgatgaaggggaaaagatgatcttaaagaaggggattcctgacgctgaagagatgaagtacttaatagagaaggggtttctgatcatcgaagatgatggtttgtcctaaatagcgcatgcatgcatcaatcacttctatgtatataatgctagagataaccccatgcatcattgttgcgctcatatgcacttgtatgtatgctcgagaaaacacagtttatgatattgtgcttgtatgcttaatgttgccactcctgttggcatgttctacgtaatatttactatcctgtgtttt

SEQ ID NO: 33517 - DNA, 3668 bp, Triticum aestivum
  unsure (1)..(3668): unsure at all n locations
  Clone ID: PAT_TA_33517
gaaacatgttgaagaaaagaagaaggtacatgagaacaccaaaaaggaggaacatgaaggtggggatgggacttctgctgttgctgaaaatgaatcattgaagcttgtttctggtaaaacagatgaaacagaagattccggagataaggatagtgaagaaaacaccaagaaatttgggattgttacaaatgaagattctgaggctgataaggctgctgcagaactaataaacagtattattgaagagtggttaaagactcgacccctgccgccgccaccaccacccctgccggttcaaccatctgctgacatctcatccaaacataataacggggagtctgttgtcgacatggcaatgactgattctgaagataatgatgattgtgttgacaaaaggacagttggtgaaactgaaaagacagaaaatgactctcttgataggaggaaagataaagagcatgataaggagaagcaggaaaaggaaaaagaacttcaaagatatgagcgtgagcgtgagcgagaaagagtcaggagggatagagataaggaactcaagcatagagaagtggaaaggctgtacaaagatcaccttanagagtgggaatccagggagagagataaagaatatcaaagacaatacgagaaggaccgtgagaaggaaaaagaacgtgaacgcaaaagggagatcatgcggccggaagatgaaagcgacgaagaggattcgaggaaaagaagacgaaggaacagtaacacacttgaagagaggaaaaggcggaggcaacgcgaaaagcaggaagacttggcggacaaattaaaagaggaacaggaaattgctgaagcaaggaggcgtgcaatagagctgcaacagcaggcagatgaagcagctgcggcagagtctgctatatttatggaggttgatggtgatgacgggaaggaagcagatgcaccaaacaagccgattgtttcagatgatgataatgttgtcagcagtgctaatggtgttgatgcagatgatggcaaaactcataaggactgtaacggtgatgaagcaagtatggtacctggtcaaattctagatatcaaacaaaatatcaatgctccagcaaaaaagttgggttttggtttgattggctctggtaaacggacatctgttccatcagtttttgctgaagaggatgacgatgataataaggataaacggataagacctttagtacctattgattactccactgaggaattgcaagctgtggaggcggattcttattctgatcaacccaataatattgtagcagctgctgagtttgctaagcgcatcttggtatctaatcaaaaggaagagcagcctgaaaccgaaaggagtaggagagccattgatagatcgaccctaagggataagagtcgaaatgatgaagatggtgcacgtcttggtgatgacagaagagaaatgatgcatgatcgagacaatgataagcccaagttagagaaaagaaagtttttggatgcaaaacaattgattgacatgattccgaggacaaaggaagaactttttttcctatgatattaattttgccccaggtgcctgcttactgcctggctgagttaatggcggcatgttgtctccgctgttcttcggggggtgtttataagtgtacacaaaattacaagccttagatacacaagaagaatttattcaatcaaccggtataatacaagcccaggcgcaagccatctcatacaaatgtcgtttcttcagaaaggccccaaaagaaatagttacagcaacaaataatccatgcccattcgcccaataagcgagcataaaataaatagatgcacaagacatggaaatatcggcttcactagagctagaggtagatcttcaatgccctcagctggtaatttggtcttggctcttagtagggaggatcagggttaaatgctaaagtttccctccagatgagctctttcatatgttcttctgtaaaagatggttgctcaaaatcaaagctgaaaggtgccgggcaagtgggttcttcgttgatgtcatgaagagaagccaagtatgggtgatgcagagcctcatcaacagtgatgcgtctgcttgggtcaaacaccagcattctttctaacagatcaactgcaccatcagacatgttgcggaagcgcaggcggaagtcctgccttgggtactgtggtaattgcttcatgtatcttcgtgcattatcactccgaagaaatcctaggctcgaatcatctggtgatcctatcagctcagtgatcaattttaactgttggatgtaatctcttccaggaaacaggggttgacgagtaataatttcaccaagtatacacccaactgaccagacatcaatagcagcagtatattgtgaacagttcaacagcaactctggtgctcggtaccaacgagtgaccacatactctgtcatgagatcggtttctgaagtggtccttgcaagcccaaagtctgcaatcttgaggtcgcaatttgcgtttaggaacaaattgcttggcttcagatcacggtgcaagacatttgctgagtgcacatattttagccctcgaagcaactgatacaagaagtactggcaatagtcatcagtcaatgattgatttgagcgaatgatctggtggagttcggtgtccatcaactcagtaacaatgtacacatccttaaaatcatctcttcttggggggcgtattaaatcctttatggcaagaatattctcatggtccatgtggcgaagaagctttatttctctcagcgtccgcttggcatcgatgtggttgtcaaacgcatttccaatcttcttgatcgcaacctcctctcctgtatccgaactaaccgccgcgcagacaatgccgtaggcgcctcggccgatggggcggatggggggggcgtacttggaggcgacctcgaagaggttgccgtagacgttgtagagcacgtagcggccgccgtgggtcgccatcccctggatctgcgcggccccgcccgcggcgtggatgccgccgccggaggtatccatggcctcttcgtcgccgctcgcgaggggtacctgcggtggtgggggggcaatatatgagaagcatgagttgcatgatagaatgaggccttggatctcgaaaaagataatcgaatttcttggtgaggaggaatcgactttggtggaatatattgtctcgtgcaccaaagatcatgtccatgcagcgaaaatgctggagctcctacagtcaattttggacgtcgaggctgaaatgtttgtccttaagatgtggaggatgctaatatttgaaattaagaaagttgaagcaggactatcagtaagagggaaggcttgaagttgaggcaactgtcttgtataacattttctgctttttgtctgcaactgttttcttacttctaagcttatgttgtaagacagctgctgtaaacatttgagtgagatcgaattactggttcccatatgttctgatgtctattgtagaaatgtatacataaactgttgatgctcaatatttgatctgaaattgttgcgtaaaacaaaaaaaaaaaaaaaaaacctcggccgcgaccacgctaatcactagtgaattcccgactcagataaaattgaccacacttatacctgagggttccccgttgg

SEQ ID NO: 33518 - DNA, 1004 bp, Triticum aestivum
  unsure (1)..(1004): unsure at all n locations
  Clone ID: PAT_TA_33518
ggcccaaccaaagncattgattgggatacgctaattgacacggtttgcagccaggcagaggacgtgccagagattgactggtgtgagccaggcgaggcggcagcaatggaggcacttctgggtaccaaggatgggttcctaacggagaggatcaagagctatgattcggaccggaattatcccacaaagccaacggcattgtccggcctctctccctacctgcattttgggcatatttcagcacaaagatgtgctctcgaggcaaaaaaacgtcgccatcttagtcccaagtcagtggatgctttcttggaggagctgataataaggagagagctagccgacaacttctgctactatcagcctcactatgattcggtagccggggcttgggagtgggcgaggaagacactgaaggatcatgctgccgacaaaagagagcacatttacacgagggagcagcttgagaatgcaaaaacagctgatcctctctggaatgcatcacagttggagatggtccaccatggaaaaatgcatggattcatgcgaatgtattgggccaaaaaaattctagaatggaccagtggacctgaagaagcactttcaatagcaatatatttgaatgacaagtatcacatagacggcagggaccccaatggctatgttggttgcatgtggtctatctgtggcctccatgatcagggttggaaggagcgtctggtatttggaaagatacgttacatgaattatgctggttgcaagagaaaattcaacgtcgatgcctacatttcttacgtcaaaagattggttgctcaacccaagaaaaggaaaccggaggaatctctgaattcagcagccaagtactcgaagtctgagaaggactagtccagctactaactctagttccgcattgattttgtttctggtctatagtggtaattggcagttaaagacaacttaaatattgcaattagttgtttgttcaaaaaaaaaaaaaaaaaaaaaaa

SEQ ID NO: 33519 - DNA, 840 bp, Triticum aestivum
  Clone ID: PAT_TA_33519
gacggaatccatggcgctgccgagacacggagaaagaagacgccaggcgagatccatggcgctctggagcacggagaagaagacggcggcggaggtggtcgcggcgctggagctgcaccgccacccccacggcggcttctacctggagaccttccgcgacccctccctcacgctccccaagtccgcgctcccgccccaatataaggtggaccgtgctgtgagtagtgcaatctatttcctgctgcctgctggggagatcgctcggctgcaccgcatcccttgcgctgaggcatggcactactacatgggggagcccctcacggtatttgaggtgcatgatgatgggcaagtcaagatgacagtagtcggtcccgatctacggaaagggcagagaccgcagtacacggtccctccgtatgtgtggtttggcgccttcctgacccacgacattgagtccttcactgatgacggcagtgtttttgtcaagacacctggacgggaccctgacctgcactattctttcgttggagtgacctgtgccccggcataccaattcgaggacgatgaaatggccacacgcgatggcatgaaagctttggctcctaacgcggaagctttcatcaattaccttgttccagcttagtgcattgctgctgcaagtaggttgttgtttgtggtgaacatcttctatctgctagttattgaaaactaatgtgtatgggtgttcaattatttgactttagagagtagttcagtatggaagttgatactcatgtaatcaagtatgcaagttcagtaaggtttgctcttttttcatgaataaataccatccactgtgat

SEQ ID NO: 33520 - DNA, 1711 bp, Triticum aestivum
  unsure (1)..(1711): unsure at all n locations
  Clone ID: PAT_TA_33520
gccggccgggnctgggactagtaccatctcaccaccctcctccctccctccctcccccactccgcccgcaaagctcccccgcctcctccttcactgtgccgcccctccttcccttccccgccccgcgccgaccctccgccccgcccctcgccctgatccggatctcggcatctgcgccggagccgtcctcgcgatcttcatcccggcgtccgccgcggccgcggcggccaaggcggcggcagccaaggaggccaggacggcggcagcccgcaagcaggcaccagcggagcagggtgacggaccggctcgcttcggggccggccctgggggcaaaaaggcggacgaggagggcaggagtcgccaggccgactttccgcgacttgcgatccggcgactccagcgacggctcgacgccgtggtcggacgcacggttccaccgccgccgcggccttcccggtgggtttgcgcgttccgccgccgcaggccgaggtcccgcgcccccgggcaccatgcccgcctaatgctgtgcaacaggctggacctgcagtgaaacgcgtaaagcgcgttcggaagaaagggtaccgagggatccgccggcgtacatgggggaaatgagcaggtgacctccgcaaccgttgcaagggtgtcgcgggttgcctcggaacatacgacactgctgaggaggcagcaagggcatatgatgctgaagcccgcaagattcgtggcaagaaggccaaggtcagattttcctgaggatgctccaactgttcagaagtctactctgaagccaactgccgctaaatcagcaaagctggctccacctccgaaggcctgcgaggatgagcctttcaatcatctgagcagaggagacaatgatttgttcgcgatgttcgccttcaatgacaagaaagttcctgcgaagccagctgaaagtgtggattcccttcttccggtgaaacctcttgtgcccactgagacattcgggatgaacatgctctctgaccagagtagcaactcatttggctctactgactttgggtgggacgatgaggtcatgaccccggactacacgtccgtcttcgtcccgaatgctgctgccatgccggcatacggcgagcccgcttacctgcaaggtggagctccaaagagaatgaggaacaactttggcgtggccgtgctgcctcagggaaatgttgcacaagacatccctgcttttgaccatgagatgaagtactcgttgccttatgttgagagcagctcggacggatcaatggacagccttctgctgaatggtgcgatgcaggacggggcaagcagtggggatctctggagcctcgatgagctcttcatggcggctggtggttactgagggttcttgtctgtgtggtctgcggatagcacaaatgtcccttgcatgtggccaagacgaagaactggtggtgcatgtggccaagatgaaggattgattgcatctgctatgtttcgtagccggatcaaaacctagttatgctgaagactgtatgctgctagcagtggaaccgtatgtcatgtttataagtattttgttgttgtacatcgcctctatgattgggtgcatgttggagactggagtttaataaataaataccttggtcatatgcctgatgtaatgtgtgtgttgagtaagtacatggttgtgcttatatattgttaagtatttacaaaaaaaaaa

SEQ ID NO: 33521 - DNA, 432 bp, Triticum aestivum
  Clone ID: PAT_TA_33521
cgggtcgacaggctgaacagttatattcctcttgattacaatctggaatgctgggaggggggctgcatttgcacccatcatggagtgatgtctgcatgaaattttattgccacccaaggctcgtctctttttatctacatgttcattaccattgtgtacaataactacatgcataggaatagaacatagtgagattatgtaaggagtgcatgccgaaatctagagtgatggtagcaacctgtggacagacccaaaaccaatgatagcaggcagataatagccgccattaaaaatacagataatggctcctttactgtttgtttcccacccaacatgatagtcatagtatacactagagattaactaggtagtaaacatataatattggttgttgcgccgatatctaccccacaaccaattaaaaacttaact

SEQ ID NO: 33522 - DNA, 892 bp, Triticum aestivum
  unsure (1)..(892): unsure at all n locations
  Clone ID: PAT_TA_33522
cnagttgaagccgccggccgttaattancggacctccaaccttattaggggnggaaattttggggtaccccggggcccccccccccccttcggaggttagnntgtggatnatagtgtttgtncggnttgcgttggagtntaaatngttgaatccaattgtacccatttcccatttttttgatccgtccttttgccttcctgtgacctggttcgttcgtcttgatcacatagctcatactggtagtgcttatggttgcacatgtatggtcagtaacactaaaactcttctcggaaagaaggttcatgctcctaaaaccaatagcactagatacaagtaaaaaaacaccattcactacaatatatctatgcccatctctagctgagatggagagcacaaagaagtatgtaattcccaaccactatatatacataacgatggtttcctttaagctaccagcagccgtccgggcaggtactctccaagagcccagatagggaatatgttcctgaactgggcataagtgagcataaggttgtggttggtagctccaataatgtcttgctgagggaactctccatcctctgattggaagttcatcagaatcttggctgctctatgtagacatgcaggatctctttgaccctgcccggcatcaattagggccaacatggcccaactagtgttaactgcatgagccctgtttccttcaagattggtgtaaaccttgtcttgactggaaaggtaactttctccccaccctccagatgggagaagctccttggacaaaagaaattcacacgcttttctgattgctaggctatttacatacgtcctccctgcagcaaccaatcctctcaccccaaaccaagtacctcggccgcgaccacgcta

SEQ ID NO: 33523 - DNA, 415 bp, Triticum aestivum
  Clone ID: PAT_TA_33523
cgacggagaccaagggaccggctggagggtgcggtccggcaggtggcgaggagttgtttcctggagggtctctgctaggattggacggctctatcgggagaggcttatcggagtccaattttcaccttttccgggccattgtttttggggatatggagggttgagtaagatggataacaaaagtccctagttccacaggaggcttctactcagcacactttgatagatgatcagctatgctgttttccgcatggggtatgtgctctatttgcaatccatcaaagtgttcctccaatcttgtcacttccttgacgtatgcctccatcaatgggctttggtaatctttgttgacttgtctcaccacgagctgtgaatctcctcaaatgatcagcttcttaattcccaattatgcggc

SEQ ID NO: 33524 - DNA, 1599 bp, Triticum aestivum
  unsure (1)..(1599): unsure at all n locations
  Clone ID: PAT_TA_33524
actttcttacgggatgtatgtagccagcgacctgtgggctacccttggttctctcagattttgagtatgaatatatctagtttgaagatacggaacaagatgtaagcaaaggacttcttgcttctaatggattctattctaatattcgtattcacaacatacacttccagcggcccgagttgatacctagctatttgttctccacctcctgcttttgacagcagcaccgcgtacttgttgtcaatggcgtaagtaatccccctacaactcgtccttcgggttcgaaccggagctcttctcgccctcggttgtcgagcccgggccctcgggcgccgtcggtccgtgccgctgacgagtctggacgcttcagcttgaacgggatagcagcatgcttcttgaggaacttgtacatctccaccaccgtcccgtcaccctcgaaagttataggctcaaagcttttcttcccagctggatagaagagtattgtggggtatccttcatataaaagattttgtgtatgaatatatgtagagtgtatgttatatacgtatgtgtagtaagaaaagggcttcttgcttttatttattggaacagtagttaatatttgtgttctcagcatacacttgcagcagccaaggttgattgatacctagcttagccattccttctccatcccctgatttcgacagcgcctcctcgtacttgttgtcaatggtgtatctaatcccctacaactcgtccttcgggttcgagccggagctcttctcgccctcggtcgtcgagcctgagccgtcggtccgtgccgctgacgagtccgggcgcttcagcttgaacgggatggcggcatgcttcttgaggaacttgtacatctccaccaccgtccggtccccctcgaaagttataggctcaaagcttttcttcccagctggatagaagagtatcgtggggaatccatcgggcttggcacgaggatgctcattgtttgtgccgtccattttggctattacaagggagtcgatgccacggagatacttggccagcttgttgtagataggctccagtgactgacaatgcccacaccatggtgcatatacctccaaaaggacatcttttgactcatccagaactatttgatctagactcttgccaacaacaactttgacgtcctcatcattggattcaggtactgggtcagacttgtaggatggtgtgagcttgtcctccaggaaatcttgagcaaattccttaatggtgtccagtgatatttcaccactgaagaagaacttcttagcgtcttcattcccagtgtaagcaagaaccgtggtctcttgtccagcaattccggggcgacccgcgactccggccccgacttcctcattgtcacgctccacaaagacaaataaaagcttccccttgaatgattntgctgtttccttaatgatgggcagaaattttgaggactccttcgcaacagcaaacagcaaaatttgcttcttgatcggattatcgaaaatcgcaggggcggtctcctgtgtgagggtggtgatcaatgggattttgttggccgaaacaaacttggcaatcgcagatgctttnaac

SEQ ID NO: 33525 - DNA, 1283 bp, Triticum aestivum
  Clone ID: PAT_TA_33525
cgtctcatgcacgcctaccttatcttggctcctctaaacgggcgggcttttttttttttttttttatgttctttttgtgttccttgaaagagggaaaaaatattgaatgagttattatacgcgtccgaactgacatgttcgagtttttggcagcagttgcaggttcacaccaaaccaaatgtaacagtaattatgcagctgcctttagggggaaatttacacatcatagaacaaatcgccactactggacaaggcaaacaaacatccgaccaacatgggtgtgagacaatggaacatgagtgcagcataatccggcacctgcatgagtgcaagtcttggaaaacaggaatacagctggttccgcagattggcaacctttgtaattatatcagtgttttcagcatggccgttgtcacggaccataggcgccaccgcgtcttatcccgccataggcaccgactcatccacctctgcgcaccaccaggttacatcatggggcatcctgctgaactgccggccctggaaaatttgcagctgcagagaagcttggtggtattgttagatcagtcgcttgggaaggctggtcagcctgtctgctgctaatgttggcatcgttcccacccatgaacggtgcaccctcctggacatggaccaagccaccaggcgacataggtgacatatcagatgcgtcagccagcgattgtctaggtatgggtgcagcaacatcagacactgaaccaggtagtggtacaggaagtggcccagttacagcagctccagcttcagttgcaggtggcaacacatcaaaaccagatcttacccgcggcctgcgttctactggaccctgatcacggcttctgctcctgctgcgactacggctgcggctccgtgaccaactcctgctgcggctcctgctgcgtgaccagcttctgctacggcttctgctcctactacttaggctcctgctatcacttcttctgtcatagcctcgcgagcggcttctatctgggctacggctgtagctcctgcctcgacccttgtcaaatcctcgacggccatcataccttccacgtccatctgagataaaacgatcatgtggacctcggtcagaacatccccgtcctccaaatccacgccctcttccaccacgtccaccagagaaatcaccccggcctcgtccaccaaaaccagaagaatcacccctaccacgaccaccaaaaccaggagaatcacccctgccaccgtgaccaccaaatctaccagggcttgctccacctctcctg

SEQ ID NO: 33526 - DNA, 1274 bp, Triticum aestivum
  Clone ID: PAT_TA_33526
ctctaaccccgggggggggggggggtgttttgttgtttgtcttttccgtttttctgtttctttttttttttttcgatagaaggctattttcagcattattgataaaccgattgtgcaattacatcagtcagcaacttcataatgcacaaggatacacacccaagacattaagatccttataagctgggcatgtacttctgcccgcaacttcataatgcacagggctacacactgcgatgacattaagatccttataagctgagaaatgtacttatgctcctcaaccgatgactcaaaaccgggctgtgacctgggagaacagcgctttgaaatctttcgtgggggtgccctcaccttcaggcttcgaagccaaatcgaatgccttgaactttacctcttcatactgcagggcctgaacacaaacttcagccacatcagccctaggaattgccttagtgtcagtctggagaagctcatcatccttcccaacaatcagctccctcactccccgatctttgtcttgcagaccaccaggccttatgattgtataaggaactccactgtctgccagatactgttcagacttgcgcttccagaccagtatattgccattgccaaggctgttcaatggatggttgggatttgttccccccatggatcccaccaagactatgtgcttcacaccagctgctttggcagcatcaatctgatttttctgcccaatccagtccacctgctcagggtaggctccgtcctcgtagtagaactcgggccggccgcccttggtggggtcgaaccccggcttcatcttgggggaggcgctggtgaggatgacgagcgcgtcggcgccctgcacggcgggcgcgaggtgctccgcctccctgatgtcggccacgtagacgtcgtcggctcccccgatcttctgcttgctctcctccgacctcaccaggcccctcgccgcgaactggtcggatctctccctgagcttgctgaacacgatttggcctgcgcgccccccggcgcccgtgacgaccgcggtggcccggcgcgccgcccgggcccgtcggggtttggtcggagaaacgggcggggaaggaaggagggaaagggtatctgtgcggccgccggcgccggtgacgaggacggtggggcggggcgcggccatggccggagggtggtggcgcggtactgcaggctagctggccgcgaactgcagagcgcctggacgcagccaagtgccgatgtgtcacgagagaagcggcgaaggatgagac

SEQ ID NO: 33527 - DNA, 2079 bp, Triticum aestivum
  Clone ID: PAT_TA_33527
gggttccctttttttttaactaattgaaaatacagtcttaaaattgaaaaggaatttctaattccagtctcatttgcaaaacactgtggattcccatgaaaaggcatggaagatttgctaccacaataaacaaaagagctatgacggatcacacactgggcaacatacagcatgacggaaatcaaaccatcgcctgtagcaaccaggaaagacgcatactaaaccagccacgcgaggacgacctcctgaaaagagtataacccaaactccatcctttttatcaaaaatcccttggtaaactgagtgccatcataaaattctttgaaccatacacactgaatgtaactaattgaaaaatacagtcttaaaattgaaaaggaatttctaattccagtctcctcatttgcaaatcaatgtggattcccatgaaaaggcatggaagatttgctaccacaataaacaaaagagctatgacggattgcacactgggcaacatacagcatgaccgaaatcaaaccatcacctgtagcaaccaggaaagacgcatactaaaccagccacacaaggagtacctgctgaaaagagtataacccaaacaccatcctgagcctcgaccaccctatagaagcacaagcccaagctcagatggcttgattccattgcgaatgcgataattgtagagataatagtgcagctgcccatctccagggccaaacttgagctccttgaggaacccctcgttctccatgacatcgagcgcgttgaacacatcatagttcttctgcttggccacaatcagtgcatcattcatcagctgctgcaacggggtcttgacagcaacattgtaatatgagtatgcggccttgagtgtcgagtagttggcattgttcagcacggacgagggcagggtgtaaaagctgcagaaatctgtgacctcgtgcgtctcagggctctccacaaggtagctgtccaccacatcctcctgggggagcaaccagtgctcaacatcaagctcatcaaaatctggcgccaccacgtaccttgcaaggtatgccctgagcaagcgtgtgactgctgcaacatccctcaactccatctggcggaacccaggggtaagcggcgcatcaggcagcttgtagagccggaccgtgcggctcatggtcatccgaggaccaagacgggagaagccaacgtcgatgagcttcttcgggttgagggatcgatgccagtagcggcaggtggtgatgggggtcgggaggacgacgcccgcagtgtaggcagcctgccagatgttctccaggtggacgcgacgggtgacctcacggatgagcaccggcgcgaggcgcttggatcggagcttcttgtggacgcagaggaagttgatctcggccatgcggacaacgtcgtcgcgcgcacggatgcgcgcggggacgccggatatgaaagcgacgagcttcttggactccttggcccggacgccaatgtgccaggcgcggaagaaggagggggggcggagcgcccagcggaggaaggccggggagtagttgaagcggaacatgttctcgtcgtcctcgacgtagttgtgggcgaggagggcgtagaggtcggcgaggagggcgtcgtcgtcgaggtcgcaggtgaaccactcgaaggcggcggggagcgggtaggggtcggcgcggacctcggagagcggggagggcggctcgatggcgccgtcggggagggagacgtcggcgacgtcgccgaactggcccacgggctgcgtctcccagaacttgtggcggcgggcggtggggttgttggcgagggtcatgtgctcctgcacgcgccgcgccagcgcctcgatcgaggtgtcctccggcgcggcgagggcggcgtcgctggtggaggcgctggcgctggcggcggcggggtcgttgttgggggcggccatggcgatcggcgcggtggggagggctggatcggctgtagggtttgagagagagatttgggggagaagactaggcgacaggccgggtagtggaacgcgaggcggaggcggatcggatctgctcgtgccgacgcgtgggtcgaccc

SEQ ID NO: 33528 - DNA, 906 bp, Triticum aestivum
  unsure (1)..(906): unsure at all n locations
  Clone ID: PAT_TA_33528
cgtcgcccccaggccccctcggcccccgagatcagccccccttccaccggctcaataaacccgctctgaaggaagtcgcggaatcggcctgagctcgcaattcgtcgtcgtcgtcttccccagcacaagcacaggcacccctcgaagcggcgggggcaccaagctccgaaggccgcgggggatgccaagctcctgatccagtccctcaccaaggcctacgccgccacgcccacgaatctcaagatcattgacctgtacgtggttttcgcggtcgccactgccctggttcaggtcgtttacatgggaatagttgggtcattccccttcaactctttcctgtctggtgtcctgtcatgcattggaactgcagtgcttggtgtttgcctccgtattcaagtcaacaaggacaacaaggaattcaaggatcttcccccggagagggcctttgctgatttcgtcctgtgcaatctggtgctccacctggtgatcatgaacttccttggatgagcaactgtcatacaagctgtcgagattttgtagtgtcctaatgtctaagactgtcagcatgttagatattcatgtggcaccatacacacctatgtaatccgagagtttctctatgaactataagaattcagtggatttagtgttaactttgtggaacatgagaacttattcgattgagtgaagacagcgaaaagtgatcacttaaaaaaaaaaattgttcaaaaaaaaaaaaacctgcccgggcggccgctcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33529 - DNA, 1270 bp, Triticum aestivum
  Clone ID: PAT_TA_33529
gcacgaggcggccgcggcaccccgtccctaaccagtaaccaccatcgcttcagcctccacacttcattgacttaaagcaatcgcccagtccagtacaccgatggctgaccgctgacgccagatcgatcgggagccccagctcgccggtgagtccattctggatcggctcatcggtggagccgtgcatgcctcagtttccttcgtcaccattataaataccgccccacccacacgccggcgaacacatcggcgcacacacacagtcacgcactaggcatttctttctttccccgtccgtccgtgcgtgctctccggagcccacgcaccacgacgtagtacgcctcccctcccgctttctctttctctttctcgctcgcgggatggggataaagtggccgggccaatgcggcgcggcggcgtcgctggccctgcttctcgtcctcctcgtcgccgcgccgccgcggggatgcgttgcggctgcggggagcggcgggggagggctcacgaggggcagcttccccaagggttcgtcttcggcaccgcctcggccgcgtaccagtacgagggggcggtgaaggtggacgggagagggcagaccatctgggacaccttcgcgcacaccttcggtatgtactttacttctcctgtattacttctctactcctataaaagactcagttgatgatggtggtgtgtctgtcaaccatcatttccgaccattaatctgcatctaacgactatggggtaagttatgctatttttacaacactagcccacttctctgcttcaatttgcaaaaaaaaaaaaccttagtatcttcaaaccaaccacatccctccctcacctcatcaaaatagctcgaggaatatattttaaatgaaacataatatatttttagtgataaatgtatatcaaagagtgttttcttttaaatttatgaccaaatagtattttacgttaaatccgttgcaacggataggcacattgctactaccactaaccagagacagtaccccaaagctagtcctctcagtgcctacagctacagtgcagccacgtgcatcgttaagagcatctccagccgttggcctcccaggaggggctaaaaatcgtccctgggggcgcaccggcgctaaaccgcgcgctgggggcgtgatgccccccgttgcggcacccacgttttttgaaaaacttaaatacggcgcaaacacggctcaaatttaacgcaaacatcggcaagttcgttcaaatttaaacatattttataaaa

SEQ ID NO: 33530 - DNA, 653 bp, Triticum aestivum
  Clone ID: PAT_TA_33530
cacattcgatccaacgcccaaccgtcgtcgtgctagttgcttcgctctgctgtatttggtgcgcctgatctggccatggcagggccgggcgagaagccgtcgtccacctccgccaacggcaacggcacgaaagccccgctgcctccggccgctcccggcggctccggtatagctaaaaggcttccccgccttgcatttgtgttcctgcttgcacttctgtaccgtcagcttcaggctccgcctccaaaaatctgcggatccccagacggccctccggtcaccgggacaaggatcaggctcagtgacggcagacacttggcttaccacgagtccggtgtcccgaaggaacatgccaaccataagatcatcttcgtccatggattcgactcatgcagatacgacgccctgcgagtatcacccgagctggcgcaggagctcggtatctacattctgtccttcgatcgacctggatacggcgagagtgaccctcatcctgcaaggaccgagaagagcatcgccctcgacatcgcggagctagctgatagcctgcatctcgggtccaggttctacctcgtcgggttctccatgggcggcgagatcatgtggagctgcctcaagcacatcccccaccggcttgctggggtgtctatcct

SEQ ID NO: 33531 - DNA, 863 bp, Triticum aestivum
  unsure (1)..(863): unsure at all n locations
  Clone ID: PAT_TA_33531
ggcccgcccggcccaggacagactcaccctgcatccatctatctcccctaaaacctaaaaacacgagaagccctactctgcctctcctcccccgaattgccgcctctcctccaccggagagagaagccaaggaaggatgccgcggatcacttcggtggagagccccggctgcccgccgctccgcgccatcaccaccgacatcctcggcctcatcaaagtcgtcgaggcccgcactagaccggcgggcgtcgccaaggtcgtcgagacgtggggcgaacccgacgcctccagggccatcctcgtcgcttcactcgccgaccgagccgtcgaccccgttttggctgtggcaaggaagaacggtgtggttgagttgctgaatcccctgaatggtgatgctctggccgctttcaagttctctaggacagaccaaactgtcggagctgtggaaaatgatcccctagtcgccctgcacctcttcagaaaacatgcaccagacttaaccacgttaggtacatttcttgcttgtacggagaagggcaaagcaagtgtgagatctgttgcaaaagaagacacggcatctgactcggatgttgggccatcaagcacttgggacgtgtgtaacgagtacatggcattttaattgngganctgggnaaatatccaatgttcgaggaatggatggaangaacttggggaaatacatntggataagagggggtgggtaaattcccgnctaacacgngggttnttaccaactttgttactgtggaacttctttgcaggnnaacccnnaaatnnnnccgccaaaaaaanaggttngttnttnaactgttnnaaaaaaactntttttnttttttttggnn

SEQ ID NO: 33532 - DNA, 458 bp, Triticum aestivum
  Clone ID: PAT_TA_33532
gacgggtttctgcggcgacgtggaggtagtcgttgttgttgttgtaggagaggtgcgttaggtgcagcgggtgctggtggtggaagacgcgcaagcagttcattaaatctgttatcgagctttgtttcgaacgtcttctcaaggccagtgatcttctccatggcctcttcaaaattgttcagcacatcttgcacctgttcagtcatcatttgctgaaacttatcatgaagctccttgttcgataagttctcccagtcaatctcgtcggcttgtgatcctggcatggttagcagcaatagaaacacacaagaatatgatcctacagactactaagaagtggtggtggtgtgtcacatatctgtcaggcaagtctcggattcttaccagttcttacccaacagcaggcggtgagtcggaaccgttgtagtcagcatctcgcaatgcttggatagagcgat

SEQ ID NO: 33533 - DNA, 1383 bp, Triticum aestivum
  Clone ID: PAT_TA_33533
gcagcaccacctctcagcctcgcacgccgcgtcgccggcgcctcctcccctgccgccgccgcgcgggccaacggcagcaccacctctcagcctcgcacgccgcgtcgccggcgcctcctcccctgccgccgcggggcattcctcctcctgtccccgctcctttcgtcctcgcctgctcccttcaaagcggtggagtggggtggtgaagatgggggcggcagtgggaggcgggcaggggggcgaggaggaggagacgaggcaggccaaggagatggccgctgccaggaggcggtgggagacgctgatcagggagcagaagatcaagacccttacaccaagggaagctggctatacattcaaactcacggacaaggtccttctggatgttaggccttcaaatgagcgtcaaaaggcctgggtgaaaggttctacctggattccagtattcgatgtggatacatcgtctgatttgaatggcctcagcaagaaagcattcaactttatgattggtggctggtggagtggcagctcaacaatgtcattcaataagaactttgtacagcagaccgaggagaagttctcaaaagatgcagatatcatcctagtatgccagaagggactgagatcaattgctgccgcagagcaactttacaatgctggcttcaaaattttattctgggtacaaggaggattggaagctgctgaagaggaggactttgagcgggaaggttcccagcctttcaagcttgctggtatcggtggggtttctgaattttttggctggacggatcagcaacgtgcacaggctgcaaaggaaggatggggatatcggctgctcttcacgggccgattggttggagcaattgtgctagcagatgctctgtttgtgggtgcccaaagtattggccctctgcttcaacaattacagcctcattaactgatcgattccgaggaagatgctgcggtgttcaagctaacttgaaggcggcatttcggccgctcatcgagagagagacccaaaacaactgcacgaggacacagttgcggccgttcctcaggcctgctatgatagcacacagagacggaatgttctttcctagaagtatctagttatgaatctagagcctcatttctgactcaatgaattacagaagttcaggccgcacaggataattatgatttcgtggaattctcctgttgaaaattctgttgagaaaaccttagtctcaaaatatcacatgtgtggatttttttttggggaatacgcaatcgcgtaccttatctttatagaaggcagaaatatgtacaagagatgaatcttacactacgccgaggtgactcacaagtagttcacgactcggtcctcgaaactccactcctact

SEQ ID NO: 33534 - DNA, 1147 bp, Triticum aestivum
  unsure (1)..(1147): unsure at all n locations
  Clone ID: PAT_TA_33534
aanaatttatcaggnaaagcattttgctgggacttcctatggtcaactaatttgcggccgtgctggatattgtcttgttgttgatgtgttcagtggtgccgtggtttctcccccacgtctcccattcagcggtgattttgagtttgggagggagttctacttcagtggtactttgacggctcccattgcatcacccaactcacacctccttgtcagtactgcaatctccctgtttgattggccggtcggaagtgactcttggtctgaactccagctttctgatgaatcgatagaacagattgtggaattcaatggtcagttcatcgccatggatgattgttataagatctatgctttgcagctgcccccccagcttggtctgcaggagataacaactgagtgggtcggtcacctgcccccaagctcgtacacgaaaccatggctagtggtctgcggcgatatgcttctcatggtttcctgtttctggacagtgagctcaggcagctcagtactacaatgtataccccaccaccttgacatgtagaccaatcctgcaaaatgggtcgaggtaaaccagctggataattgggcactctttgttgggggtgatatgaggagccggccgttttcttgcatgagcccggaaagatggggcgggaggagcaagtggctgtactatgctggacctagctcttttattgtacatggagtgggtgatgagcgggctccttctgccggccccaaggtagagtactggagaagccggcccatgtcccgcaagctgcagcccctttgggtgtatccaagcatgttctacactgatgcacagtgaccatcgcgcgcatccacggcttgctgctccacaagctcctgatgaaaatccccccctgcaacacagagtaggggcttttgcaacttgggcggtgccatcgtagcattagcacttagaacatttgtagcagtttggtgaaccagtatctagagcctgggagattagtgcttagagcttcttaggagtagtcaagcttctaggttagtactattaattcagctgtgttgtttaattatgcactggatgatgtgtaatactttgaactacctgtttcttgtctctgctccagtgacacgagttctaagcttctaaaaa

SEQ ID NO: 33535 - DNA, 890 bp, Triticum aestivum
  Clone ID: PAT_TA_33535
gggatttcttcgctggccgcgtgtccatcgatggtcggaggctcgtgcggcaaggagaggggctggggtggtctgcggcgtgctgggcggcatttggagcttctggggcgagcgttccggctgccccccctcttccgctcttgctgctggtggggttgggccgccgcgggtgccgcttgtgcgactgcgtcggcggcgctgttggcggaggtggaggttgctgtgggtcgtattggagctgcgcggacgccggacggagggggacggagcttctatcccggtcctgttgcagctgccgtctctggtcggtgcgttggggccggccttcttcgtcggtttcgtctctcggtataccattccttcccctctgttcttttttcctacagttggagtgttcctctcctgcgctgcggtatattattcgatccccttgtttagctgattgatgtgggaggcaatttgggggagttggtcaagctgtctacggtccaggcttctggtggggatgactgcgtttggaggaggtgtgcttcagctacgtctgcgcctcatgtggtcgcttcatcctggtggccggctcacctggtgaatgcgtccctttgtgttcgggcatgtatttgtgcctttattctgtgattaccgtggtgtgtcgccggcgtatttagggattggatgtgtgttgcgcttgctggggccttttgtaagtcctcttttttttttccttcagcattggtttttcctgtacggaaaggaagcctgtttaattagctgctaccatctccgtgcatgataagtggagttatgtttgtaagcttagtttggttgagcttctttcccctgtattttccatggtggacgagtcaacgtttgttatggttgttaaacaaaaa

SEQ ID NO: 33536 - DNA, 774 bp, Triticum aestivum
  Clone ID: PAT_TA_33536
ggtcctaatcactaatcaatcgggggaagcacgcgcaccgccaccaccggagtctgctcgtgaggcgaaggggagtggaggagaaggttttgggtcgttgtgtgtgtcgccggcgatgggcgcggaggcggagtgcgacaggataaaggggccgtggagccctgaggaggacgaggcgctgcggcggctggtggagcggcacggggcgcggaactggaccgcgatcgggagagggatccccgggcggtcgggcaagtcgtgccgcctgcggtggtgcaaccagctctcgccgcaggtggagcgccgccccttcacggcggaggaggacgccgccatcctgcgggcgcacgcgcggctcggcaaccgctgggccgccatcgcgcgcctgctgcccggccgcaccgacaacgccgtcaagaaccactggaactcctcgctcaagcgcaagctcgccaccgccaccggcggcgcggcgtgggaggaggccagcgactccggcgactccccgcggccgtgcaagcgcgcgagcccgggtcccgagagtcccactggatccgaccgcagcgagctcagccacgggagcgggcaggtgttccggcccgtcccgcgccccggcgggttcgacgctatcagcgcggacgtgaggccgcctcctccgcgccaggacgaggacccgatcacctctctgtcgctctcgctacccggactggagcacgggttccaccacgatagcgcccggagccacttccaggagctctcgccatcgccacgctc

SEQ ID NO: 33537 - DNA, 768 bp, Triticum aestivum
  Clone ID: PAT_TA_33537
ccacgcgtccggcaaaacaaaactgacccggggaaaaagggtcgcgctgtgctctgaccacctccgcatctccctctgcaatagccgtcgcgatctctgcgtcgcccgaagcatcaccgccgccgcgtccagtcgctcctccccaccatgcgccgcttcctcaccgacagggcgcgccgcgcggtggccgcttccctgcgcggcgccaccagaccagccgcgccgtctccggctccggccgcggcgctgtctcgaccttccccttctgctccttcggcgatggcggcctacatggcgagggccatgtccacttcggccgccggtacgccgccagtgtcactcgacaccatcaaccccaaggtcttggagttcaaatatgctgttcgtggagagattgttacacatgctcagaacttagaacaagagttacacaaaaatccagaatcgcttccttttgatgagatactctattgtaacattggaaatcctcattcccttggtcaacaacctgttacatttttcagagaagttctctctttatgtgatcatccagctctcttggacaaaagtgagactcatgctctatacagttcagatgctatagagagagcatggcaaattctagagaagatcccaggaagagcgacaggagcatatagccatagtcagggtgtgaaaggtttgcgtgatgaaattgctgccggtattgctgctcgtgatggtttccatgctagtggagataacatcttccttacagatggagcaagc

SEQ ID NO: 33538 - DNA, 827 bp, Triticum aestivum
  Clone ID: PAT_TA_33538
ctcgtgccgaattcggcacggtaaaggaagcaggcaaagcgagacgagagcgtagcagtcagcgtgagcaagagagatggcagcaggaacggcctgggcgggatgccatctcgcccacctcccccaaattcccatctcggtcagcatccccgtgaccggcgctgccgctagcagcaggaggaggaggtgcggcttagcggcggcggcgggggcagcagcagcagcagcgacagacgggcgggtgctgggccggcgccccgtggaggacgtgtacaaggtgcgcgtggtgcgcggcgcggcggcgcaggagcgggtggaggcgctgcgggcgatggagacgtggtcgacgtggcgcacggggggccgctgccacctggcctgggactggcaggtggaccagctcgtgtacatcgtcgccggcgaggtccgcgtgctccccgccggggccaccaccggcgaggagtacatgcacttcgtggccggcgacctggtccggtaccccaagtggctggaggcggacctccacttcgacgggccctacgaggagcgctaccgcttcctcgcctacggcgacgacaactgaaccgcggcgccccctcctagctagctcctttagtccttctactactagttcactgaagctttcgttcgagttctagccatatagtatttccttttgtttactatatactcctagcctgggacaataaggagtatttcctagtcgatcgtttgagttcattcgagaagcactgcacaatctccttgttgtacatttgatgattcgattggacattgctggtagccctcaaaaaaaaaaaaaaaaa

SEQ ID NO: 33539 - DNA, 912 bp, Triticum aestivum
  unsure (1)..(912): unsure at all n locations
  Clone ID: PAT_TA_33539
acttcttgctgaaaattgcctgagcttcttgattttgacaaagacttgattcatctggaagcagcttcgaagatccaattgaagttgcttgcntgaagaaatgcaagcaataaacaaactctggacatggtaggaattggctgcttcagtgactcctaaacgctggagcaagcatatctgatgagattagttgtgctatatcagtaatgattcttttacgagtgaactgagatcagttgcttccgcaggcattgaaatcctttctcgactcggcagaagctgtagttaggtccctcatttccttgtattcagaagtggaatggtctattttggtgaatatctcagtattttggtgaagatccagctcgctgcccttttgagcaaggttttgtgtggcctttataatattttacagctttattaggcaatggtctcgtgtgtgggccctcataagccgctcttccatcgccgtgccccgccgggggcgccacagcatggtgtactttcaccggagcccgcttctcccttttgaggcccctggtcgcactcccaaaggtgtaatgtcacaaggcttaggctcgttggctgcgcgtccaaggttttgtgtggcctttataatattttacagctttattaggcattgttctcttaattatgtccacatatgtagctcatcatacgccgaaggtggtcagtgaagttacatctttgagtaatatatttatcaatttcactatgacaattcgctgatcgcactagcagaaggaaaaataacttcaaagtattgcccctaatcccttgaggaagttcctctcataggtccaaacattttgttgtccagacagtgcatttcttcgaatcgaattgctgtttctagggaatggtctatcaagtggcattctctgttctttt

SEQ ID NO: 33540 - DNA, 917 bp, Triticum aestivum
  Clone ID: PAT_TA_33540
ctctcccctcgccgccgccgcgattccggcgagtttcggcggcacgcagcacaccgccgacaccccctcactccggtccttcctcctctccggccagattcacggctaccgcgcgcaacccctcccaatccccgtggatagggtcgtgggcatgtccccggctcgagctgcgcgccaagatccacggcaccatcctcctccatgatccaggagaggcggcggcggcggaggagccaagccatggaccctagcccgcggccatcaggatccgcaggcaggaggcgcagccatgggaggagcaggacgacgccatggaagggtcaccaacaactccggtcttctccatggacatggaggtcctccgctgcactccctgatgcatcaagcgcgcaggcatacaaggaggctctgcttcttcccaggtcgccatggaagattattcttcaggttgatactaacttggcaatgttgctgttccgagaccccgctgccgctgcggacgccatggagaccgtcaaggcgcagactggtgtgtgccgcctcttccatgggcgtccacgccatggagctccttaagacaccctcaatgatgaccaagggggagtgcaggacatcgaggacatgatatgaaccgccgttccagacgcccgcctcggggaaggagcactccatcccgctgataacaatggtttgagagaggagatgacggatttggtggaggagaggaactccctcaaggacgaaaagaggagccctgtgtacagaaaacttgtgatgctgctttgtcaagtgcttgtgtgggggcagcatgattgattcggtactgcatcatccccggttaatgcagaggacaggggctcatcgtgtgtgtctcccttcgaccaagaggcacgacgttgttcggcactggctgcaaa

SEQ ID NO: 33541 - DNA, 1149 bp, Triticum aestivum
  unsure (1)..(1149): unsure at all n locations
  Clone ID: PAT_TA_33541
gccggccgggcatggttgccccaggtagtgctgtaattccatagccgtctatgattccaaacgctgtttgtaactacctacgaatcctctccctggtgcgacttaccgcccatggctaccaggtggtgatagcaatccacagctaatggtgcgattatatcttgctttaaggaggaaggtagctggagtagcctgcatctttcagctgcgcctggtcaaacatggcttccatggggttcagctatgcacctgattattatcttgcttagagaggaaggtagctagcctgcatctttcagctgcgcctggtcaaacatggcttccatggggttcagctatgcgcagatacatgtgcggcaggagaaggtcaggcagaggatcaaccaacaagaagccgccaacaagacggccgtgaagaacaagaacatcggtgaagaagacaagatcaacaagaaaaactgtgattcgtggaccaccgccggcagggtgcatccgtgcgcatcttccacggcagcggcggcggctacggctaggccagtgccagagaggtgaggctggctggcgatgcgtcttctcttctctgagtagttttagcttgtctcaagatttcctcaaggaaataaagatgtgtgctcatatatgtgttttttccacaaacttggggatatcaatcaacgccaaacaatcaaatatgctccagcaaaaaaaaaaaaaaaggttcctacaggcctgcctgtcgactaacanagagactcactanaagatgcaggaacagagtattttttacatggccatagagccatggnattggtactctcctatcttgagactggaatcttaatattgccaagaacctagctactgactaaaagtgcttgatcctgaacttccactcccccttcacggcatcaaacgccacgaattcagngccattcttctcggtccattgcgccaagaatctccttatactgtcnacttctgccccctcccgtcaactgcaaaccggtcttctanccgngcacttcacatcaggagtgtgtctctcaagcttgttagctccgcccaaaaggangcncttgccnnaccggngtnacaagntncncggccctnaacncaccatgganngttcacntccnaancggntcccaa

SEQ ID NO: 33542 - DNA, 1527 bp, Triticum aestivum
  Clone ID: PAT_TA_33542
acgtttaatgactcacgccttcttggttttcacccattgtgcttgataccatattggggcagcaagcattgctcgtagcttagcaagctattttatccaattcttggagctgattccgtctgtgaaaggcaatgttccaagttggattgggcatggagaagagttttttggtggtgttatttcagttaacatattggctccaatccttcttgtcatcctgactgtgatcctatgccgcggtgtcaaagaatcatctgcagtgaatacctttatgactacattgaagataatcatcgtcatagtcgttgtatttgctggtgtgtttgaggtggatgtatcaaactggtcaccatttatgccgaatggtttcaaagctgttgtaaccggatctacagtagtcttctttgcatatgttggatttgatgcagttgctaattctgccgaggaagctaaaaacccacagcgggacttgcctattggcatcctaggaagccttctggcatgtgtcatcctatatgttgctgtatgcttggtgattactggaatgttgccatatacattactgggtgaagatgcgcccttggctgaggctttttctgcaaaggggctgaaatttgtaactgttttgatcagcattggagctgttgctggtcttactacaacacttcttgttggtctgtatgttcagtcacgtttgtatcttggacttggaagggacggcctactaccttcaatattttctaaagttcatccaacactgcatactcctctgcactctcagatctgggttggttgtgttgcggcagtcttagctggcctctttaatgtgcatgcactctctcatattctctcagttggcacactgacaggctactcggttgtatcagcttgtgtgatcacacttcgatggagcgacaaagcaactaattctcgctcccttggaaaaatttcaatctggcaggagggtgttttttgtcttgtcatagtggctctctgtggtttcatagcaggaatatcctaccggtttagctattctattgccttcatcatcatagcttttctgatagctaccgctggcagtttttctctgctgtttcgacaggtgtatgttcctgtggacccgcctcgcttttcttgtcctggagttcctatggttccgattgtctctgttttcttcaatatgtttttgtttgctcagctacatgaagaagcttggtacagatttgtcatccttagtttcatcgcggtgggggtatatgctggatatggtcagtacaacgctgttccgtctacttcggaccactcgtctgttgcataccatggagtgccttcggaagccccatgatctattgcaatcctccaagtttatctgaaaatccatgtaccattggatcgtcaggggaggccatggccgtaaccctttacctgtattgctcgaagccgtatgtgtagcacggtctccatagttccatatgtacatttgtatgaattttggaggtcagccaccatatcatttaacaatgaaaa

SEQ ID NO: 33543 - DNA, 1249 bp, Triticum aestivum
  Clone ID: PAT_TA_33543
tggattctcttccacacatcgctcagttcccctcccactcccccattctccctcccttctgtgcagcgccgccgcgcccacccctcatctgctcatcggtcttgtcgcgctggtgaagctcgacggtcgttttaagggcctgcaccgttgtgccctccacccgccccgccgtagcttcgggactttgtgcggctccctcttatttcagctccacccgcgccaccgtcgacggggcggctctctccgacgcctacagggcctcctcgcgcggcggcaccggcgctcctatccggcagaggaggagtaggaggccgctgcttcctcggcctggtcctgctctccgacgacgagggccggcgaggagacggttccaaaggaccgagctcttgcgacctacacctgttgtggataaggagaagtttgtactgttgtatggcaggtagaaaatgcggcgtcaataaaagtcgtggcaatggcaagacatccacgggctggtgtatgctcatttggattgagatcatctaccatgattccttagactgacaaaggtgatgaagaactgtgtagtgtctatgtgccaaccaatcatctatatattggtgatatctttttggtgaactctgctgaaattataaggcccaatctgtccattcgagaagggatagaaataattgtttctggaggaatgaccatgccgcaggtgattacagcgctaggacctgcccctgataagaacgagggcacccgtttaagcagaatgatgactgtctgaagcttcagatatcgccagcatatctcaggtatagtcgaagaacttcccagtactccaggccatgtgggctgcgactgaacctagatttctgatcactggcctaagttcctgtaggtattgacatttaacctttgtagatgtttacagctactaaaggaatgccaaagtcatggttgatgctacatctgatgtacaatttgtagattagaagctggaacacaaggactgtgcgatagagtaaacaccggttgtatattaggcgggttagaaattaaagtggggtgctgatgatagtcgcgcagcacaccgcacttaggtggcttactgagattactgataatggtttgtggttcttatgtgctcacagaatgagtgcttagttactcatgttaggtcattacaatgtaacttcaactgagacaggttaattttttttaacttttgattgatgctatcgcattgttttgtcagaaggat

SEQ ID NO: 33544 - DNA, 805 bp, Triticum aestivum
  unsure (1)..(805): unsure at all n locations
  Clone ID: PAT_TA_33544
ggtaattcanagttanatcgaatagttatatcaggggtttgatcattgaacttagttgattaattccttatacatttttatcctgagatagtccctacatttccnatcctgagaaacctattttttttctattaccgggttagcaaaacgggttgtgtgggagttggggttgggcaagtagcacctctttgattaagtccacatcataattgagaggcattgtagtagtggatcagttcatagataatgccatgttttatatgcaatgcttcaatggttgtattaccgggttggatgagtgcacccaaatacagataagagaccaacaataacaaacaattggttaggctctgtcaaagcggcagggatcagagagtatcatatgtgtctttgccttcaaaattgaaaaggggaaccattcctccctgttcatgagctttgaaaggttaaggtacaatatcgcaagtgcaatttttgtctacacataaatcgttctatgcaaagtatctaacagattgcatgcatcaggttaatgtgacgtgccgtctatgaagttgatcaacaaggcagccgaatgaagcaacttattagtatgcctaatagctatggctacgtagtttttacttatttatattgtgttggtacttcctctctcatatttgcgctcttagtaccgagcttaatatcaagtggtttccttttgtggtctcatgaacgcactaaattgaatgctgccttatttatcatgaagatgtcaaacgcgatgacgttttgctcctattacatgtgaatgtttcctcaaaaa

SEQ ID NO: 33545 - DNA, 565 bp, Triticum aestivum
  Clone ID: PAT_TA_33545
acccactcgtgtcttttaatccacccactcttcttcacagcgagcggggtcgagatcctggaagacgagcggcgcgtgctcagcttccggatcgtcggcggcgagcaccgcctcgccaactaccggtccgtgaccaccgtgagcgaggtggcgtcgacggtggccggggcgcccgcgggtgaccctggtggtccgagtcgtacgtggtggacgtgccgccggggaacaccagcgacgagacgcgcctgttcgtggacaccatcgtgcggtgcaacctcccagtcgctggcgcgcacggcggagcaactcgcgcctggccgtgccgcacgtcaattgatgcccgtcatgcactccggcagaccagaaaggtaccgccggccgtagaccgtgccatgcgcgcaaggttggggctctggaatctggagtgacatgatttgcaccctaaactagccctagtgtcatgtgattatttttggctttgtgcacctggttgttttgtgtaaatcatctcatcttgttaacttaactagtggttgaattaatgtgcagtactgattcgactaaa

SEQ ID NO: 33546 - DNA, 1000 bp, Triticum aestivum
  Clone ID: PAT_TA_33546
gtttagcgaggaacagaagcatccgactcgcgtgttagggtcgtcagtcggagcctcgtcaaggcggccggcaccgtcacgccgcgcatcctcgccgtttccaacctcgacctgctccctcggcccataccgtccttgctcctctgcgcctaccgcaagccctccaccggctgcttcggcgatgtcgtggccatcttcaaggccagtctaccgtccctgctcgagcacttcttccccctcgccggccgcctcgtgtacagcccgcgctccggggttccggaggtgcactgcgacaaccagggcgcggagcttgtcgtcggtgaggccggcgtggaactggcgagcctggactatggcgcgctaggcgcgtcgctggcgaggatcggcgcgctcgtccagtacggcgccgacgtcgtgctctcggtgcagctcgtgtccttcgcctgcggcgggttcaccgtcgcgtggtgctccaaccacgtggtcatggacgggtacgggctgtgcatgctcgccagcatgtggtccgagctcgcgcggtccgggaggatcgacaccacccgcggcggcggggcccccagcttcgaccgctccgtgctgccgcgcccccgcgccgcgccgtcgtacagctcctcgctcagcggggcgttcaccccgttcgaaggcaagcatctggttcactcgctcacggccgagagctaatgcgtcacgcgcctgtactacgtcgaggagcgtgatatcgctatgctgcgcgcgcgggcgagcggggagggtgtcggcgagcgacgcgcgacccgcctcgaggcgatgtcggcgtacctgtggaaagctatggccccccccggcaaccccccggatccgacgagacctgccgcatgggctggtgggtgcacgggcggcggaggctgagcgccccgggaaacgagcccgcgatgcgcaactacgtcggcaacgtcggcacgttcgcgctcgcggaagcagccggcccccccccccccgc

SEQ ID NO: 33547 - DNA, 692 bp, Triticum aestivum
  Clone ID: PAT_TA_33547
gccggccgggtcgggaaaaaaaaagtcccgggataacccacacggctcgactcgattcagccactcggtgatggaatccggcggcggcgcccgcgtacggcggcggcgcccgcgtacggcggcggcgcccgcgtacggcggcagctccaagccgtgggacgtgtcgcggcgtacctcggcggcggcttcctcctcctctccacagcatccaccgccgccgtccgctccctccgcttcctctccgataccaaccagagaaaattcgcgatgcagtgtggtgcctgcgaggggaagggaacctacgggtgcaggctctgcaggggtagcgccacggtcgaatggtctccgctctacgacccggtgttcgttaacccgtgtctctgccctacttgtgatggtaccagggtacagcgctgcttgaattgcctgggcaaaggctatgcatgaaggaacaatttgtatcaaacgccactttttatgagtggactgtttgcatcatcaatttcttttgttacctgtttgaagcttaggtgtgtattcttagaagcgggtgttaaaaagtgttgtcagaggaggcattgtattttgctcatggaatgtaattgattgatgaccaaactgtcctgtttgtgctgagaaaccaaagaataatttatgtttcagtacaaaatgaactaaaaacacccccccac

SEQ ID NO: 33548 - DNA, 885 bp, Triticum aestivum
  Clone ID: PAT_TA_33548
tttaatcatcgtgaattttgttgctaacttgcttctcaactaggtgtatgcacctccggggaatacttacttgagccctgctgtttccttcaaaacaaaaaaaaaaaccgtgccggggggaaacagggaaagttgttattgccatgaaataatcatttcccgacagatctccggtgttcaatgaaaaagagtcccgaacgggaaaaaacaccaacaacattaggttaaagaagacaagaaaacgcctacaacatcgctggaactccctctagcttacacccactttagttttcctccagcagcatctcgctgaggaccacatcccccatgccgtccgcgacggggacgcggtgcccggccgtgggcagctcgtgtcaccgcacccatgccagcctctccgcgatgtaccgcgacagggctaacgggccacgatgaggtccctcccgcgcccgtcccataggtgcacatccgcctcgccggccgggaacgggttgctccatctccagcgggctccagccccacttcccgaacccgacggtcatgtcccggtgcaggctctcgtgctccccctgctgcctcgcctggctctatgcacacacaaaataaaaatgcaaacaacgggtgtgtcattgagacaaacaaaggagcacacactgtggctctcagagatgcaagcgctggggttggttcgctggtctgtaagtattaccgtgcaaggtcgagacgcgaacttggggatcatggccatgtcttctctggagaagatggcggggttgaaggagatgacgctcgaggccgggaagagcttctgggtgttccaccagtaggccagccagggtgcgtggtgcgcaacacggacggcccattggtcctgagagatctgct

SEQ ID NO: 33549 - DNA, 395 bp, Triticum aestivum
  Clone ID: PAT_TA_33549
gggaactcaaatttcagaaaagcaaaggatagtcgattgtttacaccttcgttgtgtcaatgcaacccttctttgtattgtttagtaaacattttgatgtgcccagtgttgctcgcaaacataggatagttgattgaacaagctcattctaggtttctagtgcattgtttcttgataatagttgcttttgcttcaatgtatttgacagcatttcagtacacacccctttggttattgtcgcaactttctgttaataagaagaaagaaccaagagaatacaaagtgctttgttctaacaaaaaaaagtaatccttcaaaaaaaaaaaaaaaaacaaacaagaaacaaataagataactaagtagtaaacaaaacaaaatagaaaggggaaacaaaa

SEQ ID NO: 33550 - DNA, 1142 bp, Triticum aestivum
  Clone ID: PAT_TA_33550
gaggaattcggcacgaggcagcttgaggtggacctggaagaaagagctgagcctgatgtcttgagttgctcaacaaacagtgaccgactaaagggaattcttaatgccccaagaagcttagggtattctgaagagatcgaaaaaaaactggagaaatacagcaatacttcagctgccggtggaggggtgcagtcagacatcactgaaggaaatgcaggaatgcatagggctagagggcaaggagtccccgctgaacgatcaaaagcagtaactgttgaggagcaaaggttagagagtgcatggctccaagctgttgaaaagcacacacctggggtgagacctgagaaataccaagttgtgccacaaactggtggtggtcagtaccacaagaagtcctcactggccactgttgtgccctcaaggaatattgacaaggatttgagtaatggattgaaagctttaaagatcagtgagagtcatggttcccagaagggtcagaatgtaggaatggagaatggatttgtgatttcaccaagcctcttgcacagtaataatgaattggcaaattgcgacaacgagagtgtggcctctgagtccggagcaccaggttgtcatggcctcttcccctgctggaaaactgaaaaatcaaaaagaggaaaggcaaaacggcagactcgtttgaagccatcttaatctgggaagttataaaatgaccactgtcgttcgagctgcggaaaacagttgctaataccaagagaacgcaaggaaccagttgtcatattaggtcgcggctgtgacctcgcctgacgctctctgctgatgcaagatggctgcattttcgtcctaacgacttggtagagctcatagtagaagaactgtggccgggaatgcaaatttcagaaaactgaagggtagtagttgattgttgtttacagaacattttgatttgcccagtgttgctcgcaagcataggatagtcgattgaagaagctcagtctaggtttctagtgcattgtttcttgatgatagttgcttttatttcgatgtatttgactgcatttcagtacacacccctttagtcattgtcgcaactttctgttaataagaagaaagaactaagagaatacaaagagctttgttct

SEQ ID NO: 33551 - DNA, 980 bp, Triticum aestivum
  unsure (1)..(980): unsure at all n locations
  Clone ID: PAT_TA_33551
gcgcggttttttttcgtctcctctatttggcccattttttcgttctctttctttccttttcccccttgccgacttcgccgccgctctgtttcagagcaggccgaagaataaacagactccaaagcaggaacgcaaacagaacgaaccagaaaagaaagcgactacagctcagcgctacacttcacaagatctagcggcggtgcgacttctttgcacttgcatcggcggacggccgatggttttactactggcgtttttatttttattactggcgggtcatgacgccgacccgctccgcggcggcgcgcatcacgccctcgacgagctgcgggatgcacgcctcgcccacggcgccggcgccgcacccggcggggagccccacgccggacatgtacttgcacacctccgcgcggatcatctcctgcatggccgccaccagatcgccgctgaacgggtacgaggacgacggctggggcgccggcgccggcgggggagaaggcgagcgtggcgatggcgagagctcctggaagtggctccgggcgctgtcgtggtggaacccgtgctctagtccggggagcgagagcgagagagaggtgatcggatcctcgtcctggcgcggtggaggcggcnctcacgtccgcgctgatggcgtcgaacccgccggggcgcgggacgggccggaacacctgcccgctcccgtggctgagctcgctgcggtctgatccggtggggctctccggccccgggctcgcgcgcttgcacggccgcggggagtcgccggagtcgctggcctcctcccacgccgcgccgccgccgggcgcgcgggcggccctccgcccgagcgaggagttccagtgttcttcacagcgttgtcggtgcggccgggcaggagccgcgcgatggcagcccagcggttgccgagccgcgcgtgcgcacgcaggatggcggcgtcctcctcccgccgtgaaggggcggcgctc

SEQ ID NO: 33552 - DNA, 785 bp, Triticum aestivum
  Clone ID: PAT_TA_33552
tttttcacatcccaccttcacaatgaagatgttacttccaccagatatgatcaaacaggaacacgcatgcatgtgcgcgcgcacacacagcgcagtgcaatacatcttcaccaaaacaaagttaaatatctatgtcatcaactacttctcagatgagatgataaaaaacatctcgagtccactacacatcccaggaagcacaggtacttcgcgtccttccatcacaaacattacaacatgacagagccaaactactacatacatggcttaattctgaaacctaacccatcaatggagaaagctcgaggacgacgccgccatccagtgcatctttatcagcagagaaagcccgaggacgactgcaccatccagtgcatcttcatcagcggagagagcccgaggacaacgacgccatccagtgcatcttcatcagcgaagaaagcacgaggacgacggcgccatcgtgtgcatcttcaagcccaaaccgcgtcaacttctgcagcaccgcttggcaagagaaaatgaccggtgtcgcgcgcgatggagattttccatcatgtccggtaggtttgatggacgaaaggagtatcttcctgaggaatgcaatcttgacgatctccatggcgtcggcagcggggtcgaagaagctgttgcgtctatggaagaggcggcacacagtggtctacgccaaccacatagaaggcaatgacagaatcccttctcctggcacgagcttcggatcagcggtggcacttgttcttgcctattgaggatcctccatggac

SEQ ID NO: 33553 - DNA, 1529 bp, Triticum aestivum
  Clone ID: PAT_TA_33553
cgtccgcttgccttcccctccccgtctctctccgtcccccgtccccattgccttctccgttccccccacccccctacctcgtcggcgggcggcgacgcgacgcgacgagagcggcggcggaggcaggaggggcaggaatgcggatgttctccaaggcctgctcgctcgtcgtctcctccctcccgcgctgctcctcctccgcccccgcgattagggggcagccgtcgttgataccgagggtgagcaggaaatggctcgggaagccgctcatgtacgggatcggcacgctgctggtcatgcccctgaggaccatccacggggtgggccggatgttcggcgccgcgcggtacctctgcaacatgaccagcgtctcctcgtcgctgcaaatcgagctcgttccctgtcttcaagataactatgcatacatcttgcatgatgtggatactggaacagttggagttgtagacccttctgaggcggtgcctatcataaacgcattggaaaagagaaaccagaacttgacctacatattgaacacccatcatcactatgatcatactggtggcaacttggaactgaaggcaaaatatggtgcaaaggtaattggttctgagaaggataaagatcgaattcctggcattgacataactctaagcgagggtgacacatggatgtttgcgggtcatcaagttcttgtgatggaaactcctggtcatacatcaggtcatgtgagcttttatttccctggatctggagcaatatttacaggtgataccttgtttagtctatcatgtggaaagctttttgaggggaccccagaacagatgaactcttcactccaaaaaatgtaggctcttcagattgtgacgaagttgtacgtggacatgaatatactctgagtaattcaaggtttgccttgagcatagaaccaggaaatgaagaacttcaggaatacgctgcaagtacagctgatctgcgcaataagaatacaccaacggtgccaacaacaattgcgagagagaagcagtgcaatcctttcttgaggacctcaagtccagagataaagaaaaggctgtccattccagatcatttcgatgatgcacgtgttcttgaagttatccgacgggcgaaggataatttttgactaaccacaaaggaaattatcataaaacgatgacccaaccatctcttcgaaaaggagtagagtggacaaagaaccccgcaagaccacaacagaaggaatgcagggaaggaaatgtgtatagctcgatgttccaaaaatgctttggtgaaaatttgtctagcattgtatgtagcttgcgcagagtgcttgttaatctgatagcagctggtgattcttttgtcgactacaaataaaatgtgtcatgtaatcctctatcctgggagagaaaaaagctagttagctgtttgatagtgttcttcaaaaaaaaaaaaaaaaactcgagactagttctctcgagagagagagagagatacctcgggccactttttagggaggcccccagctt

SEQ ID NO: 33554 - DNA, 1353 bp, Triticum aestivum
  Clone ID: PAT_TA_33554
gctgctatgtgcatcagacaacagttgtacataacagagcaccgggcgagccacaatcattcgatgtcgcttacaatgggagagaaagtgcattggccgtctcataaacacatagatgtgtataccaaggatttgataagatagttgagggagaacaacatcaaccttggcaaggtatacaacataattggaatcttctttggttcagttgagaaggtgcccttcacgaaaaggacactcaggaacatttgtgggaagattagtcgtgaacaggctgaagatgaattacggaagacactgcaggtgtttgccgacatctggtcgagtgaccctggtttctcctatgtggtgctcgccgagaaagacagcaaggtgaagaatctcatgtgggctaatgggagcagacggatgcagtacaggttctttggcgacgtggtcacattcgacaccacatacaggacaaatttgtacgacatgccattatgtttatttgtcggagttaacaatcactaccagagtatcatcctagctggcgtgctgatgtgtgacgagcaagaagagagctttgaatgggtgttttcagaattcattcgcatgatgggcggacctgcacctaaaacaatactaacagaccaatgcagggctatggaggttgcaatcaagaaaattcatccgaacactgtccaccgtttgtgcaagtggcatgttctgaaaaggcgaaagaaacactggggtggctttacacaaaaaaatgtgattttcaagctgaatttcacaaagttgttaaccacatgctaactgaggaagaatttgaatcagcctgggatgcgctgcttgataaatacaatttgagggggcataactatatgacccaaatatatgagacaagacataaatgggcgaaaccatatttcagaggtgtgttttgtgcgaaaatgacgagtacacagaggagtgagagtgcaaaccacatgctgaagacggacatgccccctgcaagcccaatgcatgttttcgtctgacaacacatgagacttcaatttgaccggaagcgcgatgaaagctatgaggaaaagaggacaatgattggcggcgtcgtgtggcggactcaccttgcgatagagcgccatggcagcaaaatatatactaggaatatgtttgagaaatttggccgcccactggtagaaggaaccgcagagtttcgccgcccttatttgaaacgacgcagagttgtgtcgttgagcacatgtaaggttatatgcttttctgacacaatttgttagctaaactgaattttactcctggctgtatgatatgataagaaattgtacccatttgtgtttttgtaaaaac

SEQ ID NO: 33555 - DNA, 772 bp, Triticum aestivum
  unsure (1)..(772): unsure at all n locations
  Clone ID: PAT_TA_33555
atgtttctatatatgtaaccaccacgggtgcccacctatgttctcctctccagttctatatccctttgcgccagctacttccatctgcctcttcctgctcagatagcgagggaatcatacctatgcgaaggaggatccatcgatggtgatgatggggcagctggggaggctggttgatgggctcaggtccaagatgagggccggcggcgggaagaaggggacgggaaagaaggctgccgcggcggcatacgagcagatggggaagacggagagcatgagggtggagatcaagagtcggcaggcgcagaagctcatcgccaagaacctcgtcgccgccgactccataggccgcaggagcaggaacaagcgcttcttcctcgccttctaaccgccggcgttcttcaaaaggaagagctgtgtcctgtcctaacatgtgagctttagacagttcttcaaaaggagtagtactacgtaccgttgcgtagtgaatgtaaagaaacctcaagaaagcaaccgcatacagcggggaagctctctgttaccacctgtaaccacacatgcagtactatgatctgtcttacccgtgaaaaaaccacctggaacccctcacgctggacgtgccgcctctcccctgtacttcccgctttgcaatccgctcattagctgcgtcgccctctgtgattaaatcacaattacagtctctgaactgttaagaaggactagtcctgactgatgaaataaataccttcaacccgcaangaaaaaaaaaaaa

SEQ ID NO: 33556 - DNA, 686 bp, Triticum aestivum
  Clone ID: PAT_TA_33556
ggcgcgtgtgcgaggggccttctttgccgcggcggttggcgacgtcgcgcgtcccttcactgccaagcacaactgacgcctcatcggagcagctcccacgcacgggcatcggcaagctcttaatcttctacgacggggctcccttccggcatcggcaagtacaacacggccagtcgcagcatcgtcacctcaagcgtcgcgtgaccggaggccgtcgtcatgcgcatggggaggtggatcgactacaaggccgacttgcaaggggaggtggtccatcgccttggccgtcctcaccgtcggcttctctcctctaagttatcccactgattcctcccctctgctaatctcccttgctctatgtggtaaatcttatgatggccttggcgccatggaagtttctgctttggccatacggcattgggcttgctgtcatcttcgactaattataagcttgctgttgtcttggcttctgcgacctgtgggtagtaaccctccactgggataatattcaggtcctcgttgcacatttagctctgccttacagttctactcacaatttatatcaaacttcttacacattcggcctagctagtaccactgtctagtagtcggcagtgatggtgtctttccctgtcatcggtgatgcggacaatgcggctctcgttgcatggactacaacaccttgg

SEQ ID NO: 33557 - DNA, 1101 bp, Triticum aestivum
  Clone ID: PAT_TA_33557
ggttactggtaccgctacgctaattaagctgcaaaaagccaatgcggcatgaacgcacaaggcaccaggagaagacgctggcatggcatgggtacacacatatacgtagaaaaatgcaggcataaatacatagatacatacatacagcaaggtggcaatcagttcccacgactactaagctgcaaaactatggcccaagcaagatgagttacagtctgaagaacgactagtactataagcaagcagaggatggagcagtggcaggtggtggaagaactggtgagggactgcgacggggcagcacagcagtggatgtggatgtggatggcgttgcgcaaggccatacgggagtaaatgggaatggcgacggatgggccgacggacggtggccggccggccggggaagcgaggggggagcagaaaaggaaatgtgtaggctcgctcatgtccgagggggcggcaagcagggaatagacccgtggccacctaaccgggctgcagccgggggacagcgataacgagagacaactacggcaaaccactccgacaagccaaggccaggcgctcgacatgccacttaatgcatgtcactccaaggcggcatttcgggaacaagacgcgctcgctcgacaacagctgctgcaagttgttgccgctgcctgcctgcctgtcgctcttctctcttctctctgttctgtttgccaccgatcccattctcttgattttcgttctgaattttgttttctttccttgttctcttcattcatcagattaaaaggaggcaaaaagaagaagaaaaagagtttgtcgttgggagatcaagcaaacaaaggaagaagcagagtgtgccgaggaagacgaagaagcaagcaaggccatggaatggtatggttgaggacgtatgtgtttaccgtagattttcttcccagtggtggtagaaggcgagcacgcgggggaggacgttgtgggagcggtagggtggcggcattggcttggcggaggcggccaccatgagcgccaccatctcccggacgcacccgatgaagaagcggtagggcgggcccctgatcccctgccgcgcgaagtgctcctccacgcgcc

SEQ ID NO: 33558 - DNA, 827 bp, Triticum aestivum
  unsure (1)..(827): unsure at all n locations
  Clone ID: PAT_TA_33558
gttccacgacaaanaacagnanagaggcgattcgactcagacaacgactaactagctggtcatcttagcagtaacttcgtttacaccttctgcccccggagcggattgtctgtcgcgttcagctagactatggccacaataggatccaattcaacatctagtttgtaagctattctggttaagtctaaattttctctcaactcctctatctagctcgcctatgcgctgactattgccaaagttggcttccttcggacatggtagacacttctgccatgttggataaaaagctcctacatggaaaaaccatgcctctggtcaaatcccgggtatctcccaaaccggcgcatgcccgtcagattgcacaacaaggtgtgcatcatatcatctgcatgctgcgcctttcttacaaggccgcatcggcttagacgctggagcacttcttcgcgcagttttaatcctttggagtttgggcgctcatttcccttgccgcagaattgaattgccgcaggtgtaagcttcgcctgtaacacgaccagactgcccaaggatagcttgtgtgctaagaaaacgtacttggaaccgctctgtacccaggccatgaccttttccttgaagtcatcgtattccaggctcgctgcattttcgtgatgctcatctatgagcgcagtgtagttgctgtacattttgcggtagagtttctcagatcggatcgatcctgggcgaggaaggcggttgtatcctgtctgccgttttgaccagttggggtcccatgtgacgaagaaatagatatacataacgatgcagatcagattaagtttcgaaaa

SEQ ID NO: 33559 - DNA, 1121 bp, Triticum aestivum
  Clone ID: PAT_TA_33559
tcatctccttctttggcgaggggcggcaaagttggcaccgaggtggtgcaagcatcggtggaccaaaagagacatcgatgaagcatctcgtgctcaaccttggcgaccctacgctacgcgagagatccctcgcagagctctctcaggaggttcttcgaatctaccctgcactttcacctccaactttaacgtcggctgcatcaacccgagtctgcaatgtgattgcactttttcagtgcattgcatcacgccctgagaccagaagccctttcatagaagctgatattccattgtacttgtacccattcttgcatactgtcgacaaggcccaaccttttgagcagttgcggctcgccactttgggtgtcattggtgctctagtaaaggatgagaacactgaagctactgagtatgtgctccaatgtgaaaccattcctttgtgcttgaacatcatggagatgggcaatgagccttcaaaaaccgtgtccactttcattctcctaaaggttctgctaagcgaagttggtttgaagctgttgtgacactcgcggtcctttctatgctattgcttttgctttacaaaaaagggttgactcaccagatgaacggccttcggcaaggttgctgaagtgcattatccggtgttaccttaggctatttgatcatcgtaggggtcgtgcggtgcttaaaacaagtcttcccggcgtgctacgaaatgggacattcaatggctacctcatgggggatccttcagcacaagaatgtctgcagaaactgttggctgcctttcaccgctgcaacggcaacaccatcgtgccatgaaccgcacaacggcgttgtagtttccattgagacaatgaaaaaaagtctgttgtgttaataagccttgggcaatcatcggtgtttggaacatgtagagactgtaataaattataggggaaggaggaaggccctatacatgatgatccttctcttccgccgtatttgcgtgttaattaaataaatactagcttcgtcattatggttccatgttggggaggttgttgtatatattaccgttgaaattatggaacgtgaatcgaattgagttgtgatggagattgttgttttgttgatcaaaa

SEQ ID NO: 33560 - DNA, 874 bp, Triticum aestivum
  Clone ID: PAT_TA_33560
gtctccacatcctctagatctatctatgtccctgccttcatctccttccctgccgtcagccccctctgtgggcaccggcggggtgcttggcaccgaggtggtacaagcatcggtggaccaaaagatgacatcgatggagtatctggtgctcaacctttgcgaccctacgctacgcgagagatccctcgcggagctctctaaggagagggagatgtttccggatctggcccctttgttgtggtactcattcggcacaattgccgcgttggtccaggagattctaagaatctaccctgcgctttcgcctccaactttaacgtctgctgcatcaacacgggtttgcaacgcactcacactttttcagtgcgttgcatcacgccctgagaccagaagctctttcatagaagctgatattccattgtacctgtacccattcttgcgtaccgtagacaaggcccaagcttttgagcaattgcggctcgccactttgggtgtcattggtgctctggtaaaggatgagaatactaaagctactgagtatttgctcaaatgtgaaaccattcctttgtgcttgaatatcatggagataggcaatgagccttcaaaaactttgtccttattcaatcgggttgagtctccacgtaaacggccttggcgaggttgttgaaggcattagcggggggttccactaagttgtttgagcattaaagttacatatttactcaccaggttaacttgtttcggcacttccatggttttgcataataattagttgagtttttagcataatgcagtctacacgttatatcaccttcaaattagctgatacgaatatagataatatggccagtttgtcaccacataatgtagttct

SEQ ID NO: 33561 - DNA, 464 bp, Triticum aestivum
  Clone ID: PAT_TA_33561
gggtccacgtagaagaagaagaagaagaagaggaagaagaagaggaagaagacggaagagaaagaagctgagacgactgggcagaagcagacatttgacactactgttgaaaattcaggggcagagcctacagagagagacacggttgacggaaaacagtctagcaagtcaaagaagagcaaacgtaagcataatgatggtgcacctgccgtagaggtttctgctggcgatcaaatcgtgacaagggaagataagaagagaaggaaggaaccagttgtgctggaagcgagcaaccaaacccaaaacacaaatgaaggtgagaatagagagattaagaagagaggaaaggaaagcagtaaagccagtccagactttagtgagaatgcatctgctgggggagaggaagctggtttaggtgttaataatgattagaagaaaaagaagagcaaggggaggggaggagg

SEQ ID NO: 33562 - DNA, 1157 bp, Triticum aestivum
  Clone ID: PAT_TA_33562
ctccaatccaccgcaactctcgcgactctcgcttggcacatgcaaaagttcgaggcaaatatgtcttcataagaccataccatgacgattttctgagattttgcttccagaactttgagctaggggtatggtcgtcgagaatgaaagtaaatgtggatgatgttgtcgatatccttatgaaagatctcaggcgacacttgctattctgctgggatgcatctcactgcactactaccaagtgtagtactcttgaaaatcaacgcaaacccttagtactgaaggaactaaagaaactgtggaataaagaggaccctgatcttccgtgggagcaaggggaattttcgccttcgaatactttgcttgtggatgattccccttacaaggctctgtgcaatccgccacacactgccattttcccacaaccctacagctaccataacaggacggataattcattgggaccaggtggagatcttcgtgtgtatctagagaaccttgctgctgcagatgatgttcagcgttatgttcaggagcacccttttggtcaacctttcattactgagagtgatccgaattgggatttctatgcaaaaatacgtgacagactggagaagcgagagaagtgtgccgcttgatggtcctgtgccttgatacagtaagcaagagctttggccaggcttgtgttggatggcagaaagttttggctctggagttcgttttgtttcttggcttggcagttggcatgactacttgtagacagggggtattggtgatttgaacattttttactctctgttgtttcggtctgtgattatcctgaagtagtcaaggctaggtgttcacaaggtcgtacctattacttcacatgtactttggttacacatgttggcatgcgtcattagtcattctttcccctgtttcaaggataacagtgttgttataatagttagatagcattttaaaaagttggtcaagtatgtttaaggatgttaagagttttgccggcttgtaatttttctcctcttgagtaagtgatgtaatcttttcacatttgttgaactataccaccaatgctgttgatacttgccagagtggcaacagatagcatcattgcaaatggagttggttgttctatgttgggacttggaatctaaaaa

SEQ ID NO: 33563 - DNA, 619 bp, Triticum aestivum
  Clone ID: PAT_TA_33563
gagagaagaaggaacaaggaaccctctccggttcgtcgcctgcttccttccccaatcctcgccgcctccctccctccgtcgccgggacgccacggtacgcgtggaatcagcgataaagcggaggaatttgggcgcaggaaggatttggccggcgggctccgggatctgctcgtttggtcattcttcttcttgttgatttgatcgactggtaggtgggcggatccacaagcagcggcagccatgatgatggtggacacggtcagcgccagcacctccttcatcgcgcgccaccccttcgaccaccaccggccccaccggaccctcctccacgtcgtcagctgccggcccctggccacgcccttcgcgggccgccgcctcgtggccagaaggcagccgtcgcttcctgcgcagcagcggctcgcggactggcccgtcagggcgctcgcggcggtggggttcaccaaggagggccgtcccgcgcaaggagttccgggggatcccaggggaaggcgacaacggattagcgaccgacgacgacgcccccccgggggcggtaccgtcatggccgccgcgctaacaagcggacgacccgagcctgcacaacccgctgctgcgcctc

SEQ ID NO: 33564 - DNA, 956 bp, Triticum aestivum
  unsure (1)..(956): unsure at all n locations
  Clone ID: PAT_TA_33564
cttcctcttttctgttcttcacgcccgccatgnagagacgctcccagcgatgaccaccatccctcactgccgcgaatcaagggaggttttgacgcatgccccactggcgttgcaacgaagcttccaatggaagcaccaccgagctttttaccgctcatcggtgccgccggcgatgtgacgcggcgctcgaccacggccaccgtgctgcaatgcaacctcgtcggcgtgctcgcgctgcgatgcaacctcgccggcgccggagctgcaatgaagcgctcgccgacggctccccatgctccgatgcagcactctcgggacggttcccggtgcttcatcgcagtgctcgcctgcagctcccaatgctccgatgcagcactctcgtggtggttccttgtgctgcatcgctgcgctcgccggcggctccccgtgctccgatgaagcgcttcccatgctgcaatggagcttcgtcggcgcctcctcgtgctcgacgcggcgcttccggtgctgcatcgcggcactcgccggcggcaatgaagcatcaacggaccaacagagcaatgctggtgctgcaatggagggtgctgcagcttccgccggagctacatgtgcagtgcgttgactcggggacagtgcgtctgcagcacacttgatggcaggttggggatggacgcgatggtgtggtacttcgtgtagtcctgtcatgaggggatcgagcggctgaaatcacaatatacctgcgcgaatcaacagctgatcaggcggcttaggtttggctgttatcagccgactgatccgtagcagccgcctaacatctgagctattccccggctgctttgtttttcattattttatgaattatnaagtgtcgccattttattcaaatatgctcggctagatcctagagcacaccattcacaatacaatccagaggggtttgaagccatgtttcacaaaaa

SEQ ID NO: 33565 - DNA, 739 bp, Triticum aestivum
  Clone ID: PAT_TA_33565
ttttgacgcccaacgtgtaattagtatactcacgcatgcttattccactacgtacacaaacccggccgtgttccaacttccaagtgtcaacattgtacaaatgaaactgtgaaatcttgctactagtactgcctatcttgcagaccgacctttgatttaacttttacccccaaatgatacgcttgctcgccatctaaatagttgtatttacaggacacacgcatggcattacatttgcctgactaacctaagcatgcactagagctgagctaattaattatcaagctctaccaattaaagaatagcgcagcgcatgcatgcatgcaatggtgctttcttgccgccaatgcatgcgctgcgtgtatgtaccttcttctcgcaggctgaacaattcggctagtctacgtagtatgtccgggccatgtcactgcggcggcgcctggccggcgtcggcggccatttcgtgctcctgcggccaggggatgaggcactcgggcgggaagcagcagtcgcactgcccggggcaccgccgcggccactggcccgcgcgtattctcttgcccgcttgcggccctttccgtggtcggtgcggcggcgtccgtggcttgccgccggggcgtcgcgagcgcggccccacccaccggtaactcggcgtgcgtcgcggagcgggccccagcactcgacgcggttgaggttgcggtcgttggagtggaaagtagacccacaccgtagctcctcc

SEQ ID NO: 33566 - DNA, 610 bp, Triticum aestivum
  Clone ID: PAT_TA_33566
ttttttttgtcgagtaattcaagttgcatcataatatatatctcaacaatacatcatgtctgcatgcatacatacatatgtatacatttgtaggttcacgagtctagtactgcatcacagcatacatacaggttcacaagtccagtactacatcacagccaaaaggacaacaatccatcatgtatacatacatacatttgtaggttcatgtctccagtataacatcaccaaacataacatctagtttcagttagaaactgattccatcctagagtgctaattcatcagatagatattaaaatccaaaaaccgagttagattctaccaataggtccttttagctcacaaaacatacatctataaacttgtggggtgcaaaagcagaccattttcctttggtagcgagccaaggaagcactctcttcacggtgacccccgatcaaatccgcttccgctcccaaatctccatactccgatgatatttggctcccagatgccatgctccccaacggtaagcacccaatcaacacaacacatcaacagcagcacaaggagcagcagctcaacccacgtgccgaattcactgcagagaccggtggatgccggttgc

SEQ ID NO: 33567 - DNA, 832 bp, Triticum aestivum
  Clone ID: PAT_TA_33567
cgtccgcccacgcgtccgctcaacctcaaccacacgctacgctaccttcgtctccatccaaccatccaagcgtgacgcacttatggatttcttcatccccccattcatggagatcatcgacgctgagctgcagatcggcccgccgggcagcggcggcggcggagactcacagaagaaacggtcgtcgtcgacagcggcactcgcggtcaccagcgaggcctccgggaccgacgaccacgacgccgcgccggcctccaaggatcaggcggttgggtggccgccggtgggggcgtaccggaagagcacgttccagtcggcgtcggcgtcggcggcgaaggagagtaaaggccctggagaggccgggaagagagggaggctgtacgtgaaggtgagcatggacggggcgccctacctgcgcaaggtggacctgcggacgtacggggggtacggggagctgcgggccgcgctggacgcgctcttcggctgcttctcctcctgctccggcccctcgccggacaacggccagttcgccatggcgtacgaggacaaggacggcgacctcatgctcgccggcgacgtcccgtgggacatgttcatctcctcctgcaagaggctgaggataatgagaagctccgaagcacgatgatgacgatgatgaaaaggacacgatcaagcacacatacatacatgaagcaatctggagatgatggaaaccggccgtggcacatgatcaggagaaggacgcacgcatgggccagatgcatgatcaggccatgggtgaacggcgacggaggccgggttacgcgggcacgcgcctgggcatgccaagtac

SEQ ID NO: 33568 - DNA, 586 bp, Triticum aestivum
  unsure (1)..(586): unsure at all n locations
  Clone ID: PAT_TA_33568
caggggcttctggccgtgggagccagctaactgggatctgaacgttgcaaatgaccgttctctatgttttacacaaataacatacgggttctaataacaaagtgtcacacagccaaatccatacaatcgctaaaacaaaaactaagggcctgtttggtatggtaatccaccggctccacgaatctggcggagcactaattcccctgctccaaaattttgaactgcagcccgctccgttccgtggcaaagctgtggagcggaggggctccaaacaggcactaaaattcaaattttctcaaactttaggcgggttgctgcatgcgttattcctgtggcctgtcacccacattttgagcagcgcggagatttcctaggtgcctttggcacatcccctctggcagggcatgttgtgctcttgtgcccctgaattctacatatagaacataatttgctcctcttcgatggttgttcatatggagccttgtcgcggctggttgttggacgcccagccgatcgtttattggacggtgttggaaacacacctgatncttgtgaaagggtgtgcacagattcagttctcccaaag

SEQ ID NO: 33569 - DNA, 695 bp, Triticum aestivum
  Clone ID: PAT_TA_33569
taccgtggtcgcggccgaggtacacgttatacagtttttctttttttttttgtgaccaagcagccgacgtacaagctatacaacaaagctaactggcactcttgacctgttgctgccgcggtacacgttatacaaccaaagcagtctcagttcaccagttgttggtgcggtagccttcctcaacaggggaatggcagtttggaaatgagtattacacaccggtcgttcgcacaatggccaggtaacgttctaccgaatcactggtgaccacccaggaagcaacacaaagtgcatacggaaaggcgtttcagcagttctaattattgtaatttttttcacttttcaagcatactcgcagcataacttcttttccattgtttcactggtcaatagcgctacaaggtcatccaggcgtccggcagcgaacttcgaattttctttgtatgtttggcgacaaagcaaccaccaaaaaaattggagataaagcagcagttttccaagatgcctcgatttaaactgatgtcttcggaataattcgatatatatgcaaccggcccgggaagccgcaaccggccgaggaagtctgacaaagtgtacttccatcatcacaatcaagatgtcgcagtacgacttcttccaagcggccatctctgtaagcatgcttgtagaaacagcttgtcccgaaggggcaagtg

SEQ ID NO: 33570 - DNA, 1252 bp, Triticum aestivum
  Clone ID: PAT_TA_33570
gtacagtccgggtccacagtcccttgaatctctgcacttaaatggagccactagtgcccctcggttagctgaagacgacgaaaattccgttgctagcgacttgcattgctttgagttgaacatgcatggagatgctgtgcagactcatgaccttgcaggaactcgacgaacagtcgccgactgcatgtattcaccaatgagaagactggagttttccgatggtgtgtctgttgaaggctcgaggatctcaaccgcaaggcctcgttcagaaaaaggcaaggtgaagccaggcagcagcaaagcacagctgcatacttcggcaccagaaatcagctcccgcaactgtgacaggatcgatcctatagatgtgcagaatgaaacagtcatgacccaagtatctcgacggttgcatgatgacctgctgaagatcaaatcagaggctcctcagcatgcatttctagagcgaaaaccgcacgatcatcatccccggacgtatcagtttcgtgaatgtgcttcttcaagcgatctactccacaatctgcacagtccagcccggcagctgaagaatcatcaacgcgcgtcgttggactaccaaatatctgaatgtgctactgcaggtgatgtacgcggtctgcgcagtccatcctggcaactgaagaaccaacgagcgtcgttagactaccagatatctgaatgtgctaccacaggcgatctgcacaacctgtgcagtccatcgcggcagctgaagaatcatcatcgcccgtcgctggaccatgaaatatccgagtcctcgccggcgcggtctctcggctcaaaagacaatacgctcaaggcgaagctactgcaagcgaggctagaggggcagcacgcccggatttgggcgtcgggctaccccctgatcagcacaaggagatgagaacactgactggctggcacccttgggctgagcttccatgctgtggtttcctacggcatggggttgcattgtaagttaagacatctgacttgatgtgttcagaatttcatgcgcggcggtctcgggtcgcgggcgggatatgcggaattgtagctgcatgggggaggagagacccccttgagtagatttgcatccttcagtctcgtccggctatgattgaatgactgaatgtacctgcagaggcgctttcgcgaatcacctgtcgttgtaatgtttgtatagtagtattatatgtgccgatgtaaaaaaaaaaaaaaaaagtcgacgcggccgcga

SEQ ID NO: 33571 - DNA, 1257 bp, Triticum aestivum
  Clone ID: PAT_TA_33571
aaatattttgatttcttgcaaagtttcaacatcggatgacattcgtgaaaacagtggcaaaataaatcgatgctccaaaactattactccctccgttccgaaatatatgacgttttaaaaaacgtcccgaccaggtgaaaagggaggaaagtacagaagtgcccttaatttgaatcgctattgccgtcgtcttcctcgccgagcagatcctctccatcccagtcgccgctgctgcttgcttcctgtcgccagggtcgccccccatcccagggccgcccctctcccagggccacccccctgtcgcctgcgccaatccagccccctgccgctggagggggcctcaccaactcgcctcgtcggagggggtgctgctgcagatcgttgtccccctcccaaggcctcgccagctccagagagtactgcttcagatcgaggtactgctcgccggagggggtaccgcttcagattggcagccccaggtccagatcgccgcgccctcccatgcagctccaggtactgctgcagatagcctccccacttggtccagatcgcctcctggagggcttgaagtaggcagcaacagcaacagctcgaagcaggcagcatctccagcacgacacaacaacctagaggagtcggtcccgatgaagatgatatcgatgatatcgacatgcacgagagcattgatcctggtgaagatgacatcgacatgcacgatggcattgatgccgacgaagatgcagtcggtgagcttcctcatcttccctataaagatgatgtcactgtcaactcaaatactcaatgtgaaatgatcaaaatacagaataaaatggattaggagtagagtatagcaatgatcattttagtttgtaccgtactccattttggtaacatgagcctgtaccaaattaaacagtcaaaaacattcagtgtgaaacgcattaacatgaaagacagtagacagaaacatgacactagtggctaagcgttgaaacagacctcactgagcattgacagcatgtaaacatacagtacaatgtgtgttgacaaacagcaaaacagaaggggcatggatggatcatacacagtgaacaagctcatccttcaccaccttgtcggtccatcgagcatgtccgctttcctcacccacatccttcagttgctgctgttggtccatggcgtcggagcaggtgttggtgagttgttgctgctgggcatcgtccctaatttcacccatgaccatcactttgaccttaa

SEQ ID NO: 33572 - DNA, 869 bp, Triticum aestivum
  Clone ID: PAT_TA_33572
tttttaacaggcaaaggctcggccatgtttattgctttcattgcatgacagtgctgtcagtacataatgtgaacatgacctgaaaaaactaaagctacagaatagtcctggaaattaacacaaagggaccctaaaaattaaatctaaaaatcaatcaggtccttcttctcccctgcagtgctttgttcgccccggcgcccggcctcaacgctggccgcactgctctgccgtgctctgctcgctgcgccgtctccaagacctgctcagccatgtcgctccggcctagccgcgctcgggagctgactcgctccgacgccacgacgaggcagcgagggaggtcggggatgggcggtgcttgaccgacggagttcacgaggtggagcgcccggctgctctgacggcggagctcgcgaggcggagagcacgaccagcggacgaggagctcggagtgtggacgggctcgggtgcgcaaccggaggagctgtggtgtgaggcggcggcaggaggatgctgggcgcggcggcggacgggcgggagggcgggccggagggcggcagccggaggatgttgggtgcgacggcggatggacgggcggaagggcactggccgcggcgtgcacctgtttggggacgggcgagcgctgggatcagcgttcggctgctcggggcgccttacgggcgggcgggcgttgccctgcggccagtggcagctcgggggaggagcagggagcaggagagatgagggcgctggccggcggggtgctactgctcgatcggggaggtggaggctggagagaagagggagcacgggggaggagatgggagtcctgggtggagcaggtggggtcgtcgcctcatgggtggggacgt

SEQ ID NO: 33573 - DNA, 1051 bp, Triticum aestivum
  Clone ID: PAT_TA_33573
agagcagctcttaggctcgcgctccatagcctcagcccttccccgcttcaattggagtcgcaggggaggtaccggatcgagcttcccggtcggcatggtgcccagggacatggtgaatgcccccgccgagaggctgcacgaccaggggtctgtcgtgaacaggaagtgtgagaaggtgccaaagaaaatccataagtcggagagggagaaacggaagcgaggcacgcagaatgacctctttaatgagctgggagccatgctagaaccagacaggcagaacaacgggaaggcatgtgtattgggtgacactacacggatactgaaggatttagtttcacaagtggaatctcttcggaaggagaatagcacactgaagaatgaatctcattatgttgtgttggagagaaatgaactgcgtgatgacaacagcatgcttcgcaatgaaatcctggagcttcagaacaagcttataatgcgtctgcagagcaaccctatttggagccaggatactactacaagatcagccgttgcagtaccttatcccacaagcggagtgttcccagtacagcattcgccacattcaccagtcatcacctcgacagcactttctctgcatcccgtaatcactgagcaatgctatgctgccccaccacgagagctgcagctcttcccagtaagtttcatcttcatccactgcaggcgcccacccggcccaagaccagtggatttccaatagtgtaacaaggccccaggcacggtacccaacaccagcggcgatgtcgccagtaaatgagttcccaattccttccaaggatgggagaggagcaacaatgcaggagtggccgcgcgagggtggcactagtgaggaggtttaagtacataacacaatttgcttcaccgtttgtgaagtttctgtagtgtgagtggagtgtgtttctgtgcaacagatacatacgcagatgtgcatgtaaactccaatctgtctccgaatctttatcttaacgggttaaataggggataataaaaactgctttacccctgaaaaaaaaaa

SEQ ID NO: 33574 - DNA, 759 bp, Triticum aestivum
  unsure (1)..(759): unsure at all n locations
  Clone ID: PAT_TA_33574
tataaaggacattatcagtgagctcaacaaactagattctgaagtcgtggagatgttgaagaaagatccgaaaccacttatatgccagctgaataggattttttttttaaatgannnagaagtggtgaaacggcgggggggggtgaatgatttgggaaaagatatctgggtggatccatcggtggagctccgcttcccgttcgagccaaagaaggacatatcatgctgcctgcagctcaccaacaaggctgcctccagctacattgccttcactataaatatcgacgtaaacaagtattgcgcacagccaagcaaggggattttagcaccatgttccaagtgctacatcaccataactttgcgaccacaggaggaggccccactgaatatgcagtgcgttgacgtgttggtcatgcagggcataagagtgagcgagcactttacttctgatgaaatcactcaagacattcatgcaaatgccggcgtcgtggatgaggtgatattgcccattgcctatattgcattggacaaccagcctctctctcaatagtcagattcgaggaatgtgatattttctactacacaagaagacacaccccttgatttcatttcatttggatatttttggcttttacccttgcggaccccccttgggaattgttatcatgcaccccctctcagtatagaaggtaggcaaactagaagtttttttattttcccacaaagattcaccccgcagtacccagtaggcatagaagc

SEQ ID NO: 33575 - DNA, 601 bp, Triticum aestivum
  unsure (1)..(601): unsure at all n locations
  Clone ID: PAT_TA_33575
gcagcagcagcaactccgtggtccggccgggcgccatgccgcactacgacgtcgtcgcggcgacgacgcatccaggcggctggggtgatcaccagcttggctacgccgtgcaaggaggaggtgatgccgcgtgtgccggtggaatggacggcggcgtgccgccggagttcttgcaggcggcggcggtggcggccgacaacgtctggggcctcgaggagttctggccaacggtgccgccgtcgctccacggcgactactgattgcgacggatgctgttgtgccgtgtgccgcctgtataggtatccacatcggtgtgttagtgagttggattcgtttgctagaacaaagcgtgccggcttcgctaaaatttcaactgaaatttcactcgagttcgtctcaagccaaagctaaattaattttgccgggcaaatcttaaaaatgttgtctntctttgggatgagttcagacctactgtagattaagtgttgaaggtcgaaacctcaattctnncaagcacattagagccgtcaatgcttctttgagattcacactatacgtcaatgtatttttcctncattgctctgtattagatctagtttgt

SEQ ID NO: 33576 - DNA, 542 bp, Triticum aestivum
  Clone ID: PAT_TA_33576
cttcaagttggaaaaaactttagtcggtcaccagcgctgggtctgggactgcgttttctcggtagacggagcttatctgataacagcttcgtctgatacgacggcaagactctggacaatgtcgaccggagaggccaacatggtgtaccaggggcaccacaaagcaaccgtctgctgcgccctccatgacggggctgaatcggcaccctcataagcaacaccgccgcgacgcggcatggttctgtacatatctctgtcgattcgaacaacgcagcagggtgctctgctagattttcagcgccgtggcggctcgaggacaggcggttttaagatttgatttgctgtagtgctaggaccatgtgtaacaatgtacttatatgcagtgcagcctttgggggctgcgcacaggtgatttgtatggttgcttacattgttggatatttatttgtgcacaaccgaaataatatgcacccaccgccattggttccgcttggtaaatgcgagccataaatttgttccaaaaaacaaactccttactggga

SEQ ID NO: 33577 - DNA, 714 bp, Triticum aestivum
  Clone ID: PAT_TA_33577
gggaaggcagcggaggagagacagcatttcaagagcgtgatcatgtgtgcactcatactgatactgggactgcttgtccagggacaaatccaagtagcagagggcaagagctgctgcagagacaccaggtcaagaaactgttacaacgtgtgccttcttgtgcaccccagtactccctgctcaaaaatgtgtggctgtgtgctcacaagggacagcacatgccccagggaataccctaagctcaaccttctccccggctcagctgaaccagatgccgttgagtactgcaaactaggatgcaggctctcagtctgtgacaacgtcaactcagctgagcttcgcaaagacatgaaagtcggcgtggagcgctgcggcgatgcgtgcggccggttctgcaacgatgccaccaacattgcatccgtcgatgcttgatcatgtatgagcatgcgctgagatcccggtggcttaccttcttcgtcgttgctgccgcctcagccgttatctagttcttgctttagctatgatatgttagcctttgatgccaactactgtatgttgcaccctagtatctgaaatgttgtgtgggtgccccggttcagctggtgtgtgctctgcttctattttgggatcttgcatgatcctttgaggtgctgggctggggttcgccgtaatccccggtcatgtaagatagtatgtcgtgtgtggggtaacaaa

SEQ ID NO: 33578 - DNA, 683 bp, Triticum aestivum
  Clone ID: PAT_TA_33578
gcctgcgacgccggcggccagccccgggtgcgctgggctgccggcgcaacctccgacgagctcactccccggatttgaaggcccccctagccggctgggcgttcggaggccggcatgggtcgtccgcaccgagtctaatgttaggagagaaagaccaaaacgacctgatcctccatgcaccatctgcaaaggcactgggacaataaattgccgcaactgtttcggtagaggaagaataaatcatgtcgatctcgccgtgctccccaagggagaatggccgcaatggtgccaaatatgcgggggtagcggcctagattactgccaccggtgccatggaacaggtgaatatcgagaacccatgggctttcacttcacagtcaataggaaatgagtgtcgcacaggcagtgttggaaggccggccaagtcaaatggtcaggaaaaaaaatgtcccattgaggccataggattaacatttgaatgagctgtgtgaagttactgtgaaaactttgatcttatgctaatgctgcagaattttcttgccagcaaagaaacattagatgtagattatgatcagaggctaagggtcttcagttttatcaaccggctaaatttgtgtatgaatgacagtgtgcatctgaatgctttgttcgaaagaagatgccgatttaccgcaaaaaaaaaa

SEQ ID NO: 33579 - DNA, 767 bp, Triticum aestivum
  Clone ID: PAT_TA_33579
gaaaaaataaacgtgcccggctagaacaaatcagggtcatccttggtctttctgattctcaaaggacaccaacgccaggagaatcactgagggatttctacaagagaacaaatatgtactggcaaatggctgcctatgagcacactcaacacaccggaaaggagctccgcaaggatggatttgatcttgctgaaactcgattcaaggaactgaaacccatactcgatgagctggccgtgctggaggctgaacaaaaggcggaggaagaggccagcgcatcgactagttccaagaaggacctgaagaaaggcaagcagaagagcgcgggaagatagctttggttctagaaacggggctttgctttgctccagaggcaaaatgaagcagtacaaaatcttccggtgtttttttcgaaatgaaaatcttctggtgtttggacctatatagtgtagatctcatgactttttatgctatcggaaaacgagagacacctcaaaagagttttgtaatttgtgtaatacatttttgtttacttctcatatgaactgggaaggtgttcgtggtagtgttaaagaaatcgtcgattgtaaaactttggttctagaaacggggcttagctttgctccagagctcgccaaaattaaagtacaaattcttccggtgtttggacctattgtgtagatctcacgactttttatgcgatccgaagagtgagacccttgaagagttttgtaatgtgtctagtacatttttgtttacttctcata

SEQ ID NO: 33580 - DNA, 1130 bp, Triticum aestivum
  Clone ID: PAT_TA_33580
cctcgcttcccctggccaaccgacagaccctgcagtgaggacggcatccccgtcgtcgacttggccgtcctcgtcaacggcgacgccagggaacggtcgcaggcggtccggcacctcggccgggcgtgccaagactggggcttcttcatggtgaccaaccatggggtgcccgaggatctccagagcgcgatgatggacgcgtgcaaggagctgttcggcctaccgccggagcaaaaggcggagttcatggacgccggcccgatggaccccgtccgcgtcggcacgggcttcaactccgccgtcgacggcgccaggtactggcgggactacgtcaagatgttcgcgcaccccgagctccactgccccgccaagcccgacggcctgcggggcgtggccgcggagtacgcggcgcgcacgaggggcctgctgctggagctcacggcggccatctccgagagcctggggctccccgccggccgcatcgctgagcgccttgacctcgggtcctgcttccagatcctcgtcggtaaccattacccgccgtgcgctgctggcccggacgacgacgatggggcggtcgggctgcccgctcactccgaccacggcctcctcaccctgctcttccagaacggcgtcgatggcctccaagtcaagcacgacggccggtggctcctcgccaagcccatccccggctcattattcgtcatcgccggcgatcagctggagatcgtgagcaatggaaggtacaagggtgtgctccaccgtgcactggtcgaccgcgcgcaggcgaggatgtcgtgcgtgagcctgctcgggccgtgcctggacgccgtcgtcaagcccgtgccggagctggccgtgccacccctgggactagagttcaggggggtcaagtacagggactacatggaacaccagcagagcaacaagctcaacgagaagggagcgctggacctcgttcgggtgcagcgtcacatacttactgacacgctattcagttcttgaacttactaggcatgattcctcaggttcataacctcaagttgaccaaaatttatgtgtccattattaaaatttttttagcaaccggctggagctctgacttttcactaagaagaagagaattgatc

SEQ ID NO: 33581 - DNA, 367 bp, Triticum aestivum
  Clone ID: PAT_TA_33581
ataatctgcaaattttggtgtctcggatggtctaaacatgagacctatgctggaactgcaaattgtgcctggtctttgtaagaatgctttttttcgtgtgaccagagcatgctagaattatagcaaattaggggtgtctttatggtgtgagcatgagcatgatgagacatgtgctggaactgcaaattgtgctggtggattaagaatgttttcctgtgtggctagagaagtactgtacgctagaactggcaaattgtgctgctgttgcgcgaatctttcttgccacaggttccatcgattgtgtgaggttttatgtatgaaacggtcgctgaatttgtacttggttcagtaaagcttttctgttgtt

SEQ ID NO: 33582 - DNA, 1056 bp, Triticum aestivum
  Clone ID: PAT_TA_33582
gcccgggcccccgcccggcgcccgccggggcgccgggggccccggccagccccggcgtcctcgaggcccgccgcgggctgccgcatctggtccacccgccccccggggccgagccgcgcggcccgcgctgcgcgccgcaggcggcgcggcaccctgccccgccccgaccccctcggggacgcccccgcggccatcctcgacctccgtcccctcggcggcgcggcacgccccgggccggtcttggccccggggcgccctttccgccgtctcggcggggcgggcgggcccccgagcttggggcctgtccgccgcgtgctggtgctgtcccagatggtctggggcggcggtcccacgcccgcaccgccccctgcgccggcggctagtggccaggcgcctttccgggtcgccggggcgtgcgagctgtatccctacctggcggtgccggtgtgggagctggatgcggcgaacccgggcatcttcaagaggcagttcgggatgatggacgacgacaaggcgcgcgcgatggacgagaagatcaagaggcagagggtggcgcagatgaaggtggagctgcgccgccacgacctggccagggaggtgaccaaggcgatcatcgacctggtcgactgatcggagcgtcatgggcttacaagttagtacaaactgaaactgtatctgtgatcacctgaagttggtgcgatgaaatgcggcgttttggtggagcaagaatgtttctgaaactatgatctagagtctgcagattgggctggctcgatgcatcagacatgtggtggaactgcaaattgtgcctcctgtagtcctgtttgtaagaatgcttttctcgtgtggccagagcaaatgctagaaatagcaaattaggggtgtctttatagtgtaagcatgatgagacatgtgctggaactgcaaattgtgctggtggattaagaatattttccgaagtgcgctagaactggcaaattgtgctgttgttgcgcgaatctttgttgccatggttccatcgattgtgcgaggttatgtaagaaacgttcgctgaaa

SEQ ID NO: 33583 - DNA, 1716 bp, Triticum aestivum
  Clone ID: PAT_TA_33583
cggcacgagcttgtactgcagtaatgtataaggcaaccagtggaagttgcttgcctactggtcagtctgagagttcttcgcgtggtgatcaaccagccacagaagaggcattccaggatctatctttaattgataagcaacggggcatgtccgagcaggcacagtctagtacaatgcgacttgcggagaaaaagcgcagtacagctgagaagaatattggcatggatgttcttcgtaagttacttctctgggagcctaaaggatgctgcaatgagccttggtcttggtccaacaaccttggaacggatatgccgcacacatggaatttcgcgatggccatctcgcaagataaacaaggtcaaccgttcgttaaagaagatccaaactgtcattaactctgtccatggagtggacagctctttgcagtatgatccagctactggatctcttgttccagcagtttctctgccagagaagacttcattcccttcatgtgatgctgtgtctagtccatctgttgggaaaactgtggatgaaaaatctggcccaaaatctgagcaagggtattcgtcacctgaaggatgggaaagagatagctgtcagttgcagcgctctgatgcgcagaaaggggaaggcggtgaatttcacatgcagacaactaactatagtggcagtggtgatcacggctcttatggtccgaatatcacacatcatattagttctgaaggaacacaaggaccattatatcccactggtgctgttagtgctttacatgacaaagaaacaggttgcatcgaacctttgccctgtgtcctcccaagcatcaagactaccagggaccaaatagtgggaaggaactcaccacccatgcaacaagcagatattgatatgtttgatgatcgcgaaggcagggagcatactcatccttctacctctggtatgacagactcttctagcggcagtgcatcaagccaccccacatttaagaagaacccagcacgtccacttaaagacaagagcagccctgcacttacggtcaaggcaacgtacaacggagacaccgtgcggttcaagttcttgccatcgatgggctggtacaacctgctggaagaaatagccaagaggttcaagctgtcgatgggggtgttccagctcaagtacaaggatgacgaggacgagtgggtcatcatggcgaacgactctgatctccaggagtgcgtcgacgtcatggactcgatgggcacgcgcaacgtgaagctccaggtccgggatctcccgtgcctcatcagcagctcgggcagcagcagctgcttgcagctggaaggacacaattcataacacggtgaggaagtttaaagaaggatcttttgttgccctcaactgtatcatactgcggtaggtgtagtctacgctgtgtagcaacagggtttggtagtctgtactgtacgcgtgtagcgtgttatgtagcggcaatggcgaacaggaagtgtagtgatcgtcgtgcaggcatgacggtgcaggcacgatgtcgtgcctgtgacgaaacggtgtcatggaggtccctgagaggatgtcatgacaataatctgttgtcatgagggtctgcggtgcctggctgccaatgtatcgaactcaaactcctggctttgttatgcatgccggaggaaacaaatgcttttgaatgtttctgtaaaaaaaaaaaaaaaaaggccccta

SEQ ID NO: 33584 - DNA, 988 bp, Triticum aestivum
  Clone ID: PAT_TA_33584
cctgagctgccttcccaggctgcggaaattggtgttggatggaaccgtgatcactaatcaagcaatggagtatctgggcgctggagtatgcccgctagcttcattatctctgaggggctgcggtatgcggcccgaggattgcatacccttgctgcttgctggttctgttaaagagagcctacatgcgttggatctctcaagaatcccaagtctcaccgacgacgctatcatggtgatagtgcggacccgaactcctcttactgagctgcggctgcgagagaatccagaaataggggatgcttctgtcaaggctcttgcatccatgcaattcaagggggtaacttgcggcagcaccttgcagctgctggatctctacgactgcggtgggatcacattacttgcaatgaagtggtttaagaaaccactcttcccaagactgcgatggctcgggctaaaaggcagcttgaacaggatcatggtcgacgccctggttctaacccgccctttcttgcgcctggcatgtggcggcgaggaactggggacaccataccgggacacatccggcgagtggtgtcggcacgaggacgatgattccgaagatcttgagccctggcagttggacggtgagccggtatccgacgcggaaaccaccaatgaggagtaatgcagcaacttggccctatgctgccgtgtgccatgtttgcttgccccagaatgatcgaaacagctctcatcagtcgtgtgttggtctcttgttgtattaccggataagctatattttcttgctgttatctttcctcatgtgcccgttccgtgtgcatatggcaacctgtttgttgttacatcgtgctatgtatgttgtatccagattctggacgttatttatggaaatatttgttctctcacatgttgatgatcctttaaaaaaaaaaaaaaaaaaaaaaaaaaaaaaaaaaaaaaaaaaaaaaaactcgagactagttctctc

SEQ ID NO: 33585 - DNA, 812 bp, Triticum aestivum
  unsure (1)..(812): unsure at all n locations
  Clone ID: PAT_TA_33585
ccggcgccngagcacagtggaggaagataggctcatctccctcatggnaaaaagtttgcaagcgatacaggcaatactaccagcagctccaagccgtgatctcctcgttcgaaaccgtcgccgggctgagcaacgccgccccattcgcctccatcgctctccggacgatgtcgaagcatttcaagtaccttaagagcaccatacagagccagctgcgcaacaccagcaaggtggcgggcgggaaagacagcctcggcaaggaagacatggccaacttcgggctcatggcgggcggcgccgccctcatgaggggaagcaacgcgaacgcgttcagccagcctcacaacatttggcgaccgcagaggggactcccggagcgcgcggtgtcggttcttcgcgcctggctgttcgagcacttcttgcatccgtacccaactgatagtgacaagcaaatgttggctaaacagacaggcttaacgaggaatcaggtctcaaactggttcatcaacgcaagggttagactctggaagccaatggtggaagaaatccacaacctggagatgcggcaggggcacaagagctcggccgccgacaagaatcagctcggcccgcagcagcaaacccagcagcattccccggacagcagcgggaggccctccgatccttcgaactcacaccaagggcaaagcagcagcatgtcacagaaccgcagcgcccacgctgcacatcggcacatccagagcgagctctccccgatgacccacgacatgccgggacaggtgagcttcgcgtacaacggcagcgggatggcc

SEQ ID NO: 33586 - DNA, 957 bp, Triticum aestivum
  unsure (1)..(957): unsure at all n locations
  Clone ID: PAT_TA_33586
tgcacggcggcggccggccactctttaccgtgctgatcctcgccttgtttgcgccaccggccgatgccagcccttggcaggtctgcggcaacagcggcacctacacgaccggtagcgcataccaggccaacctcaaccgaatggccgacactatcttggccaacatctccacttcgcccaccctcttcgccaccggcgccctgggcgcggcccccaaccaaaccgtgtacgccctcgcgctctgccgcggcgacgttgacgccagctttgcctgtctcgtgtgcctcaagtcgggcttcagggacgggcaggtgctctgtgattccgacatggacgtcaccatgttctacgacatctgccacgtccgttactccaaccggaacttcctcgcgttcaccaacaactcgcagcagcatgccttcttcagtaactccccctcccttggctcctcagtcgccgcccgcttccagactttcgtcacgaagctcctcaacgccaccgctgattttgcggcggtggccaactcgaccagaaagttcgccaccggtgagatggacgttgacaggaactacttcggcggacagttcgacaagatctcttcgttggcacagtgcacgccggacctgacgccgccgcagtgtcgtgcatgcctggcggcggccatgtcggagatgccccggctggtattcccgtccaaccccaggggagccagggtggttggcgagcgctgcggtttgcgtttcgacgtatttcccttctatgacggcaaccctatggtgcggctgcaagttgggggagcaggaggaaaaacgaaggacactccagctgtagtaattgtacttgcaatattgggtggactantnnngagtccatctttattggtctgtcaacactgcaatcggcaacaagcaacttcgatgaaaagaacaaacttggtgannnnnnnnnngntgccgn

SEQ ID NO: 33587 - DNA, 827 bp, Triticum aestivum
  unsure (1)..(827): unsure at all n locations
  Clone ID: PAT_TA_33587
aaattcctctcctcgctctggtttcttcctgtaccgtgcgngaaactaccgacggctcaaaactccgaacacaaatttgataggtcacttgacccccagtcgagcaatccagccagtttaccatcaaaatctacggaagcaagcagtatctcatggatgacgaccaaacaaggcaggacaggaggaacaggcaggttgaccaagcagatgcatcaaatgcccacgcttacaagcagatgttctttgcgaagattcagaatagtcgctgccggcaagtttctgatggtaatccatcatctatatatgttactgtattttcttttcaaaagaggaagcttcagtactatccgacctctgaacaatccgtcatctcatgcatccacaacctagctatttcgtcttcagactgcaacttgcagattctaccagggcttcgttttatgatttcagaataagttttgggggacagtgtaagtagtactcaccgcatcataattgctctatgctcaatcaaatggaaattttatggatgcaaaaagggaaggttatgttcagtaccggagtcattatttcattcatcaacacctcatgtggtaaagtgacgaacagcaaaggacgggatgactagagcagcagttttgtttgaaaaagtgcatggaaatgattgggtgctgcccagtgcatgccaatatcagcaagtaaaggtgccatgaacaaaccagtaatcagcatcagttttccctcgtgagctctagcagttatataacctggcactgaccaatgtagaagatactgctgatttacaagaagaaaaaacagaagttggt

SEQ ID NO: 33588 - DNA, 482 bp, Triticum aestivum
  Clone ID: PAT_TA_33588
ggcaagaaaatcagggactatcactacatccatgttaaaaggctggaaaataaagtcacgcacctggtgaggttgctgaacgcagcaaacaggacaataaagaaggcacgcagaggatggtattatgctgctagatacatgaagtcgtattctacctagataaagaatacggcagctgctcggcacataaaagggcgcgacgacaccaaaagggctatgaagacagcgctcgcaagcacagcaaagttggcaagaaggctatgttacataggcatgaaatcggagcagtgcctagagaccacggatagtatttggtgagcttcggtaagctcatcataccgagcacgtttgctgagggctttgcccttttgatgctcttttgaacaacaaatacatatatcctgtgtattcctgttgttaccgtgaagtgtgcaaacaatctttgtttccaaatttatgcagagccaagtacgctacgatgg

SEQ ID NO: 33589 - DNA, 652 bp, Triticum aestivum
  unsure (1)..(652): unsure at all n locations
  Clone ID: PAT_TA_33589
acggncgggcgggaactcatattctctgttttttgagggatctgtggaggccaggggctgcgcgcctgcgacgatctgcggacggtactaagcctggtgtcgttcctttgtctccaccggtgccacttccctcgccttgtcatattcaccgaccttggcaggctatgagcagcatgtaccaccaggtagtacatgttctatggagtcttcatcggtacagacagggtgtcgttaaggagcatggttcgtggtgagatggttgcaaaaatggtctctccctctaatgacttcagtgggtacggccggatctgcggcaacaaaggcacggggatgaaccctgcttgatgcatgacgagcgccaccagtgcttgaggagttggagatggacgagtagcctagtgttccgtccgatgtttgtaatttcaagtttttagggatcctttttgacatgctatatccaaccatccgttggcaagtctacgcagtagcatacagttggattagctatcggacgagtgtgttcagacgagtttgatctttttttcttctgtacatgtgtatttccctgagattttatgtaatgattatttatttaataaataaagatatatttttctgacaaaaaaaaaaaaaacggcggccgcatacaaaa

SEQ ID NO: 33590 - DNA, 773 bp, Triticum aestivum
  unsure (1)..(773): unsure at all n locations
  Clone ID: PAT_TA_33590
ttcggcacgagggcgaggtccacttcacgtccgcaccttcgccgccgctgctgcccgacccgccatggcttccaccagcaccaccttacctgattggttgatgctcgaccgcttcgtgttctggagcgagaacttcaccttccccaagacgccgattcaaccctggccaccggcaccaactccatggataaaaagttccagatctgcttcaaactcgttgagccgccggaggtgtcccgcctttttctgcagatggatgaaggcttgtcgcagtcccatagcttcgacatcatcgccgcccaccgcgccgcggtgctcctccagatgagttatcctatccttgtgccaggctacgagaacatcatcccgatgatcgactacttcctctactataccgccggtggtggctctccgccgtctctacagcggctaccccctcttgacgggaccattgcccaggtccaggaccaaatcaaggccagtgctgacgtcatgacgaatcagtttttgcgcaggctgaagtgccttgacctaggcgtcctgtgccgcggagaggatgaggtcgccgtcgcacagctcgagatcaccgagtccggggcgccacctaaactccaggtcctgtgcccgtctatctctcgcagttgggaggtcaagcatccgcccatcgtaccctgcgacgatgtgaaggaatntgatttggaggaggtctttaagaactttgatgctcacacagtcatccccttcaagagttacctgtgttgggttgattactc

SEQ ID NO: 33591 - DNA, 1090 bp, Triticum aestivum
  Clone ID: PAT_TA_33591
tttttatatctaaccatgaacaaatatcatttggaaaattgtactaaggagattgaactacaaaaactgcgagtagtaggatactaatggacttataaaatcgacacgacactcctttacacttatgataaacaccttttacttttgtttcacctttcatatccctcgcatgaatgatgaacctgcatacattgcctttaagaaaaatgcttgaaaatgaaggaaacgggaaatcttgaattttgttgccgacaccatgactcgttggtgaagatgtgccatggccaatccagttctggtatgaatccatagtccacacttttccctatgatcctaagccagatggttggccaggatggccttggcacccttcgccatgaggaacttgatggacaacacggaggcgcggatgcaattgtcgtcggtgatgttctggctgtcgtccagcagaatgttccgattggcaccatgcaacaccttcttccccctgagatccttgtcgctgacggtgcccacgatcctcttggtcgccctgagccccttagcgtccccttcaccacggaagaggcgggtcggcttaaccctcggtgagtgccgaacgcgccgccaagtcaggagtcgcaggcagatggttggccaggatgaccttggcacccttccccatgaggaacttgagggacggcacggacgcgcgggacccccggctgcggttctcctctcggccgtccgcccggcagttcgtgcagcccggcatggaggaacaccttcttccccctgaggtccttgtcgcccagggtgcccacgctcctcttggtcgccatttcctcctcggtctccccttcccaggcaagaaatcaatcgggttaatgccaattgaacatcacatttctgccattcgaaagtgagttcatgaatccttgtgattattttgtaggtgttctctactgcactgaattcaaaatctgcaaaaatagaaaggaaaaaaaataagttgcaggtgtgtaactgaagaacctcgtcatgttatgacggaagaatcacttatccggagcaaaaatagactggagacgggcaggcttttcatccgcaa

SEQ ID NO: 33592 - DNA, 434 bp, Triticum aestivum
  unsure (1)..(434): unsure at all n locations
  Clone ID: PAT_TA_33592
agggatctaagatttggtgcggaagagtgagagagagagagtgaaatgtgttctagggtttgttcaaagtgaatggtcaaccctctcccgtgggggaggagggctatatatagtgtgagcccaaatgtggccgttgtaatgcaagtacgggcaggccggacatccgggcaaggggccggacatccggcgtggcaaggcactaaaataacagagctaaagcagaggaaaaaacagaggggccggacatccggggccaagcccagacatccggcatatcaggaaagcccagacatccggcacatggccggacatccggcaagttcaccaaatcgaatagccctctagatagcacaagccggacgtccgacaagggagcccagaaatccggggcccatggagagacaggacatccggcatanagggccgaacatccg

SEQ ID NO: 33593 - DNA, 1293 bp, Triticum aestivum
  Clone ID: PAT_TA_33593
gccggggccttcggcacgaggctctactccctgcctttttgcggatggaaacaatttccaacaaacagaaagtgtcaacagcaatgtcaagcacatctgcagtataagtcctcattagaatgtcattctattctgttggtggcgtgttggatcgaccataagtagcaaggacatgcgcttcttaccacactttaatatcctcccagtaactgtgataatgctctgccctgccaccgagtatctcactggatatagctggccatcgtgcttcaactcatcctatgtggtcaatggcagaaaaatgaacatgttctcattaacctttattttagcttaggcattttttttcttttgttattgccattcattcagtcctaaacacgaccacgaagttcagctatcacctccatccggtcggcttgcttctctttcttggggccgcggcaggagccgcgctttgctagatagacaaaggcctcttgattagtcaagacactggacatgatggtgtacagcacagtggctatgctccgagagccgacccagaccacaggaacttctgtgcttcatcagaatccaactctttgcagcacaatgattatttgccaagaattgaaccaaatcgcaggaacttctctagtccttgggaagcaaacagttcacaatctctgcttgatgacattcgggaccagcatggttgcttttcttctgttcaagctcagagaaactctactccatgcctttttgcagatggaaacaatttccaacaagcagaaagtgtcaacagcaatatcaagcacatgtgcagtataagtcctcgttagaatgtcattctattctgttggtggcgtgttggatcgaccataagtagcaaggacatgcgcttcttaccacactttaatatcctgccagtaactgtgataatgctctacgctggcaccgagtatctcactgaatatagctggccattgtgcttcaactcatcctatgtggtcaatgacagaacaatgaacatgttctcattaaccttttatgttagcttaggcattttttttcttttgctattgccattcattcagtcctaaacacgaccacgaagttcagcaatgaccaagatgcggtcaagatatttctgattttttggacggcatcatatgtgtatacattgtagtattgggaaagccagttgccatctcatgatcattcaacttgacagccggccggctcctgtcgccatctgtgtattgcactgttgttcagtatccatgctttcgtccacggggaggtgtttgc

SEQ ID NO: 33594 - DNA, 1140 bp, Triticum aestivum
  Clone ID: PAT_TA_33594
accagggaaacccactgtgtgccaccaaccatttcatgggttatgggaccaacaaagtagcatgatctgttcccaatagagccttctcacaaatatacaaagctcacactgtgcccacgattgaaccattacaggagagttcagcaatcttctctcaactacactcctaataataccaatcgtacatgacccaaatcacagtgcccagctgagctgagaaccaagacaagagcaaaaagaccaaacaacacttgctctgcaaaccctacaatctatcaccaacactaacatgatctgatgggtgatgatgatgatgtttgacagaacagatggccaccttttcttcctttctacatctcctcttttatgtggcagggtgacctggatgaagaggctcacctcctctccccttgttaactccatgtaggataaacatttttattcaccgccggtatctcctctgtcttgccttctctccagtctattctatctatgcatgtttttcgtatctacaccacaaattatatatgtatcacaaggctaactgacggtctccatgcgcctaagccagattaacaactgctgttgtctccaacaagttatgtccaaatgcaagcacctgatgttcagctatccatcttcaatgccccttactccttgtctccacagccgaaccatccttgagtgcttctcgagcttcgttttcttttcctaatgaaaatagggccgcagcctgaagataaaatgtagttggccatgtaggaaatatcgccagagcctgcactgcatcatccagagcttcttgtggcatgtcattcatgagatacgacaagcaacgcctcgcataaattgttggtgaaaccatggtaccaacatcaatgaactgagagtagcaatcaatggccatgctaaaatccttttgtcgaaatgcagtgtcgcccttcttctttgaatcaattgtagcttgcatttgattagtccacatctgaaatgagagctcatttgctgttccctcgtcatctttatagccagcggtttctagatgttcatgtattgcagtaagatcctttctggagcaagcttcagcaagaggagaaagatgaattgattgaagagtaaatgcaccaccacggggcttat

SEQ ID NO: 33595 - DNA, 820 bp, Triticum aestivum
  unsure (1)..(820): unsure at all n locations
  Clone ID: PAT_TA_33595
gcgatcttctccccctcctccccctccctctctttcttcctctactgcctccatcaacgccaagggcggagacggcaggagcgaccacgacgacgtcgacgcgcggaagccgctggtggtgaccacggggggcgggtacaagatggggtcgagcctcgcggccgggagctcctccatggccatcatctgcgagtcccacgtctccgccttgctctgcacgctcatcgtcgcgctcggccccatccagttcggcttcaccggcggcttctcctccccgacgcaggacgccatcacccgcgacctcagcctctccatctccgagttctcggtgttcggctcgctctccaacatcggcgccatggcgggcgccatcgccagcggccagatggtggagcacgtcggccacaaaggggcgttgatgattgctgctgttcctaacatcctcggctggctcgccatctccttggcaaaagacactacgtttctgtatacggggcgattgcttgaaggatttggtgttggtatcatatcctacacggtgcctgtatacatagcagagatttctcctcggaacaagaggggcgctctaggctgtgtgaacccgttgtctgtaacaccggggatggtgttggcctatgtgctcggcatgcttgttccttggaggatgcttgcgctgataggaaccttgccatgcacaatattgatacctggcctattcttcattccagaatctccaagatggctggcaaggatgaacaagatggatgatttcgaagccttgntacaaggcgattctcantcctgactcncaanatggagg

SEQ ID NO: 33596 - DNA, 734 bp, Triticum aestivum
  Clone ID: PAT_TA_33596
ttttttttttttttttttttttttttttacaaattgaaaggacactgcaagatttcctatatgaaacaaatacgaagtattttcatggagtcatctaccagatgttccaaaaggtgataaaaattctgcattcaaacaaaacatgcacttttcaattattgcccgtcctttcacgttgttgcttgacgcataacatatctatcaaactgataacttcatcacattaacttcctcttcttttcagttactgcaataccgatagcttgatcgctcccgccttggagaagaccagtccttgttccaagcaaattgaggtgcttggagaactcggcaggaagaaaggtagagtaaacctggggtttttctctggcaaagtacaaagcttcatcagcacagaggtcccccacctgttctgtaccattgatgtatgcagatgacgacttcaccttgccattgctaatgtcaatggcaacaatccataccttattatacatgtacgatgcttggtcatgcccgatcatgaagtaaatgacactgggctcatacatgctgataacagggtactctaatggggtacgaggaagatgtgtgagtccaccaaaccctatctcactggatctaatagatgcatcctgcttccacttcatcacgccgttgctttctgttattagtgcccaggaggtgatggtgaaatcatcactggcaggttcagtggtttcaaaaaactcatcatt

SEQ ID NO: 33597 - DNA, 620 bp, Triticum aestivum
  unsure (1)..(620): unsure at all n locations
  Clone ID: PAT_TA_33597
ggccgggccagagtcaaccgccccggacatgcatcaagccacggggcctcccctctccgagcgctaccacgcagaggcggctcagctccgggagaagttccacgcgatggacatcagccgtgtggctgtagatccaaccgaccggcgatggagcagctgtcagcgttcctccgcgcggcaccaggttccgttgcacctcctccattgtgctctccctgccccgcggtccctaccagaagccttgccagccgcagtctcccagatcctcctctctacgcgtctctgcttcccgtgcgacgtcgccggcttcacgatctccaccacgatgggcgtcacgagcccaagggagcgcgtcgagaccatggcgataatgcttcccttcctaccgtcgttgccgcgttccgccaattgcggcaggaagccatggcgcaggcagagaagtcgcctgtcgagtaggcggcttcagctgcaacaccggataagtgacccctccgtcataagatgaggttcttcagttacacacctgcagcttaaacaaaattcatttctatttttgcagattttgaattcagtgtagtagagaacacccacaaaatcttcacaagnattcatgaactcac

SEQ ID NO: 33598 - DNA, 808 bp, Triticum aestivum
  Clone ID: PAT_TA_33598
gcggtcggcgaggtccacatcgcgcacgagctcccaccccgaaccccaccagggcgctcccggcacccgccctgcgccggctcccgctccccctcgccgccgcgctcgccccccccttgtgcgccctgccacgcgccgccccggcccccgccccaggcgctgggtccgcccctgccgcagcccgcgtcctgggcgtcctcgtaatcgacctcgcctgcgcgacccgcggcgaggccaggcgaacctgtccggcccctccacgccgcgagcgttcattcgtcgccccttcaggctgttttcaatggctacggattagatgaaagaacaactcctctgatgggcgaagctcacatagctgatgagtgactcgtttaatttgcccgcgggttgctaataggatgtgctaatcccctcacgcgcgcctcccgcaaccgggagctcaacaagcacgcccgcctcggctgccaggtcgtgctcggcaaggagcaccaggggatggtcgtcgccctccccgagcccaagccctgggacatcccgtaatgcggcccccttccatggcgcgaggcgaggcgaaattgtgcggcgcttcgacatgccgacccgcgagccttccttcctcgccccttccggtgctttcatggtacggatttgatgaaagaataatgaatttgatgggcaaaacttagagctgtttctgaaacttttattttgtttgaatgtggatgatgtaatgtggaatcccttgccatttacgtcagtttgttgtttgttttgctttgtacatttgatgtattattggttgcagctc

SEQ ID NO: 33599 - DNA, 176 bp, Triticum aestivum
  Clone ID: PAT_TA_33599
gcgactccgggtgacgcgccacagaacggtgctctcgttccctcggaggctgagcccaaaccttaagctgacatgattagatgctggaaattgttttattaagacccggatggatactgaatatgggaagtatatgtacggagtacattctagaaaatagattattctagtaaaaa

SEQ ID NO: 33600 - DNA, 620 bp, Triticum aestivum
  Clone ID: PAT_TA_33600
tcgcccagcgtccgacacacacccgaccacgtctcgatacccttctcccaaacacccggaagcaaatcgttcgccatgtctgagaagtcccaccgtctctatgtcaagggaaagcacatttcctatcagcgaggaaagcgcaacaccaaccccggcacttcgcttttgaagctcgagggtgttgacaacaccgaggcggcaaactggtactgcggcaagcgcgtagcctacgtctaccgtgctcagagggccatccagggctccaagatccgcgtcatctggggcaaggtcacccggccacacggcaacagcggtgccgttcgcgccaaattcaggtccaacctgcctcccaagtctttcggtgcctccgtccgcgtcatgctttacccttcttcgatataatccccgtcacgactctgggtatggaaacgaacgatagatgagcgatggagtggagggtgacacggcgcaaaactcgggcgaagagcgagagaatggcagcagagacattcatgctcgtcctctttctcatggcatgttcaggctggttcacggtgtcattgttttcggaaaatccatgacaatggcgaaatcaatcaagattccttccaagatcaatc

SEQ ID NO: 33601 - DNA, 757 bp, Triticum aestivum
  Clone ID: PAT_TA_33601
tacacagtacccccttcccatgcgtccctcggatgggttgaaggcaagaactaaaggaggaccccctaacggcggcaagcttcgtcgcaagtcacgcctccagcaccgcacagctctgtttcttctcatgttacatctaaagaaaagagtggcgcattccgtgtccagtgaagctcaagaagcaaatgcctctgctccattagcggccagtgttcctcttcaccaagaagcagagggcagcgcgtcgctgattgccaccgaggcgcagaaacccagcaccgtggcatcccaactctcgcgcagcggctcatctaggacaacggaaagtgctccggatggcggccaaggcaatgccggtgcagcttgattgtgcatcatgcttctctatacccatgggatggtcatgagttctgattagattgaaggcttctccctttccagcagaaatatgatgtactgcagctgtagcaggaataggtgtgacgtccatttttgtctaccacaaaaaatggtggttttagcttggttgtggcacaaaaagtgtggaagacaatcaaacatgtcgttgccatttcacttttttggatcattccctaccgtcttgaatttctgggggcagtggtaagaaccatctgcaacaaactgagatggaaagaacgaaatgttcgccaaaagacgttgaatttcggtgagtgtttggttgtagccagagttgtgatgcgccacacctttttaacattttaccccactttcagac

SEQ ID NO: 33602 - DNA, 855 bp, Triticum aestivum
  Clone ID: PAT_TA_33602
ctcaaatccccccagcgccggtggccaacagtgccgcccaccgcgtgcgtgctaggagatccaggggaggccatcggggttccggtcggtggtggagccacagatctcgtcagtggctccacatccacatccccgcagttcctccattcccgtcgctggagcacccgcacctcagctccctaccccgcagccacgccggagccctgcgccgcgcgaggccgccaaggtcgccgtccatcttggtggcagaggtaggtggccggagtgcccgtgcctcccgcagccgaatctgccagagccaccaagacaaggcggatccagggacgacatggctgcgggggagacaaggcgatgcaggggaggccaggattggcgtggggcataggggcgcgatagagacggcagatccagttgcgggaggcgtcggctggactggatccggccggatggaggtcggggagggattggcggccggcggtggggtgtagggctccatggccaggatggaggtcaaggatgagcgggggaggaagaagagggatgagcgccgcagcggtggtggccagcgcccgtcgtgtggactaggccgtgatggtcgtggtctggaatcgacaccaattgcgccggcgagttcatcctccttctctcgtcctacaactctgtttttcgtgagctccggctccgattctgttggcttcggcgagctcatcctccacgtacagagtgcgggttaattgtgacctgatgtaaaaaaaattgaagacttggccccgtgtaattatatggactaatggttaattactgttgttttaatcagtttatatgatctgttagttattcgatgtttactccttc

SEQ ID NO: 33603 - DNA, 814 bp, Triticum aestivum
  unsure (1)..(814): unsure at all n locations
  Clone ID: PAT_TA_33603
tagcgtggtcgcggccgaggtactatattgacaaccttgtggggaataagcaggcttactttgagaggtcgccaataaacttcgctgacagatttacatgtccggtcattttgtttcaaggattggatgacccggatgtatcaccnnatcaggcaacaacaatatacaaggctataaaggacaaaggtctgcctgttgctttggttgagtatgaaggggaacaacatggcttccgcaaggccgagaacatcaagtttaccttggagcagcagatgatgttcttcgcaagattggtggggcacttcaaggtggcagataacattgctccaatcaagatagacaattttgataaagcctcgtgattgttccaaaggacaaccgagcgtctctcggttgatgagggtgtgttcgtgccaacacgcccaccagatttcaacctccatgaggcagaataaagggggtgaacttcctggattgtctcatttccttgtaatcgttttaaagagctgcgacatgtatgccgttgaagcatcaactagtgtaccttttccttcggcttggtacacctctggaccaagtttcagtagtgaagcaaagggctgcttagcatttcccaaaatattgtgccaggagactttatttgagtgaagagagatgcggcattatggtttattatcactgccgtgtttagattcagggttttgcaaagtaacttccctatgaagtcgagaccactttgaaatcaatcgaggatttgttttgtaaaaaaaaaaaaaaagtcgacgcggccgcggtcgacgcggccgcgaattcg

SEQ ID NO: 33604 - DNA, 927 bp, Triticum aestivum
  Clone ID: PAT_TA_33604
ttcggctcgagggtgacctgcttccttcctcattacgaataattttatgacctaactttttatttttatgttcatagatccatggtgattcctctgtgcctgatatgcgttacggtccattgtcatgtgctggtgaagccacatctgcaccaagtggaacattgaatttcgaggaaaccaatcaggtatgttttattgatctttatccatcttgccatctcaatttactaatatttaactattttttgtacaggtactgagttcggatgaatgcagtaatagagggcagaccgttatactacagtcccttcatgccattgtggtctcatcaggatcagaatcaggctattttgacccgacgaagaaaccagtggtgaagactagagaagacggcaaacaatggctctccttgccgctgggtcgccacttctcaaacccttcggggccagagctgaagctgctcaagtcactgatgtcccaccagccaatggtcccagcctcgctgaagcattggggttcggacaacatttatcagtttccgaacatccccatcttttctgaggtgctgccgcttgtaactgtccttgactgtggcctacgcaatctagcacaactccgccagtgatttacaaggctctgataactcagatgccaaaagaagtctcacatgttaattcttggttttcctttgttatgtgttgaattatcttagactaagttagtaattttttatcagtgaattaaaagtttggttgtggagaagtacagcttgatttgcttgcagccgtggtggagtaaattgcaagaaaccaccactgcgagggctaggttatcagaaaacactacgttactatgtttgtttgcagttggtctgttatttctggtttgtccaactgctgcaacttgctatgtttgcagttgtgctgt

SEQ ID NO: 33605 - DNA, 959 bp, Triticum aestivum
  unsure (1)..(959): unsure at all n locations
  Clone ID: PAT_TA_33605
gnatcaatcaaactgcatggtaaactaacaanattgccggacttctttctcaaggtggatttctagtccgagagctgcaactttcaaaaactggtttgagctgcgaagatttgtcagacctgcaacagctggatctgttgctctatctgaagctagatgaggattctctcgtctttgttgatggcacatttaccttccagtcggatggattcaaaagccttaaggggctgtgctttgagacaccaaagcttccaaaaattgaggtcatggaaggagccatgcctgttcttgagtctcttcagctgttttctcagaatatacaaggcctggatgtgtcagcaatcaaatctctccatcatctcaaggaggtgactcttcgctcttcagttgatgcgcaaacaatgcgattttgggaagatgaagcaaagaagcacaaaaataggccaacaattgttgttgctcaaagtcagaatacatagcagggacaggccaacaattagcaagacctctagaatggagtgaaaactggcagaagactggtcaatttggtgataacttttttttgaacaaaaaaggttgagttgtctctacttatgtattccagaagactatggcagggagccaaagccaagagtacaagttatgcatgaggcatcgcacaaaagagcaaagagaggagaggcaagagaaccaaaaaccctggtctaattaagaaaagctatcacctagttcttgatggtactttggtgattactcatggatttcgttctttccttttatttattgagatcatgcctctttatttcgattgagctatgttgttctgttatcaagtgtatgatattattattggttgttgtcttgagacagctacaaacaaagcttgtgtgttcactctatgtgcacgcttttgggattgatgagattcatctgatcttaagagcatatggttagcactt

SEQ ID NO: 33606 - DNA, 1278 bp, Triticum aestivum
  Clone ID: PAT_TA_33606
ccgcccccctgcccccgggccgcccccccccgccctcgggcccgtcccccctcacgcggccagcgaccatgtcgagtggcctgaacatgtccctagacgacctcatcaagcaatccaagtccaggcccaaagccaaccccgccttctcttccgggcccacccgccgggcggcgccgtccgcccggaccatgccctacccgtgagctccaacgttattctgttacgccgaataaggatgggaagtctcagggaagcacgtaagttgtctttgcaagaaaagtagaccgcctggatgctattgagagatataatgggggtcggccagataggaagccaatgaagatagagctcattggaaataagaccgagccacacccaacagaacctttgatgtacaacggcacttcttctaactacaatgcaatgccaaacagtctgcttcagagaggtggcccgagagggccatttcatggtaatggtcgttctggaggcagtggtcagggcggtgctggcaaaagaggaatgtttcaaggcaacgttcgtcctggaaacactgtccaggacggtggtgggcggggacagggtagagccagggggcatgatcgcagccgagttccgacctctgctgcggatcttgatgctgaactggagcagtatcatgcagcagcagtgaagcaaaaatgaggctctgatgtatattttatactccctccttccatatataagtgacgtagttttagtccaaatttaaactaaaaccacgtcacttatttatgaactgagggagtatatacatagactgttgcattattagttttctgcttttagtcgtcaggtaccatgttgagaaaagttggaaggcattaattcgacatttacatctgctgcgctttttatatccctactccgagtgctggatatattgtattacctaattttgaaacatgggtgtcctattggggtttaaaaaacttcacttatttatgaacggtgggtctatttaaattgattttctaattgtttcttgtctgcgtctagtcgtcaggttccatgttgagaaaagttggtaggcatttattcgacatttacatctgctgtgcttttgatatccctactccgtgctggatatgtcgtattacctaattttgaaacaggggtgttctcttggggtttatttggataataagattacaaagaactagttcttgttaaattcaatttctaactgaatctgagggggggcccggtacccaattcgccctatagtgggtcgtatta

SEQ ID NO: 33607 - DNA, 1289 bp, Triticum aestivum
  unsure (1)..(1289): unsure at all n locations
  Clone ID: PAT_TA_33607
ctgctcggctcagtccagccatggagctggcgctgcggattccctgctagcctccttcatcttcatgtggatttaggtggcacactagatgttgcaccaccgatggcagtagccagatttggcgttcgtggtgcaattacctctctcgctctcaatggtgacgtagatctccttttgaccgatatgccattgtttcgtgcagccagttgaggttggggtgtgcttgtgcagatagtcgatggggcgcttggccttctagctatagactgattgacaggcatggttcattgttatttccttcctttaatagtattgtaagggaagcaggttctccaaataaatgcggaagattgcagcatcaagggtatcacttcactggatttttctacttcttggtgggcagctaaattagtttccctggtccgtttctcaactatcacagaagaactctttactctgtaattttctctttatttgtgctgaaggcatagatcaagtgctacatggctatgctcttcggagcttagagcatcagtggttggcctcctttctatttgttcttttttctaggatttgcgtgtgttaatcggatgaatatatggaaggatacagagaggccagagagtttgctatcaaattctcaagcagcaagaagatagctagcctaaatgaatcaagacatgaacagtgtcgagaagttacggatgcagaagtgcagcaagtatcgcctctatttttttatctcaaatcaaccgcagaaaaaactactggataatcatcttcttgccactttataattggcttactgctatgatcctggtgttatttgctatgagaaaagaacgagaggttcaatgtgcacctcatatcatcacatcaaatggaataattgaataggcttatatttcctcatatctgcacacataatctcttttatgattgtttacctcttcagtctactattcttagatgatgaacttctgctcttttatgccaagtagttaaatttgtgtgcatgttctcatggatcatacttagattttgcaactgtggcccatagggccatgctaattagtcctggccatgatcaggagtaaatttatacaaattttaatttgcatggtattttgtccagcaccaannncaccaatggtgctattgttatgcttatttttcacttgataagaaaatatacgtacaaaatctgcttgaagttgtaactgtaactgtacgtctgcattggataatttcttggactcgtgtacagtagcttgcnnnntcttttcaga

SEQ ID NO: 33608 - DNA, 421 bp, Triticum aestivum
  Clone ID: PAT_TA_33608
ggtacccgtggatccactatgcaatagaccactcgggcagtgttgccataggcgacacgcagagcccgcactgtcagatgggagagcgccaacggcctttggacgatgtcaggaacgggggaccttgaaggatcaggaagagaaacatctgagccaccgtcagactcatcaccgtcggagccagcgttgtcaggcgcctgaatagcatgggatcagtccatcatcgcccgcagcttcacttcacttcagttcagctcagcatactagggagaccacggggaatgtgagagtactgacatatgacccaatcgcgacaaagccttgtgctgcaacaactgtggctagggataagagttcctcggctgcaacttccaataactaagctcgcgtaaaagtattagttagcgggtcttggttgaat

SEQ ID NO: 33609 - DNA, 871 bp, Triticum aestivum
  unsure (1)..(871): unsure at all n locations
  Clone ID: PAT_TA_33609
ccgtccggtgaaaagcacaaagaatctgacgagtacaaaagggcacaagaggaggagtgggcatccagacagcgtcagttagcaatacaggctgaggaggcaaaggaggcgaagaggctacggaagagaaaaaaggctgaagctttgcgactgctcgacatggagaagagacaaaagcaaagactggaagaagtccgtgaaacacaaagaaagagtgaagaaactatacagctgaaggagcagtgtcgaggggcggtaagattggagcttgaaattattgaaaggcgatacactgatatggcttcaatattgcgtgcattgggcattcctgttgaagggggcgaggttaaagctgcttataagcaagccctcctgaagttccatcccgacagagtatcgagaaacgatatttatgagcaggtcaaagcagaggagacgttcaagttcatctcgcgctttaaggagaagctgaggatatagcttccctgctaccagttatataggagggttaactttttgataggctgaaatcttgtcagcaggtcaagctgtgaaattaattgacgctgaacgtaagacagtgtaatccttaggattagcgtggagcattcctcatccatcatttgagtttttcttttcagtggcatgtgctctgcttagcttaatgttattccaagtttaatgccggggagatgtttagaggtggcaggcagaagggtcgttttcactgatggacccaaccagtagcacttttttcatgatatacgcgaaactgtgctgattgtacgattggtttccctgcattttttggagcagtcaactatacctgtaatataagtgaaaaagatatttacaananaaaaaaaaaaaa

SEQ ID NO: 33610 - DNA, 1283 bp, Triticum aestivum
  unsure (1)..(1283): unsure at all n locations
  Clone ID: PAT_TA_33610
ctctgtgttcttctctgttttttttttttggccaaattcttggctagaacacaagaatttcacatatgtgctgcataaattttgggccttgtttgaactaacaaatcaggaaattcccacatcacggacggattttattcaaccaaacacacatatatggcatcgacacgcgagctctttacgatgacacttgtaccgcaccatatagcatgcatgtttcagtccacctcccatggtgcatcctctccaagccgttcctttttctccacacaattctttcagggtgcctaacgcaagtacttggacaagcgggcatcagatcgccacggtaggccggtgcgcgcgccgatcgctctgcatttgatgcctgccacttgacaggcaaaaggcagcatcttttccggagccatctctgtgcacagcccgtagagcactgctcctatgaacgcatcgccacaaccggtggtgtcaacaagctctggagcggggattttttctgctgttcctatgagcaatcttccgtgtatagtcccatgccctcttccagagagtctcatgaacttggatgatacacaagttggcagactgtcatctttatgcactttaagccttaaggactcagcaacattcccaatatctaccgcatctattccagaatcatcttcgatcctctcaagcatcatgcacccgttttctccaagggttgcaatgacgaatctcgcacggggatattgcacaaggatctctagtagtgctgagggaatgcatgaaattgatgtccatttctctggaaatttacccgagcagacaatgtaactcgataggccgagcagatgctccagttctgtctttgttctttctggctccgcatcaaccagtattggaatcttcatcagatcagcctgcttaccaacagatagtgccatttcatgtgaatatccgtctaggtatagcaagtttacatcttgtagtgcagctgacaaatttgacattgatatgtcaccaggaaccattggagggtaacctgacgtgattatacatgttcgggttttcgttttcttatcaataatgacataaacaaatgttgtgtttccaccatcagagattataacatgtgacacgtcaatcccagcttccttgagttccaaaataacagttcctcctatttcatcgttggccaccttggagatgagcctggtgttgagacccagacgagcagcgcctgtcaatgcgttcccggcgttcccgcctcccgatatnctgcgcacacacctcgtgccgaa

SEQ ID NO: 33611 - DNA, 739 bp, Triticum aestivum
  Clone ID: PAT_TA_33611
ttttttagtcgcggatgaggtacaataatcagattgattcactaacgcgacaatgacaagcacttgaacactgacatagcaaagtaataaacattatataattcaacaagaatgcataagtatagaatatagctccataacaaccacgatgataacccaatacactttgttccagctcaaaaatccctgaaacaacacgttgactagaaaatccagaacacacaagattaaagattggtttatacaaaaccaccgcaaaatcatcacaatcatgtgaaccactagacgacacacctactacatgcccacaacacggtttggccatagacccagcgaagtggtcattccaagttccatcgattttctactgcgctggtgcgaccagttttcgtagtcaaggtggcatactttctacaagttgtgctcatgctgcatgctgcttgtcgtggttcccggctattgtcggcaaaactaaaggaattagtaatttgtttctgaccgtgcattgtaattatgacaactttatgtaataacctaaaactgctaagccgaaaaatagcattctggtctcagctgattccctgagccggtggccatagtaatcattaaaaagcaggccagcgccctcgcatcccctcttgagtgctcctgattaagagctacataacctcccacggaaaagaggaagcgtccagtacggaaaaacaaagaagagtccggcacctaaccccccacgcac

SEQ ID NO: 33612 - DNA, 1067 bp, Triticum aestivum
  Clone ID: PAT_TA_33612
tcgagtttttttttttttttttttagatcgtaagaaagtatttcgtcccctatagttaggccaaagcccaaaagtagcacgtacaggaagttttacaatccaccctcaacgaatgtgaaaaatgcagatattgttctctacagataattcccaagttttagagatatactactagaaaaggacgtctctgtgttccaccaaagccacacgtcttaatttagttagttataaagtgatctgacaaggctccaatttcctcatatcttgacttgcatatcatcatcagctttcggtaaagagatagcagcatgaggcaagcggacggactatcttcgtgcaggccatcttcagttaaagaggtatcttatttctttggttaattctgtggatcaactgtccagagctgctgctggtgcaggtggagtttgcctgctcaaggtaaggggagataaagccttcaccacaatgctcatgcttggacggaactcggcttcatattgcacacacagagctgctaccgccccaagctttgcaagtccctttggcggatattcaccctccaaccggggatctatgcaacccttcaccttgtcttcggttaatcttggtgtagcccatgtaaccaagctctgctgccctcgaggcgctgtatggtccacaggctttcttcctgtcagaagttccaagagaacaaccccaaaactatacacatcactcttctgggtcagctgaccagtcattgcgtactctggggcatgataaccgaaggttcccaacacacgagtagaatgcaaccgagcagccatatctggagcctgatttgaaagattgaagtctgcaatcttggccttgaagtcctcaaataagaggatgttgctggatctaacatctctatgtacaatagaaggctggaccttctcgtgcagatattcaagtcctttggcagcatcaacagcaattttcattcgctgcatccaattaagtggtggaccaggttgtgcaccttgtactccttttcttccatgtagaacatcatgcagagaccccatggggcaaattcataggct

SEQ ID NO: 33613 - DNA, 1348 bp, Triticum aestivum
  Clone ID: PAT_TA_33613
aggggagggagcggtggtggggtacgccgccatggactcgcgcttctcctccggctccggggacgtgaggtcggggagctcgctgacggtgggggagcggctctgcgccgccttcttgcccttcgttgccgtcgccgaggccgtctttttcgtcctcgccgactgcctcgccgacatctgcccttcctcgtcctcctcctcgcgcctgcgcagagaatcctctgcttcgtccttcctcacggccaagaagaagagccatcacctgttccgccgccgcgtcgggccaggctgcacctccctcgacttccgcaaccttgcccgcctcgccgaggagtcccgttgcttctcggtgaacgaggtggaggcgctgttcgagctctacaagaagatcagctgctccatcatcgacgacgggctcatccacaaggaagaactgcagctagcattattcaagactcctagcgggcagaatctttttattgacagggtttttgatttgtttgatgaaaagaagaatggagtaatagagtttgatgagtttattcatgctctcagtgtcttccatccatgttcacctgtggaggataagattaattttgcatttaagctgtatgatttgaggcaaaccggatttattgagcgtgaagaggttatgcaaatggttattgccattttgaatgaatctgatatgaaattgtctgacgagcttcttgaggccatcatagataagacgtttgaagacgctgatactgatagggatgggaaaatcagccaagaagaatggaaggaatttgtattgcgccaccctaatctgttaaagaacatgaccctaccctatctaagggacatcacaacatcttttcctagttttgtcttcaacacggcagttgaagactaaagagtgcaagattcgttcatgacggcgacaagttggcagcatattatatctgtcagctgtcttgttgaatatcgggtttcctgagaaacagaatactcataaccacctagtgaagaaaattgccatcggtgactgttgattgtgtctgtcatcagagaactgaatcggcgccgaaccaaggaccacgacggcaacttagaaatgaagcaacgatcatgagctcaaactggtattttcagagctgtacatacatcactcctttagctcagagaagctcagggtaaactgtacatatatgctcgggcttgtacaagggaattcagacaaggcaccggaagtgccagccagttctggaatcagcagttagtttgttcgagtgccttcccgcctaacagactatcttatgaattctatacattctatcatattaaaaaaaaaaaaaaaaaaaaa

SEQ ID NO: 33614 - DNA, 106 bp, Triticum aestivum
  Clone ID: PAT_TA_33614
gccttgcaggagctgaatggcataaacggtctccatggccaactaaaaattaaaggtcttgacaatgttttgagcaaggatgaagccaccaagaccgacatgaaaa

SEQ ID NO: 33615 - DNA, 749 bp, Triticum aestivum
  unsure (1)..(749): unsure at all n locations
  Clone ID: PAT_TA_33615
gcagcaggnagaacaggatgatgccgttcggcgtggggaggaggatctgcgcggggctcggcgtcgccatgcttcacctcgagtacctggtggccaagctggtcaaggaattcgagtggcaggaggttgcaggcgacgaggtggacttgaccgagaagccggagttcaccgtcgtcatggccaagccgctacgcgcgcggctgctgcccagaaccagataacactgtactacctactagtcctctgggtgttaggtgcaggaagaagaagaagaacatacagaggaaggcaggggatgaggttcagagcacaggatgaggagagtttgggtccagccggttaacgagcgaagagggggtgaacgttcgaccacaccgttgacaagcaatttgggggccacctttttttccccagttgctagtcaccatcgatatgcaatcttttggacattagagcaactccaacgggggcgacccaaaaggacagcgattttgtccgtttgggtcgaccgtcagcctggtgtccgccctgttttagatatgggtcggcagcacacccaacgcgccgatgcatataagcgcgggttggccgccctattttacattgatgaattgcattcaaacatattgtcaaataacatagtttaaaccgaataaaatagtatagttttataagcccaatataaataaaaatgtttcacattgttttgcaaatgaataaaagaagatacatctattggttgccaaaaa

SEQ ID NO: 33616 - DNA, 828 bp, Triticum aestivum
  Clone ID: PAT_TA_33616
ctttcactagccgctatgatcggcgggctaacccccaagacagttgtattctgaacaacattctagagatattctgcagctctattcctccttcagacaacaatttccgggcaagagtcacggtagagcaaggtgtagaacaagcacgatcttcatctggggatttcatgagcccccacatgggcaaggctgttgcctttcttgagatcggcaagaagccagcgccttgggatgaacccagcacgacagccgatattggcgacttggaagtaggtcttggtggcatgttggatgagaaaaagggcagactaacccatgcatccccgggtgttagccgagatcaactttccctggagcttgtggaaggccgagcaggcatgcattcaaggcattcaagctgggatcctagagctgaaacctcggagtcagtgaacagcaattctgtgcaaacagcccctacagaggaaactaatgggagcggccatgttactacgagcggcgcattagcaagcacaaacggaatgccacagatgaacatttgagctctgctttgcagtgcgccatcgatcatgttctgaatggagcaccatgtgtttaccagttgtggcaggataaggtcctggacgtgtgtaattcagaacagacttcccgttgcttttccggtggtgcatcagaccgttcaggcttctgttgttgtgcgtgtttgttgtgataatagctcaagctcccacccttcccgggtttgggttgatgatgtatctgcaatgcagttgtgtatatatatatatacaaattatgggacaaaatgtgttaaaaaaaaaaaaaaaa

SEQ ID NO: 33617 - DNA, 1098 bp, Triticum aestivum
  Clone ID: PAT_TA_33617
ctctgtctctgtgtatcgtccaactttgagctggggatcttttgcaacatgtggacgaagagaaacaatggaagatactcattttatgcttacctgcatgtctgaagaaaaagatgtgcattcctttggcatttttgatggacacagaggtgcggcagctgctgagttttctgtccgagcagttcctggatttctcaagcaatttggacacactgccagcccgattgatgcccttgcagaagcatttgtaagtagtgacacagcatttagagaagagttaattgctcaccagaagtcaaaaaggataatccagaaagactggcatcctggttgcacggcagtgacagcactgatagtgagaaacaaactttttgtagcaaatgctggtgattgccgagcaattctcagccgtgctggcaaaccatttcctgtgactagggatcatgttgctagttgccccaaggaaagagagcgtgttataaaggaaggggctgaagtcagatggcaaatagatacatggcgagtcggtgcagctgctcttcaggttacaaggtcaattggtgatgacgatctcaagccagcagtgacagcattgcctgagataactgaaactgatttaacagctgatgacgagttcctggtcatggctagtgacggactctgggatgtggtaggcaacgaggatgtcctttccatcatcaaggacactgtgaaagagcctggaatgtgctccaagaggctggctaccgaggcctcagcgcggggcagcacagacaacatcactgttatcgttgtcttccttcgccctgtctccacagcagaacgaatatactagccacctccattctaccaagtagattatatgaccaatacacacattcatgtacgcgtacaaagtactcatgctgtactggactagaagggacaaatgatgttcagactgcgctttttcttcttccaagtattttgcagttccattgtattagcatttgtttgtataatacgcatacaccagctagggcctgtttggaatacatgatatacaaaacacaggaattggaaggcatatcttgaaatctgaacaggaattgtataaaa

SEQ ID NO: 33618 - DNA, 813 bp, Triticum aestivum
  Clone ID: PAT_TA_33618
ccacacgcgcctgcctgcgctctgacgccaccccacacacaccacaccggggaaccaaggaagaagcaaggaaggaacctgctccgctccatccatggcgtcccacgcggcgcgcctcctcctgctcctcgcgctggccgccgcgctcgccggccgctccgatggggcgtggtgcgtgtgccgcacggacctgccggacgcgacgctgcagaggacgctggactacgcgtgcggcagcgccgccgactgcaagcccatccagcccaacgccacctgcttcgcgccggacaccgtcaaggcgcactgctcctacgccgtcaacagctactaccagcgcagcggccagaacccgctcgcctgcgtcttctccaacaccgccgtgatctcctccaccgacccaagcaccaacggctgcaagtaccctgcaagtgcgaccccaagtgctcctggcagcccgccgccgccaatggcgcaaggtccgaacggcgacctgaaggacaccagcggcggcgccgacgtcttcccggtggccggagccgcgacgcgggcggtgatcctggcctgctgctcgctccttgctctctacttcatagcgtgaccagaggagacacaaggcacccctcctgcaccgacccttggttttgggtgtcttgtttcttggcacttttctcttagtagtggtggtaggaagagaacctttgtgatgatgatggtattccgttctggtggaagagtgaagatagcttgtcagtgagaccatgatattgttcggtggagggtttagggctgatgtagtgatgctgttatgaaaaa

SEQ ID NO: 33619 - DNA, 1047 bp, Triticum aestivum
  Clone ID: PAT_TA_33619
acgtcacaggatacgcgcgcctgcgctctgactccaccccaccacaccacaccggggaaggaagggaggaaggaacctgctccgctccatccatggcgtcccacgcgatgcgcctcctcctgctcctcgcgctggccgccgcgctcgccggccgctccgcagcagagggggcgtggtgcgtgtgccgcacggacctgccggacgcgacgctgcagaggacgaaggaagacgcgtggagcctagtcccccactgcaagcccacgcgggccaacgccgcctgctcctcccgcgggcccccccgggcgcccgcctccccgcccatcgggcgtggcgcgtggcgcgccggcccctgcccgctgggctgctgctgcggacgctgcactgcgcttgcggccgcgccgctgagcaccaaccgctgcaacgcaacggcgcctgcttcgccccggacaccgtcaaggcgcactgctcctacgccgtaaggtctgaacggccccctgaaggacaccagcggcggcaccggtgttctcccccaccgccccggtcccgcccgtcctagcaccgccgccccgggcccccccccccacccgcgcccaccgccgcaggcgccgatggcccccgatccgaacggcgaccccaaggacaccagcggcggcgccgacgttctcccggtggccggaaccgcgagccgggtggcgatctggcctgctgtcgctctcgctctgcacctcatgccgtggccagagcagccccaaggaccccatggcgtgaccagaggagacacaaggcaccccttctgcaccggccttggtttaaggtgtctgtttcggcacatttgctcttactagtggtggtgggaagacaacctttgtgatacataatatgcattccgtctggcggaagattgttgggtgccggggtggggctgtggtactttgattttcttgcttatggtttaaggctgatatattgatgcatgtacgaactggatattggttcatggagtacgggactattttgtacttcattgaagtaccgattagattaaag

SEQ ID NO: 33620 - DNA, 753 bp, Triticum aestivum
  unsure (1)..(753): unsure at all n locations
  Clone ID: PAT_TA_33620
ggnctgcaccacgcgccccacccgtgttgctatcttccaccggcaggtgaaggccgacgctgatctttcctttcatccccccaagatggcagcgaggcagtgggtcaggtgggaggaggagatcttgctggaggacgatgatgaacaccacacggagtgcttctacctccgctgcgccccactcctgggcggtggtgtgagcgagagggatctggcggtggtgggtaagtattgtccggacccagcccccgggaacatggtgtactcggcggacccgcagttcctgcggttcctccaggagggaataacctgtgactcagtgttggctatgggggtgacggtgcgggtggagatcacccaactcagctggaagtccaggaaggaggtcatcgactggctcaacttgctcgtctcagaaagcagcggccaggcatccaacagaggcgctgctaacccggtgaattcagtgcctgtgcaagagatctgcataaccaacgaacaggcccctgtccctgctatcgacgaagagcaagtgatcgacctgaccatgtctgacgactaaagtcagtagcagaggatatgaagtctggcatttactttcgataatgaactgtcatttatcaaagatctcgcgcattcgcttcttgatgcgtgctctttcagatccattctcgacagagatcagttgtttgtactttctgaatttcaaataaagtgagacattatattcctaaaaaaaagaaaaaaaggaag

SEQ ID NO: 33621 - DNA, 438 bp, Triticum aestivum
  Clone ID: PAT_TA_33621
gcaatgcgaatgatgacatgagacgagatgcatagcaagaacaaaatgcaaaacaacagacaaaaacccaaccacggaggaaatatcatatagcatctccggaaaaggcaagagtcggagttacgaatatggaaagttgtatccggggcgttacaaaaggtcacttccaccttccttgttggtgacaagtggcacactgtatgtgtgatagttacacaacccgggagttttgtgtttttttgctatatttttttaaaccaattatctcttaaaccatgcgtccaaatcacgaaccattttcaccatcgcatttcttgcgtcaagatctttgaaaattaattccatgttaataagttttgacgaactttttattaaaaaactttgaaactagaaaaccaaaaccaaaaaagaggaaacctagaaaaaaggaaaccaaaa

SEQ ID NO: 33622 - DNA, 511 bp, Triticum aestivum
  Clone ID: PAT_TA_33622
cgggaccaatcaaagcctctttctgtagtggactgaccgagcccaaaatatggcctccaaggtgttcgcagtgctggctatcgttctggtcctcacccatgggcatctccctcctgtgatgggcgagaagacaccgtcagatcgtccaaaagtcttaccacgtcaagatgctgcgccggcggtggccgggaatggtgcacctgcagcccctggcttcactgaggagaaggggtggttctttcagcgtccactagcaaggccgacacctcttcctccttccttaaagctgtgaagtgacatgaagttatcctgctagagtttgtataagctcattgtaagaaagcagagtacgcaaggcgaataagtagaccactactggctacaaatggttgtgttccccgctatggtattgtactatatatgatgttttctgcctggacacacggatgtgcttgggcaaaacagtgtgctaactatatcagataatatcagcctctcggttctgaacagc

SEQ ID NO: 33623 - DNA, 549 bp, Triticum aestivum
  Clone ID: PAT_TA_33623
gctggaccgcgctggccaccctgctggcctattatgtctgatggtgtccgacgtcggcgagcttctgtcgggttccacgaggtgcgcggcgaagggtcgtattctgttcattcggttccacagttgcatataagagacgagacgggtgaggaatgctgatgtgtgtatatgtgttctgctaaattaaatagggcccaaaatgtagtggcaccaaagctttggtgaactgattaattgaattgtatggctgtagtgaattaaacgtatgagttagtacataataatgtttgtgtgaaatggaggggatgctgttggtcgaggtgatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaggggcccccccaaaggttccaactttaatttccccttaaagcaaatttaaaccccctccaaagggcccccaaaattcaattccagggccc

SEQ ID NO: 33624 - DNA, 1047 bp, Triticum aestivum
  unsure (1)..(1047): unsure at all n locations
  Clone ID: PAT_TA_33624
ggccccttccccgcgtgctccgccaggccacggtggttgacacgcacttgtaccattactggtacctgaaagtcaaggaatgaagctcagtcacaggatgaggctgcatataaagtatccacaagtccaaggctgagaagaaaaaagtgaaaaaccttgctgtccagtttgatgtcatgcgcgctaataccaaggtgatgtggagaggacgattccgaggaccgagtacatggatgtgcaggcctaggagttggaacaattcaccaagagaagccaccagttcgtgtataacagaataggtggaatttattgtgagatcttacccaaatccgagtacttctccaaggcactgtagatattccatcatgcccaaaatgatctcaccaaggagcggttcactgcagcaatgtgggcgaatctagcatgcaattaacagtactttagtcaaaacgattgtgatttcacataataaatactgaagttcagtactagctccaaggacatcataagtgcaaataggagtcgaaggaaagcatgttccagcagaaaaaattgtttatgtgcacacaacttaagtagcgaacgctgagagtcaagataaacatttgaaggtttgcaaccattggaagaaattgaggacatgcggtgtacaattgctgaaaattacaatcgaaaccaaacaaccaggcttatgtcgtaagttagctatgatcagagggtcgaccgctctgatcccgcgtctgggctcgccccactccttgcccgccaccagcaacgatgcgtccttcccatcactccaccaccttatagccaagaggaccagacgcctctttgcctcatgttctaccagcgctcaaggcaaacatgtagcccttcgagacctacaatgacaatatcagatttctccacacctacaagaacttaagtggctttcttgattcctaatggtgagattctccatgtccagtactgtaccataaataacttcaatatgtattaaacagtgctgatgaatgcgtgggtggggaaatgtataatcagcnaaaa

SEQ ID NO: 33625 - DNA, 1120 bp, Triticum aestivum
  Clone ID: PAT_TA_33625
cccaccccatgcgctcccccgcggagaactgtctggcttcctatctttcaacggccagctgcatgcgcttacatctgccaaacttcctgccggaaccctccatcctcggaggcagttaaagaagaggctggctttggagtttcaggtttataacccgctggcaaggaaatggagagtgttcaccccctatccccccctcagtgtgcccatccatctcaggaccgcagctctttgtacagtcgagttgtagggctgctggtgcgcgccagctactgtacggactcagatagcaggggggctatcgcttgcaaatttacatgtaaatgacgaacgactggtattgatttctgtgggtagccggggactattgcgagtacttctcggattgtttaactcgtggaaccggttgtataaaaataataaaaattgacggtgcactatttaaatcagggggtggtacatttggggtaaggtttgcccgcttccaaggcttgcaagtacattgtgtggtgtacatgctcgacggagacgatatcttcaggtatgactttgcttcaaacgggtggtcgaaggaggctactttgaggagaaagatcccagagaccgagttgtgtggcttcgtatcattgaacggtgaactgcatgtgcttaaatctgccaaacttcctgccgaaaccctccatcctcggaggcagttaaagaagaggctggctttggagtttcaggtttataacccgctggcaaggaaatggagagtgttcaccacatatccccccgtcagtgtgcctatcgacttcagaactgcagctctttgtacagttgagttgtagagctgctggtgctcgtcatctactgtacagattcagatagcaggggtgctatcgcttgcaaatttacatgtaaaaatgatgatgaacttctaatgatgtcggtggatgccggagactgttgtgcgtacttcgcattgttaaactcgtgcaaccgtttgtatataaataataatactgaacggtgcactatataaatcaggcgctgtgatatgtggtgtaagtatgtccgcattcaaggcttgtaagtacattgtttggtgaaatctgcagtatgtttctggttgtgaaaa

SEQ ID NO: 33626 - DNA, 801 bp, Triticum aestivum
  Clone ID: PAT_TA_33626
cccaaaatgccctcttgtcttgtggccaacatcaatccaccaactgaaacctgacattgaaaatagtaggcaactgaaccaattttcagtcagacatggttttcagctgctgctgctgacaaatcctgaatttttcccttgtgaaaactgaaggatttgcggagaccgaagcagcagcgccgcagccgccaatggaggcgctctacctgctggcctccctgtccaccaccctcctcacctccgccctgctctccctgctgctcctcctccgcctccccttcgcccgccgtcccgctcccggcggcgccggcgccggcgccgcccggctctacgagggccgcgtccggcactcgcgccggcggccggcggggcacgccttcgagtacgccgtgcgctacgccctcgtggacctcgacctcctccccctctccggccacctctccgccgccgaagcccgcggcatcgcctccacttccggccccgtgcgtctcctgacggtacccaagagcgtggggtacgaacagaacccactgagcgtctactactgctatgacgcagctgcaaaagaacaagatgaagacctcaagatgtgcattgccgaagtaacaaatactccttggggggagaaggtgatgtttaccttccaaccgggttctgatctcgttgcaaagcctttacatgtcagccccttcatggatatgcttggcaattggagtattcgtgctaatgccccaggcgataatctatacgtggctattgcggttcagcatccaacgcttgggaactattttactgcagctt

SEQ ID NO: 33627 - DNA, 1631 bp, Triticum aestivum
  unsure (1)..(1631): unsure at all n locations
  Clone ID: PAT_TA_33627
ccgcgacgtgggcgctcaggctggcgggcgaccgcgcgtccgagagatggactgccgccatgatcgccctcgtcggcctcctccggtacgccaagtgcgtcctgttcagtgccacgccccggccttcggattccaaggcggacgtcgatgtcgaagacgacggggaatccccggcgccgccaccggacctgcggtgccccatctccctcgatctaatgcgcgacccagtcgtcgccgctagcggtcagacgtacgaccgcgagtcgatcgaccggtggttcagctccggcaagtcaacgtgccccaagacggggcaggtcttggccaatctggagctggtgcccaacaagtccctcaagaacctcatctccaagtggtgccgggagaacggcgtggccatggaggtctgcgaggccagcaagagcgagcaggcccaggcggtggccgcgaataaggcggcgctcgaggtggcgcgcatgacggcgtcgtatctggtgaagaagctctccgtgtccttctcccctgacgcggccaaccgcgtggtgcacgagatccggctgctctccaagtccggctcagacaaccgcgcgttcgtcggcgaggccggagccgtgccgatgctggtgcccctgctctactccgaggacgccgggctccagctcaacgccgtgaccgcgctgctcaacctatccatcctcgaggccaacaagaagcgcatcatgcacgccgacggcgccgtcgaggcggtgacccacatcatgagctccggcacgacgtggcgcgccaaggagaacgccgcggcggccgtgctcagcctggcgtccgtgcacacgtaccgccgcaggctcggccggaacccgtccgtcgtggaaaagctggtccacctcgtgcgcaccggcccgacgagcacaaagaaggacgcgctggcggcgctgctgtcgctggcgggcgagagggagaacgtggggaagctggtggaagccggcgtggccgaggcggcgctgtcggccatcagcgacgaggagacggccgcggcggtgctggcggcattggccaagcgagggggcgcggaggcgatcgtcagcatcgacggcgccgtggcgcggctcgtggccgagatgaggcgcggcacggagtgggcccgggagtcggcgacggcggcgctggtgctgctgtgccggcggctgggcgcgcgggccgtgacgcaggtgatgggcgtggccggcgtggagtgggcgatctgggagctgatgggcaccggcacggaccgcgccaggcggaaggccgcgtcgctgggcaggatctgccggcggtgggcggccgcctccgccgccgacggggagcggggcgccgagtgccccgcctccagcgtggtgccgccggccatgatggcctcctaggatgaatcaatcacgctcttcttgtacaaaccacaaggtccgattaggcaggctgtgtcacgattctttgacgcgagagagataacaaaatgtgagtgagtggtgttgatcagcaaccgtctgtgcggccggtgctccgcccggctcggccccttgtcttctcccctccgtttgcacacccacatttgtccccgttcttcttcttgacacganaaaaagaaaaaaaaaaaa

SEQ ID NO: 33628 - DNA, 1021 bp, Triticum aestivum
  unsure (1)..(1021): unsure at all n locations
  Clone ID: PAT_TA_33628
gcgtgcccggncggncnnggcgcttgcttccttccttggccggcttccttgcttcgggccttccttgggcggcccggcggcccggcgcggggccaccggaccccttacgccgcctttcgactggggacagtctccttacgtcaccaggaaccccgctcggcgtcccacaaaagtaatcgcaatcaacaagggaattcccgggccccgtggtgaacgtcaccaccaactacaacgtcgccgtcaacgtccttaacaaccttgacaagccgcttcttattacctgggacggcattcaacaacgggaagaactgctggcaggaccgggtgcttggcaccaactggcccattccgccgggcttgaactggacctacaactttctcgtcacgcacctccgcggcagcttcttctacttcccgccgctctccatgcagcgcgccgcgggcggcttcggtggcgtcaccgtcaacaaccgcgccgtcatctccgtccccttcgacacccccgacggcgacgtcaggctcttcatcggcgactggtacaacaagaaccacacggacctgaggaagatgctcgatgatgggaaggagctcgggatgcccgacggcgttctgatgaacggcaaggggccgtatcggtacaatgactccctcgtcccggctgggatcgagtacgagactatcgatgttgagccaggcaaaacttaccgcttccgagtgcacaacgtgggcgtctccacgagcttgaacctgaggatccagggacacaacatggccatggtcgagacggagggctcctacacgatgaagcagaatttcaccaacctcgacatccacgtggggcagtcctactcctttctggtcaccatggaccagaatgcaagcagtgactactacatcgtggccagcgctcggttcgtgaacgagtcgctctggaccagggttaccggcgttgcaattctgcactactcgaattccaagggcaaggcgtctggtccgctccctgacccgccgaacgatgagt

SEQ ID NO: 33629 - DNA, 737 bp, Triticum aestivum
  Clone ID: PAT_TA_33629
cccgagcccgcgacatcggactcgtcatcctcctcgtcctcctccgggtccccgaaaaggaggaagagaggcgaggccgcggccgcgtccatggccatggcgctggtgccgccgtcctcgcagttgagccggccggcccacgcgtggtaccccgccgtgccggcggagcaggtggccatggcgccgtgcgtgcagcagctggtcagctaggccccgctctccagcccccgggcgcacgatcgtgaaagacaatgcgcaagtgcagtggattcgccagcaagtgcatggacgcgacagcaacaggagcccgcctttcactgttgcacggtgcaaggtggtgatggcaatggagtgcgatacctatcgagcgagcaggcaaagcaaccttggcgacggctccatttggatagatatttggatatttgatggcaatggaagataagctctcggagcaactgggcgctgcaatttggtctggaatgatagttcctcctcttgctgctcggtgcaactccgcccaagtgggtcaaaagcgaaactgtgctagtatcggggttgtcgtggttccttcttgagtcgtagggttatatttgagtgcgtgtggtcaaaattacacccttgtgagtgatcgagcataatggaagttgtgaaactttacaagcatctgtggagagaattccgggagtgaattgttaccccatttgttctttgatcaatgaatgtttcccattggcgtc

SEQ ID NO: 33630 - DNA, 856 bp, Triticum aestivum
  unsure (1)..(856): unsure at all n locations
  Clone ID: PAT_TA_33630
tacacaacttgctaaaanacaggttttatgtatccatgtcacattgcacagctatgttcaaaacaacaggtcaatatgtatacatgtcgcattacataactatgctcaaacggtacaaacgctcggagcataagatgttcggctccataacccacaagtcaccaagtttcagaagcaagaggaaggatccaagagatgaaggtctcatctagaacagaaggaacagaatattggatgggtataaaagcagtagcccaccctgcagggctctagcgtcaaactctcaaattcattgctctgaaagccataccccctcagtagtcatcagggtcatcagatgcatcgctgaacccatcatcactctgcttgctgtcagactcactcattgcgtaaggatcatactctctccattctggatttctcctcaccctcttctcgaagatgcgcagctccttcgaccgttcctcgtcggcacgtatcctctccgcacggtcccgcttttcaatttcatcatagaaggcaatatttatattgtctggactaatcccattgactaccagaacacttagcagcttatcaattcttccatcaccctctgaacattgtatgacaacactttcaaggagtggacaccggaaggtcatcccgtcaattggcatgcaatctatttccgctccttcatcaagcggcctattcatcaaagtgagttcttctagcctcggtgaaagctggaggaagcgaagcacaacgaacaagtcctcagttaaataccattcgccaatctcaagagttgtgaggttttcaaacgctgaacatgttggcagctccttttccaacataacctttatgtaagaac

SEQ ID NO: 33631 - DNA, 1726 bp, Triticum aestivum
  Clone ID: PAT_TA_33631
atttcatttcatttttggtctcaagcaaggcacagaagaaagcagagcagaggtccttgacggccggcaacatccatggggctcaggcggtgcttccccggagagctcgctgccctccctgacagctgtaacacctgctgcagtccgggagcacccggacgagcacgcggggacgaccgccacccccgtttccagttcgatgggcaaactagaagtgaggcttcaaaggggcgatatatgtggatgctgccggagcagatgccgctccgtccggcaggggcccaccgcccacctgacatggcctgattgaagcgcaccatgcaagtgtcctgggtcagctcccctggcccaacacgagcctagcctctaccattcacattggataacccagacagggtcttcgttgccgaggttcctggcaccttcctgggtcgtcgctcttgcggcttggtccaaagtcacacctccagccgatcaggaataacacatccgtagctaaaggcggtgggcgtcagagcgggctcggggcaccatgaggtgaaggaatgagtacctggaatgaaaagggggtggggctagtttatcgacgaaaagaggagttacctaggtcatcttcaaggtggtggagatgacgtgcgacgcgcaccgcaacgagctggtgacaagaacgtcgctgggggaagtcatagaatgtgacaagtaggaggcgatgtcttccacctacccactgcgcgcatcctctgggtgaagccctctccttgcgcatgagcccagtctgcaagtttttcccgggaactgggcgatgtagcaaagacgttggtcaatactaggcttgtcgcatgggatggccttgttagggttggtcttgtggagactggccttggatttagcgacaaggcagacatgaagctcctacatgaaatgttagtcaagggtttgaaggaataaatctcgaaaatgttgaagaaaagctgagtagatatcgttgcgaagtattagacgcgtgttgaagttattgaggtacattatttgtttggtgctgaatatgataacctcgagattatgaatcacccgcatgtctatcatacgctccatgagtgaaacccagaattgatctgtcctagctcagctgggatggcttgacatgcggctacctactctatacaccttatcttggccagatagggtctactgctcggaggtcacctggtctcggctagatctttgcgagatgggccccgctgacaattcaaagctgtcgacaacgcgaaatacgcatcgcttgatgggggatatgcggcaggctaatgaggaggcactagagctgttcatcgacgaaaagatcagctacctggacatcttcaaggtggtggagatgacgtgcgacgcgcaccgcaacgagctggtgacaaggccgtcgctcgaggagatcatacattacgaccagtgggcaaggaagttcgccgccaacctagagccatcgtcgtctggacggagccctgtgctcgcctaaggcccttcttcctggagctggccgatgaagcacagaagatgtacactactactcccatggcctggccttgctaagactggccatgtggaaatcaagcttagatatttcaacaaggcacacataggttgccttcctgaaatgtaaatcatgtgttcgcacaaataaatcacgtaaattttgaaataggcaagaatcaaacacatgcatccctcc

SEQ ID NO: 33632 - DNA, 1814 bp, Triticum aestivum
  Clone ID: PAT_TA_33632
agctcgcgtggcgaacggacgaggagttcgcccgggagatgctcgccggcctcaacccacacatcatcacccgcctgaacgtgttccctccgaggagcacgcttgaagggtacggtgaccagacgagcaagatcacggtggagcacatccaacacaacctcggcaagctcaacgtcgacaaggcaatcgacgccaagaggctcttcatcctagaccaccacgacaacttcatgcctcacctgttaaagatcaacagcctcccaaacacattcgtctacgccaccaggacgctgctcttcctgcaagatgacggcactctcaagccaatcgccatcgagctcagcaagcccctacttaacgacctcggcaccaaagtggtcggcgccgacagcaaggtctacacgcccccctcctgtggctcggagtcggagtgggctgtccaggacaccatctggcagctggccaaggcctacgccgctgtgaacgattccgcgtggcacggcctcatcagccactggctccatacgcacgcagtcatcgagccattcgtgatcgccaccaaccggcagctcagcgtcacgcaccccatccacaagctcttgcagccacactaccgcgacaccatgaccatcaacgccctggcacgccaggtcctcatcagcgccggtggcttcttcgagatgaccgtctgtccaggtgagcacgcactgagaatctcctctgaagtctataggaactggaacttcaccgagcaggcactgccggtagacctgatcaagaggggtgtggcgaaggcggacacggagagcccgtgcggagtgtcgctgcacatcaaggactacccgtacgcggtggatgggttggccgtctggtcggccatcgagacttgggtcgacgagtactgcaggatctactacccctgtgatgacgtgcttcggtccgacgtcgagctacaggcatggtggaaggaggtgcgtgaggtcggccatggcgacatcaaagaccagccctggtggcccaagatgacaaccgtgaacgtgctcgtcaggtcatgcgccaccatcatctggatcgcctctgcgttgcatgccgccgtcaactttggccagtactcgtacgccggctacctccccaaccgtccgacggtgagccggcggcagatgccggagccgggcaccaaggagtacaaggaggtggagactgacccggacctggccttcatccgcaccatcacgagccagctccaaagcatcattggagtgtccgtgatcgaggtcctgtccaaccactcctccgacgaagtctacctggggcagcgtgatgagccaaagtggacatcagatgtcaaggcgaaaaaggcgttcgaggacttcagccagaagttgatcgacatcgagaagaggatcatgaatatgaacgcgaatcgccaactcaagaaccggaatgggccagcaaaattcccctacatgctactctaccccaacacatctgacatcgatggtgagagcgccaccgggatcacagccaagggcatccccaacagcatctccatctgatcgatgttatgccgttttatgttattgttgtatgtttcccattgcaaataaggaacgctgcatgtgcacgtttcatgagtggccagaagcgtgctcgttcacgttgaggcgagttgtgtttattttcgtgttgatgaagttgttttggccgcaatggaaagcccgtgggatggcacggatgaagggttgtggtcggccagtgtgttgagctggacatatatacggaaaaaaattgtatgagaccgggtctcatagacc

SEQ ID NO: 33633 - DNA, 593 bp, Triticum aestivum
  Clone ID: PAT_TA_33633
agggaggaaatcataaaaatcctgacagataaatatagaaaagagaaaaacaatgtgtctttccattgatctcagaaaccccagaaaacaaaatagctttgattcaatcatacatagcttggagcatttcaaaaaataatctcatctactataaatgatttctccctgttggtgttaccatcagcaccatggccattgagcatccgtccagacgcaccacctcgccccgatgctccctccgccatctttgtaattctgatggtttgagttctctgctgtttcatcggtcgttgctgtgccgcttcttccaatgctctctctcggtttctgatgcaggaagctgcaggaggaacggatctcaaggtcgcgcttcagagcttcggacctgtagctcccgctcaggtacctcggatggtctaggaatctcacattcttcaaccaaagcctgaaaggcctcccagtatatccctgcagcaaccttatgaggcatcagccagaagatgttgctagcttaaccgagtcattcgtctgcccaactaacttggcatccaaagctgcagtaaaatagttcccaagcgttggatgctgaaccg

SEQ ID NO: 33634 - DNA, 782 bp, Triticum aestivum
  Clone ID: PAT_TA_33634
gcggccccccacccgccccccgccgccgcccgagctctcctcctcgccgtcgccctcgatcgccttcccttccgtccctcgcttccacacaactcccagggcctgctgctgaaacctgcttcttcttcttcttcttcttcgtcgtcgtgttgtttggcgtcggtatatccgacggggggagatcgaccagatgactggctgcaacggcaacggcaacggcaactcgtccgcatcccaccatgcgacagcagacggtcactgagaagaagttcggaggaattgcaccaaagaagcctctgatttcaaaggaccatgagcgcgcctacttcgactccgcggactgggtcctcggcaagcaagctgcaagcaacaacgcacaggcggcggcaatcgagtccttgaagccaaagctaaagaggacgccccatcaccagctcccacctcgcaagccggcctgcgcgtcgggctgatcgaccgcgacgcgacaagggatcaccagagggagccggagcggtcgcatgagacgacgaagctggtgatttagctggttgcatatgttaggagtcgatcgagtcagggtttgagatctgcagttagacccttttggttctagcagcctaagattgccacagtagggctagtagcatactcctacagtgttatggcttcagcttgagatagttggttttcactccttttctgtctctaattttcttcttctttctttcataaaaaaaaaaaaaaaacctattcgaacaacacttaaaaaaaaaaaaaaaaaa

SEQ ID NO: 33635 - DNA, 779 bp, Triticum aestivum
  Clone ID: PAT_TA_33635
tttgctccgtcccacgaccccccacctctctcccctctcctctccttctccgtcctgccttcccttcgacctttccgccgctcggcacagcactcctctgcctttcatttcaaggtggaccttctcgctgtggagtcccccgacgcgattcttcacggtggagcaaatggcggtggagtggtcggacgccggcgaggagttcctgcttcccgacgagttcttggacgacgacttcttctccgaggaggagaaggccgcggtggccgcgcggagcgagagtgatgaggaagacagcttggccggcctctcgcgccgcctagccggcctcctcggcggcgacaaactcgccgtcacgcctgccaaggaggaggtgactgcggggtcgccgaagtcgacgctgtgtgggctgcctaagtcgggccaggagagccccaacagcggcgcgtcccaggggaactcgccgccgtcgtccccgctggagcagcagccggcagacccgtgggacgtcctctacgaggctgcctggcaggtcaacagcatcccggcgccgggccacccctacgtcttgcacggccgcggtggcttcgtgccgcctgcgcggaaggcctcgcctccgccgccgccgcctcacgtgcctgcgccggccggcacggccgcgggcggcgtgtactaccaccctttcgcagcacctcatcacgcagcgccagatacaggctgccaggtttcatctcctcaaacagcagcagctcttcaagcagcagagggaccggcagctggcc

SEQ ID NO: 33636 - DNA, 1212 bp, Triticum aestivum
  Clone ID: PAT_TA_33636
ccacgcggccggcagccttcccggagctggcgccccacctgggctgcagatcgcaccgccgggtcacctgccgctccatgctgcgccgggcgcgccaaccccctcgtcgccccctcgagtgcctctgatgcggccgcccgctcctagcccgacgcttcgccctgctctgccccgccggccggccccggcgccccacccgcagctgtcgcagcggcagggccaaccgcccccctgccgcagcctgcatccgtcgttccccgcggctgcagcttcttcacctcttcagcaaacccaaaggccacatcagatgtcacagccactgaacatgctgggtaacccgcatctttctcagacccaaggaaccagccatccaagcccacagcagcagccatattctactatgcctatgcagctggctaaggaaagacaatttcaacaccgcttggtgtctcaacagcacaacagtcttcctgtagcaggtgtgcagaacggaccgcagattcagcagcagaaccatgcatctccggtcacttcaaccccttcttcgcaaccactgcatcagaagcagcagtctgcacaaagcccaacagatagctctgcacttgccaatcgacctgccaatgctacagaacctaagcagaagaaacagcagggtcaacagcagcctaggcagaatcaacaacagaggaaccaagctagtcaacaagctaagcttatgaagagtctaggacgaggaaacagcacggtgacacctcagactcctgcagccgacgcaactccacccagtgctgttcctacagcttccaagaaacaagttcctgacagaaatctgatgcaacatgggcaagggtcctcggctggtaataaagcggcaacagcagttacacctcagcctgggaatcaacataagctatatgcctcggtgcagcagcctccaaatatcggtaaccaaggcttggtgcagggtcctcctagtcacaccgtcttcgctgcacaaccgcccccactccattccaggtacccggtgagcacgcagcagcggccgatgaatccagcacagaacaacattcagagaatgatgatgcaacaaagcctccaaatgaagcccgactctaggatggacgcacagatggaccaagttcagcacagtcagggcgattccagctacacctacatctcacagttcagaagcaggcagccctggggctttca

SEQ ID NO: 33637 - DNA, 789 bp, Triticum aestivum
  unsure (1)..(789): unsure at all n locations
  Clone ID: PAT_TA_33637
gnagggngaagaggcgctggnctacgtgctggtgcctctggggctggtgctgatgctgggataccacgcgtggcttctcctccgtatccagcgtcgccctgcgaccaccgtcatcggcgtcaacgccatcaaccgccgcatctgggtccgccacatcatggaggagccgtccgggaagcacgcggtgctggcggtgcagacgatccgggacaacatcatggcgtcgacgctgctggcgtccacggccatcacactcagctcgctcatcgccgtgctcatgtccggcggcggcggcggagggccaggagctggcggcgggggcctcctcccggacgcgccgctggtggtgggcgccacgggggaggcggctctgtcggccaagttcttcgccatcctcgtctgcttcctggtggccttcctcctcaacgtgcagtcgatccggtactacagccacaccagcaccctggtgaatgtcccgatccgagcacaccgcctccgccgcccgggccttgccgtggactacgtcaccggcaccctcaatcgcggcagctacttctggtcgctcggcgtgcgggcattctacttctcctgcccggtcttcctctggctcttcgggcccatccccatgttcgccgcctgcgtcgtcatggtctgcgtgctctatttcctcgacgtgtgcgaggactgggaggaggaacagggcgtgagtggtggtgatgagacgtcggaacgagggaaggatgcaggaggcacgcaagtttaggtaggtggctagctggaaatgcaaaa

SEQ ID NO: 33638 - DNA, 1323 bp, Triticum aestivum
  unsure (1)..(1323): unsure at all n locations
  Clone ID: PAT_TA_33638
gctccggcctcggcggtggcaaggggcgcgcggggtcggacgaaggcgaggactcggacgacgacgagtgggcgccaccccctgagttgtacaccggcggcgagaggagcggaatggttgttagagatcgatccaaacgcaaaaatgttgcggatgaggtttttaagcaagctaagaggaagggagctaagcaaggcccagctcgccggcaatcttctagttcaaggagctttcctggggctagcagacttctaacaggtgaaactgtacagcctgacgcaccacagccaccaagaggaaattgttcacaacatctacttctggagcgatgggttcacagtagatgacggtccactcagaagtttcaacgacccagagcatgcatcctttttagagagcatcatgaagtctgaatgcccaactgaagcttgcgccggctgatgggatgtctaaggtgaatgtaaatcttatccgtaaagaagaaaaatgtcctgagtcactcaagcgcccggccccatttcaaggaggggggagaaattcctcgcggcaccttctgaaaactctgctccttcggatatctctcctgcggctgctgcttctagcactgcgaccaccaccgtgcccaagactatcacagtggaagattctctgccatcaacctctctccagatcaggaaatttgccgagccagtcaagcgccctgccccatttcaaggaggggggacaagccacgcggcgcgcattcatccacacaacaaggccaggagaaatcaagcgactacacgctgcaggtcgggttcccccctaaagccgctcgacgacgcgaccaagaccattgaggaagccggcgtcgccaactcggtgatcatccaggaggtctaatctcaacaggctgttgaccccacgtcatcgaacacaccatccatccgtcccaatcgtgcacatttccttgcccttttgtccgtccctgagctctcttggattttagcatttgagccttccatggccgctcttcactagccgcccctcgggtattaagattgtaaaaatcagcgagatctgggtacccgtccgtccgtctctgttaaactccaatagcgtaagtaaaaccatccatccatccgtcccaagcgtgcacatttccttgcccttttgtccgtccctgagctctcttggattctagcttttgagccttccatggccgcacttcactagccgccccttgggtattaagattgtaaaaatcagcgagatnctgggtacccgtccgtcttattcatcctgctatagcataagtatacttgggcttgcaaaaaaaaaaaa

SEQ ID NO: 33639 - DNA, 931 bp, Triticum aestivum
  Clone ID: PAT_TA_33639
cttcgctgcggcgtcgcacacgtgaaagctgctacatcctgtgtacccgctctcctctctctcttccattattcccgtcgccccgctctcctctctctcttccattattgccgtcgccagctacctctcgtctgctcatggctccgccacaccctacctcagctccaacaatgcgcgtgcgaccgaagcgacggccggagcactcgtcctcttccattccggcggccaaaccacccggatcccgcgtcatcttccactccggcggccagatcacctcgagcctgcgcaacaccggatctgcagaggacgcggtcctcgtccatggatctggccgagggaaatcattttctccattgtttccgtcggatccgtgttgggatggcaaggccgatttctgatgtcttccgtcgcgggattccatcatcatcgccgattccagttgggccgcgacggcgagggcacacagctgtgcagagacgtcggctttgatgtttgctcagaggccaccagcggttggaccataagggttaggataaactgccttgtgagcaacatttgaagaggtccgcgtttgcaagatttgtggagtgcaaaagcacaacatgtcttgatagaggagattttcggaaggagccaaggaaattgccaaaatgtttgaatgtggtgttctgaattgtgtgtggtaaggacactggaccatttgaagctaactttcattggatggttgttgttgttagccaaagagtttccaactcaggaaatccttatttatgtgccgtttcatgtaatcgcaaactgtgtaatgcgactttactattggacatggaccattttgttgaagattgttagttgggtgaaaaattgtgtttgctgagtgccattgttgtgaggcggattgttatgtttcaattgaatttaccatttgcatttt

SEQ ID NO: 33640 - DNA, 1557 bp, Triticum aestivum
  Clone ID: PAT_TA_33640
gggtgccctgcgctcacctcagccctcccggatgggtgcaagtcctccccctcctccgcgctggagccagagcgagaccgagagccacccatgggcccacgcagccggccacgcgtaacaatgaaaggaacacaagccattagtgtgactcttctcatgtcatttcttgttctagcgaccagaggaaaagatgtgagatatagaaggcaagaggaagacagtacccagattctcacttatcaaggagttaataaaaccattcagatggaagacggagacgtctatgactgcatcgatgtgtataagcaaccgggtttaaaccacccattgttgaaagaccataaaatccagatgaaaccaagttctatccctgtttggatggataccgaaacatttccttcggattctttttcacaagcggaaccatctatcatcgagtgcccaacaggaacagttccaatactgcgtagtaacggaagtaccaccatagcaacacacaatattgatgggctcaaaaacgatatgcaatgggagagggcaggactcagatacatgggtgatttatatggggcgcgtgcttcattaaatgtttgggagccaaaggttaaaggtagccaggattctagtgcaatttggataagtattgaaaatagaagaggacaacagcctgatcgggtgagcgccggtcttcgggtagctccagcattgagtggtgatgcttttgttagacttcatgttgcttggttcgatggctattcaaaggaggggttgcattgaccacagctgtcctggatatgtgcaagtccacccccacattggtcctggatcaagaatacaaccatcctctgtctatggtggagaccagagagtagcaggcattcaaatattcaaggagccgaaatcaaactattggtgggtgagttacaataacatagcaattggatattggccgggtgggctgttcgaattcattagatacaagggcgatttggcgttctggggcgggcaggttgaggggccgacagcgtcatcaaagtctacgcagatgggcagcgggcattttgcttcggaaggatttagaaaagcagcgttcataagaaagatcgagattgcagacgacacggtcaagtttgcgaccccaaatagatacatagtgggtcaagggtcgagcgatccgtccaaatacaccacgggtggatttgaaattagcaaggatttcgggatgactatcttctatggtggaccaggttccatgagggcctgatctgatgatagtaatatgtatggacgcacaagacaaagctaataaaacagtcaccatatataggatggaatgagtgatggtgtatatatatatatatatatatatgtataaaaatttcaatacgggccatatatagaacaaaatgagtgaatggaccctttacatttgtatgttgtttttaccgatgaaatttttaaaagggttatatatcatggagttcggtgtgcattatgatagcgagaatatgtaatgaaatcacacttaggttgggatgggatttttttgttttttgc

SEQ ID NO: 33641 - DNA, 1493 bp, Triticum aestivum
  unsure (1)..(1493): unsure at all n locations
  Clone ID: PAT_TA_33641
gagaacaccgcaaaagctggctccttatgcagcaatcacctgtgcaaaaagattgacccattacatgtaattctgccagaacagctggcgggataacttctgcgagtactggagaaactttgtcaatgaaatatttgctccaactgctaaaaagaggtggtgtgtatctctctatggaagtggtcgtcaaaccaagggagttttccctcaggatgtctggcactgcgaaatatgcaatcgaaagcctggccggggctttgagacaacagtagaggtcttaccgcgactatgccaaatcaaatatgcgagtggtacattggaagaactattgtatattgatatgccacgcgaatcccagaatgcatctgggcagattattttggattatgcaaaagcaatccaggaaagtgtctttgatcaattgcgcgtggtacgtgaggggcatctaaggatagtttttaatccaagacctcaagattgcatcttgggagttttgtgctaggcgtcatgaggaactgattccgcggagatgaataatacctcaggttagtcagcttggcacggttgtacaaaaataccaggctgctgctcaaagttcaacgagtttaacgacccaggacatgcagaataattgcaactcgtttgttgcatgtgcgcgccaactggctaaagccttggaggtgcctttggtaaatgatttaggatatacaaaaagatatgtccgctgccttcagattgcggaggtggtaaactgcatgaaagatctgattgactatagcaggcagacaggatctgggccaatcaatagccttcataactttcctcggaggagtccagcaggtattaaccctcttcaaccacagcagcaacagcctgaagagcagcaatctgttccccagagttcaaaccagagtggccaaaattctgctcctatggctggtgtgcaggcttctgcctctgccaatgcagacgtgacatcaaatagttctttgacgtgtgcaccctctacatctgcaccctcgccatctgttgttgggctcctccaaggttcagtgaattctagacaagatcatccaatgggcaccgtaaacggtctgtataacagtggagatgatggcgtgattcccaaggtgaactctacaagttcattgcagtcaaatccgtctccctctttctcttcccaggtgcccacatcatccaataacaacatgatgcccgcccctcagaacacaaaccaactcagttccccagcagtatcatcatcaaacttgcctccaatgcagccacctgcaactcgggctcaggaacctgagccaaagtgattcccaaagctcggttcaagagaacctttgcaagagatgatgtcatcacaaatgaatggtgttgggcatgggagcaaatgacatgaagagggcaaacgggactttgcccctgggtattaatggggttaactgcttatgggggttgggccgtcaccaactcggctcgaggng

SEQ ID NO: 33642 - DNA, 1510 bp, Triticum aestivum
  Clone ID: PAT_TA_33642
gtactgtgcacacgggtgggccctctcccatcgagactgtgaagggtcattctttcagcagagaaataatgaaatccttaaggcggaagcctgcccggtctggggcagagtctctcccttctcctctggggccgctcagggcggatggcggcgctcgcggctctgcccggcctccccttcagcagaatctgtcacgatagtgtggggaggtctcatgaaattgcagggaaaattcaagaagatgaattccctattgtctcaactcacaaggagcctccagtgagtcccgcatgagcctccgcaaccaagagcagctgctgaaagttgaactgtaagccaaccgtacctggccttaactcatccctctaggaaatcctactgggctgtgccaactcgattgagagcacaacacaaatgacccaatgtgcaacagaagcttgttcttctagcgggtgagaacactccattgttctacgcatccgttgctggtaatgagcatgagaatattcaagataacaattctgagagaagtagtgtcatttcaatttcgtatggtggtgacaatgacagggatgaaatactgcaagatgagtcatccagctgtaatcatgatggcagtagtgttcaagattcagaagcagaaacttctgataaaactgcagatccagatggatcctctgaaaaaactgtggtttctaatgaaaggaagccatttatcagtaaatttcagtggctgttgaagctagggagaccctcaggtgaaggcagcatcgagaagggtagcggtgagaaatcagatggtaaagatgctgttgacgcatcctgctccgaagggaattcgaataacccgcgtggtaacacaaagttggctgctggtgataagaaggtgatgggcacatttaagaatcttggacaaagcatgctcgagaatatccaggtgatcgagtcggcgtttcagcaagatcgcagccagcccggcccgatggagaacttctcaaacaacatcctgggcggcaaaggacaggtgaccgcaaccgcagctctgaccgagctccgcaagatcagcaacttgctcagcgagatgtagccatccatgtaaggcggcatacccacaggccgtctgttcctgcccaacccacccctctctagctcagcagtcgatggcctgcctggtgataacaagcgaggtgcctcggccatcttgtccaccggtgctcctgcgctgctccatatgtacatataggttccattcgagtccatcatgtaactaattaaggcacttgtacgtacgtacctaaggaactccgatcaatctaggtgtcaccgcgacgacgaggcagtagtttacgtctgtcagcgttagaaggatgtattttttgatggaagaattttgtaagattaactggtcaaggggggaataaatggaaggaatagttccattgcttcaaaaaaaaaaaaaaaaactcgagactagacctcggccgcgaccacgctaatcactagtgaattc

SEQ ID NO: 33643 - DNA, 644 bp, Triticum aestivum
  unsure (1)..(644): unsure at all n locations
  Clone ID: PAT_TA_33643
ccgtagcaaccacatcatcatcaccggcctccatcgccgcctcgccggacaacaccaccaccaccagcgccacaagatgggctcgcggtacgaggtggagatcaccgtcggctccgcgcgcgacctcaagaacgtcaactggcgcaacggcgacctcaagccctacgccgtgctctggatcgacgccggcgcgcgctgctccacccgcgtcgacctcgacaacggcgacaaccccgcctgggacgagaaggtcgtcgtcccgctcccgcccgccagccgcctggaggacgccgtgctctacatcgacgtcgtccacgccaacgccgccgagggggtcaagccgctcgtcggctcggcacggctgcctctccgcgacgtcgggggcaaggcgtcgaggaatctgaggctgaagcggccctccgggcggccccaggggaagcttgacgtccgcgtcgccgtcaaggagccggccaggtactacgactccaacgtccctggtggctacccggcgcccgcggggtacgctcctcccgtgatgcctacgtggtggnatggtgtcggcgcgnagngtacggggccgcggcgggcgccgtaaggacgggagcgtacgctgcggcagcgcctccgtcggggtacccgggcta

SEQ ID NO: 33644 - DNA, 1274 bp, Triticum aestivum
  Clone ID: PAT_TA_33644
cggaccccaggccgagcgagccacccacccgccctcgcgaccatggacatgcgggccctcaacttgaaggccgccgggccctccttcctcgcgccgcggcgccacccgccggcgacctgggctcccctccccgccggggagatcgggaggaggcggcagccggcgcggttgaccaagctggcggtgagcgcgtcggggaagaagagcaggaacggccgcgacggggacgaccccaagagcaagccctccccttccggaaaaggtgatgcatctactcccattggagatgatgatgccgatgcagtaagccaaaatcatggcgaactgaaacccagtgacacgatgtatgtaccaagcaacctgtcatattggcgagatgtgagagcaagctttgtgattccaaagtcggagcaggcagtcgatgtaaatacactaccacaaacatcattcgatggaccagtacactgtcttcctcggaaatgggcccattctatttctgcgccagaatctggctgtgtgctggtcgccacggaagagcttgacgggaacggtacctttgaaagaaccgtcatcctcctcctcaaactaggttcgagagacgcctatgacggtccattcggcgtcatcctgaaccggccactctacacgaagatgaaacacgtgaacccatccttccgcgaccaggcgacgcctttcggcgactgctccctcttcttcggaggccccgtcgacatgagcatattcctgatgaggaccaacgaaggcaggcccatcaaggggttcgaggaggtagccccgggcgtgtgcttcggtttcagaacggacctgcagaaggtcggtcacctgatgaagaacggggcgctcagccctgatgacctcaagttctacgtcgggtactccgcctgggaccacgaccagctgctgagcgagatcgacgcggggtactgggtcgtcacctcctgcagctcgggcctgatcaccgacgcgctgacgacggacccttcttgcctgtggagcgaggtgctgcagctgatgggaggccagtacgcggagctgagtcagaaaccgaaggaagatggcgcgtgaactcgggtatgttgcggctcaggcacggtttgcagcaaactctgttgttgttcgatttgtacataatttgagtaatctcgtctggtcactgtcctgttcgtcacgtgcggagactgtttttgttttcgtggcgctatgatcaataatacgtttgctgttggtgggtgcacaaaaaaaaaaaaaaaaaa

SEQ ID NO: 33645 - DNA, 714 bp, Triticum aestivum
  Clone ID: PAT_TA_33645
aggggaggcatcgtcgtccgcttcttcatcagcgtcgacggagagatctcatgttctttgtaagccgccagtggcggtaagatttcttgttctcagatgacatatcagacgtccagctactctgcatctcccgctgcatctaacacgcatgtggtctgcatagtgcaccggtaaggggtgcatcttttgtgcgcgtgctatcacggcgaggtatgctgctgcacagatatcaactcgaagaaacagagagccggaggtgaacacggttggggaagtaacacaactgatggcggatggattggccggagcagatggcggacggcatgtcgggcaggcaagtgagcatgtccagctgcaccatccgccggtgagtcccgcagctagtccggctgctagtcctgctgcaatatcaaggacgctatgcaccgagaatgcgtggcaagtagcagtgaaccaagacgtggggaggttgtagacgacacgtctcatcgccagtggctcgtttgaaacaccgaccgacacgtacatctacctctgagtactctggcaggcaaacatgtcatatcatgtaccaatattcataggtttgtaggtcggtgtaggtgcgtaacagtagagctatactagactagtttatgttgattgcgtcaaacggccaccgtctaatcaagaaacagatctgttattatattcattggttagatagcttggcac

SEQ ID NO: 33646 - DNA, 695 bp, Triticum aestivum
  Clone ID: PAT_TA_33646
cgggtcgaccgggatcagaaggatatggacaacgcagatgcagctggagaacttgtaggtccgattcctcctctgccggatgctcaagtggataatgatggagcttcagttgaacagagtacttctaacgctaagagtggtgagaacgttgccatgaatgagggagctgttgacaaggttgattcgtccaaattagatggtcaagacaataccaatggtagaatggatgttgatgctggtagccaggaagagggaaacaatgttcctgccgctcctgatgctacaattgtagatgtagggaacacacctgtatcttcagatcaagctgtctcgaatgaagagagtgacgtggtccctgaatgaaacatctaccacatacctcatctgcggcgcatgtcacaagcatgatgaggaaggtaactagaaacaggatgcagttgcaaagtgtgaaactgtatgtgttggtaaaattgtggatggaagcaaattggatgttcaaggctgtagactattacttttcactccttccgaacacgcttgtgtgccatgtttattttgtcatttttcgtcaggcatttttcaaacccacgcgtccgcggacgttatttggaaggtagaaacctgacatttgcatttttctgttgaaaatatgaacttgaggaaaaaaaaagatatcactcagcataatgaagccg

SEQ ID NO: 33647 - DNA, 1035 bp, Triticum aestivum
  Clone ID: PAT_TA_33647
tgcactatacacatttgttaacaggttacatcggctctgtttcctttttaaatacagtgctacaagtcgtcgacaaattacgatcggtcaatcctgatcttatatacgtttgcgacccggttctaggtgatgaaggcaaactatatgttcctcaggatttagtatctgtttatcaggagaaggttgtcccagttgcttcaatgcttacaccaaaccaatttgaagttgaactactcacaggattaagaattacctccgaacaagatggcttgaaagcttgcaataccctgcacagtgctggaccacggaaggtgataataactagtgcacttattgaagacaagctgctcctcattggaagttacaaaagaacagaggaacaaccgccggaacaatttaagattgagatacccaagatacctgcatatttcacggggaccggagatttaacaactgctcttctactaggatggagcaataaataccctgataacctcgagaaagcggcggaactggcagtatccagtttgcaggcactcctaagaaggacagttgaagactataaaagagcaggctttgacccagcaagcagcagcttagagatccgattgatacaaagccaggatgagatcagaaacccgcgggttacgtgcaacgccatgaagtataaatgatcccgtattaattctgacaagcatcaccaccaaattgaggccgtcaaactgttataaggaggaatggttgtaaacaaatgttggtctcctcgaagcatgccaagatcttcactgtcaacatgcaccgtatattcgacgcggtttctggcttcagttttgggaaagccatttctagcttgccttaggttcaaacccgtaaaggcccccaattaggaaaaacaacaatatgccatcatgcttttgctataatttgtcacttttatttgtggctgtgagaattaattgtacagaaggtttagttgcatctttgaagctttgttgtgttggtgttacaaaaaaaaaaaaaaaaacaaacccacgc

SEQ ID NO: 33648 - DNA, 1452 bp, Triticum aestivum
  Clone ID: PAT_TA_33648
atccggcgatggcacggccgccgatcctctccgttgcactgccgtctgacacggggcgcgtgctcagcatccagtcccacaccgtccagggctacgttggcaacaaatctgctgtctttccgttgcaactccttggttttgatgtggatccgataaactctgtacagttttctaatcatacaggatacccaaaatttagaggacaggttctcaatggcaatcagctgtgggatcttattgaaggactggaggaaaatgaattattgcactatacacatttgttaacaggttacatcggctctgtttcctttttaaatacagtgctacaagtcgtcgacaaattacgatcggtcaatcctgatcttatatacgtttgcgacccggttctaggtgatgaaggcaaactatatgttcctcaggatttagtatctgtttatcaggagaaggtcgtcccagttgcttcaatgcttacaccaaaccaatttgaagttgaactactcacaggattaagaattacctccgaacaagatggcttgaaagcttgcaataccctgcacagtgctggacctcggaaggtgataataactagtgcacttattgaagaccagctgctcctcattggaagttacaaaagaacagagaaagaaccggctaataactattgcacttattgaagacaagctgctcctcattggaagttacaaaagaacagaggaacaaccgccggaacaatttaagattgagatacccaagatacctgcatatttcacggggaccggagatttaacaactgctcttctactaggatggagcaataaataccctgataaccttgagaaagcggcggaactggcagtatccagtttgcaggcactcctaagaaggacagttgaagactataaaagagcaggctttgacccatcaagcagcagcttagagatccgattaatacaaagccaggatgagatcagaaacccgcaggttacgtgcaacgccgtgaagtataaatgatcccgtagtaattctgacaagcatcaccacaaaattgaggccgtcaaactgttataaggaggaatggttgtaaacaaatgttggtctcctcgaagcatgccaagattgtcactgtcaacatgcaccgcatatcgacacggtttctggcttcagttttgggaaagccatttctagctcgccttaggttcaaacccgtaaaggatccaaattagggaaaacaacaatatgtcatcatgcttttgatataatctgtcacttttatttgtggctgtgagaatgaattgtacagaaggtttagttgcatctttgaagctttgttgtgttggtgttacaatgattaaacagcatcttattgatgtgttctgtacctactcttctttattaaattattatgtgtaaactcattggtgaatattcaaaaaaaaaaaaaaaaaaaaaaaa

SEQ ID NO: 33649 - DNA, 897 bp, Triticum aestivum
  Clone ID: PAT_TA_33649
aacgacgccgcaactcgctccccgcctctccctccgaaaccgcgagcgccagcgggatccatcgcaggttcgcaaccgaacggacggagggacggcgcacacatgggcatggccggcgacgactggcgctgccggaagcacccgcccgtgccctgcggcggcgtgtgcccgcactgcctctgcgaccgcctcctccgcctctgccccgactgcgcgcggacgcgcccctgcgcctgcgcctccccctcctccccgtcctcctcggcctcctccgcctccgtcggccgcgtctgcagcctcatcgagcgggagcgccggatcgggcgctcgcggtccgtggccggcggcggcagcgccgacgagaggcgccggtccagggtctggggctgggcctcgttccggaagcccgcggccggcaagggcatggagctggagagcgaggaggagcgccacgccgccgaggacgcggcggcattggagttggagcggtcgagctccgcctctgcggagaagctggcgcccaaaacgggcgggtgggggcggttcctgcccggcccgatcaaggcgctgcgccaccgcaagtcgcgcgcttccgccggcgccagcgcccgaggcgacccccgggagggcgtaaggtaaggtgagatccccggccggcgcgcggttaggtcgtcttctttccgtgactgttgtgatgatccatggatctcgttggttggtgatcctgtaaccccgagtcgtcccggccccttccttcgggcctcgcccgtgattatacataataaagttgtgcatagaatgtgttagctgctgatccaatcccgttcttccccagccttggaaatggggttccccagttcattctggctcaggttcagcaatggcgatcgatttctt

SEQ ID NO: 33650 - DNA, 831 bp, Triticum aestivum
  Clone ID: PAT_TA_33650
ccgctcattctttcttcccccaaatcgtatagccatggacgcgggtaatgtgaggagccccggttgctgtgagcggacggcgaccaccatgtgttgccagatagcgaccaccccgattggcggagttgttgctactgcgaggggcaccgctgcgctacaacggtgggatgacccctcgcagcaagcaggttgcgacccgccttgtagcaccagttggccatggatcttgcctgggcggcaaagctcatggtgctgcaaagcgacgtccgacgcaacgcgctcgtggtgttgtcggcatcctacgcaacatgctccgcagcggtgctgctgctccagtgaagtgcgctgaggctgcaatggagcgccgcgcgggtcgttgaagctccgtcggggctgcaatgaagcgtgtcggagctgcattgtagcgccacggggccgttgaagctcgtcgggggttgcaataagcgccgtcggtacttcgcgccgcgcgtttctgccaaggaagttgttgcgctgaagcttttttgcctcgctcggcgttgccatttgagcagcacccggatggctcctcggtgctgcgatgcagcggtcgctagcggcttcagtgcagcgaggtcgccgacatgtgcagatgctggatggatgcgcgtggtgcatggtagaacagaggaggaagacgatgactccatgtgttgcgatcgtacaaccacaatccgacagatcggacggctggctaggcggtttaattttgtaacaaatgagccgactgatttgtagtagccgccgcttttatatcataatgcattgtattggcttgagttcatatcaaaa

SEQ ID NO: 33651 - DNA, 655 bp, Triticum aestivum
  unsure (1)..(655): unsure at all n locations
  Clone ID: PAT_TA_33651
cacacccgcacccgcacacagccgcggcgacagacacccaacggcatcgtcatcatcaccgccaccgccaccacttcttctagatagctcctggtactgccgtgccgtcattagccgcgggagcagagcctggacgagtcccagatcggtcggttcggtcggcaccggaaggcattcaggcagctaggcgtgggaactagattaggatcctagcggcaaagtgcagcatgggcgccgggattaggatcctagcggcggccctcctggcgctcgcggctgtccgcggcgcgacggcgcagctccggcagggctactactccgccagctgccccaacgtggaggccatcgtgcaagccgccgtggccctcaaggtccagcagacgcccgtcgccgtcggcgccaccgtccgcctcttcttccacgactgcttcgtccagggatgcgacgcgtcggtcatcatcgtgtcgtcggggaacaacacggcggagaaggaccacgtgagcaacctctccctcgccggcgacggcttcgacaccgtcatcaaggcgaagcggcgtggacacgcagtgccccagccccaccctggtgtcgtgcgcggacatcctcaccatggccacccgggnacgtcatcggcctggccgacggcccggcgtac

SEQ ID NO: 33652 - DNA, 729 bp, Triticum aestivum
  Clone ID: PAT_TA_33652
cggacgcgtgggtccattcatatcttgcatctgccggggtcgacggcgtgaaagtagacgtgcagaacattctcgaggcgctaggcggtggtcatggtgggagagtggttctgtctaggaagtaccagcaggctctagaagcttccatcgcacggaatttccgcgacaacggcataatatgttgcatgagccacaacactgacaacttatacagttcaaaaagaaatgcggttgtaagagcctctgatgatttctggcctagagacccagcttcgcataccatacacatcgcatccgtcgcttacaataccgttttccttggagagttcatgcagccggactgggacatgttccatagcgtccacccgatggccgaataccacgccgcggcgcgggcagtcggcggttgcgctatatacggtgagtgacaaaccaggaaaccatgacttcgatctgctgaggaagcttgtgcttcctgacggatcgatcctgcgggccaaactgcccgggagaccgaccggggactgcctcttctctgatcctgcaagggacggcaaaagcattctcaagatctggaacctgaacgcgcactccggcgtcatcggcgccttcaactgccagggcgccggctggtgccgggaagggaagaagaacctcatccacgacgtgcagcccgggaccatcaccggggccgtccgggggcgggacgtcagccgccttcaggaggtc

SEQ ID NO: 33653 - DNA, 1409 bp, Triticum aestivum
  Clone ID: PAT_TA_33653
gcgctaatggcgaccactcctcccgccgcgcgcctctccctctcccttcccctctctcctctcccaaaccctaaaccccacccccacctccacgctctctcccccgcactccctctccctctccctctcccccccccccgcgcccccccccctcccccgcacccacagccggggccggcgggagagctccgcggcggccgcggacggcgacagcgacatggacgtcggcggcgcgggcgcgggcgacctcgaccgcgacggcggcgtgggggtgggggacgacctcgacatcgagcacgaccaggacgtcgacgttgaccgcgtccgcccccccgcccccccccggccgcgcccgtcccgggccggggtcggcggcgggggcgaggagggggagatcgccatggtcgcggccgaggaggttcgtgtcctgtggggcggcccgccccccccccgtcctcgactacaccatccactaaagtgagtttcacaagactcgcctggcctgcttcactgtgttttctccatacgcaccctgcccgaccctaaccaactactacttccctgaggtgaaattcacgtcacccgacaccgcaacctactcaattccaagggttcttgccccgatgccacaaaagtatgtgaggtgcgcgacgaaaaactttggccgctaccatgtaagtgagccaccggttgagcatctgcgtgatcccctgtacaagacagagagggagattatgaaggttttcttaacaaaacactacagaaacaggcggttcagcgatacagattttttccttgattttgaggagatttatgtcatcgactcaaaaacaaggtcaatcacaagggcaaaagtagtggtgaacgtccctgcaggcaaaggaagagataggagaaatgacctgctactcatacggtacggtggggagtctttccgattaactgacaagtcccaaagagacgacgccaccaccatcatccaatccggagagtggacgggaccgagtcgggacggggtgtggcgttgccggtcccgcagcgctgtggtcttctcgactcggttcggttctgacggacctcccgcctcgcctaggctgtgcagggtgggctgcgattttgttgtttctttagctgctgcttgtgctagagctaattaaccgtggtggtctgggtgagaactgccatctttatatatggttcgtgctccctcgttgcacgtatagtagacgcgtgaggtatgcctgtcagcgtgcttgtctgttcgaactctccggtctgaaacgccttataaaaaggaacggagggagtacgtgtagcatggtagcaagtagaatcaagatgtatgcatttgagcagtatgtctgtacgaaaattcagagtagctctgtacgaaaaaaaaaaaaaaaaaa

SEQ ID NO: 33654 - DNA, 766 bp, Triticum aestivum
  Clone ID: PAT_TA_33654
cccgacgggcaaaagcgcacacactcacacccacacacaaggaatcaatcaacccaccggtgccggccgcgtggtgcctgcagcgggcagtatgcttgtggggggggtgagggcccgcctggtggccgtggcgtcggccgctcagccgccggtgagcttcagggtggagaagggagccgacaagacggatctggcgctacagatcgagcacgaaaaaggccgacgacggcgtgaaggaggtgaagctggaccagcaacgcgggctggctgcccctgaacaaggcgtgcaggagcacgtgcgacaccacgagcgagaaggcctctcgccggccccctacaacttcggctatgcgaccgagcaagggccagcgcaacgtcttcgaccgatgcacatcccgaccgatctacaatcgcggggtccaccgaagaacctacagggagtcctactgagaatacacccatgtatctgttccaccatcatcgttattcctggcaaataagataatgtggtaagacgcacggatactaataagttagattatattacccttcgtcccgaatctgttgtctaattcgggacgaagggaagggagtagtaggagaagcaacggccggcggtcggttgtatttgctctcccgtacgcccgttgtcttgattgaccatttcttttttttctttgtaccgaatcttttcactattatttgtaatatacttgaaatctagatttcatattatataaaaaaaaaaaaaaagcccctagggcct

SEQ ID NO: 33655 - DNA, 620 bp, Triticum aestivum
  Clone ID: PAT_TA_33655
gatgcatgcacctccaatctgctgctgccatgcaaaattcaccagcgatctgaaacgatttgctcgccaggtcaacacggcagctgagttgatctgaaatgatctgctgctgagggatcttgtgagttttacaggttatatactcgccgctgcgaatttgcaaccactggcgatctacgaggacggaggaagaagaagagattcttataactaactgaacaaaagaaagaatttggtttcatttttctctttcgttggggtgttgatcgacaatggcgatgatggtctggtcacgagcagtctccgactcggttggactgcggccggccgccgacgacccagagcagggtgcgccgggcgaacgacggccgctcctccgcgagcgacgacaccacgctgttgccgccgccgctgcccgtctccacgtcgccccagtccgcctcgctcccgctcttgcgctcgccccctgcctcctcctcgccgtccttgctgccgctcctcatcggccaccggaacgacaccgtccgccgcccgcccgcgtcggggtcccctttcctggacgacgccggcggcacatccagatcttggactcggagaagctgtcttggtgagcttcgccc

SEQ ID NO: 33656 - DNA, 681 bp, Triticum aestivum
  Clone ID: PAT_TA_33656
gatccaatgcaacgatgaactctttcaaccattcactgtcgcatttaatcaacttgttgtaccactgtcataagttaaaacgacaacaaatttatacagtcactcaagagacactctgactctaccaccaaccaacaagcataagcagcagcagcatgtacagccttccggttatcatccatccatccgacgagacacggaaaacaaaacacctcctcctcctccttcctcctccatcatcatatcaatctatctcacttatctagactgcaaccagccgaccaaacctcaaaaaggaggggtggcaatgcattgccaaatcatcttcttatctaccacctaacaacaaaacagcaaaagtcggtttgttcaggaccactgtcagcaacgactttcgttccgttccgttccattccattccatacatcggtccgacacctgtacactaactttggatttcagagacaagggatgctccatgcatacgaccagccggtgtcgggattccatcagcccggccctggattcgggggagcatacatgccgcccgcagcacctgaccctgggtttgggggagcatacatgctgcctggaccaactggtctctgctggagctgatgctgcggctgctgctgatgatgcggaggaggcaggtgcggcctagacagttgctggtggtgc

SEQ ID NO: 33657 - DNA, 430 bp, Triticum aestivum
  Clone ID: PAT_TA_33657
cgtgaagatgaccagatcgagtctgtagcgtgtgtgtcccccggcgtgagcccgtggttgcgttcgtggagtgaaggagctgcatgcgcagagccgttgcgatctgttggagtcaggtgcgatgtgcgcgcggctggagggagttagttgcaagctagctagatggttggccgggtcatgctagtgcatgcatgggctagcccggcgggtcatgtggtcatgcatggatatggatcgtgcatgtagtggttagcttagtgcgtgagttagttgccgggtgtgcaggccgtgtggtgtgtgtgcacgggtataaaaacccctcctccatgtactgatcgagttgagccggtgtgtagccatgtagccactgtgaggaagaaaaggattggggcggggcgccgcggtgttggtcgccgggaaaaaaaaaaaa

SEQ ID NO: 33658 - DNA, 467 bp, Triticum aestivum
  Clone ID: PAT_TA_33658
taccggatcgacacttcccggggtcacgggatgacgttgcgagattctcgggaaatgaactacgatagcaagctccaaaacatgagctggttctgctacaaacatgtgaacacgttgtcccagacaagcatgaccacatagtagtcttataataaaacactaccgagttcaggagggggaaccatcaacgagggtatcgaagtccttacataagtccggattagctcttatgaagaaactccttctccttgaacaaatcaatcagtggcttggtgtgctagggacacatatagaatgaaggttgcaagtcttcaaaccacagaatacttcgcacgtgtgcatgactgatttgggatgattccaaagaaagcaacactaactttctcgaattcacggcggcaacttgcatcagatgcacatgaattagaggaagtcactaccttcatcaaacatatacttcatgaact

SEQ ID NO: 33659 - DNA, 1426 bp, Triticum aestivum
  Clone ID: PAT_TA_33659
catctcttgagctgagagacgaagcacacccccttggggggatggagtggaacagataacgagggttcactaggtagacaacaatttcacgcttaagaaggtggtaatcgattgtcaacgtagcgaggagttgagttgccatgaaaccacaacgaggcaccttagggaaggtgactcgtagaaatatccccttaagtggcaaaaagaattacttttgattcaaagatcattgaaactctttataccagcctaagacaaatcacagcgatcgtttggagggggtcggtagaatggcatactcggacttggatgatgtggattaccttgttgaagacaacgtaatggatgaatttgcttatcatcggaaatggaagagacccatggtagaatggctcagtgacggtgcaagctgggaacaaaatgcaaatgcaggttgtcattctggtaactggggtaggacctcaacaatagaagagtgaggtcactcttttgaaaagtgattagcatggctggagggaactgagagcaaacccagttagtgccgatggataacacctagcgcttgtgtgtgctctcaagaacttgagcatttcccatattcatctaaggttttaccaatatccgtgtccaaggatcctggcaacacaacttactaccatgatgaatagtgatggaggatgcagatgcaaaggaggataacactttctcagatttcaccttagcggggccaagggaacaaaatctggatgatcgaccgagagacatttagcactccgcttctaatgttctccttgatgtgctagcgtaacccattcatagatatggtttgatatctagaacatcaagtaaaaggtcggacttcgggagcacaagaatccataaggaacaactacggaggtaaatcctacgaaatccttatggggaggtgcccaacttcctcaatcaagatactacaataataggtcttccggctgggtgtgttggccacgacatccactttaccggttatcgagggaccgatattatagttcttgggaaatgttccaaccatcatatctgcctgagattcagatctggttggtgtcaggatattccagactcatcgagtctaggaagaaaaatgaaagtttgcaacacaaatcgacgagacaacgttgcgagattctcgggaaatgaactacgatagtaagctccaaaacatgagctggttctgctacaaacatgtgaacacgctgtcccagacaaacatgaccacgtggtagtcttacagtaaaacactaccgagttcaggttgggaaccatcaatgaggatatcgaagtccttacataagtccggattagctcttatacagactccttctccttgaacaaatcaatcagtggctattaatacgactcactatcgggtgccccatcgacccacgag

SEQ ID NO: 33660 - DNA, 1569 bp, Triticum aestivum
  Clone ID: PAT_TA_33660
cctgcctgtccaagttgaccaaaagaaaactcctcccctcgccgtacccctatcccgatggcgatcggcggcggcggcggaggcgggagctggagcatccacggccgcccggatgtcacctcccgctacgatgtcctcggacgcgctggctctggcgcctacgccgacgtctaccgcggccgtcgccgctccgacggcgcaccggttgccctcaaggaggtccacgacgctgtcagcgcccagcgcgaggacgacgccctcctcgccgccgcctctgagtcctcccctcatgtcatcacgctcctcgaccacttccccggcggcgaccacgacgacgacgtcctcgtcctcgagtggctcccgctcgacctcgccgccgtcgtccgcgaagggaggcgcgcgggcggtctccctgccggccagctcaagcgatggatgctgcaggtcatcgaaggcgtcgccgcctgccaccgcgccggcctcgtgcaccgcgacctcaagcccggaaacctgctcatctccgagcacggggtcctcaaggtcgccgattttggtcaggccaggattcttcaagaacagccatctgatgaaccggaaattcctgctgctcaggagccagagacactcactgcagctgactacctacatgagattgaccaactccgggccaagtccacttatggagatgtcgacagaatgagccttcaggatggaaacacctcctgtcttgccacttgcagcacagctgacatcgacgatgatccatttagagcctcatattcgtatgatgctgaagaagacattggggatgaagagtctggtgccttcacttcttgtgttggaacacggtggtttagagctcctgaactcctatatgggtcaaccagctacggccaagagatcgacctgtggtcactaggatgcattttggctgagcttcttagtttagagcccatattcccaggccaatctgatattgaccagattggtagaatcatcggagtcctgggcaatatcacagaagagtcctttcctggctgttcaaatttacccgattacaacaagatctttttcagcaaggttgagaagcctacgggcctcaaagcatcacttcctaacagatctgcctctgaggttagcatagtaaagcggctactttgctatgacccagcaaagagggctagcgcttccgaattgctgaatgatccgtacttcactgaagaacccttacccgtacctaccgaggcgctacaagtcccggcatcaaagggcgaggacgatgacagctctgcggaagaatggggtaattacagggacggcaattcggattcggacattgacgaattcggcagcatggatgtcaccaaaactgacaagggttttagcatacgcttttagcgatgaagaaagatgcccacgggaacaatatctttgtattgaaacattgttgtattctctgtctggaacatgtcgtttggggagtttcggtaagttgtagtatctcataaactgtgagattatgcacagcaaccagtattctcctggtggaaaataaagttgtactgtact

SEQ ID NO: 33661 - DNA, 634 bp, Triticum aestivum
  Clone ID: PAT_TA_33661
aaggaagttgatagcaagtccgtgcttggcattaaagcaagcgatcttccatctttttcctaatcggcttgttattatagccgtcgatcaacacgagaaccacagcggattacaggtcattgtttctcagcaaagagcaagccatggagatcatgaaaaaaccgtaatctgacacaattaagcactctaccatgcaaacgctaaactagaagtctgcaaatacgtagaacgaggggggtatatgggggtgctggtagccgcctatgccacgcggcgtgacatttacgacgcgcatcttctagtttggcatcggcgcaggccacctgttgtaattgctctcttccagcatctctgcagctatagtttttgacaccgtgctgccatctccttgtcgctttattacaacctcaattgccatgcccccatcccaacctccataagcttcaatatgacttacggcagcatccagtaatattgcactctggaacactcgagagaaccttttcaccacattttacaataacatcaccgacacataatccagcaacatcagcaggtgatccctcaacaacctttgaaacatataaaccctggtcaacatctgggcatttttgatagataggctccaagacgg

SEQ ID NO: 33662 - DNA, 266 bp, Triticum aestivum
  Clone ID: PAT_TA_33662
gcagatggggtggattcctgacaacctgaacgaaggccaccttgaccgcttcttctggctcattgctggcctcagctccctgaattttcttgctttcctttattttgcacagcagtacaagtgcaagaaagcttctgtactttaatgttttctgctttgccatgtattgtacagaaagttgcgtgcatatttccctcatgaacaggctaacaatgtacagtcttctgtaatgtacagtcttgtatccttggatacattcgttaaaa

SEQ ID NO: 33663 - DNA, 246 bp, Triticum aestivum
  Clone ID: PAT_TA_33663
aaggggtcttcctccatggtgacggcaagctcggggtagccggcgagcacgcggcggccgagggcgagcacgcagcggccgagggctagaacggcagccatgtttcctttgttatttctcgcatggaaaggatacgtgaaggaggaaagatgcgttgggcgcctagcagtcgcctgtatcaaaagtctgtacagcttaagttatgatacagaatgcgtgacggtagaaaaaacccccaccccacgc

SEQ ID NO: 33664 - DNA, 872 bp, Triticum aestivum
  Clone ID: PAT_TA_33664
cagcatcctggttggtaatgcactttgccggctgatttctggaggtgatatccttgtgtttgatttgggaatgtcagagccttgatgtgatcgagaagccggcattctactatgttaccgacgggtgttttcagatcttacggatggagggtggtggacttggccttgctgttttgttggacttgaccatccaattgtgggagaggaaatctaactctgatggtgtcgttggatgggtgttgctgaagaaaaccattccactggaggggatgtttccaaggagaatgaattctgtacgtatcgtcgggtatgatgaggacacaaatgtgattgttctcacttcgatgaccggcaacttcacactccaacttgactcgatgcagctcaaacatattgttaaaagaaacaacatatgttacgacccgttttatccctacacaaatttctatactgcaggcagggcagtcggccgggaaggggtgaatctggaactaattgtgatcggaccagatctgctaacatactatcttggtcgaacaatttaggtactgagagttaaattcgtgttgctgagacgcagccatggctagttggcgtacggaagttcttctattttgttgagatgcaaacatggctagttggtgcagtgaagttcttctattttgtatggtgtggtcgacgcttaaactgtcccaccatgtagtctgttggatcatctactatgtatgccgtggtcgatgctgagatgtctccaaaatgtggtatgtaggttgttctacttttaggtaccgcgggctgtgacgtgaacctatcgggtttaatcatctgaaatcttatatatatattagtatctaaaaaaaaaaaaaaaaaaa

SEQ ID NO: 33665 - DNA, 2221 bp, Triticum aestivum
  unsure (1)..(2221): unsure at all n locations
  Clone ID: PAT_TA_33665
cggggcggcgggcgcggtctccgtggcgctctcgccggccgccgccacgggcgcccgcctcgcgccctccgcggtggcggtcccctcggcctccacccaactgctcccggcctccgcgccgccctactgggccgggccgagcgccacccgcaccgggaggagccttgcacccccgcgggtggcgctgttggggcggggcggcggcggcatctccacccaggccgccggcgtcgccgccgccctcgtcgccaagggggagcgcaacatccccgaggcgtaccctcgcaaccccccggcgctcggtgacaacgtggtggacagcgtcggcgacatcggcgggatggggtcggacgtgtcggggtcggacgcgcagtcgtggtcggcggcgccgttcgtggcgtccatctcgtcgttcgggacggagcacaacttcgcggcgatgatgtacccgctgctcatcagcgccatgggcatcgtggtgtgcttggccaccacggccgtcggcaccgacctcgccgcggtgaagaccgtcgaggggaccaggccgtcgcgcaaccggcacgatccccatctcggccgtgcgcatgaccgtcggcaccgccaccttgacgtcgcctcgtcctgccccgcgcctttacccgccgcgactggcggccgccgcttcctgcgcctaggagttggaattccgtcttcggtcggcctgctgcctgggccggcatggctaatcatcggctatgtctcgccgttcttaacctgcagactgggagaattgtatgaggtgatgaatggttaatggttactttagtttcggactttatttgagtgcaaacccgccttagaaataagctcgtggtgtagcaaatagtcacttttaaggcatgacttttaaatgccgcctgccgcctcgccgccgggcccgccgccgcgcgcccgccccggggcgcgctctgcgccgccgccgcggggctctgcatcgacgcctacggccccatcagcgacaacgccggcggcatcgccgagatgtccggcatgccgcacgtggtccgcgagcgcacggacgcgctcgacgccgccggcaacaccaccgccgccatcggcaaagggttcgcgatcgggtcggcggcgctggtgtcgctggcgctgttcggcgcctacgtgagccgcgccggggtcgcggcggtggacgtgctgagccctcgggtgttcgcggggctgctggcgggggccatgctgccctactggttctcggcgatgaccatgcggagcgtggggagcgcggcgctggcgatggtggaggaggtgcggcggcagttcgacagcatcccggggctgatggagggcacggcgaagccggactacgccacctgcgtcaagatctccaccgacgcgtcgctcaagaagatgctggcgcccggcgcgctcgtcatgctcagcccgctggtcgccggcacgctgttcggcaccgagacgctggccgggctcctcgccggcgcgctggtgtcgggggtccaggtggcgatctcggcgtccaacagcggcggcgcgtgggacaacgccaagaagtacatcgaggccggcgcgtcggcggaggcgcgggcgctggggcccaaggggtcggacgcgcacaaggcggcggtgatcggcgacaccatcggcgacccgctcaaggacacctccggcccgtcgctcaacatcctcatcaagctcatggccgtcgaggcgctcgtcttcgcgccattcttcgccgcgcacggcggcctcatcttcaagcacctctgagtttgaattccgggttcgcgcgtcttgctgcctggacctggatggccaagcagaagactttcgttgccaataataacctctagactgggagaattgtatgaggtgatgaatggttaatgtttactttagtttcggacttaattcgagtgcaaacccgccttagaaataagctcgtggtgtagcaaattgtcactcttgaggcatgacttctaaatgcagcatggatgctcgtctctgggccttcagcagagtaccatcacggtgaggtgtgtttggcacctgtgggttatatctttcttttgtcctcgtcccgctgtcctgccgcccggcggacccgcctgttcttgagcggccgccaccgcggtggagctccagcttttgttccctttagtgagggttaatttcgagctaggagaatnaanagagnttaaannnanccnnc

SEQ ID NO: 33666 - DNA, 341 bp, Triticum aestivum
  Clone ID: PAT_TA_33666
ggttcttgtaaacctacagtagcatgctgtagcatagtacatgctgatccgagtgaaaagattttgcaacgagcctggcattctagctctgcttccatgattttttttgtgaaatcagactgagtttgcgtgcacaggggaataatttgctgtcatcgcttctgatttgatgataatcaagcctgcaagaggatgaccagttttaatggctgactattgttggttgggccatatgtatgttgctttcttgtatatctgatggtggcatttttctcgacgatatctgatggtggctgtatctagtgctgcaagtcaaatcatatattcatatgtaatgggca

SEQ ID NO: 33667 - DNA, 696 bp, Triticum aestivum
  unsure (1)..(696): unsure at all n locations
  Clone ID: PAT_TA_33667
cggacgcgtgggcaagagctgctgctaccacccaaccatcccgtcggctctgccgcgccgccgacgccgccgcagatctgatccacccgcgccgccgtccgtccgcccctcttccaagatggcgatcacggtgaggcggtccacgatggtgcggccggcggtggagaggccgcgggagaggctctggaactccaacctcgacctcgtggtcccgcgcttccacacgcccagcgtctacttctaccgccgccccgaggcgggggccgacggcttcttcgacgccgaccggatgcgcctcgcgctggccgacgcgctcgtgcccttctaccccatggccggccgcctcgcgcgcgacgaggacggcagggtcgagatcgactgcagcggggagggggtgctcttcgtcgaggccgacgcccccggcgcggccgtcgacgactacggggacttcgcgcccaccatggacctcaagcgcctcatccccgccgtcgactactcggacgacatatcctccttcccgctcctcgtgcttcangtgacctacttcaagtgtggtggtgtctcccttggtgtcgggatgcaacaccatgttgctgatggcatgtctggcttgcacttcatcaactcgtggtctgacctctgccgtggagctcagattgcggtgatccccttcatcgaccgcactcttgtccgtgc

SEQ ID NO: 33668 - DNA, 1949 bp, Triticum aestivum
  unsure (1)..(1949): unsure at all n locations
  Clone ID: PAT_TA_33668
gtccggggtcacaccctaggggaaagcctgcaagtcatccttctcctatcgacctgaaagggaatgcatatgagttgctgcgatgcaaagcttcgagctttctcctcgatgacttctacaggactcctcggaggtattcaatttgaaggacctggtttcaagatgcaaagcccatcacactgaccattgaagatcaggaccacatgggcgacatcgaaatgctaaaactatatctcgacaaggtgaagacgatcgtgaagcccggttgctcgagggataccctcaaagcggcgataagctcgatgatctcagtgacacatgtgctgacagtgatgtcccaccctctcaatgctgagctgcctctctaccatttacaactgagcttgaatcactcactgcatcctgaattacagctggcttcttgagctactctgtttgcctctgtcttccttttctgaagggcatcgtgtgaaagcactgcagtctatatgccagcaaacgtggaaataatagtactagttaataatccttgctgtgtgtgagactggatatgtttctactgagcaaccgatggagcttgaggcaaagtactaatacttaccggccttcattaagtcacaactacttctccatctagaatctgacaactctgcccagttgtcccaagattgacaccgaatcaactgttagctcacttggtagaagcagaaatgataaagagaacaaaagaagggagatacaagggaaagaagttcagttcagtctgccatttctttgggatatcaagctcgaggatccctaccgtcaaactttgactgtgactacgcttatgttcttggccatatctccctgcatatgatagcagctggtttgactggctacatggcaactgtggctaatctcaaggaccctgtacacaagtggcgatgtgctgctgccccactaaccgcaatgatgagtgtcaggaggcatttacgtggcccgggggcaatccctataggaaagcctgccattcatccttctcctatcgacctgaaagggaaggcatatgagttgctgcgagagaaagcttcgagctttctcctcgatgacttctacaggactcctggaggtatacaatttgaaggacctggttcagatgcaaagcccatcacactgaccattgaagaccaggactacatgggcgacatcgaaatgctaaaactatatctcgacaaggtgaagacgatcgtgaagcccggttgctcgagggacaccctcaaagcggcaataagctcgatgatctcagtgacacatgtgctgacagtgatgtcccaccctctcaatgctgagctgcctctctaccatttcaactgagcgtgaatcactcactgcatctgagttacagctggcttcttgagctactctgttttcctctgtgatccttttctgaaggacagcgtgtgaaagcactgcagtctatatgccagcaaacgtcgaaataatagtatactagtatataatccttgtgtgagaccggatatgtttgtgatgagcaatcgatatactccagccgaagtaatcagaacttcaggatcagttagtctcgaaaacttttgattgtaaatgacttgtaattgttctaagtaatgacttgtaattcggacattacaaccttactgaatgtacaaccaaaaatcatcaaatcatcgtgaagcccggctgctcaaccggcgcccccctagccccggtgagccccctgccctcggggacacatgtgccccccgtgacctcccaccccctctatggggagctgcccctctgcctttccggcggtgctcccaccactcnctgcatctgagttacaggaggctggcttgagctattctgttttcctctgtgatccttttttgaaggacagcgtgtgaaagcactgcagtctatatgccagcaaacgtcgagataatagt

SEQ ID NO: 33669 - DNA, 373 bp, Triticum aestivum
  Clone ID: PAT_TA_33669
cggaggtggagatggagggcggaggtggagatggaggtggagggcggaggtgagggtggaggtggagatggaggtggagggcgggagcgtaggtggaggtggagggcggaggcggaggtggaagacgatcgatcgggattcaaattttgaagggagggtattcaggtcaattgtcagcttttcacctggttggaacagaagccccagcgacctatattttggtacggagggagtacaacaaaaatgttctagatgaaatggattcaaatttcttggtaaaggagtgcaaagtactggagaaaaattcaaaacaaattgaacagagcaaagttggcgcccctccacttctataagattattctttttattgcct

SEQ ID NO: 33670 - DNA, 824 bp, Triticum aestivum
  Clone ID: PAT_TA_33670
ctccaaagaaatccccatcgccgccgctccctcccaccttgttcactcgccgccatgtccgccgcgtcatcctcccctctcaccgtcccaactgacttcctgctccctctcaacccggtatcctttttgcggtgacgagatcgcgacgaacttcgcaaggacgggagacaagttgggtcattggttctacaagtgtagaaaatacgatgccctccagtgccgattcttcgatgccagaagacgtacgtgaggaggctaactccgcttcagcttgcccgtgcttagaagcaacaagcaagtcgacattcaccaagccgtgcagatggtccatgctgccaaccaaccccctgtgcagcaaggcgatggagggcagatagccacccaatccagtctttgccaccgcggtctcggccagggcagactttgtgtcaaactgatcaactacaagtcgtcgttgcatcccgttcccaaatgcttgtagttgccactctactgcttgcagctgccaatcccatgcttaccgtgcttgtccttctgtttgtagtcgccaggtactttggcttggtaattaatgtgttcagagttgtttactgagtcgccgtgcaacggccagaaggcgtcaaccatgtcagggtggctccctgtacctcaagcctgtttcacctaaaatgtcagggtagctccctgtacctcaggcgtcaaccgtgcgaactttattggcagcttcatatgtaatgatagtaactatgttcagtatgcttgttactggctgtcattgaaataattctgcgtaatgaaaattcttattgttatgctattaaaaa

SEQ ID NO: 33671 - DNA, 582 bp, Triticum aestivum
  Clone ID: PAT_TA_33671
gcaacaagtggtatgcggctcgaagcctctgagggaccacgcagcccccaatagttcagataaattttgtttaggaatgagttaggagtagtcccaacttccaggaccggctggatttggattgcgcgctcatgtatgtatgtaaataatttccaaaggctggtgtccttgctccggcaagatgcatttgggaaggtggatgagagattcacatatttggagttgaaggttgcatcctttgctagtgatgtcaaagtcagtctagtaaatgctgagtgatgatgagagcgatgcttcagtgcctcctgcacacattgagttccccctcagtgttccggaatcttagcctagtgggatgttagctcttcttttttatctcaaaggggggaattttagactagacggcttcatggttattttgagtttggtggtagaatctatggctagacagcattttcatgtggttgggacttcaattttgaatgtgttttctactcctgtgaatgaaccaatatttggggaattgagtttctatgaaactcgtgtttccccgtcctctgtttatatgttgctatcctattc

SEQ ID NO: 33672 - DNA, 227 bp, Triticum aestivum
  Clone ID: PAT_TA_33672
tagcgtggtagtaagtacagtacatacgaatgatacgtgcaagcctacgcggttacgaagtgcttggctttgcttgtgctttagctgcttgattagtcgtgcctgtaagcttggtataaggttgagggtgatctcaagagtagaagggagctcgtctagtgcgcgcgtgttgtgtgtactccaaccaaaatgtatatacatgggatttttatttcattttcaaaaaa

SEQ ID NO: 33673 - DNA, 735 bp, Triticum aestivum
  Clone ID: PAT_TA_33673
ctccgcctccctcggcagcacgtgcgcgccccggcggccaggccccttttagccgcgccgctcgccggagcacccccgctcgtttcgcctctttttctctgggtcggtttctttgggtcgcggtgcttcgccggccggctccggtcgtcgccgaggagggtgtttttttggcagcttcctggccgatcccgtcgtgagccgctgcttccgtccccgccttcgccgtctgccggcggtggtgcctgccgcgtgcttcgttcgatctcggtgacggggaggccgagattcggaactccggggaacggctcatggcgtccatggcgctcgccgagatacttctgttttgggagggcacagaccacaccaccggaacatctttagaggcttcgagaactagagatggggaggacactacttccgtatttcatattttaggtagagccacctaccaagcatgccaggaagccacagaaacaaatccagaaacaatggatggcgctttccatcctaggaaagggatgccttggattcctctaggttgcgtatcagccaagggctatcggtggatgtcgcaatgcagcccaatgaggagggaatggcctaggaagccatacacgatcacgaagcagagggagaagtggacggaggaagagcatgagaagttcctggaggcgctgaagctgtatggccggtcctggcgtcagatacaagaacacattggcacaaagaccgctg

SEQ ID NO: 33674 - DNA, 1406 bp, Triticum aestivum
  unsure (1)..(1406): unsure at all n locations
  Clone ID: PAT_TA_33674
ccggcacgaggccgaggagagcgcgcgggcgccgccgggacgccggcaggccgacgaccccggcggccctcgcctcctcgggcgcggagagggaggacagagtggggtgcgtcgcgctccccagggtggctccccacccacacctcaacgtctccgtccgcaactccaccctcagagcactcacaacaactctaggagaaaaccgagggagcgtgttttaacctgtaaagtatgtactcatggagaatgacatctctctcccagtctgttttaggctctttgatttgtttcatatactcacgactgacccagatacagtgacaaggattgccaaaggagttgtgggggattttgctgccgagaatgttgtgtatttggaaataaggacgacacctaagaataatgaagcaaaggggatgaccaagcgatcctacatgaatgctgttgttaaaggtcttaagtctgttgaagatgttgatgttgttctatttgattctaacttaagaaacgatgaaacaccaagttctacacctatgactgatttgggtggcgacagaaagggaaagaagatatatgttaggctccttctgagtattgaccgccgtgagacaacttctgctgcattggacactgttaatttagccatggaaatgaaggaccagggtgtgattggcattgatctctctggcaatccagttgtaggggaatgggagacatacttgcctgctctagaatatgctaaagagctgggaatccccaccacaattcactgtggcgaggtaccaaacaggaaggagatccaagcaatgctggacttctgccctcaaaggctaggtcatgtctgctgcctcgacgagcctctcaaacgagtattacctcgtcgcgtctaccttcggtcttagcaaggccgagctgtttcggctggcccagggagctgtggagttcgtgttcgctggcgacgaggtgaagaagtcactgagggcggtgtttgagcgtgcggcggcagagaggatcgagagttaggccccctcggccttgctccccagtgtaatagtatgcgactatgtgtttcccgggtagatcaggaggagatgaatagagaatagaaatctcatgtgcggtgtgcgcccgtgccggatcaaatgacgcaccgtgattcagttacctggacaggacggcgattcagtattccattttccctgaaccanaacagttgttcggtttggttngtgtcaacggaagcanacggggtccacatcgatngcgtgcatttttttttttgaatgcacaattgcacagtacacagcagcggcatagggacgaacagtcggtggagtgccaatctggtatacagatgctctgaacacatttcatggaacccattgttatagacctggtagtagttg

SEQ ID NO: 33675 - DNA, 862 bp, Triticum aestivum
  Clone ID: PAT_TA_33675
tcatgaacaatgacatcattgctgcagggcgccaggcttttgggcaatccctctagatcggtgccttcatcatggggctcgcgtgactatcgccccagtagttcgcccccccaataaccacttccctccccccttcggcttgcaggactccgaccagtcggaatcggcatatttcttgtctttactttcggggcgcgatggaactgccgcctttgcgatcttcacctcactctagcagagttgataaaggccgcccctaggaacccggatcacccactcctctccccccgagaggtagttgtgggagacctcatgcatataggcatcaccactagaaaaaaagacacatccgtgacattttgggccgaacgaattttttttctgtcatacatatgacacttctatgacgataattgtgacaaaacccggtatcatcatagatgtggtgggctcctacttctatgacaaaaaatcatgacagaaaatgggcttttcatcctgggcgggccggagacgcagctgcatgacattctttgggccgtccatgatggaaaaaccgtggtagaagcgagggggaggaaaatttcggggagttcccggttacggtgggaggtcgggggccgagcgatgcgcgtttctctcgtacacgtacgcgcgtgtgtgcgaggcgttggctctaactgaacccgagcgaggcgttgggctctaactgaacccgagcgattgcactgcaggctacgcgttactaaacccaagcgatcgatcgatggctgttgactgaacccgatcgagtgattccttcactactgctgctaactgaagccgatcccttctgtcgtcttctcgcagcgtcgacccggga

SEQ ID NO: 33676 - DNA, 947 bp, Triticum aestivum
  unsure (1)..(947): unsure at all n locations
  Clone ID: PAT_TA_33676
gngttgctgatggtgttgatatcgtccaaaatttaagggccttggaagtcaaaggctctttcatcgccatcactaacatcagatggcagatatcttatatccaccggcatggactccaatgtctacatatggaattttgacaactcaagcagcgcctcacagaaaggcgaagccaaatcggttcgatcatgcgaaatgttcttctccaaggacgtgacaaccgcggtgccatggccgggagtgcatccagacaggcatgtcaagccggcccgcttgaccgagaaatctgccagcgtgtcgcctttacgccgtcatggaggagaaagccgttcccctgggacatggttcttcgccgacggtatgagggggtctgtgacgtggccagaggagaagctcacttcggcgaagcctgtcaatgggccccggctggctgactgtctctcggcgatatcggctgcctggaatatggtgatagtgacagcgagtcacggcggagtgatccggtccttccacaactacggcttgcctgtgacattgtgaggctgtaagctttggttattagcttcctctactgacgaccttgagttgtttttttgttcttcctccggaaatgttgggaatgtggtggaagaaaggttggtatagcaccaagaaaagagggaatgttgtaccacgggggtccctagcttctgaaaaggagattattcagtggagatgcttgcttttgtctgcaagctcactctttttttcttcttcacgaaaaggcctcaaaattgttgctccggttttttgttgatagttacttgtagcatttccatctgttgtgactatagagatttactatctctctacgaggtataactagcatatgtaaccctgttgaagctgtttccaaagatggtgggtaaaatccttctgtgtatttcatcttggaagaccagacaaaa

SEQ ID NO: 33677 - DNA, 322 bp, Triticum aestivum
  Clone ID: PAT_TA_33677
cagcgcagctctgtttttgtcgcggtgatagcagagtctgttgccaatggaatttaaaaaaggttgttcgctgcttcacccgatgggtgcacgactgtgtcgggttgcccggcgggttcgggcatgggtccgatttaagacccatgggtagggtcgtgggtcggtgaggcacccgatagtagtgtcggcaatgggtttggtttaggtcaacccgacccgactgccaggttgaatcttaacgtaagttgcgtatatgtccaccggttgttgtacctatcctgtacttgtaatcttggcaatcaagtcattgcccatattaaaa

SEQ ID NO: 33678 - DNA, 614 bp, Triticum aestivum
  Clone ID: PAT_TA_33678
ttttatacattgtttacttcttagtggttgcttattaacgcagcaactcatcatgttttatttcagtttcttcgacaaaagctcatattacagtatagtatacaaagagcacaagctcacattacaatgaaaacgcctaacttgaatggacccaaccaaacaaaatcacgtcgatttccatgacatgaagaatataatttgtcacattattagctcgggagaagccgattgcaaagctctccaaaaaatgagctgcaaccaacctgtgtaactatttgatgatttcagtacaagagggcataggcgcactttcctgtgttttatccagtgttggacaacacttccaagtgatcatcactgaaatcgtattgctcgtaaaccttgaacagcatctctctgcaggggacaactgcgccaatcttgatgcatgccaggaacgcacctgacagctttctatggaggctgtaaacttcatctggaggcggagtcagcctgtatttcaacatggtagccccaaggtttgaaacactgtgtgtgatgttgtttgcacggaacaaatgaccaccgggtgttgcgaagggcaccaatacatcacatgactcggtcccacgtaa

SEQ ID NO: 33679 - DNA, 604 bp, Triticum aestivum
  Clone ID: PAT_TA_33679
ttttggaacaatttcaaatctgtctcagaaaaagcttttaggtactgcatgtatatgttcataaaacagtttgcattcagaaaaacaaaattttcatccgcagttttttttaaagcacaacctgtacatctagcccctaggaaaaacataggtttgcacattcttctctatacatggcacatatcttgtttctctgttcgactgtacatagtctgcatcttggcatcctaaaatctgcagtcttaggggctgtaaaaggcacaagcaccattccaaggtgtgcaacaggggggctgcaaaaggcagaatttgttcagggtgaagcctgcaagggtgtatgaagtgctcgaagagagaagtgcaaaggatggagatgctcagggagggaggctgtgatgtagaagctaagcgccgcacagcatcatgccgagctgctgtagcctgtggaacgtgcagctatcggagctggtggtcaatataccaaagacgagaccccacggtgcggcccttcaggatagcaacatccgtggcgacgactagcgcccgactcttcacgcacaccttacgggggacgcgcgttgcggagcaccagaggaggtggcgt

SEQ ID NO: 33680 - DNA, 1118 bp, Triticum aestivum
  unsure (1)..(1118): unsure at all n locations
  Clone ID: PAT_TA_33680
gtccacccggcgcctccgccggtctcctctcctcgtgtttatttatacacacacacgcacacctttctccctagccaccactcaccactcggagcgatagccgaggaaggaagatcaaacgacgaagcaaagcaagcagcgagcgagcgagcgtcggcatcacgggcatgggggagcagggcaccagcggcagcgagggaggcggcagcatggtggaggcacaggcgccggccaagaagggcgacggccgcgccgccgacccgcggctccagggcatttccgacgccatccgcgtcgtcccgcacttccccaagccagggatcatgttcaacgacatcacggcgctgctgctgcggccgggcgtgttcaaggacgccgtggacatgttcgtggagcgctaccgcggcatgggncatcgcggccgtcgcaggcattgaagcaagaggattcatatttggcccggcgatcgcgttggccatcggggccaaattcataccgctgcgcaaacccggcaaactcccaggtgcggtgatttccgagaattatacgctcgagtatgggacggattgcttggagatgcatgttggagccgtcgagcccggcgaccgtgtggtggtcgtggatgatctggttgcaaccggcgggacactttctgcagccataaaacttcttgaacgcgctgcagctgacgttgttgagtgtgcatgcctcatcggactccctaagtttaaggatttctacaagctcgatggaaagccagtttacatactggtggagtccaaaaagtgaaatgatgatgattgatcagaaaaaggatcacagcttcattcctttgcaagagcgcatggtggatgtgtcttgataactctgcagtacactgtcaggggcagctgctattgctaagtgtcttggtggagagggtgagatagatgagatgtagtcttcctagcactagttttccagtagtggagtatttgatgagagcttgtagctatttctgtcgggaatcaccactgttagctgcaaagaaaagaaccatcctgctgttcaggttctttttatgagaattttttgtgtatctccgcattagtttatcccattgtctctaaatttttttg

SEQ ID NO: 33681 - DNA, 1190 bp, Triticum aestivum
  Clone ID: PAT_TA_33681
cgtccggcgatagccgaggaaggattattaaaccacgaaccaaagcaggcagggtgcgatctagagttggcaacattaactcacttgttgagctccacactccagctccagcgcagccgcagagtgcagagtgagtgagtgggcatgggcgaggaggccaattgcgacgccgtgatggaggccggcaacggcaacggcaaggccaaggagaacggccacgccgttgcggccatgccggacgtcaaggccgacgacgccgtggtggcgccggccgacccccgcctgcagggcatctccgacgcccatccgcgtcgtcccgcacttccccaagccaggcatcatgttcaacgacatcacgacgctcctgctgcggccccggggtgttcaaggacgccgtggacatgttcgtcgagcgctacctgcggcacgggcatcgccgccgtcgccgggattgaggcgagaggatttatatttggccccgcgattgcactagccgtcggtgccaagttcattccgttgcgcaagcctaagaaactcccaggtgaggttgatttctgagacctatgttctcgaatacggaactgattgtcctggagatgcatgttggtgctatcgaaccccgtgagcgtgttttgatcgttgatgatctggtttgcaactggtgggacactttgtgctgctataaatcttctggaacgtgctggagctgatgtcggttgagtgtgcttgtctcattgggctccctaaactttaagtgatttgctacaaagctcagcgggtaagcatgtttatgtgactgcctggtgtattctctgaaatatgaaaaatgagaaaccggtgaccaggagagggacgcatcatggccttcatcctgctcgcggtagtattgtaggatgagggggagggtagggagagggacgtgaatgtatatgtgtgtgcgtagtcggctgagggtggtttctttatctgtctggaatagagtgcttcgtgctgcggcgaaagaaaagttagtttcgtggtgagtagggtaagtccattaatatttattattcctaattgtatgtttccattaatggagtatttgatgagagcttgtagttatttctgtcgggaatcatcaccgtagccgcaaagaaaagaaccatcctgttgttcaggttcttctacgagatttttccctgtgtatctca

SEQ ID NO: 33682 - DNA, 679 bp, Triticum aestivum
  Clone ID: PAT_TA_33682
cccaaaccctagctttatcaatgatcccgtcccaagcggcggcggcgcatagagatgaagcgcaagaacaaggagcagaggagggcagatggaatcaccgatagaggcagtgattcgctggagaccatgcggccgaacaagaagcagaggttgggcggtggcagcggtagcgatgaggagacctcgccctacctggtggtaggtcatgggagcgtgagccctgccttctccgtgttcaaggtggaaccctacaccgacggcggcggcgacaccccggtgagcatcccgcgccgcctcgcccgcctcaaatgcaaacacaacatgtctttcgtccctttgagattgaaggaccgccggtggatcgtcggcgtcggcggcagctcaaccgagaactactacggcccggggaccatcattttcgacaccgagaagcagttggtgatccggggaccggaacctaagtcgatcaagagccacccgatcctgctacccatcgaccagaagatctacgccctttcccgaagcccctcagtgaagggaccgctcgattacttgccctggttcgaggtcctcgatctctcccaggcacaggaagttgacggctgtctaaccaactgcaagtggagctccctgcagcggccgcccttctttccctgggagctcaccccacggcagtact

SEQ ID NO: 33683 - DNA, 902 bp, Triticum aestivum
  unsure (1)..(902): unsure at all n locations
  Clone ID: PAT_TA_33683
cttttcaaagnaacagctaatatttggtggcaaaagttattatggcgctctcttgtgttgcacctggagctcggatggcaaatatctattgacaggtggtgaagatgatcttgtgcaggtatggagcatggacgacaggaagactgttgcatggggtgaagggcataattcttgggttagtggagttgcttttgatccatattggtccccaccaaatgctgatggaacgggagaaaatgcggtgtatcgttttggttctgttggtcaggatacccaattgcttctgtgggatttggcaatggatgagattgttgtcccactacgtcatccttcaggtggttcgccaacatttagcagtgggagcccttctgcacactgggacagtgcatgccctccaacaggtattcttcaaccttctcccagaatgcgggacgtgccgaagctttcacctcttgtcgcccaccgagtacatgcggatctcctgtctggtgtggtgttcagcactgaatcaatcgtcaccatttgccgcgagggactaatcaaaatatgggccagacctggccacagtgaaaacaatcaacagtcaaattcttccgagttggctttaagcaatactgtctccaaggatagggcaatcacatccttcagtaaagcaagtggctctagcttcaagcaaccttcattgcttggcttgacatagccgtgagtttcttactaacaccatgattgatgagacaagctctcaaaggaggcttctggtgatgaaggcacatatttgtagatgttccttgattacagcaaggctagttagtggcacaaaacaataatggaacatgcccctgtacagatacatatactcccaaaatagctaatacaagtttgccttctgttttgtaaaaaaa

SEQ ID NO: 33684 - DNA, 700 bp, Triticum aestivum
  unsure (1)..(700): unsure at all n locations
  Clone ID: PAT_TA_33684
ctggttgcaatgaaaggattcttgtacgaacanaagtacacgggngancccgtccnccccctnttncccggattcttgaggganaagcgggaccantgagactgtnccccagagcgtntattgcacgagggagtggcntccttncgcatgcggttgaacccgtctttggagacatcggcnccggggtccngatctgttgttgcctttnggcgcngaccagtacacngaagcgagtagtttgctccgagtgcgcgtcggcattganatcgcggcgatgtcaaggagggacgagttggagcgccatccgggagtgatggatggaggagacaagggaaagagatgaagagaatgccatggagtggaaggagaagctgccgcggctgccatgacaggtgggccctcttgggtggatctggagaaggtggtcgatgaggtgcttgctgtgcatcctagcaagattagtgatacggagttatgagtaggctcgtgcttgctctacgctggaattatgagtaggcaataaattgatgaaagggaaggcgtgccatggttgtgatcgagctttgtcgaaatttaatgggttgtttcattaattgttaggaaaatgaatgcaaatttgggtgatacatatctgtgtatagtgatcacccaactacactcttcaatgttgtagtattattcatttcgtatttttggcacc

SEQ ID NO: 33685 - DNA, 770 bp, Triticum aestivum
  unsure (1)..(770): unsure at all n locations
  Clone ID: PAT_TA_33685
gntatttgcatgggcattgcttaaagggatgtcttgccatgtctaagggtggttcaaaagttcctggctctgtcaccatctgttgtcctggggcctgccagccaaagaagagttggagatcttctntagcaggatgagtaaaaagacaatatatagccgggcagcattaagagatgcatggaatactgacccagattatctttatcccgagattcaggcgtggatccaggataaatatcagagccagcttggagcaatatgggaacaaatgcaccaagaagttcgcctcgaggggcgcgaacttttcccgaagaggttcaagaaagttaaagggtaatcaattagaacagattgtgttgtaattgcttgactgatggaagctgatttgtggtgggagctttcatgagatggatgatgctctgacaacgggaaacatttggactacaggtggacagaagaagattttctcaaagtcttcccgtccttacaattgcagagaacttctctgcatgcacctatacctgtctgtcctcaactgaatcgcaaacataaacagaagcagtgactggccaaggacaggggattgctttagggtgttttgttttttatttaacatattcagcatatataagtagaaagaagattttcatgtctggtgcgtaatttataggtagtggatggttggagcttccgcgaagcatctgatccctctgttaacgaccgtttccctgtgatgatgcactcgatcctagcctttagaggtatcaaaa

SEQ ID NO: 33686 - DNA, 599 bp, Triticum aestivum
  unsure (1)..(599): unsure at all n locations
  Clone ID: PAT_TA_33686
nggtagctcggagtcggaggcttgcaatcgagtagctgatcctgccatacataacctattgttaacggagaagccgatgtcaattgccgcggctgtcaccggaaccgccaccgcggcggtgcatgcgcccgtgcaccacgcgccgcaccacgcctctacgcagcgcacggcgccgcggcgcgagcagtcgccgctcaacccgagctcgcaggcgctgcgcgccgctgggtccggggcctcgcccgccgcggatggcgtgaggacgcacatcgccaaccttgaccgcgtgctcgggaagccgccgaggacgccgagccaggcggggccgcccagcagcaagcaggagcaggagagcgagcaggagccgcttaacatcaggcacgggctgctcaacgcgctcaacctctccttcttcgtgcccatgcccgggatgcgggcgcgcatggccgcggacgagcacatgtcgccgcgcagcctcatgcacatgcagcagctcctctcggccgactccccgcgcgcgtcccccgaaagcaccatcgccccccggtggcgcgccctccacggggagggcgggtgggctggactcctcgacccgctcg

SEQ ID NO: 33687 - DNA, 1114 bp, Triticum aestivum
  Clone ID: PAT_TA_33687
cccgaacgaggacaagaaagagttgagagggagatccatggcgactcggtggttccctatccgctcgatgcgctaggctggccggcgttctccctccggctgcttcactcccgtccggctgcccaccccctcctgctcccccgctgttcgcgccgttagtctgcagcatctctcgaccgccgcacccacccccggcctctatttctgccccggcgacttcgctggtcttcgtgattcggggatttcttcactctttttctcagtggttttgcattatatttgcactttttaggtgtaattccaatggtatttacattttaatccaatttgcattgattttgtcgttgttttaggtttaattgacttctttgtgctgtattttcagagtatattttcagtaattatattttcagctaagagtaagttgcgaccaagtatcataatagtctaattatttcagttagcactcaaattatgtgggtttttttgcttttatgagtgtaagaacaatgcgtcgctttcttggtttagaccaaacttgtaggtgtttttttctactcaagacttagttttttgtactatgtgcatttgacaggaattggggtccaatagcaatcgaattaagacgtcctttttggcttcatcttacatgaaggagtgcatcttcatcttgctggtttgccctctggatcttggaggaattcccccggtgatttctttcttgaatgggtggacaagcacatcgacacattcaggggacaggaacaaaacggagcacatgtgacactagttaaactctgtgttgccaaaaactatgactggaaacgaattggatttcagacagttccaaaaacacatatcatcttggatttattagtggatttacagtgtctttttagtggattttacagtggtttctttaatgttccttacagtgtaattcttagtgttttatcttagcagtttttcagtgcaaaagtgtaattctagtggattttacactgtaattcttagtgtttaatcttagcagttttttagtggatttacagtgtaattttagtggatttttgcagtgtcactttaatgcacctctctctataattctcaaaaaaaa

SEQ ID NO: 33688 - DNA, 942 bp, Triticum aestivum
  Clone ID: PAT_TA_33688
gccggccgggtcggggtggggagtttggctggggcggacatctgtcgcccggagatacttctctcctttcccccctcccccattctcccgcctgtccggccgctcttcgaactacttctcttcaactcttctatcttccgacctccgtctccttctccatcaacgtctcttcttttcccctttcccatacacacaccgtaatccacagccatggaggaagaagttgctgctctcgtcattgacaatggttcgggtatgtgcaaggccggtttcgccggtgatgatgctccccgagctgttttcccttccattgtcggtcgcccccgtcaccatggtatcatgatcggtatgggtcagaaggactcttacgttggtgatgaggctcagtccaagcgtggtatcctcacactgcgataccccatcgagcacggtgttgttaccaactgggacgacatggagaagatttggcaccacaccttctacaacgagctgcgtgtcgcccccgaggagcaccccgtcctgctcaccgaggctcccatcaaccccaagtccaaccgtgagaagatgacccagattgtcttcgagaccttcaacgcccccgctttctacgtctctatccaggccgttctgtccctgtacgcctccggtcgtaccaccggtatcgttctggactctggtgatggtgtcactcacgttgtccccatttacgagggtttcgcccttccccacgccattgcccgtgtcgacatggctggtcgtgatcttaccgactacctcatgaagattcttgctgagcgcggttacaccttctccaccactgccgagcgagaaatcgtccgtgacatcaaggagaagctctgctacgtcgcccttgacttcgagcaggagatccagactgctgcccagagctccagcttggagaagtcttacgagcttcctgac

SEQ ID NO: 33689 - DNA, 1606 bp, Triticum aestivum
  Clone ID: PAT_TA_33689
gcggcggccggcgggggaacgtctctccttttcccgtaagcttgctcctcactaattctagcatcgcatctcatcacatttgtcttctttataccactttgtcctttctttttcttcctcgccttgcaatcttggccgctaatcccgtttctgggcagctttcccatacacacaccgtaatccacagccatggaggaagaagttgctgctctcgtcattgacaatggttcgggtatgtgcaaggccggtttcgccggtgatgatgctccccgagctgttttcccttccattgtcggtcgcccccgtcaccatggtatcatgatcggtatgggtcagaaggactcttacgttggtgatgaggctcagtccaagcgtggtatcctcacactgcgataccccatcgagcacggtgttgttaccaactgggacgacatggagaagatttggcaccacaccttctacaacgagctgcgtgtcgcccccgaggagcaccccgtcctgctcaccgaggctcccatcaaccccaagtccaaccgtgagaagatgacccagattgtcttcgagaccttcaacgcccccgctttctacgtctctatccaggccgttctgtccctgtacgcctccggtcgtaccaccggtatcgttctggactctggtgatggtgtcactcacgttgtccccatttacgagggtttcgcccttccccacgccattgcccgtgtcgacatggctggtcgtgatcttaccgactacctcatgaagattcttgctgagcgcggttacaccttctccaccactgccgagcgagaaatcgtccgtgacatcaaggagaagctctgctacgtcgcccttgactttgagcaggagatccagactgctgcccagagctccagcttggagaagtcttacgagcttcctgacggtcaggttatcaccattggtaacgagcgattccgtgctcctgaggctctcttccagccttctgtccttggtcttgagagcggtggtatccacgtcaccactttcaactccatcatgaagtgtgatgtcgatgtccgaaaggatctctacggaaacattgtcatgtctggtggtaccaccatgtaccccggtctctccgaccgtatgcagaaggagatcactgctcttgctccttcttccatgaaggtcaagatcattgctcctcccgagcgaaagtactccgtctggatcggtggttccattctcgcttccctgtccaccttccagcaaatgtggatctccaagcaggagtacgacgagagcggtccttcaatcgttcaccgcaagtgcttctaagctacccgaccgacaaattaaatcctcccactcgcctaacgacaagatcatggaggtggcgacagacgctaagctttgggtggttggccaacgtcaatgtcgaatctcgtatctacgaaaagtttttgacatggtcgaaagagtgggcgttgcgcttgttacgaagagatgtgatggccccttttcttgtagttcgcgtataatgcgtgcctaggggtagaagccgaggttgacatacaaatacttttttactttccgcttagaaaaaaaaaaaaaaaaaaggccccta

SEQ ID NO: 33690 - DNA, 717 bp, Triticum aestivum
  Clone ID: PAT_TA_33690
ccggcttccggggccatgaggccgatgcatctcttgggggtcacctgcttatggatcctctcatgcgccttgctgctcggcggcgcttgctccgatgggttgctgaggatcaacctgagcaagaagaggctggacaaggaaaccctagcagcggcaaaatcggctaggcaggagaccaacctgctgaggtccggcgatggatctcgccactctcccggcctgtcaggggacgacacagttcctctggacaactacctcgacacccagtacttcggagagattggcgtcggcacgccgccgcagaacttcacggttatttttgatactgggagctcaaacttgtgggttccgtcgtcaaaatgctacttttcgatagcgtgctacttgcaccacaaatacaagtcaaccaaatcgaccacttacaagaagaacggagaaacttgcacaattagctatggctctgggtcaattgctggcttcttcagtgaggacagcgtgttagttggcgagcttgttgtgaaaaatcagaaattcatcgagacaacccgtgaagcaagtcctacttttatcattgggaaagttgatggtatacttgggctttggatttccagagatctccgtggggaagtgcccctccaatttgccagagcatgcaagagcagaagctgatagagaaggacatcttctccttctgcttaaccgtgatcccgatgcatc

SEQ ID NO: 33691 - DNA, 2014 bp, Triticum aestivum
  Clone ID: PAT_TA_33691
gccggacgcgtgggcgtgtcttatttactccccctctttttcccctcgagtttttcctcactcttttctctggtggcctctggtttgggaagctcgctcgcatcagcaaggtggggattattttgcccagagagctccggggccatgaggccgatgcatctcttgggggtcacttgcctatggatcctctcatgcgccttgctgctcggcggcgcttgctccgatgggttgctgaggatcaacctgagcaagaagaggctggacaaggaaaccctagcagccgcaaaatcggcgaggcaggagaccaacctgctgaggcccgacgatggatctcgccactctctcggcctgtcagacgatgacatagttcctctggacaactacctagacacccagtacttcggagagatcggcgtcggcacgccgccgcagaacttcacggtcatatttgacaccgggagctcaaacttgtgggttccgtcgtcgaaatgctacttttcgatagcatgctacttgcaccacaaatacaagtcgaccaaatcgaccacttacaagaagaatggagaaacttgcacaattagctatggctctgggtcaattgctggcttcttcagtgatggcgcagtctgggcagaccagctggatcagtgggttcatggcgttagcgcgtccagccgcgaagcaagtcctacctggatacttggagacgtcttcatgggcgcctatcacaccgttttcgacttcggtgagagcaggattgggttcgccaaatccgcgtgaggacttggtgtatcaaggttcagggccggtattgtacatactgcaagcacgtgcaagttgcaaggtcaacaataaacttatacggagtattagtagaaaggaacaaatgaacttgccaccagcatttgtatagctatttgctatgtatggcttgatatggacctgcagacagcacacacgatgacacgacacgaggttgatgtaaaaagcccactcagggtcctcactgctcgctggcccaacgaccatagtggctcaagtcaatcatgcaattggggctgaggggattatcagtacggaattagcgtggtcgcggccgaggtacggagagatgatcctcgagttgcttgtagcacagacaaggccacagaaagtgtgcagtcagattggtctctgtgtatttgatggtagtcactctgtcagtaaccaaatagaatctgttgttaataagaacgagaagcgaggctctgatcttctctgcactgcttgtgagatgactgttgtctggatacagaatcagctccgaaaaaaccaaacgaaagagctcatcttggattatgcgaatcggctctgtgagcgtcttccgagccccaacggggaatcaaccgtcgactgccaccagatctcagagatgcctgatcttgctttcaccatagcaaacaagactttcaccttgacgccagagcagtacgtagtgaagctggagcaatcaggccaggccatttgcatcagtgggttcatggcgttcgacgtgccgccccctcgtggcccgctctggatacttggagacgtcttcatgggcgcctatcacaccgttttcgacttcggcgagagcaggattgggttcgccaaatccgcatgaggacttggtgtatcagggctcagggccggtattgtacatactgcaagcacgtgcaagttgcaagggcaacaataaacttatacggagtattagtagaaaggaacaaatgaacttgccaccagcatttgtatagctatttgctatgtatggcttgatatggagctgcagacagcacacacgatgacacgacacgaggttgatgtaataagcgcgatgagaatcatggttttatggtgtgatctcatcgtttatgcggccactctcaacgcacattttcttagcacggtatcatgagacatagtagatatttagagacaattatcgcaatgtatgttcttttgagtaaaaaagaaaaaaaaaaaaaactcgctc

SEQ ID NO: 33692 - DNA, 963 bp, Triticum aestivum
  Clone ID: PAT_TA_33692
tggtatttgctccctcttctgtagtcgaggaataaactagacaggtctagccatggattctgtaaatcaagatcgtctcctagacgaggctatgattgaaacgagatgaagtgggggtggagccaggaacaaattgactagtgttacagggaaagggcacagagatcgagaagcactgctccaggaactggctgcagaattgcgtgaggagggaaagcatggaatatgaaagaagacatagggcaccgggcctccgggccagccatgttggatctgtttgttccggcagtcggagagacaagggaacaaacctgcgctgtgtgccttgaggatttcctggaaggcggaaagaagctgaagaggatgccctgctaccactccttccatcagcgctgcatgttcaactggcttcgctttaaccgtcgctgcccagtgtgccgctttgcgatgacctccgtcgaggagcaacgtgcccttgaccaggcaaaagccgaggcagcggcgacatgtggtgatgggccggaggcagccaagcgacggagactcgacccggctactgattgaggcagccaagcccagtgaactagactctgacacttgtgatctgaagacgatggcactcggccaaggactttctctcgcttctgatctgaacttgccttcagtacatttggctactgattgcataagtggtactccaaagtagcatggtgattttgggagattaaggctaagatgggacctttgacggagtaaacatgatgcatgattatctctgtaacctgaccttttttaatctgtgtaacctgaccctgttatctggggatgggcaacccctttctcttctcctcacatgcggctgtaactgcgcctagtagcgtacgctgtgtacggcccgcgtccttgtatacttctacttttttatcaatgaaatgacatgcaatatcgtgttgggtgccaaaa

SEQ ID NO: 33693 - DNA, 616 bp, Triticum aestivum
  Clone ID: PAT_TA_33693
cggagttcaagttgagcataaacgagtacttggcgaacctgtcctactctccagtccattctcttgcaggcatcatagctttcaacaaagcgcatcctattgaggagaggctaaaagatttcgggcaacaaaaccttatcttagcccaaaacacaaatggcattggccatgttgagagagcttggatccgcctgctgaagaagctctccgcgaatggcctggagaagatgatgaaggagcaacaactggacgcgatcgttgcacccgagcattatgcttccaaccatctcgccattggcggccaccccggtatcgttgtgccagctgggtacaacgagaagggtgtcccttttggcatatgctttggcgggctgcagggatatgagccgaggctgatcgagatggcctatgctttcgagcaggctactgaagtgagaaggccacctatgttcaagccttagctaggtcgcataactttcttgagtagcaacaatgtgacgcaccatggcccaaaaagtctccacttgcactgttctcccttagtgtaaaagaataaatctgaaatgttacttttttggccaacaagcatcgtatgcaagtgctactccgaataaat

SEQ ID NO: 33694 - DNA, 864 bp, Triticum aestivum
  Clone ID: PAT_TA_33694
ataaccaccatagcggttcttaccgagccacactactttcgctcgtatagcctcgtagccaacgcccgaacgctcaccgtggataggatgcggcgaccggccagcttcagagcaatggccacaactttcgctcctatagcctcgtagccaacgcccgaccgctcatcgtggattaggatgcggcggccggccatgggaagggcaatgggggcggcgctcgtgctggcggtcctggccgtcgcggcggccacggccggggctgttgacggagatgtcaagtgcgctgagtgcggcacgggcacggtgccggtgctgccgccgccgccgccgtactactactacagccctccacctccggcgtcctactccggtgtgtccaactgcccgccaccaccagggggatacatccagatcggcggctcggggccgggaaaagggcgcatgtacccgcaggaccccgggttcatgccgtccagcgcgccgcccaggcatgggagcagcgccgtccacatcacggtatgttcgtttgcggcgttggcggttctacgggccttttggtgatcggtctgcagcagttgcgcggccatcgtctccgttacgtgtcgcgacggaaggacggagacgtgccggcgttccatggatctcctgtgtatgcattcaccttgtaataattcttactggtcatatgttttgtagttcttgcaatgcatcaagcttcttctttttttgtttctctcatttttgttgttacagaacttttacttgtaacaaattagttgcaaatcaatgggaactagcaggtcatggtgggtaaaaaaaaaaaaaaacaaggcggccgtttagaggaccaagaaaagacgcgtg

SEQ ID NO: 33695 - DNA, 694 bp, Triticum aestivum
  Clone ID: PAT_TA_33695
cgtccgcccacgcgtccgttcaaaaggaaaaagctgatacggttgtgggtagcagagggcttcgtcaagggaaggggtgaaagcacaatggaggaagtggctgaaggttatctagaagagttggttcacagaaatatgcttcaagttgatacaagaaacccttttggtaggataaaatcattccggatgcatgatattgtacgtgagttggcagtagatttgtgtcgccgggaatgctttggtgttgtttatgatcaggatgaacacatggaatctcttgatgagacggatgcacgtcggctggtaatacacaaaatgaagaaggatatttatcagtcagtatcgggtgtacaccgtctccgctctgttatcgcattggacatcaatattccatcatccactctactgcctctaatagcaaagaagtccagatatatgtcggtgctggagttaagtggcctacccattgggaaggttccagatggtattggagatcttttcaatctccgctatctgggtctgcgtggttcaaaagtgaagctccttcccaggtctcttgagaaactctcaagtttgttgacactggacctttcagggtctggcatgaaggagctgcctagaggcattggtgaactaaaaaagcttaggcagttattcactgacaaagctagggatcgatttacgacagatttcg

SEQ ID NO: 33696 - DNA, 1063 bp, Triticum aestivum
  Clone ID: PAT_TA_33696
tcggcacgagggcagaagaggagctggcctctgataatgatcttgaagctgaaaacaagaagcagaaagcagtcactgaattgtctgccagtgttaagagtgaacctctcacaacgcgtcgccgagcccttcaatcatggatggatgggaacagcaacagtaccattgagttccccgatggtttaccagcagcttcatcaagaagcaagaaggaaaagctctctgatgctgagatgctcgcgaagaaggctgaggctgctcagcggcgcaagatgcaagtggagaaagccactaaagaaagcgaggctgaagctataaggaaaatactgggcctggacaccgagaagaagaaagaagagaggaagcagaaggagcgagaggagaaggagaaggcagccagagcgcaagaactcgccaggagctccatccggtgggtcatggggcccacaggcacggtggtcacgttccctgaagaagtaggcctccccagtatcttcaactccaaaccctgcagctaccctccgccgcgtgagaagtgcgccggaccgtcttgcacgaacgcgtaccggtacagggactcgaagctgaagctccccctctgcagcctggagtgctacaaagctgtccgcgggagcgcttgattttgaggacactggggtggcgtcagagctccctattttcgcagccgcattcattcatgcaccttcagaataagagaggacggccagtcctgacgatgcaaatttgttcgttggtccaataagcgagttacaagatagttacacatagctctgtgggtaaaagattatcgtgtactgcaccagtttgttttactacaccgttgagatgtactgagccagtgatgttaccagatgatttctaagtagatatattacacatacatacatatagagaagacagcagacaaagatagttttatttttcctggcgagttttcatttttatataaaccttagtgagttggcgtttgtattttggaagcaagaaacaaaaggcacacaaacaaatttattgttgcacatgtgaaggaaatttgtgcaag

SEQ ID NO: 33697 - DNA, 734 bp, Triticum aestivum
  unsure (1)..(734): unsure at all n locations
  Clone ID: PAT_TA_33697
atttctcaaaaaaaaaaaaaaaagacagcagagtgtcccccttcctccaccatctcgtacgcgccgccgccgccgtcgccgccgccgtcgtcccgtgcgtcgccgcaatccccgtcgcgctttgaggtgtgagcaggagcagcccggccaccttggtgcgggatggagaagaggaagaaggcggaggaggacgaggagcagaagcagccgccggcggcggagagcctctgggggggcgacctgctcccagagatcctccgggagatcctgtcgcgggtgccgtaccggtcgctgtgccgcttcaggtgcgtgtccaccgcgtggctggcgctctgcgccgacccggccgtccgcaggaggtcgccgcagacgctctccggcttcttctgctactcccagcacgacgtcggcggcggccagcgccgcgacggcgtcggcttcctcaacctgtccgggtggggccggccgctggtcgacgacccctccctcagcttcgtgcgcgtgcgcggctaccgccacgtcacgcccattcactgctgcagcggcattctcatctgctactgctggaagtttgacatgagcgacgaggcggattttgtcgtgtgcaaccctgccaccaaggagatctgggccgcgctgccggtgccccagaatgagatgatgacgcgcctcaacaccgnccgnctgtgctttgacccngctattccccgccgcttcaaggtgtttgtgtcgtg

SEQ ID NO: 33698 - DNA, 1097 bp, Triticum aestivum
  unsure (1)..(1097): unsure at all n locations
  Clone ID: PAT_TA_33698
catctctttcttcccaaatccccttcctccaaactgcaagccatggtggtcaagcacgtcaatctttcccgaggagcgactttgctgatgcggtgctcgcgcagctcttgcctccccacggctgcggcgctacaaccggcatcaggcggtgctacatccggtggtcggcaagctgtaacctgcacagcggctaatcggcggtcggcggtccgcgagctgcaaccacaccgtcgctgccaatgttggaaccatcgatgcaaaaagctggaagcagcggcgcaaaaagctgcagccggcaaacgattttgctacattcatcatggcggacctgcgcccccgcgatgacggtgacatttttgctgcaaccgtcgtctgattttgctactatcggcgaggtaatttgctacatccatgatggcggagctgcgacgctggcagccaaatttctttttgctgccatcgtcgtctaattttgctactatcggcgaggtaatttgctacatccgtggtggcggagctgtgacgccggcgaccaatttttcttgctgccaccgttggtgttttttgctactacccagcgatgtattttgctacatccactcaatgtcgtttaatggtggtcgtcagtcgcagcgagggtcgacgacgagtggcggaggcgacacattgggtgccacaaccatggagcgttgacgggggagttgcaactctgaggtggagcttgtaactgaaaattacccagcgagaaggttctccggcgagcagcagaggggctacaaggaatagaggtgcaagcgcgcggcggccggcagtcgttcccctcgccgagctgcacacgaaggcggacccgcggggacagcggcgtgggattttatttgggattggtgggaaggcaccccccccccccgcaaggttagatgggagggaatgatttttctggacggctgtactgtaccagatcgcacggctgggtctgcccggccgaatctagcgccggcggcccggcgcctagtactgcccataaaaaaatggcatctcttccccccccccccccccacggcggccgtttagaggatnccaagaaaacgtacgagtgc

SEQ ID NO: 33699 - DNA, 393 bp, Triticum aestivum
  Clone ID: PAT_TA_33699
tgaagcgcgtgctgctgccggcgatgttgccatgaagcgggtgctgctgctggcgatgcgacaagttgaggacggcgacgctgcaatgaagcttggcgccgctgtgggtgtcggcgttgtggcaagcggcgtcgctgcaatggcttccggcgatgttgtgttgcagaacggcgacagttgggcgacagcgagaagccgtgttgggttgctgctcccataggagaacgaaccgggggtgcggattgacgtgatcagaggagatcgatgcagataagcgttgacccatcaagcggtgcgacggatcggacggcttgtggcccgactgatttcttcacaaaatcagtgcgtgcttgtttttcttccccgtgaataaaaactgtccttgaattacac

SEQ ID NO: 33700 - DNA, 2064 bp, Triticum aestivum
  Clone ID: PAT_TA_33700
ccagctcatcccgttcccagcacactgcccgcgccctgcctcctcttctctcgattccccccctttagccatctttacaggcacaaaatcatcctagccttttcctgctactcctctccttgtccacattccgtgagcgcgttttcccctcttgaaattccggctctcgagacacagatccgcgaggggtggtggattctttacttgctcgttccaaaaatcccactctgcgccgctgctccacttaccttgtaggagtagcggagacactttacccgattcgtttcttcaggcggcatggaacggcgtgtgcttccaccgtgcccaagatttcagctttagagctgcctggactccgttgggggcggaatggaggtctggagcatcagagcggcgcagctcttgctcttcttcttcctcttgtctgagaggcatgggtcttgtgccgccctcggtgaagaagggcgagtcatgagtttcagagaagagcacccaagtggatggttatggaatttgggacaaaagaaggttttcagcgcagcggcgacgcgcttagtcaagggaaacaaactgtcaattgaaattcctaacgagttgcaagagcgtatcatgatttcagaggttctaactgatggaaggcaacaaccgtgcagaaaatgtttaacaaaaaccatacggagtaccaccctgaggcaactcctacaggcaagggggctgcaagaatcagcaccttcctctaaggctactgatcagcatcccatgtcttcgccgccatcgcattcgcaagctgaaaccaacgactcttcttctgtgcttcactgggttatctacgcattgtgcgtcagtggagcgcttggccttgtgattatagcctctgttgtgtatctacttgtctcccgtagaaagaaggataacaccgtcaatccatgggctaccgggctgagtggacagctaaggaaagccttcgtgacaggtgttccttctttaggaagggccgaacttgaggcggcgtgtgagaatttcagcaatgtgatcggtactgtatctgacagtgcattgtacaagggaaccctgtcgagtggggttgaaatagctgttgcctccagtccagttaagtctgccaaagaatggtcggatcggtccgaggagcaatttaggaacaagatctctgagttatccaaggtgaaccacaagaacttcatgaacctacttggttactgcacaggcgccgctccggtcaccaggatgatggtgtttgagtacgctccatgcggttccctcttcgagcatctgcacgtgagggaagcagagcacctggactggcctacccggctgcgcatcatcatgggagtgacatactgcctggagcacatgaaccagctagaccctcctgtcaccccaagaaccctaaactcctcatccatctacctcaccgaggactacgcggccaagttctccgacaccgagttctggaaggacgacgacgcggacgcgtcggcgccgacgcgatccgcaggccaggacagcatcgtctacaagttcgggatactgctgctcgaggtgatctccggccggctgcccttctccgaggaccacggcctgctcgtcctctgggcctccagctacctggacggcaagcggccgatcggctcgatggccgacccggtgctcagggcgtcgtcgcctgtgcccgaagaggacctggcggcgctgtgtgatgtcgtgaggctgtgcatcaaccgcgaggcggcgaagaggccgtccatgggcgaagtcgcggggctgatgaaaggcgccgtcagactgtcgccggagcagacgaccccgaggaataacccgctgtggtgggctgagctcgagatcatgtccacggcatccacctgaaatgacatacagtataaagggaagggtaattatactgtacgtacttactagattttgcgttttagtttcttcttcgttactttttttgtatgatatggtacactccttttggccccgatttgttttgtgtcctcggatcactgtgagcctgcatatttcttcctcggccgcgaccacgct

SEQ ID NO: 33701 - DNA, 430 bp, Triticum aestivum
  Clone ID: PAT_TA_33701
tcgtgggtcgacctcagtctgcgtaaaatcagtcatcttatcgatgtcgggtggccgtctgtctgggtcaggatcgcgacccagtgggcaacagcaggtctgttcatctggtcccttgttgctcccctcctgttcccagacagggagttctagatcgacctggttacctgctagtgcatacctgctagtgcatcatctgattggagccacctacgtattgtatcgtatcgaacgtgttttggctgtgatggctaagctgactatctgtattctggtctgtaatattgtgtaagcaaacccatggcaaggagccggtgtttgtgtgacgttgtcgagtctggtctgcataatgtgtgacctaaggcattgttgccagtatttcaacagtgaagatacggtctttggttgtatatatattgaagttgatcaa

SEQ ID NO: 33702 - DNA, 3123 bp, Triticum aestivum
  unsure (1)..(3123): unsure at all n locations
  Clone ID: PAT_TA_33702
cgtgcgcccacgcgtccgagcggcgcggcgaccttgcggagcacccaggaagcgaggagggagagcgcgaagaggccgcactaagcgatccgcgcggagcggcggccgatggtggtcccctccccatcacgcgttccccacaaattctcccaccgaatccccaaatcgcgcgagctcctccacgaatccccctccccgatcgattcggttcggcccgactgatcggccgccggagcagaggatcaccgccaccatctgggccgcgtcgtgcctggcgtcctgctgcgccgcgtgcgcctgcgaggcgtgccgcaccgccgtccggcagcatcggccgccgctccgcgcgggatcgcctactgcggcctcttcgcgctctccctcctcgcctcctgggtgctccgcgaggtcgccgcgccgctcctccatgtccatcccatggatctaccactgtcactaggatgccggacctcgtgtggttcgacgtcggcacgccggggtcaaggtcttgcctcggtcacttcctctgcttcagcactcctcgcccacttcactgtccgttcagtcaacggacgattattgtatccgcactgtcaatggtccaccactgtgccctagggttcgatgagatcttctggcttggatcagttattcgctttttctgtatatgtttgcgttccagcctatggtcgagtgagccaagcttttatgaatgtagtgttttcaacgtttactccaaagctatgtcaactggctagccttacgttgggattatgtaccaccatccattttctgtggtctactcctgcctgttcgtgcatggctcttctgtcaaccggtgcgtctgctcaccagactcaccacgcgccggtgccgacaagccactgctgcccttcagcaaggcggacgaggaggagactaaggacgtgccaaagccggtgacgtactcctactcattcttccacctcatcttctctctggcgagcatgtactcagcgatgctcctgactggctggtcgacctcggttggcgagagcggtaagcttgtcgatgtcgggtggccgtcggtctgggtcaggatcgcgacccagtgggcaacggcaggtctgttcatctggtccctcgttgctcccctcctgttcccagacagggagttctagatcgacctggttacctgctaagagtgcatcatccgtttggagcacctacttatcgtatcgaacgtgtttcggctgtgatgatagctaagctgactatctgtatctggtctgtaatattgtgtgagcaaacccatggcaagcagctggtgtttctttgcccttgccggcttggactcgcctaagctgcgccctggcgcatcgatctcggtctttcacacaggaatacccaaatcgaaccctagacagaggcgtcgcgcgagctccatcgccgcccccttccgatcgattcgattcggttcggcccccgactgatcgccgccggagaagaggagagccgccgccatgtgggccgcgtcgtgcctggcgtcctgctgcgccgcctgcgcgtgcgaggcgtgccgcaccgccgtcggcagcatcggccgccgctccgcgcggatcgcctactgcggcctcttcgcgctctccctcctcgcctcctgggtgctccgcgaggtcgccgcgccgctcctccagtccatcccatggatcaaccacttccacaagacgccggaccgcgagtggttcgagacggacgccgtgctcagggtcagcctcggcaacttcctcttcttcaccatcctcgccgccatcatggccggcatcaaggaccagaaggacccgcgcgacaaggtccaccacggcggctggatggccaagatcttctgctgggtcgtcatcgtcttcctcatgttcttcgtccccaacggcgtcgtcagcttctacgaatcgatttccaagtttggatctggactgttccttctcgttcaggttgttcttctgttggacttcgtgcacggatggaatgagaactgggttgctaaagatgaacagttctggtacatggcactgctggttgtctcagttgtttgttatattggctcattcgctttctctggtctactctttcactggttcactccatcgggacaggactgcggactcaatatgttcttcattgtctccacactgattcttgtttttgtgttcgctattgttgcgctgcacccaaaggtcaatggaagcttgctgcctgcatcagttataggcctctactgcacatacttgtgctacagcggactctccagtgagccaagggattatgagtgcaacgggcttcacaatcactccaaagctatgtcaactggtagccttacgttgggattatgtaccaccatcctttctgtggtctactctgctgttcgtgctggctcttctgcaactgtgctctcagcaccagactcaccacacgctggttccgacaagcccctgctccccttcagcaaggctgatgaggaggaaaccaaggacgtgcccaagccggtgacatactcctactcgttcttccacctcatcttctccctggcgagcatgtactcggcgatgctcctgactggctggtcgacctcggttggcgagagcggcaagcttgtcgatgtcgggtggccgtctgtctgggtcaggatcgcgacccagtgggcaacggcaggtctgttcatctggtccctcgtcgctcccctcctgttcccagacagggagttctagatcgacctggttacctgctagtgcatcatccgtttggagccacctacgtatcgtatcgaacgtgtttcggctgtgatggctaagctgactatctgtatctggtctgtaatattgtgtgagcaaacccatggcaaggagctggtgtttgtgtgacgttgtcgagtctggtctgcataatgtgtgacctaaggcattgttgccagtatttcaacagtgaagatacgctctttggttgtatatatattgaagttgatctatctaacttgcattggggggtggcttaagtgccaatgaatgaaatgcatgggccggatgttattttcataaattaaggaaaaaaaaaaaaaaaanggnccgggcncccccggggganctccnt

SEQ ID NO: 33703 - DNA, 858 bp, Triticum aestivum
  Clone ID: PAT_TA_33703
ctcgccgccgtcgccccgtccccgacaaccacctctgaggtcgccggccgcggggccggggcagcgctgtacgagccgggcagccacacgcggatccagcgcgggacggcttcacctccgggctcgccctcgcctccgcccccgaaccagctccgacgcctcaacctcggctcctcgtcacagctcgccgtctcccaccccaaggtcgacgagatctcactcctcgccgtcagcaccaccacagtccacaggcgtcagccccacaagcgctgcgttccctagatgaagcacatattcaagatcatcgcggtgctggcagcaatctccgccgtctgggttgcgctccttgaaacctcgacagtccctcgcagttttacttggttgcttcccatctacttggtagtggcgcttggatgctacggccttttcatggttggatatgggctcatgttcttcccaacctgccctcaagaagcggtgttactacagcaggatattgtggaggcaaaggaattcctatcaaaaagaggtgttgatgtgagctctgattgaggtcaataccaatgatctatgtttcatgaccagtttgaagcttcctggataccatatagaaaaaatatggcatttcaccatgtctagatatttgttactaacgcagtttttgtgagtggcatgttacaattctagattttgttagttcagtggatggcttgtcacgatactagttatgtcaggaaaacagtgtgagaacaactaattaatggtttgttagcaagtccatcagtgttcaagacatgtctgctattttagcaatctggtttcatcactggatgtgtccaaaaaatttctgcgcggtgc

SEQ ID NO: 33704 - DNA, 2490 bp, Triticum aestivum
  unsure (1)..(2490): unsure at all n locations
  Clone ID: PAT_TA_33704
cgcggcacgcggacggacggacatatggtgggcgatcctttgaagccccccacatgcgacagccaagctccgccgcggtctgcgcttccgatcgaatccgaggcttcctctaaatttcaaaaacatggttgttgcaaacggcaatgtcgacatggaggaaggaacccttgaaatcgggattgagtacaggacagtttctggagttgctggtcctcttgtgattcttgacaaagtgaagggtcctaaataccaagaaatcgtcaacatacgattgggagatggcacaactaggcgtggtcaggtgcttgaagttgatggagagaaagctgtggttcaggtttttgagggaacttctggtattgacaacaaatatacaactgtgcaattcactggtgaggttctaaaaactccagtatcactggatatgcttggccgcattttcaatggttctgggaaacctatagataatggcccaccaattttaccagaggcgtacctggatatttccggaagttctatcaatcccagcgaacggacataccctgaagaaatgattcagactggcatatctacaattgatgtgatgaattctatagctcgtggtcagtccttagatcccccctccgggcacagtcaagctcccatcgtgggcgcttccaatcgaatccgaggcttcctctaaatttcagaaacatggttgttgcaaatggcaatgtcgacatggaggaaggaacccttgaaatcgggatggagtacaggacagtttctggggttgctggtcctcttgtgattcttgataaagtgaagggtcctaaataccaagaaatcgtcaacatacgattgggagatggcacaactaggcgtggtcaggtgcttgaagttgatggagagaaagctgtggttcaggtttttgagggaacttccggtattgacaacaaatatacaactgtgcaattcactggtgaggttctaaaaactccagtatcactggatatgcttggacgcattttcaatggttctgggaaaccgatagataatggcccaccaattttaccagaggcatacctggatatttctggaagttctatcaatcccagcgaacggacataccctgaagaaatgatacagactgggatatctacaattgatgtcatgaattctatagctcgtggtcagaagatccctctgttctccgctgcaggtctgccacacaatgaaattgctgctcagatttgccgtcaggctgggctagtaaagcgtaaagagaagactgataatatcttggagaatgccgaggaggacaattttgctattgtctttgcagctatgggagtaaacatggaaacagcacaatttttcaagcgtgatttcgaggagaatggttcgatggagagagttaccttatttcttaatctggcaaatgatcctaccatcgagcgtattattactccaagaattgctctcaccacagcggaatacttggcatatgagtgtgggaagcatgttcttgtcatcctgactgacatgagttcatatgcagatgcacttcgtgaagtctctgctgcccgagaggaagtacctggaaggcgtggttatcccggttatatgtatactgacttggcgacgatctatgagcgtgctggtcgtatagaaggaagaaaaggatcgattacgcagatacctattttaaccatgcctaatgatgatattacccatccaactcctgaccttactggttacatcaccgaggggcagatctacattgacaggcagctacataatcggcagatatatccaccaattaatgtccttccctcactttcgcggctcatgaagagcgctattggcgaaggcatgactcgccgggatcattctgatgtctcaaaccagctatatgccaattacgccataggcaaagacgtgcaggcgatgaaggcagtggtcggagaggaagcactgtcatcagaggacttgctttaccttgagttcctcgacaagtttgagcggaagtttgtggctcagggggcatatgacacgcggaacatcttccagtcgcttgaccttgcctggaccctactccgcatcttcccccgtgagctgctccaccgtataccggcgaaaacccttgatcagttctacagtcgtgatgcctcccactaagtcagaatttgggcgccatcatggaaattggttgttgttgtgcaataaaccggtgccaggggcccagttaatatatattgtgctatcctcccaatttgtagttcaaatttgtgctagcattagcaaaacatcaattcttttgacaaaaaacattatttatctagcaatttgggcaacattgatgctcaaatcgcgtcatgtatcatcttgctgaggacaattgttgcaaggaaggggaataatggaggataagttcctcgcaaaataacaataatcgagaacaagttgagctgggcattaggactttnnaataaagnagtaaaacgatnt

SEQ ID NO: 33705 - DNA, 718 bp, Triticum aestivum
  unsure (1)..(718): unsure at all n locations
  Clone ID: PAT_TA_33705
tngaagtttccgcatcccagcggctctattcttgacctgccacatataccacctgatggagtacaaggagtgcgggctctcggtccgcgcctggtggaacaaccacaggatgcaacgcatcacctcggcctccgcctggctcctcgccttcctcaccgtcattctcaagacgctagggctctccgagaccgtgttcgaggtcacccgcaaggaaagcagcacgtcctccgatggcggcgcgggcaccgacgaggccgatcctgggctcttcaccttcgactcggcgcccgttttcatcccggtgacggtgctctcaatgctgaacattgtcgccctcgccgtcgcggcatggcgtgctgttgtcggggcggcggcgggcgttcatggtggcccgggcatcggggagttcgtgtgctgtggctggatcgtgctgtgcttctggccgttcgtgagagggcttgtcagcaggggaaagtatggaatcccgtggagtgtcagggtgaaggctggtttgattgtggctgcgttcgtgcacatctgcacaaggaactaaccggcggggctggccatagaaatattcgaagcgtaattttggttctgcacagaactactcctaccacatttgtaattaaaagcttgttgttaaggaaagtttgatccaattctttcaaaacacaatagttccttcaatgactaaactgaaagaaaatatggattt

SEQ ID NO: 33706 - DNA, 1239 bp, Triticum aestivum
  Clone ID: PAT_TA_33706
ttttggtcaaaacactcaagctttcgcctgatcaattatgtcacgcacacatacatgattttcctgtacatgcatcgaaacgaaaacgaaaacgaaacgatggaaatgagatattttcctggaaccgacgccctgccgactaacgaaagaattgtttgtctctacagtacaaaactaaatttactgcgcgatttggtcatgacgggctcgcgacggggcagttgccgtacgccatgctccggccgacgtccgccggcgcggcggggtcgacgccgagctcccgggcgcggttcacgtactccttcttcacgttccccttctgcagctgcagcaggcgtatcacgctgcgccgcgcgtcgtaccggaacgggtgccccgtcgcggtgaacccgtcgatgaggtgcaggtacgcctccaggtcgtgccggctcgccgggcccacgtcggggcgcaggcacggcgagttcttgctgtcgatgcgcagctccgcgcccacgtgctggtactgctccttgctcagcggcagccgcggcgccacgccgggcaccttggtcaccatgtcgccggcgttgacgatgcggaggacgttgaccttgccgctctgcttgagcttatccacgaacgcggcgttgcccaccttcgggccgccgaaggagaccacggcgaccggcggcgcgtcggggacggtggtggcgatctcgtcggccaccaggagcgccagcgcgccgccgaggctgtgcccgacgatcgtgatgctcagctcctcgcccttgtacttctccatgaggcgtctcacctcgtccatgacgtcctccgagaggctcttcacctcttccccggccgtcttgtagaggctccggaatccgcgcgccaccttgggatcctcaggtccggcttgcttgccctcgccggcctcgccgtcgaggggcacgagcgaggcgcgcaggttctcggtccactcgaggcaggtggccgtcccgcgcagcacgatggcgatgtcccggcggcccatgcgggcgacctcccgctcggactcgcacacggcgacgtagccgatccagttggactgctgcgtgagccactcgggggtgttggggcgcttggcccacggcggcatggagagcgcggaggtggcgaagaggctgcgcgtggggcggtaggagcggtccgggagcatgaggccacggtgcctcgccgccgcggtggcagcaagtgaaggcctgccgcctcgagcggccg

SEQ ID NO: 33707 - DNA, 433 bp, Triticum aestivum
  Clone ID: PAT_TA_33707
gtcggcgattggggaaggctcgccggctgggcgacagcgagctccgatgagtgcaacgaatggaagccaggcgtcggcttacaacaatgattcgggtgcctgtggcatgatggagagccgccgctgaaagctcagtgatggggcgagttggttgaggcgtcaatggcacctttgctcgtgaccgaggatggcacttgcacagctgaagtaagatgcaggccaacttcagcctccaaggcttccctggcaccctcctctgccactacgtgctcaacaacaaggtcttcgaagggttagggcttagggcaactcgatggtagccagtcggagtttgctaggttacatatgcaagtccttttgaaatctcaaacttctttgtggtgatgagcttctgctcatcttgattgattcctctacagttgaagggtgtgtc

SEQ ID NO: 33708 - DNA, 1194 bp, Triticum aestivum
  unsure (1)..(1194): unsure at all n locations
  Clone ID: PAT_TA_33708
cccacgcgtgcggggtattccttaatgttgggtctactacatgtccagatcactagatgatacaaaggtgtcttcccttcctttgtttatattcctttatgttggaactggccctaggttccactggatcaaattttagctgttgtttcttatgttctagagaagctagaggagtaattagtgttctctgtttttctaatgagtgtatgtgtggaactatggatgcatacaaatagtaaaggagcgtgttggcgtcggcggcaccggcgcccgtccccgtcgccggcgcgggcgcgtgcgcgatctcgatgccggcccccgccggcctccgccgccgccccgtccccctccccctcctccacctctacctcaatgtcttcgtcggcttaggggcttagggcaactcagatggcagccagccggagtgtgctatgttacttatgcaagtccttttgtaaatctgaagctgctgtgtggtggtgaggttgtgctcatcttgcttcctttcttcctagtgaatgaggattcgccaatggagggggctcttcccctacctgggtgctcggccaacgaccagatcctggcggaaaaggggataatcacgaagaataatatgctggtcctgtgcccaccaatgttgagtgttcctgctcaaattctcatcttacacctctttctccggccttcaagccatcggcgagtatgttcacaactttttttatctttatgatctcattaggagcacatacatagtctgttgcgcaattggccacgtgctcaactagctaaggtgctcccttaaagttggcgctaccacaattaaatttttcgagcttatgtgaagcctatgttgatgttcacaaaatgtctgctttcatcttatatcaagatttgtatgttcctttggtaatatcagccccaatatagagcatatcaactgatattctggtcatatcacccccaatattgggcatgccagctaatattttggtcatatcacactttcaacaggctacggcggatcagctgccactgggtggcttcttccaccttcgcgtgggggggcggcccgccggtggacggtcacttggggaaattcgtggggggtttggcctgctacctcccttcggtaggtgggcgggntcnttttgggaagttttttatccatgttnaaactctgganaattaatnttt

SEQ ID NO: 33709 - DNA, 1143 bp, Triticum aestivum
  Clone ID: PAT_TA_33709
ttgccggcccaagaagcgtgggcgcgagcgtaagcgctgaggaggagttctcccccaatccctcgttcccctccgccctacacgttctcgcccacgttgccgccgccagctcctccccctttcgccggagctcctttctccggcagtagagatggtgaaaggcgcagtccgctatgagcctggaccggcgtttcaggagagtggagagcagggcaagcttgaaataccagcatctggctccacagaattttggctaatacagtggcctctaaaccatgtaaatgcttctgattttaatggtcaagaagtttctcttaataagcatcatgacgatggaaacttgggaaatttggagagttcttcggggaaatcatatgaactcgttagctttgctgctcaacagccagatgctactgtcttcattccatcaggatctgaaatgaaagccgtggggaagatttcacgcagagtttgcttggttcgttaccctgaacctgaagaattggagaaagagaaaccaagttttgggagtcttacacctggcagtaggagacctgcaggttcttctcggaagactatgtctcggttcagtggcttatcgaagaaccgtagcagccaaggatcagcattgtccctgggtcaagagaaccgtagcagccaaggatcagcattgtcccagggtcaacagagcgtggagccgacgcccaaacacaagcagaagagaagggacgaaagcagcttggggggccactcaaacgtgtccgccaagtcctcggaaggatcccaggctcgtggcgcaggaagcaacacaacctcgtgagatgctgcagacgcccgtcgagaaatccaagaagaagaagagagttaggattgaagagtagtaacaacaagtggcaggcagcagtgccatgagtcaccctaccttggagaagagatgctaattttccctgaacgatcagcagttgcttctcctcttgtatgtgtccagacagttattgcttgttcctcgatcggtagtcctgcgtttgttggccttggtgttgcaggtagttgatctctgcggccacaatacaatcttgaaagttagtcgtggtgaatgaaagctgtggaggcaaatttcgtgacaaaaaaaaaaaaaaaaaa

SEQ ID NO: 33710 - DNA, 2138 bp, Triticum aestivum
  Clone ID: PAT_TA_33710
ctttttccttttttttcttcccgagatttcaattcttgcccgtgtgtattagtcgctctcacgattgggggcgacgctaatcgcggtgccaccacttccaatccactctcgcggtcgccgtgccgagctgttcctgctctgtcttcaaccactccaagatttgttctttagacgcctgcagcttcggtgcgcagggacggaggagagctcgggacttggttcagagcttaggatctttgtcgattcaggtttcgattggtttcgtctgctcggctgactgggttgtaaatttggaactggaaggaagaatttgagcactttgagaaagacatcggtgcagacctaactccccgatgaatgggagagtgctttgattgagcatgaaatgggcgaagcggataccataaaggacatcatatcagcaagtcgacacagataatgatgggaggattaactacgaggaattctgcgctatgatgagaggagggatgcagcagccaataaggctcaagtagtctttccttgtagaaatggtgtaccattagcaactgttcttggttccttttttttcgctgctgcacggatgagaagttctctttggcgttgttgagatgattgtgtatatcttgtggccttttgctcgtgcatgttgttcctccagtgttttggacctactttcttctgtaagttggtttttgcaagtacatctaataaaagagtatttttgcacgtcaaatgtgcatattagttctgtggagcatacgaggacaagggcagcgtgcatgttgtaatggagctctgtgcaggcggggagctgtttgatcggattattgccaaggggcactactcagagcgtgcagctgctacaatctgcagaggagttgtgaatgttgtcaatgtttgccatttcatgggagtgatgcaccgcgatctgaagccggagaacttcttgcttgcgaccaaggatgagaatgcagtgctcaaagccactgattttgggctttcggtcgtcatcgaggaaggaaaaatgtataaggacatcgttggaagtgcttattgtgttgctccggaagtccgtaggagaaactatggtaaagagatagatgtttggagtgcaggtgttattctgtacattcttctcagcggtgttcctccattctgggctgaaactgagaagggaatatttgatgctattcttcaaggggagattgactttgaaagtcagccatggccttcaatttctgagagcgctaaagaccttgtgaggaagatgttggcacaggatccaaagaaaagaattagttcagcccaagttcttcaacatccatggctcagggaaggagaagcatcagataaacctattgacagtgctgttctttctaggatgaagcaattcagagcaatgaataaactgaaaaagatggctctaaaggttatagcttcaaatcttaacgaggaagagatcaagggcctgaagcaaatgtttatgaacatggacacagacaacagtgggacaatcacatatgaggaactcaaagcaggactagccaaacttggatcgaagctctcagaagctgaagtaaagcagttgatggatgcggctgatgtggatggcaatggatcaattgactacgttgagttcataacagcaaccatgcatagacacaagctcgaaagagacgagcatttgttcaaggcgttccagtactttgacaaagacaacagtggcttcatcacaagagatgaactggagactgctttgattgagcatgaaatgggcgatgcggataccataaaggacatcatatcagaagtcgacacagataatgatgggaggattaactacgaggaattctgcgctatgatgagaggagggatgcagcagccaataaggctcaagtagtctttccttagaaatggtgtaccattagcaactgttcttggttccttttttcgctgctgcacggatgagaagttctctttggcgttgttgagatgattgtgtatatcttgtggccttttgctcgtgcatgttgttcctctagtgttttggacctactttcttctgcaagctggtttttgcaagtacatctaataaaagagtatttttgcctcaaaaaaatcaaatgtgcatattt

SEQ ID NO: 33711 - DNA, 1060 bp, Triticum aestivum
  Clone ID: PAT_TA_33711
ttgcttgcgctttcccttggttgggacggggacctacctatgcatcgacccgcgccgccctcgcctcgagccttcctcgggccccccccttccccgcccgctccctctcccgctccgccgcctggttccgggggggctgccgcgtctgcgccgccgggtcagacgacacacgctggttgcggagcagctagcggcggaggtgctttcttcatcatggagtcgcagcagcagcagcagcagatggaggcggtttctgcgccggccgcctccacgaacgggggcggggagctgatcgggtacgtggacgtgcacgtgcggagcgcgcgggacatccagaacatctgcatctaccacaagcaggatgtgtacgcgcgcctctcgctgccgggggagggcgcgccggcggcgtccacgcaggtcatcaatggcggcggccgcaacccggtgtttgaccagtcggtgcgcgtcggcgtgcgcgcgggggacgtcgacgccgcgctccgctgcgaggtctggatgctcagccgggtcaagaactacctgcaggaccagctgctggggttcgcgctcgtgccgctcccggacgtcgtcgccgccgagggcggcacgctcgcgcgcgagttcccgctctccaccaacgacctcttccactccccggccgggttcttggagctcgagctctcttacatcggggtcgtgcccgatgtcattcccgtctcgcccacgcccaagcctgcgctggccgatcccgatgagtccgagaacgccggcggcggagccggcgctggcgcagggaaggactacgagaacatggagttccctgacatgaatcttgtggaggaaaaccagattatgctctcggaatatgttgggctgccgtgcacggccatggaaacgcagagctccgagagcctcctgacctcggaggacgtggatggcgccgccaccgagtcccacgacgctggcgtgcgcgtcgtgcagagcttctccacggactacagcaccgccgactcggccggcgccttccggagcgagacggcagtcagcagcgtgtccacca

SEQ ID NO: 33712 - DNA, 614 bp, Triticum aestivum
  Clone ID: PAT_TA_33712
cctggtgcatctagtgatgacattgtactgtagtgagtgtacatttctgttgctcaactagcttatgaagcccctgatgctgtaataaactgcacagactggctttgtgcatgtgctgatccataatactactctctctgtaaggagggagtatattgcagtggccagtgtatgaccactacagttctactagtgatggtgctatatctactgcagatatatagcttccattgcgataaatgatcacgagtctgaatctaagtactagtgggaatacagtaggatagtggacacggcgcctacagtcttctgaaactccggttagaaaaactacatattccagaacagctcgtcgaagtccatgtcagccccgaggccgcctccggcggcgtagccgtagttgccggcaagctggcaccaggagttccccggcgtgtagcagccggccggcgaagcggcgaacgagggcggcgtgaagggctctgccggccactgcatcccttccgacgcctcagccggcgagctctgttgctgctgctgttcctggcccaaggaagcaggcggctgctgatctgtgccgacgaggacagcggtggcctgggcgcaggtgtgcc

SEQ ID NO: 33713 - DNA, 596 bp, Triticum aestivum
  unsure (1)..(596): unsure at all n locations
  Clone ID: PAT_TA_33713
gatccanttttcgatggtactgtattaaattactacaaagggaacctccatttcaaataacatatgacagagtactactttcaaatgcatcagaacaggacgatatcaataattcaactgtgatccataacaagttgcagcagagtgaaggtactagcagtaaataactggatggaaagagcacctatccaatcaacacccaaaaccatcgaggaccatacccgacatctgattctcatgaagtcaccggagccacgccaacttggcaaatgtgaagctgctccaaaattcactgaggaacgggcggcttctccacaaaacagggaatgtaggggtgaaatctttgcgcccagcggtctccaagagagcagacaatatccagtttaccggtatccatattgtaggacataagcaatgcttcctgccccgcatcttcaaggaatatcagattgcagtctggatggatcgcaaccgcctggtagaattcgttgggtgcacggcaagggcttcctagcagttcaagaatgctggcagtacacttcagggtccacagtccgctagcatgatcctcgagaacccacaccaagagccggcat

SEQ ID NO: 33714 - DNA, 1828 bp, Triticum aestivum
  unsure (1)..(1828): unsure at all n locations
  Clone ID: PAT_TA_33714
aggggntacggtcgttcgggcttgctcccgttctgctgtccagcgccgcctgcgccgcctcgccgcccccccgcctagccgccccgctttcctgggcagcttcgtcccgagacggtgtgattatttttggctggattggagcgtggaataagatggacgaattcgagctggaggataacctagagttcatcctccagagcatccaggagctcatagaggaccagggggacaacaatcccttcggcgaggtcaaccagaatgagctcctcgccaacctcgtcaactatgaccaggacaacttgatgccggacgtgtccgtggaggacgtagtgaacgggaaggacgtgcaggggattccgtgggaaaagatgctgttcccgagggatcagtaccgggagatgaagatgaagggctacaagaactatcagaacctcagttatgcccgggaggatgctttgcaggattgcaaacaagttgagagggacggcccttactacgattttcagtacaacacgaggcgtgcccgactgtcaattgtgcattttcagttgaggaatttggtctgggcaacaaccaagcatgatgtttatacagtacacaatcaatcaatgacacactggtcatcactaaaccagataagcactgagctaatcaatggtgatgattgcattataccaaaacagagagggcatggttcacaatctgtctcaatggtccagttcacaactatggctgtagataatgattttttggggtagttggtggtttccatggagagcttatatgcaagcgtctggaggatgatgggatagttttcagcacgagagttacagatgatgagaatgctataaccaactctttagagatataccaggatcccaatggatcaagacggttggtggttgctaataatgactgctctgtcagaatttttgataccaagtattttgacctacttaatcactatgttttcccatggtctgtgaatagtgtttcggttaaccctgatgcaacactttttgctgtccttggtgatcacgaggatggcttggtagtggatcccaagtgtggcaagccgattggtaaagttagaggccatttggattactcattctcatctgcgtggcacccagatggcaatatattggctaccgggagtcaagacacaacatgtcggctgtgggacattagaaacctatcacaatccttggctgtccttggtgggaaggctaggctcaatacgttgtatcaaattctcttcagatggccgctttttggcaacagcagagcctatagatttcgttcacatctatgattgttttgccgattatggcaaatctcatgagattgacttttttggtgaaatagctggtttgtcattcagcccagacacagaggccttctatattggcgtagcagaccaaacatatggaggcctcatggagttcaagaggaggcaccagcatcattacttgaactgcctgtggtgatgccttttggttagcacagtttgcttttgcagttcctttattcgcgactgattgatcgtttgactgtgctgcaaaaactgcatggttttagtcaaggcaaccggtggaggaactcattggggcaacgtgattagtgatttgctgccgcaccttaagctcactccagataaatgagctggagctgtataaatttctgttctgtcttgttgctgtctaggaaccgacggggattgtgatagttaatgtgtagtcttgcattccattttatcaaatcaatgtacatagttggtgctttatctgtactatgcttttttctttgaacgagactagtaagcgtg

SEQ ID NO: 33715 - DNA, 905 bp, Triticum aestivum
  Clone ID: PAT_TA_33715
cacaataaatcagagttgaagactctggatggaatcaagctgcaagaaaagatccaagggggctcttcaatcagagtctgaacatgagatcgaagtgaaacaagaaattttagagaatgatgaagcgtctgaacaagagcagacctacacagagagtgcctcagttgctccttcaggtatggatcaccggggtgagaataataacaaaggggctgaagaatcgataagaaactatgggaagcatgtttctgatccagtaaacacaggttgccagcccagtaaatttggccgaccaagtactgaagaggtcaggagaatacatagtggcagtatatctgtctatctgaaagacatcacagtatatcaggaaagaattcgttctgatccatcaaagagtacacatgtaaacaatgctgggtattattctcgacatggagctctggaaccagtttcagtcagcaaggatatcaaagttccattgcatgacaatgggagggtttgtggaagagatggtgcactggagttggtgacaggtccaccagaagagacgcctcgatggagacaagagcaatatgcacttaatattttagaagatgtgcaaaatgctcgcattgctgagaaaactaggatggagatggagatcagaatactgaaggcacagattgctagcatgcagagacaagtgatgaacatggatcatgttggtgaggttatttccagatcaaaaaggcattgacctttaattagctccatgctaaatgataggttagcataaaatttcatgtagaactgtacttcctttgcgagatcaaacaccaatgcacgctagtttgcttcgtttgtgttgactctcatgaaggtcggtacgcaccttttctctggggtgaagtttatttaatttaaaa

SEQ ID NO: 33716 - DNA, 908 bp, Triticum aestivum
  unsure (1)..(908): unsure at all n locations
  Clone ID: PAT_TA_33716
caccacgaggcctccaccaaaaactagggttagggttagggcggcggcggcggctttatttccgatcgcgatcgccatggccaccggaggcgccccaaagccggaggaggagaccgtcgtcttccccgattgggtgatgctggaacgcatcttccgcaaacggtgccacgacgacctagacgctgctggtgaggccgtcaacaagaacaagaccgccgctccagtcaagattgacagcggccactcctgcttcgtctccttcaccctcgcagctcctccagggtcctcctacttcaacctccattggccggagagacaaggctcagaagaactccttgccttcgtccgggcagtcgacaagaaccttgtcctcttcgacatctcgatccccgaccggattcgctacttcgacgctccgccagatctgttcgtctacacggcctctgctcctccccccccggtgcagcagcttcctcggcgcagcacaaagcagttcctggctcatcagttcaccaccggcattctgcagctcaaagcggagcactgctacatcgttgccgacctcaatgtccacctcaagaaagagggcgctagtgctgaactctgtgtcttcaactccggcgccaccgattggagaatcatcaccgaggtgcttgctgataagctccctgacctctggtttaccgatgatgtgtttgctttcgatggccgtttcctttgctgggtggactacttcagcggcgttgtgctatgcgacttctccaaaaatgtggactcccaggtgctccacttcgtgccttttcctggaggaatcaaataccctgatgacgcacggttcccgaggtacgtgcgtcnancacccaaggcatgatcnggnatatccacattgncaatgantntcatgagac

SEQ ID NO: 33717 - DNA, 1854 bp, Triticum aestivum
  unsure (1)..(1854): unsure at all n locations
  Clone ID: PAT_TA_33717
tcggcacgaggggaaagaaaaagcggggccgattggacaggcgagggggcccggccgtcacgtcgtcttcctcctcgctccattagaaccgagctctcgggtctccgcctctgctcgcctcccactgttatcggaaccgctgcggacgaagcagcggcactatgcgtccgtccctctgtcatgttccttttcttcttctgctactattacatgtggtcattgctagaccattctttccactgccaagtaagaccagtaatgaagagaagaagcccatacagacatttcgaccgtataacattgctcaccgtggctcaaacggggaaatcccagaggaaacaagtgctgcttacctgagggctattgaagaaggtgcagattttatagagactgacatccttgctagcaaagatggtgcattgatctgctttcatgatgtaacacttgatgatacaactgatatttccggccgtaaggaattcgccaatcgaaggagaacctatgaggtggaatgggccaacgttactggctggtttgtagtggatttcacgcttgaggaacttaaaacacttaaagtgaagcagcgatactcattcagagatcaacaatataatggcaaattttcaatcatcacatttgaagaattcatttcagttgccttagatgcaagcagaaccgttggaatatatccagagataaaagatccagtttttatcaacaagcatgtaaagtgggcagatggaaagaagtttgaggacaaatttgtggataccttactaaagtatggatacaggggtcaatatatgtccgaaaattggctaaaacagccattgtttatacaatcatttgctccctcttcccttgtacatgtatcaaatttgacagactctccgaagatctttctgattgatgataccacagtgagaactcaagacacaaaccagtcatacggggaaatcacttcangatgactaccttgcatatattagtaactatgttgtcggcctcggtccatggaaagatactattgttccagttgcaaaaaactatttgctggaaccaactgatcttgttgcaagagcgcatgctcataatctccaggtacacccttacacatacaggaacgagaaccagtttctgcacttcgactttcatcaggatccctatgccgagttcgatttctggataaatacgatgggggttgacggattattcacagatttcgctggaagcatacacaagtaccaagaactgaaatctccacacccgaaggacgcaaccgcgaacagcctcctagtaaaaattgctcagttgatcgcggcatacgaaggccactgaataagtctgtgttccagcaaaatcactgccattttcagtgatgatgcgcaagacccaaatgagttgacatttgacgacccgcagtgacctggaaaggtcactaatagatgttggtttacgctgttatatagtgttaacacgagttcatgtatacctcttcattgaacccctgaatctcaagggggagatctttattatcgcaataaccatttttttccggaaggtttccacacgaaatttaatggttgacgtatagctcatccgatgggatatcgtttcaacaatctcccaagttggggcgttcatatgtacaagtgggaatgggtgtttgaaatgctaaaagttagtgttgacagttgacctgtggtcaagtaaataggacaactgtctgcacttgtgccctgttggtaataactgacactttatnttggcaccgcaccacaccccacgtgtgtttgttggtggtgcnccccccgtcaattggtggaattttttnnaaaaaaccncccngggggn

SEQ ID NO: 33718 - DNA, 845 bp, Triticum aestivum
  Clone ID: PAT_TA_33718
gtaaactcgctgcaggaaaagcctagttcaagtgttggagaagcaactttagtatcagctgataaagagagagttcattcgggtgccgtcacataaccagggcagcaccgagcagcaagcaagtcgtttgcaaacagcaaacacgcagggtagaccaccaaacgtacgccattcctacgtccactgtcggtccatcaacattttcacacttgaacacacaatactgcaattcggagacggtcgtagttcgatgatgtacatctaaatacctgacatctttacagacagcaatcacaacgaccagggcacccaactcacccgcgtcgccggttgagcaccgcgagccgtccagatcaccgcgcaacccaagtgtcagcgggtcatccgttggcgtcgaaaagccaatggccttgacaccacaatggcactgatgcaaagggagcattcaagctagtagcctacataaacgtggatctgcggagcgccgcaccgtcacacgcgcatctaaaagcaccgcacgggcttttgcgtgctatccaattccttagtacgatgtttctgcatatcgatcatttccatcaagcacctcatcgatcttagttcagttacaagagtatcttgtgtagctcctacgtgactcataagtcatatatcaataatagtgaatatgtacttagcctcgtcgtccaggggacttagaacagtgtatactgtgtatatacatcaaataagttatgttttagatgatgtgagatgagttgcccctagggcgcgttagtgtaagaaatgtggcatgcccagtgaactttatatgttggtatatacaaataaaggaaaaaaaaaaa

SEQ ID NO: 33719 - DNA, 1064 bp, Triticum aestivum
  Clone ID: PAT_TA_33719
ggtcgacccacgcgtccggagttacgggagctagagaagaataaaaagggagaccaggctgcagttggtccagtggaactatcaagtccgaacaaaggaaattcccatatatctttacctgaagtagaggtggctgaaaagtcgtctccagggaacaaaacagttggtacagcgatacccttttcgccttctgatatcaagaaaacatacaaggatgctacccttcccactcattggaaggcttttgataccgttattttccgtgagcaggatgatggccttcatgcttcagctaagattgctgcttttgattttgacgggtgcctcgccaaaacctcagtgaagatcattggtgcagacaagtggtctttacagcataaatcaattcctgacaagttgcaaagcctgtacaatgatggctacaagttggtcatattcaccaatgagtcaaacattgagcgctggaagaataagcggcagcaagctgttgactcaaaagttggacgccttgacaactttattgagtgtgttaaagtccctattcaggttttcattgcgtgtggtactgggaaaggaaaaggcacaccggatgatctgtttcgcaaaccaaattcaggaatgtggtggttgatggcagagcatttcaattctggaattgccatcgacatggaccaatctttctatgttggtgatgctgctgggagagagaatgatcatagtgacgcagatatagaattcgctaaggccatcggtctgaagtttcacgttcctgaagaattcttcggtccctagccgttcactgtgagcagctatgttaggtggtgaataagatggtttaccaattgccgtaggtcggtgtctcatgtttggaacctaagaatgccacagttattcttacgttgcaagatcgctgtttaaacttgccgtagacctttgccgtagtatcatgcctgttcgtctaggatcgacttgaatcaatgtactggaggcggtgaactgttgggatctgagtcaatgccatactgggactcgtcgatcactgatttctatcgcccagttgactc

SEQ ID NO: 33720 - DNA, 741 bp, Triticum aestivum
  Clone ID: PAT_TA_33720
ctcccctccggcaaccggccggagccgttccccgctccgtaaaagaggacggagaccagagccgttctcgcagtggccgtgggcaaaatcgtcaactcgacgacccaaacattgccgcccgggcgaactgggatcgcagacccgtcctgactcggcttaatttcttctctggtcggcatggggctgtggtcatttcttgagggtgtcctgcttattgctaacgctttggcaatattaaatgaagaccgtttcctttctcccagaggatggagcttcgctgacgctagaggcgtgcagggagcaaacaccttcaaaggacagatgattggcctcatatacgcagctcaatacatgagatttccattgatccttcttaatggaatcactatacttgtgaagtttgtttcattctgacagtgggaagtggtacgctatgcagctcttcttcggtttgcttccttgaagattgagatatttgcactcaaaccaggctttatgtatatcttctcgtgattcaccccttcttccaatagtcttctgttgatggttgtatagctgtgccttgtatatgcacactgctgagatgtgcagttgtgctcagctagtaatttattggttatccgcaacacactagacggtatgtgcctaactgtgatctttcattgttcttttgtatgtacatgatgtatttgcatttgtccactgtaatttttcttgttattcctgaatttttttgcaaaa

SEQ ID NO: 33721 - DNA, 659 bp, Triticum aestivum
  Clone ID: PAT_TA_33721
gaattcggcacgaggatgcgtccgtcaggacggctactcctacaagattaccctaatctccaccctctgcactgccgccaagtgaagcattggacgagcgagaggcgtacgctcccaagctcctctctccatggcctcctccggcgggcacacggtgcccctgctcgcccgacttccagccgaggcggcggaggcgtacaccaccgacgggacccttgacttcgacgggaacccggcgctcaagaatcgcacgggcggatggcgcgcgtgccgcgcagttctcggaaccgagttctgctactgcctagcgttctacggcatctcctacaacctcgtcacgtacctcaccggcgtcctgggccagagcaacgtcgccgcggcgaggaacgtgtccacctggcaggccacctgcttcctcatgcccctcggcggcgccgtcgtcgccgactcctactgcggaaggtaccgcaccatggtcgtctcctgcttcatcggcgtcgcaggcatgctcatgacagcattctcggcgtacctcccgctgctcgtcgagaacggcgtgtcgttcagaggcctcacctcgtcgaacatggtgtcggttcaggagttcgtcttgtttctcggcctctacatgattgccgtcgggctgggcggactccggc

SEQ ID NO: 33722 - DNA, 1438 bp, Triticum aestivum
  unsure (1)..(1438): unsure at all n locations
  Clone ID: PAT_TA_33722
gccccccctcccgtgcgaccccgacacgtgtgcgttgctggtagttacagtgatagtgagccatggcgacgatgagggccgccgccgcgctgcctggcgccgtggtgctactgtgcgcgctccgtcacggcggcgcgcagcggtacgatgccatctacagcttcggcgactccatctccgacaccggcaacctctgctccggcggctgcacgtcgtggctcacaaccgggcagtcgccctatggggagaccttcttcaagcgccccaccggccgctgctccgacggccgagtcatcgtcgacttcctcgccgagcactttgggctgccgctgctgccggcgtccaaggccacggtgaccggcaccgacttcaagaagggcgccaacatggcgatcatcggcgccaccaccacggacttcaggttgttccagtcacatcagacttagctccaagaatctggaacaacgggcccctggacacccagatccagtggttccggaaactcctaccgtccgcatgcggtaagggaggtgattgcaagagccatctctccaaggccctgctcgtcgtggccgagttcggcggcaacggctacaacgcggcgccctgctcaggttgggccatgaccgtcctagcgggatatggtccgcgagtcgtcagccatttcgtccgtggcctcgaggccattatcgcactccgcccgatggacgtggtggtgccgggggtgctccccatcgggtgcttcccgatctacctgaccctctacggcacctccaacgccggcgactacgacggcgacgggtgcctcaagagctacaacgagctctccgcccaccacaactcgctgctccggcggagcctcgccaacctccagaggacctacccccgcacccggatcatgtacgccgacttctacgcgcaggtcatccagatgatccgggcccctcagaatttcggcctcaagtacgggctgaaggtgtgctgcggagccggcgggcagggcaagtacaactacaacaacaaggcgaggtgcggaatgtccggggcgagcgcctgcgccgacccgcagaattacctcatctgggacggcatccacctcacggaggcggcgtaccgttcgatcgccaacgggtggctcaaggggccctactgcagcccccgcatcctgcactgatcattctttttatcgattccttgttttattattatttattttattgacttgtggcgttttctgatcaagtgtggtgggatcgatggatgcgtcatgtgtgtgtgtgtgaatgtaacaactaatatatatgatgggtgttcgtggggtgattaattaattaggttgcctcggagaatcaatgaataaaactatatagatgtgttgtttggggttattgtttaactgtaaactgaggaaatggttcgagccccncctgattaaaaa

SEQ ID NO: 33723 - DNA, 483 bp, Triticum aestivum
  Clone ID: PAT_TA_33723
gccggccgggcaaaaaaaaaaaaaagactcgagtcgtcttcttcctctgctcctgctcggatcccctaccctgctcctcaccccaaccccccctctcgcggcgcggcacggcagagaggagtcggcggagatgtcgggcgtgacggcggacgaggacaagaagcccgcgggcgacggcggaggcgcccacatcaacctcaaggtcaaggggcaggatggcaatgaggttttcttccgcatcaagagatccacacagctgaagaagctgatgaacgcctactgcgaccgtcagtctgtggatctcaactccattgctttcctttttgatggtcgtaggctccgtggtgagcagacccctgatgagcttgagatggaggaaggcgacgagattgacgccatgcttcaccagaccggaggggggtttcctcgcccttagaaggagcttgctgcaccctggctgttctatgtccgatgctacccttt

SEQ ID NO: 33724 - DNA, 480 bp, Triticum aestivum
  Clone ID: PAT_TA_33724
ggagggtaccgcgtttgcaaggacaaagccagaaaaacaaatagattcgaggttgctgggcctagctagacatttcaggatctagaatgagacaaatcgagggcagcccttcacaagtaacctggatagatgagagagcggaggtgtttgaactagtctcgtggctgcacaccttgatgacaccattttcgaccttgctgtgtactttacagatagttttccttgaaacacaattttgttgaaggtatatgttatctatgggatttctgatcttatttgatcttagagctgcgtggtttcacatacacttaccgttatggcattagcatttctacggtttggaggtcagcgtactgtttttcatttgattatcttctcattcttataaaacagtattggccagctgccttagatttcttcatagtttgaggtctgtccttgctccaagagatttgcaacggttgtgtaccttgtttaatg

SEQ ID NO: 33725 - DNA, 800 bp, Triticum aestivum
  Clone ID: PAT_TA_33725
aaataaaaaggccgaaaaaaaaaaaaagacagactcgagtcgtcttcttcctctgctcttgctcggatcccctaccctgctcctcaccccaaccccgcctctcgaggcgcggcacagcacagaggagtcggcggagatgtcgggcgtgacggcggacgaggacaagaagcccgcgggcgacggcggaggcgcccacatcaacctcaaggtcaaggggcaggatggcaatgaggttttcttccgcatcaagagatccacacagctgaagaagctgatgaacgcctactgcgaccgtcagtctgtggatctcaactccattgctttcctttttgatggtcgtaggctccgtggtgagcagacccctgatgagcttgagatggaggaaggcgacgagattgacgccatgcttcaccagaccggagggggctttcctcgcccttagaaggagcttgctgcagcctggctgttctatgtcgtatgctacctttagaactagagtaaaatgtaagaagtgaaagaacttgcgaggctatggttctgtgccataacctgagggggggtctggaggtgaaagaacatcggagtactgttgatgtcgtgactgaactatcatccattgcctaatatatcatgccttgttgtgttccaaaaaaaaaaaaaaaaaaaaaaaaaggcccctaaaaaaaaaaggcaaaagaatatagaaaaaccaaaacaaaaaaagaaagaaaccaaaaaaaaaaaaaagaaaaagcaacggaaagaaaaggatgaagaaaaatgacacagggcataagggg

SEQ ID NO: 33726 - DNA, 2197 bp, Triticum aestivum
  Clone ID: PAT_TA_33726
tggcttgctgcctgttgttgaattggtgcaatggtagcttggagctccacctgctggacctggagcctattcaggacctgaagtcagcggagatctgcagtacctggaggtggacctggcgaggcctcgggagggtggcggcaatctgcagcgggcgctggcctcgtgatgacgaggggggggatctgctggcccgagacgatgagggggatctgctggcccaggaagatggggaggatggcaggggatctgaggggcgagatgggaggctatggaggaggaggccccgcccgacgcaccggcgcgccacccccgcctccccctccccccccgcttcttcttcttcctctgctcctgctcggaccccactaccctgctcctccaacccccttccgcggcgcgggcgcggcgcggcccagcacagcaggagtcggcgggagcatgtcgggcagtgacggcggccgagggacaagcaagcccgcgggcgacggtgcgaggcgcccacatcaacctcaaggtcaaggggcagggatggcaatgaggttttcttccgcatcaagagatccacacagctgaagaagctgatgaacgcttactgcgaccgtcagtctgtggatctcaacctccattgctttcctttttgatggtcagtaggctccgtaggtgagcaagatcccctgatgatgcttgagattggaggaaggcgacgatgattcgacgccatgcttcaacccatgaccggagggtgcttctcctggtcccttaggaaggagcttgctagcaagcctggactgttctatgtcgttatgctacctttagaactaagagtaaaatgttaagaagtgaaagaacttgtgaggcctgatggttttttgtgccctagtccttgcagggggggctcggggggtaaaacaacatcggattaaatgttgatttaggctgactttattttgatccaacctgatgatatattagtggtgaaagtactattcggagtactgttcgatgtcgttactggaagtatcataccgtggccttaatatatcatgccatatgatgtttggcctaaaaatagaaagtccccaaggtggaaccacgtaggcgcaaaacgtgataccactggaaacgagcgtacagggttgcaaggaggaagtagggaccaaaacaaacaaagacaactcgagcgtgtggggcctagcctagccatatctggaaagatcaagaatcagacaaagcgatggcatctctgcagtagtgactagctaggaatagccagaggtggtttgagaaatagtcaggggtgcccatcacatgaacaccatattctagatagtagtggtggtttttaaattagtttcccgttgaaacacatttttgttgactctattttttaccttgtggtgtattttacagatacgttttccttgaaacacaattattgttgaagggtatatgttaacgattgtattgatgctacaagttggtaggtttgcctactgtttttcatttgattatcttctcattcttataaaacagtattggccagctgccttagatttcttcatagtttgagggccacggaaaaatacccgaaagaaaggctcccaagcaagaaaaggcagacgaggagggtcggcctaatccgatctgcggtctcgtcaaaccgccggtttctgttgtgtcaatattatcacagctctttactttgaagcgtgcagaacctacgcctgctgcctaggatcagtatcaggctggattcctgctggagaagtcagaaggtatctggacgagaagtcgaggtgttgctcccatgatcgctgcaaatttgttggtagctatgagcagctgcgtgagcatgctagaacagctcacttgcttgcaaagcctgcccttgtagatatctcaaggaaaaggtcttgggatcgccttgaacgtgagcaggagtttggtgatgtgattagtgcaatcaggtcacagaatcctggtgcagtaatagttggtgactatgttattgagactagagatgcaatgtctcctgatgaagattctggggaagaaagtggtgatgattggtgggctcctgcccaagaccaagtagaatcaccggacaaccgacatcgtgccccctaagccctggctgaatggagactatggatcaccctaccatttggccagatggaaagcatgccttccctta

SEQ ID NO: 33727 - DNA, 866 bp, Triticum aestivum
  Clone ID: PAT_TA_33727
gccggccgggctgggaaaacccacgcgaccgaggacgcgtgggcagcagcagcaccacctcctccctccttcctcctgatccgatctgactgagccggccatggcggttagggtttggctctccgccatcctcctcgccttcctcctcgccgcctcccccttcgcccaagttgctagagctcagtctgaggaagatgctgctatgcaagaagttgttgatggggctgatctaggatatgtgggtgatgatactccggtttccagtgaagagcctttaagccctgctcctggtgtggagactgtttgcgtcttccccaaaaatgctgggaaaattgtaccagcgggtgaagaaactgagcttttggttggcctgcaaaatgagggtgaatcaactttgaatgttgttgctgtccattcaaccctgcatcttccttatgatcacaaaatgtatggacaaaaccttacagttcagagtttctacaacgcgtcagttcctgtctctgtgcaagcaacctttccctatacatttgccgtgagcaaattcttgcagcctggagcatatgatcttgttggttacattgtgtacgagattgatcagcacccttatcagaacgtattctacaatggcaccattgaggttgttgaggtcggagggttactgagtgttgaatctgtgttccttattacccttggaattgcacttcttggtctcctaggattgtgggcttatggtcaagtgcaacagctctcgaagaaaacaaagaaaggccccaaggtggaactcggaactggaacaactgatgccaacatggacgagtggctggagggtaccgcgtttgcaaaggacaaagccaagaaaaacaaat

SEQ ID NO: 33728 - DNA, 1281 bp, Triticum aestivum
  Clone ID: PAT_TA_33728
cacacgcgaccccgcacacacacaacacacatcccgtggggattttacggttctgcccctgccccgtgcgcgacccggagccatcatgaagccggtcatgatgcccagactcatgcccctgcagagggccctgggaggcgaggcaacgggaggtgagcatggagaatgagtggaagcacgctgtggacccacgagaatccccctgcccccgttgcccatgcccccggccgctgcccggcgggtggcgtggtgcggcgaggcggggctcggggcctcactacgagggccatcggctcgtggccgccgctcaacttcgccatggtcccaccacagcatctaccgcctccggtccctccagccccgctccattgcgtacctctgaccggccctgaacctgcgatccattgggtgctcctggagagggccgtacccaggctccaccagttcggaattgagggcggaaaggaaccattcgttgagatacccgaagagagagccgcaaggcgcttaaagttgtccaaaatgtaagaaatcagccattgcttattcactgcaagagaggcaagcaccgaactggatgtgtcgtcggttgcatgaggaagttgcagaaatggtgcctgtcttcggtcttcgatgagtaccagcgcttcgccgctgcgaaagtgaggagcaccgacctgagattcatggagctgttcgacgtctcgagcttgaagcacctgaccaactcacattgttaacccagggcgagtgatcgctcgcccccgacgtcctcccagattctagtacatctccatgctgtcctccggcggtcactgaaccgaatcagcagtgaataacttttggaacccgtagaatgaatccatgagatagtggcgagacctctgcaaaaaagaagattgaagaagaacttgagagctctatttttcccctgctcaggtccctgcagatcctaagaaccagaaagttgtgggtaggattgcaagaggttttctttttcttcggttactcttgcgatgaattcaccattgttttcgggtactgaagctctgtactcgagcagcattgctaggcagagagcttggctcttctttgcatgaatgcatctaaattaatcagaggcttttggcatggcatgcgacttactgggatgcctctggctcgctcagaacttaatgagtaatgagcgtatgaatggcggatgatactaacatgtactccccccgttcgtaaatataagtctttttagagatttcaatatagactccaaagggatgtata

SEQ ID NO: 33729 - DNA, 1395 bp, Triticum aestivum
  Clone ID: PAT_TA_33729
aggcaggtgcggtggccgtaattcgctccacggcttctagttttgcagtcaatattctggtgcatatatgtatgtatagtagtggggtcacgagttttcgaaaatgtcaactgtcaacacactcctctccgcttatgcttgcacccggcccctatccagcaaggcgcttattaacaggccaaccatacaacaacacgttccgaattctccagcgaacgtccttcagtgtattgacaaggaacacgatggatgatcgacacgcgcccggacactcatttcttgtctgggatcttctccaggagctcctccaggacctgggaaacagatccccaaacgattcccgtaatcccgcgaccttgaaagattggggcgtccgcgtctttgttgaccgccacgatgtacttggaatctctcatccctgccaagtgttgtatcgcccctgaaactccgaaagcaatgtagagctcaggcgcaacaatcttcccggtctgcccaacttgaagttcattcggcacatatcctgcatcgacggcagctctggtcgcacccactgccgcgccaagtttctctgccagctgctccaacaatttgaaattctcggcgctcttcaaacctctgcctccagtgattaccacgcgtgcatttgcaagatctggccgttctgtatcttgggatgtaagattcacccatgaagatttccttgagcttgcttcactgaggaaagagagatcaacctgggttataggtgcaactttagtttctgacacagactcggtagctggagaaaatgatgttgatctaatactcatcatacaaggagactccccagtatatcgtacagtgcagagtgcattcccagcatagattggcctcacaaagacccggggctcagagattgcagtgacgtccgtgacaggggagacatctagaagagccgcagcgcgcggaagcaaattcttcccgaacgatgtcgaagaggctataacatgagagtatccgcctttctgctgcacggagcggagcagctcggcccaaggctcggctaaaggatgcgcaaacacgtctgaatccgcgacaagaacctcattgaccaatgggtggctagacgcagcatgctcagcagccttgtgcagcgtcggtccggatccgccgagaagaagagacaccttgttctctttggcgatggcctcggcagccgccaatgcgctcagagatgagggcttcacgagcccaccttcatgctccgccacgaccagagtgctcacgagcctacgcagcgtcctctcggccgcgccgcgggcgccggatctcccccgccggagcgctcccgccaccaacgccgtcgccatgagctctctctgagaaacgcaacgcagcgtgcctcgcgccgaattc

SEQ ID NO: 33730 - DNA, 979 bp, Triticum aestivum
  Clone ID: PAT_TA_33730
atatttttttacacagcccacatccatatactgttcacacagcctttcatctccgtgctgccccactgcaccccccgcagcgcccctcgcggtgcaccgcacgtcgcactccgcaatggcacctggtctggctccagcgcgacctccaaccggactgccccccgttctgccccgcttcctttccgtgaaggaagaaggggttgcagggctgggcgtgctgggctgcgccttcgggtccgcccctgtgcggccacccgacggcgtcgcccacccccttctcccacccgcagcgtcccctcaggctccagcgccggtccacccccgaactacaccactatgcgacctgtactacacgcatggccgacggaattgcacatgtgctccgcaccgcacaggcgcatcgcctttactgcactgggacagggaaccaagatcgccctcctcttcttgcttggagaagagtgtcgctcagctgactgcacctggcacgtcaccaagctgcatgaccagggaactggccagccactgagctataccacaacgaccaccagagtgcaccacagcaactacccggagtgcactgcattgctgccgtcatcgccggcgcgctcatgaactgcacccacaggagcacttgaagtgcatctaatgctagtgagccgcacgtccgtggtcaccagactgcacacaagcttctgaattgcaatggcatcgccgtctgtgctgcactgaactcatgaccgaactgcaagccggcacactgccatagttctccggcgaagagagagctgcgaggggtgctctggcaaactgaatcccaggggcggatgtggcatggccgagggatctcttccccgcgggaagtcgatggtggctgcacacacctgctgctgtgtaatgctccaacaatggcattgggctgctcaagccagagaggatgacccaatcgacctacgtcaggtaggctcagctaccctcg

SEQ ID NO: 33731 - DNA, 678 bp, Triticum aestivum
  Clone ID: PAT_TA_33731
ggggtaggtcctcgcctggtttttctttaataaaccgggctgtgtcaaccttcgggcttggtattctgcaaatgaatcttaacagctctcctactaacttttctctattgctcatgaatcgtgctttatcttgggctggaaaaaaaactctacccacggaaaagcaactcaaaaatcagcaacccttcctggatttgtacctcatggcgcagctcgcgaacgctatcagattcaggcaaccaagcccggacatcatccagaagaagcgatccagatgaccctcgttcaggtcgtcggggatccaccccggcgcgccgccagtcgtcgtcgcccactgcacggctgtcagtaggactgagctcaggtagccgccggccgctactgcgagaagcgcgagcgccgtgcacacggtcttcatcgcggccggcgcctggccgtagaagaagtcgagctgcccgatggtggtgagcacctcgcccacgcccacaagcacgtactgcggcgcctgccacagcacgctcgtcgagcatggcgccaggcccgccgccttcgccgcgcggaggcgcaccgtctcgagaagcgccgcggcggccatggcgagcacgggcatggtgaggccggcgccgatcctctgcagctccgagatacccttctccctcccggtgagccttctcgccg

SEQ ID NO: 33732 - DNA, 821 bp, Triticum aestivum
  unsure (1)..(821): unsure at all n locations
  Clone ID: PAT_TA_33732
cgtccggtgaaaaccagagctgcctatatataccccgtcctgggtgcgacccgcgccccaagctccggcgcgccagtgctacaaaccaccgctaccacagcgtccacctacccgtcctccgcctcgagaagcgtcggcgaggccatggcgcggaagaagatccgggagtacgactccaagcgcctcctcaaggagcacctcaagcgcctcgcaggcatcgacctccagatcctctccgcgcaggtcacacaatcaacggatttcacggagctttcaaaccaggagccatggctctcgtcgatgaagttggttgttaaacctgacatgctgtttggcaagcgtgggaagagtggccttgtagccctcaacctagatcttgctcaagtccgccaatttgtcaaggagcggttaggagttgaggtcgagatgggtggatgtaaggctccaattacaacattcatagtcgagccatttgtgccacacgatcaagagtattatctctcaattatgtcagacaggcttggttgcaccattagtttctcagagtgtggtggtattgagattgaggagaactgggacaaggttaagacaatctttcttccaacagagaagccaatgacacttgatgcatgcgctccattgattgccactcttcccttggaagtccgcacgaaaataggcgatttcattagagggtcattttctgttttcaaagacttggatttctcattttatggagatgaacccattcaccctgggtaaatggtgaaccataccctctcggacatgagaggntgaactggatgacacagctgctttca

SEQ ID NO: 33733 - DNA, 706 bp, Triticum aestivum
  Clone ID: PAT_TA_33733
agttttgaacccaaaaggcacgcatctggacaatggttgctggaggtggtgccagtgtcatatacgctgacacggttggagatttgggatatgcttcagagttaggaaattatgcagaatacagtggtgctcccaaccaggaggaggttctgcagtatgctagagtagtacttgattgtgtgactgcggaccctgatggccgcaagagagcccttctcattggaggtggtatagccaacttcactgatgtcgctgccacttttagtggcatcattcaggcattaagagagaaggaatccaagttaaaggcatccaggatgcacctctatgttcgacgaggtggtccaaattaccaaactggactggcgaaaatgcgcaagcttggtgcagaaatcggtgttccgattgaggtgtatggaccggaagagacaatgactggcatctgcaagcaagcaattgaatgcattatggcggcatcataaatcaggatacagttcagaagtagtttgagatctacaaacaagaaactggctgccgcataaatgagagcatagtggcattaggttcacatcacatggttgattagtttcttcagaagttatttgaacaaagacacatatattgttatcgtaaaggaacctgtactgttgtaatgtgacaaacagaagatttattaccatgcaaaccggtatgtccgtagcctgtt

SEQ ID NO: 33734 - DNA, 1756 bp, Triticum aestivum
  Clone ID: PAT_TA_33734
cggaggcccgcgccggcaaggcacctaccatcgctctactccgcttcgagtccacagcacctcgcgcgcgctctacccaccataagccttcgggccttccgggagcccaagccatggcgcgcaagaagatccgggagtacgactccaagcgcctcctcaaggagcacctcaagcgcctggccggcatcgacctgcacatcctctccgcccaggtcacacaattgacggactttgcggagcttgtgaaccagcatccatggctgtcgaccaccaaactggttgtgaagcctgacatgctgttcgggaagcgtgggaagagtggccttgtggcactcaacctggatgtagcccaagtcaaggagtttgtgaaggagcggttgggagtcgaggtcgagatgggtggctgcaaagctccaattaccaccttcatagttgagccgtttgtcccccacgatcaagagatactacctttcagttgtgtccgaaaggttgggtagcaccattagcttctcggaatgtggagacattgaaatcgaggaggactgggacaaggttaatacaatctttcttccgaaagggaacccgatgacacctgatgcttttgctgccccttgatcgctacccttccactcgaaaatcggcgatttcattagggggtcattttctgttttccatgatttggcatttctcatttaatggagatgaacccattcaccctcagtaaatggtgaaccataccctctcggacatgagaggtgaactggatgacacagctgctttcaagaactttaagaaagtggggtgacattgaattccctctacctttcggaagagtcctgagcccatcagaaagttatatccatgaactggatgagaagacaagcgcatcactgaaattcacagttcttaacccgaaaggtcgcagatattacaatggttgcaggtggtggtgctagtgtcatatatgccgacacggttggagatttgggtatatgcttcattagctagggaattatgcagagtacagtggagctcctaaagaggaggaggttttgcattatgctagtggggttgtggtttgtgccactgctgatcctgatggccggaagagagctcttctcattggagggggtatcgcaaacttcaactgaatgtcgctgctacattcagtaggcatcattcgggctttaagagagaaaggaatccaaattaaaggctgcaaggtgtgaacatatgttcgtcgcagggtgtggtccaaactaccaaactgggccacacgccaaagcgtgctccaaaggatcagagcttggtcttccaattgaggtctatggaccagaggcctcaatgactggaatctgcaagcaagccattgattgtgtcatggctgaagcatgattcgtggttgtatagattctggtgtttaagttgtgtccatttttttccatatacatttagtatgaacaactattcgtgtgaagcaaacgggagaaagatcggttttgtgggggaaagaaactacagttgtaatgcaactacgcaataatatatatcttgctttgcggttcaaaaaaaagatttattaccatgcaaaccggtatgtccgttcacctgttacaagcacggtataccgcatttgtgtgttctgctctctccacaacttcctggtagagcggcctgcgatgtatccatgtccaaagcttcatgcccccagggtgtggactttgttcccaccgtctgctaaaaaaatgccccctaa

SEQ ID NO: 33735 - DNA, 1641 bp, Triticum aestivum
  unsure (1)..(1641): unsure at all n locations
  Clone ID: PAT_TA_33735
gaattgggcccgcgggtcagagcgcatctacacgtacgcccggcctcctcttcaagtgacgcgagtataactagccacccatagcgtggacgcagaaactttccaaggtgcgcaacggcctctgccccgatcccggagcagagcaacagatagaacccttccttcctctcgcgagatcgaccgacgccggtaagatgctgccgtacgcgacggccggcgaggcggaggcggcgctcggccgcgccctgacgtgggcggaggccgcgtggctccgctactcggcgtcggtgccggaccgctaccttcactggcccaacatcgccatcacattggtcgtctacacgctggcgccgctgcccctcgccctcttcgacctcgccgcgccggccgccgccgcaccgtacaagctgcagcccaaggtgcagcacccgccggccaccttcttacgctgctacatggatcgccgttcgcgtctcgctgctcatcatcggaccatacaagctcatctcgtatcttgccgccaattacatggacatacggacgggacttccattgccgttagggggggagatatcggcacaactgactgtatactttttggtggaagaactatctgaactactggctccatcggctgttgcacacaaaatggggctacgaaaagatccaccatgtttaccatgagttcacggcacctatggcgtatgccgcatggtatggacactgggctgagatgctcatcctttgccgtgccctccttggctggccctgctctcgtcccatgccatgttaccacgctgtggatttggtttgctgcacgtttggttgagagcctcaacatacatagcggatttaagttgccattcaacgctgagaagtatataccgttctatggaggggcggagcaccatgactaccatcactacataggaggacagagcaagagcaacttcgctcctgttttcacctactgtgattatatttatggaacggacaagggctacagatatcacaaggcaactctggcaaagctgaaggagttggcaggcagcgacgttcagaaaggagtcgacaatggattcaacaatggaaagcaggactagagagaggttggcttcagaggactcatggtcatacaaatcctatcactaattcaagtggtctccggatatatatccccatgatggagtacactagcataaataattgttctatgccaatcatcaacgttgagtggctcgtgaaccaccggcagagtcgttccaagtgttaattatttccagttctccctccattcgtacacatagctccactacttctctattatcggatgtaataatgatgcttagttcgtgatatgcttgaaagtgtgcgtctttgcatactacgtgacatgtctctagcaagcaggcatgtgggaaccgtcaaatatggagacaatagtcgagagcatttgcgtttgtacttccaatatcagatgttgtacataattggacaatctatctttttccctatatccacgtaaaaaaatgaaaaactcaaggggggccngtacaattccctanaggatcntntanccccacggctcgtttaactctacnggaaaccgggtacaattaccctganaacccttccaggggg

SEQ ID NO: 33736 - DNA, 571 bp, Triticum aestivum
  Clone ID: PAT_TA_33736
cacacacgacaatcgtcacgaccaacgtcacaatgtctacctctgagctcgcaacctcctacgctgctctcatcctcgccgatgacggtgtcgacatcactgccgacaagctccaatcgctgatcaaggccgcaaagatcgaggaagtcgagcccatctggacaactctgttcgccaaggctcttgagggcaaggatgtcaaggacctgctcctgaacgtcggctcaggcggcggcgctgcctctgcccccgctgccggtggtgccggaggtgctgctgctggcggtgccgacgcaccagcggaagaggagaagaaggaggaggagaaggaggagtcagacgacgacatgggcttcggtctcttcgactaagcgctttctttcgcatcttcttccacatttgccttactcggggtgtccaaaaggaatcagcggcatactccccctgctgggcagaacgttcacgacctttccgtgatacgacatgcatacggatcatctaggagaatacaatgacggcgtcttgagatgtgtataggacggcaggttcaatggaaactcgaaaagaaaaa

SEQ ID NO: 33737 - DNA, 1043 bp, Triticum aestivum
  Clone ID: PAT_TA_33737
gagccgcgccacaactcgctcggcggcgtgtaccgcgtcgtcccctcggaccgctatcccccgccgccaccagcaatgccgtgccggacatagtccccacagacccaggtgccggagaggcggaggacgaccgtggggaggacatcgcggaggaggatgcggtgtgcccctcttgcatggtggagctgtccgaggggggcggcgccatagatccgtgtggctcctgcaggggcgagctcgcgctggcacacactttttgcgccctcaagtggttcggcatcaagggcaccaggctgtgatatctgtgcaagtgggaggtccagaacctgcccgtcaccctgcttgacgtccaaatcccgcgcggcggcggcgacgcgagccgcgcccgatggaccgggccgcgccacgtccggtacaggctgtggcatgggacacctatccttgtggtcatcagcatcctggcatacttctgcttcctggagcaattgctggttgcgcataacggcttcgccgccctggcgatatcgctgcccttctcgtgtatcctaggcctcttctcatcactcaccacaacaagcatggtggcgaggagatacgtgtggatctacgcggcgatccagttcctcttcgtcgtgttcttcacgcatctgttctacagatatctgcatctgcaggctgtgatatccatcatcctggccaccttcgcgggtttcggcgtggggatgatcggcaactccatcatcatcgaggtgctgaggtggaggacgatggccccggcccagccgcgccacgctcgcaggccaccacgtgttgcgcagcagcagcagacggccccagcgtccggtgagccttcaggccagccgtcagccgccgatgagatacagcgcaatgccagcggcgatgtcgagaatcccacagtccctcaagcataaacatatgtagtttagtttgtggctatgttctgttggttggtgcttgagagcttgggacccttgtactgtataaatggtagaacaaagaggttgtctgcaagtttttcaaaa

SEQ ID NO: 33738 - DNA, 720 bp, Triticum aestivum
  Clone ID: PAT_TA_33738
tggagaagtctaactggattatactcattgtagatagttgttttctttatctaatgcctatcataccgactcctacattcctagattaattttatctatcatgtgacatgtctattttttgaatgcattctttagtagccatgtatgccttatttttcccacatatgtatcacatgtctcaagaagaagacaggcaaaaggaaggccagtccaactctgttgcaaattttacaaacaacataatctacaaagaagttctcactgtgcagtccaagaaacgtggttggtgtcagaaagttacaagaggtccaataccaattttttctgtatccgttctagggaaatgaacaattttattgcaattgttgttctaaggttggaagtgaaaatatgtattggcgatcactgtttgagctggtgctgtgggcgatctgacatggagatatgatagatccgcggcatgggcaggcggtggattatgatatgtgctataacagattgagcccatcagactaagtcgaaggatgagttagtagtcgctacacttccattgcacaaattcctggggacaaacatcgatattatcgcattttattcttccattatgtgtattaatgttaggttaaattggggtgcttgatgtgttaccatttctgataaagctggtcagtgtcgtcataaaaaacacaacccccccccccggccgttttagaggtccca

SEQ ID NO: 33739 - DNA, 475 bp, Triticum aestivum
  Clone ID: PAT_TA_33739
gcctgcagtacgtgtcgaagactccgggtccacgggcgagagtgagagtgtgagtgagagagaggtcatgcgcgtggggataaggtagggatagttgtagcgcgtttgccaaaacgcgctatagataatctgaatagcagtagcgctttgcatataaaccgctactgctaagtgtaactatacaaaaatatgtcaatgcaaaaatacattggccatcaatgatctttttgtgtacaatctaaattgtcaatatgagtcctcttcggtaggaaccggagaggactcatattgcagccacaaattttacacatagagttcagtgaagaccaactggttgtgatagtttcagaaataacatatttaaggtggtaaacaccctgttcacggagcgaggtgggactaaacttgtgggctgatcttagcagtagcagttttctactaagcgcgctgctgctaacttccatagcagtagcgc

SEQ ID NO: 33740 - DNA, 524 bp, Triticum aestivum
  Clone ID: PAT_TA_33740
agacgacagaaaggaataggttatccggacttgccatgaaggatgtcgtgagtcttttgtggccgaaaaggcccgagccgaagagttattttggcttggtgaagcagttccgtggtgcggttccgcatatcaatgaaatgaggaggtcggcatgcatagagggtgcgcggatggctcttgcccgtgtcaagacatactgggcggagatgaaggccaccgatgttgcatccccagattcggacggaagctgagtacctatcgagcaatattttcaggaagttctgcagggcgctcgtttaatagagacgcagtgcttgaaggatattatgttcgaataacatgtattattgtgaaacaatgtttcgatgtaatataaaagctttttatacttgtgccttcaagaattaaaatacctcctgtgcggacgttaatgtatatgtgtatataacccgactgatggcagtcttcggcttcagcccccacgcatataatgccgggggtgtatggcaaaatgtgcattttca

SEQ ID NO: 33741 - DNA, 642 bp, Triticum aestivum
  Clone ID: PAT_TA_33741
ggtgtacctcttgggataaaagccccaacaaagtcacaactttaaggccggtgccatgaatgttctgacaagggtgtcggccgtgatgaccaacgctccgatcatgctgaatgtggactgcgacatgtttgccaacaacccgcaggtcgccctacacgcgatgtgcctcctgttggggttcgacgacgagatccacagcgggttcgtccaggcgccacataagttctacggtggcctcaaggatgacccctttggcaaccagatgcaggttataaccaaagaaattggaggtgggctcgccgggatccaaggcacgttctacggcggcacgggctgttttcaccgcaataaggtcatttacggcatgccgcctccggacaccgtcaagcacgagtcaaggtgttcaccatcttacaaggagctgcaagccaagtttgggagctcaaaggagttgatcgaatcatctaacaacatcatcgcctgtgtcctgctcgctaggccaaccgtagatatatcaagtccggtcgaaatggcaaaacaagtaggcgactgcaactatgaggctggcacatgttggggccaagagattgggtgggtctatggatcaatgacagaggacattttgaccgggcaacggatcca

SEQ ID NO: 33742 - DNA, 1063 bp, Triticum aestivum
  Clone ID: PAT_TA_33742
ttttgtagacagtatttttctttatagtaaaaaaaatgtatacagaaaaataaccaaaagaaatatcccaatccaatccaatccaaccaatgctcctaccaggaatgatcgtgcactgatatgacagagaagcaacagtgatcagcccaattagaagatagtgaaaaagaacagaagaactttccgacagttaaaaactttacaagggcgcgaggagtgttgcctcctactactatggaacccgtctcctgccatggctactgctgctgctgctcttgtctatgctcctgaagctgctgcttctcctgctgctgcctcctaccgctgctactctgcttgttgttgtgcatccagaccttgagcgcctgcctccggaccccggcctgcgcgcagaaatgccccaccatcgcctcgtcctgccgctgcagcctccacccgacgcgctccgcgaacgccagcatctgctccttctgctcccgcgtgaacgtcgtcctggaacgcttccgcggcgccggcgacgccccacgccgctcctcgctggaggactcggtcgtcgtgccggtgccgccgctggccgcgaggccgtaggggaacggcaagcgctggtgcgggtgcttgctcgccgccggcgggagcagcaatggtgcgcgcgcgctggcagccagcagcggcaagtgggcgcgcctcggcgaggggtcgcggcggtggaagctgcggtggcagccgcaggccgcgcatgcgagtgggtcttcgggagaggccggcatgaactcgcagcatccgtccaggacgtgcccgcccgcggccgccgcgtggttacggaggcactcgtggtactgccgcctcgcctccgcttgcatgttgtctgccggcccgtttgcggtggcgctgcggtgaggtgccgcgggcggggcgccgtcgcccacgtcgctgccgtccccgtcctcccctcccggccggcccattgcgcgtatagaaatagagcgcgcgcgtgcgcgtgtgcttgtcaaactgcagcacgccaaggctgaccattacgtctttggtggctcgtgccgaattc

SEQ ID NO: 33743 - DNA, 860 bp, Triticum aestivum
  unsure (1)..(860): unsure at all n locations
  Clone ID: PAT_TA_33743
ctctctctacagttgccctcttccccggtcgccggacgacgccttcccgccgccgccgccgctgcagcgtcacagcgagagcggcgtcccccgtaggagggccagcgccgccgacgccgacgccgacgcggggttgagccgccaccgccaggatgcggggcctgacgcgggcgggaaagcgcgccagtgagatggccttcaacgccggcggcggagccatcaactggttccccggccacatggctgccgcctcacgcgccatccgcgaccgcctcaagctcgccgacctcgtcatcgaggtccgcgacgcccgcattccgttatcctcagcaaacgaagaccttcagccggtgcttgcagctaagaggcgtatccttgctctaaacaagaaagatctagcgaatcccaatataatgaatatgtggctcgatcattttcagtcatgtaagcaagattgcatctcattaaatgcacatagcagcaactctattaatcagctgcttgggcttgtggagttgaaactaagggaagcaatcttgaaagagcccacacttcttgttatcggtagttggtgtccccaatgttggaaagtctgcactcattaattccattcatagaattgccaattctagatttccaggtatggccaatataagtatataacagaaactagtttaaagcccacacttttgctgcaggtattattagattgttttagtttggttgctttgaaatatttatgtataaaactttgcatttttaagcaatagagttgcaaagttcaaatgttgttngaagtgcnataacaaattggaaatgctaaatttttggtncattagttttctgggcgacangtttaa

SEQ ID NO: 33744 - DNA, 954 bp, Triticum aestivum
  Clone ID: PAT_TA_33744
cacggttttcgctcaggtgtgaggagcatgagggttttcgggctgctcgctctcgccggcgcggcgctgctgctggccgcggccgtccccgcgagcggcagcgtggcgtcgatcgtcacgcgggacacgttctactccatgctgaggcagggccaccacggcggcggcgacggcgggtgcgacgggggcgccttcttctactcctactacgcgttcgtggaggccgcgagcacgttccgcggcttcggcaccaccggcgaccaggccacccgccgccgggagctcgccgccttcttcgcgcagacctcccacgagaccaccggttactgctgggtgaagcagcggagcccggccggcgatcagtactacgggcgaggccccatgcaactcactcacgagcacaactaccggcgagccggggacgcgctggggctggacctggtgaggaggccggacctggtgtcgaccgaccccgtggtggccttcaagacggccatctggttctggatgacgccgcgacatggggcgcacaagacgccgtcgtgccacgccgtgatgaccggcggctggaggccgtcgcgcagggaccgccgcgccgggaggctccccgggtacggcatgaccaccaacatcatcagcggcgggctggcgtgcggcaagcgccacggcacgccccagggcagggatcgggtcgggtactacaaaaggtgctgccgcctgccccgtgtccggctcggccgcaacgtggcctgcatcaaccagaagccgtacgggcacggtggctgattgattagtcagccagtagtactcattgttgctcgctccagtgcttgcttggtggtgacaagaagaatagatctttgagagtgtgtttttccgtaagacccccccccagtgtgttcttccgtaagagatgatggcgtatggtcatttcgatctggatgtgtgatatca

SEQ ID NO: 33745 - DNA, 1128 bp, Triticum aestivum
  unsure (1)..(1128): unsure at all n locations
  Clone ID: PAT_TA_33745
gntgtgtgcagtggaaaatatagataaataagaattctttgttcttctttcatgttggagagagtgacagtacctacattcctgttagtgggctgtatatattctataacttcttgctgttttctttgttacggtaatttttttgacatttgtaacagcaaaatgatatgtcaagatgctctgtttttatggcacttttagagatttctcctcatattatagatggtgtgcgatatacttcttgacatatccctaggcatcttgacatatccctggacaggttctcatgttcagcgcatccagtttggttgattattttgggaggcttattttggaaaggctttgagaggccgtctgaatcaccaccttgtgttaatagaattatacatagttttgtacagccatttcattttgcatagggctacaaagtacaatcaaacaatctgcagcttagcagtactgtatttcctggattctccaatttggggtttgagcattgaggcgttgaatatgtctatatgaactgtagttatatattacctgctactcgagctggctctctctctctccgacgtcttggtttgcaggccgctgcgtggtgaggtactgactaaggagcgcgaatcgccagcaccacgtaccagatgatgccgtcaaggtcggcgtcatagtgactgtcgatgacttgcagatgattggtgggcagaattaaagagggattacacaagtaaggagatacacctgagcaagcagctagacccatgcggagttttaaaatcaaaacggggcaattctctactgtgacaaagtgaagagaaaactgatgcatcaaattaatacagaaattcagttcatatgaagcagaagaaaggcatgcagtaccttacattgacaatgattgttagcccattgtggtacttcaaatctgataaagaatatattttatgaccgagaaatggcatttggagaatctcagttctaatatctacatgaatcaacttttattttgtcacgctactgaatgttctggtatgggactatctattctgtgtagctcttataagtaataatgaaatgatctatatgtaaagtttcttattttaattatattatgttgttgatgaaaaa

SEQ ID NO: 33746 - DNA, 826 bp, Triticum aestivum
  Clone ID: PAT_TA_33746
cgtcgctcaggaggagaacacgaaggcgccggccatggcgtgctttcagacgcgtccaagtgctgctgttgtggtcgtcatcaccatgtttctgctccaagcttgctatgaaggtagtcaagcatcagcgtcttcctcgctgcagctgcagctgcctcggcatcagatgcgcaagatgctcagcgtcagtgcaccttccatgtcatcgagcggcggaggagggcgctcgacggagccgttggagctggaggagtgctcaaaggatctcctggaggtgttccagatcaacgcgccgagcatggcgggcggcataccggcctacagcgtggagttcaccaacacatgcatggaatgtctcgtgtgcgacgtccatgtcgcatgcggcgacttcgcctcaaatgatgtcatcgacccagccaagttccgccgcctcggcatcaacgactgcctcgtcaacgacggcaagtccattgagcccagcttccccgtgtccttccagtacggcaactcctttccctacccgatgacagtcgcgtccgcctcctgtgactgtaactagctatggctagggtatcggtgacggatatagctatctattcttgtcatgaataaaatcaagtagatctcgacgggcggctggtggtcggatcttactttcggagctactgttatctatcaatgtaatggcgctgaggaatatttgaaccgagtccaatgaaaattatcgtcgctatgacaaatgtttggtgcttttcatgtctattaacatttttaagttctctactttgagatccccccttgcccttttttaccccccccccccccc

SEQ ID NO: 33747 - DNA, 987 bp, Triticum aestivum
  unsure (1)..(987): unsure at all n locations
  Clone ID: PAT_TA_33747
cngagttccatcgagnagcttggccatgaaaaggatcagaagacgatcatcgtgtgctcggtcgtcggctccctcggggtgctgagtgccatcctggggttctctgccgagggcaccaagctcaccgtttcggacttgtacgtggatggaggggtgtgcctgtacccgcagaaccccgcgctcgggctcggggtctgcgccgccatcttcctcatcgtggcccagatcgccttcgcggtcgtcggcggctgctgcggctgctgcaggtcccgcgccatcccctccgagagcaaccggatcatcggcgtcgtctgcgccgtcttctcatggatcatggcgataatcgcgttctcgctgctggtgacgggcgcggcgtggaacaccaccgggacgcgggacccgtcgccgttcgggctgtgctacgtcctcaaggacggcatcttcgccggcggcgccgtgctcacgctcgtcgccacggccctcgggctcacctcctacgtcatgctccgcgggcagccggccaccgccgcgcccaaggaaggcgagcagatgccggcgggcgccgccgtgatcagcatggggcagccgcagttccagcagcagcctccgcaggggcaggggtacggccaagcgccgaaccctcactacgcccctcctccggcacaaggacaaggctatggagcgcacacagccaaccagcagcagcagcagcagcagctacccccgcctcctggacgaggctacgggcagtaccctcctcctaaaggacacgaacaggtgtgacgcgcgccgttcgatcaaatcatgcatctcgatcgtgatatactccgtgatttctaccgttttgtggatgtcacgcgtgtctcgctcgacctcaccggaggccctatattcttcagttacttttagaggatcagtcatgcttgtttgctgctttacgtttgcaatcgagatctctcctatgttcttcagagagtcagcaatgct

SEQ ID NO: 33748 - DNA, 1109 bp, Triticum aestivum
  Clone ID: PAT_TA_33748
cgagcgtcaaccgtgagaagaggccgtgaaaatggatcggaacatgatcatcatgtgctcggtcgtcggctctcgcgggctccggcgtcggatcccgggcgttgcagcctagggcaccgggctcactgtcccagggtaggacgtggacggtggcggatgcgtgtgtccgtagaggccggtgcctgggctcggggtgtgcggcgcccgcgccgtgggtctgcgcggcaaacctctcgtcggcgggccggctggcggctgctgcggctgctgcatgtcccgcgccatcccctccgcgggccaaccggtctgagccgcgccggtctaccgcgtcttcttgctcgatcatctgatggtatatgggtttgctcgcgttcgggctgctggtggcgggcgcggcgtagacgaccaccgggacgcgggagcgttcaccattcgggcagttctacgtcctccaggacggcacctgcgccggcggcgccgcgctggccccggtcgccacggccctcgggctcacctcctacgtcatgctcccggggcagcaggccactgccgccgccgcgccaaaggaaggcgagcagatgccgccccgcgccgcagggacgacgacggggcagccgcagttcccgcagcagcctcccccaggggcaggcgccacccaactacccgcagcactctccgccgccccacggggcaggggtacggccaagcgccgaaccctcactacgcgcctcctccgggaggcaggacaaggctatcggagcgcacgcagccccaaccagcagcagcagcagcatgctatcccccgcctcatcggaatagggaactgctcagtaacctttaccccttaagtgaatgcaaccaggggttccccccacctctccggaggacctatattcttcagttacgtgtagtggaccagtgatgcctgtcgtctgtgtgacggttgcgtgtgtgtcctctcctactatcttcaggcactaaataatgcacgtacttttagaggatcagtcatgcttgtttgctgctttacgtttgcaattgagctcgcgccgattcccgcccgagagtcagcaacgctaaaactaatgcttgctgtgccatcgtgttta

SEQ ID NO: 33749 - DNA, 910 bp, Triticum aestivum
  Clone ID: PAT_TA_33749
ttcgagcggccgcccgggcaggtgcgtaggcgagcttcaatctggctctctctccccgttcctcttttgagagtcgaccagggttgcccggcccgatccaacgcctcgtccgacggcgctgccggccggcgatggatatggagaggagctcgggtcttccttgtgtatattagggcagcagtagttttagtttgtcttggcttcatgccgtggtctggcgttatgccgtggggatgcaaaccactggagctctcgagcggcgtctggtggtggcctccgtcgttttctttcttgccaccatggtggtggaaagtggaagacgccggatctggcaagatccccttgaataagctcgttctggtgttgtggtgttccctgatctggagggcatccaactgctactgcttgttttctcaggctaccatggtggtggatgagaagcaggatagttgcagaatcctgaagtttataggtcgagttcgagcatatcagcagaggtccctttggtggagcgacggcgcccatcgatggctgccggtcttcgtaggtgccctgtttcttctagccgaatggcggctgactatattcctcccggcttgcgtgcctgatgggaggcagttccagtggcggctcggaggctatggcgagcaggtgatgcttccatggcgatttcgtcgtgccaagtggttcgtccccggcgacggcgaggttcaatctgggcggcggctgtcaaggacccgatcgcgtttcttgctttcagtctggggtcctccttgtaaaagtcagggacttaatgtaatgttcctttctattttggtcctgttgtaatatgtactgccgtgtttatccaatgaagcctgggtccttcaagacccactttctgttcaaaaaaaaaaaaaaaacgccccta

SEQ ID NO: 33750 - DNA, 722 bp, Triticum aestivum
  Clone ID: PAT_TA_33750
ggcccggtcgaggccgcgccgggctctccattacacccatccccacccatccaccgaggcgcagacaggggagaagaagaagaagcggaggaggaggaagatgccttgcctgaacgtgtcgacgaacgtgaacctggagggggtggacacctccgccgtcctcgccgacgcctccagcaccgtcgcaaccatcatcggcaagccggagaactatgtgatggttgttctcaagggttcagtgcccatggcgttcggaggtacccaggagcctgcagcctacggtgagctggtttccatcggagggctgaaccctgatgtgaacaagaagctgagtgccggcattgcttccatcctggagtcaaagctgtccatccccaagtcccgcttctacctcaagttccatgattcaaagcgctcggactttgggtggaacggatcgaccttttagacgcctcatatggcgtggagtcctgtatgaacttcagagttcctaatattctgtccattgcctatttaaggagaaaccgctgcagtaagacgtcatgtcagtttaatggccagtgtttatgagtgctggagtacttgtgtgatctagttggtttggtttcggacttgccatggcaaggaaatgttgcaactgctcggttcgattcgtaatcatgaatcctttctggtgtccaaaaaaaaaaaaaaaaaaaaaataggcccttaagggcctcgag

SEQ ID NO: 33751 - DNA, 945 bp, Triticum aestivum
  Clone ID: PAT_TA_33751
caccgatgcaccggaggcggtggaggacacctggcaggggctgggggacaggcaggggacaagaagcaggagggggggggagggggaagaggagcggcgggaaaggacggagcgggacgtgaacgtgttgccggaaggtgacctcgaacggtgaagcctgcgccggggtggacgcctcccgccgtactcgccgacgcctccagcaccgtcgcaaccatcatcggcaagccggaggcctatgtgatggttgttctcaagggttcagtgcccatggcattccgaggtacccaggagcctgcagcctacggcgagctggtttccatcggagggctgaacgctgatgtgaacaatgaagctgagcgcccggcattgcttccatcctggagtcaaagctgtccatccccaaagtcccgcttctacctcaagttccatcgattcaaagcgctcagactttgggatggaatggatccacctttttaagacgcatcatatggcatggagccttgcatgaactccagagttcctaatattctgtccattgcctatttaaggagaaactgctgcagtaagacatcgtgtcagtttaatggccagtgtttatgagtgccggagtacttgtgtgatctagttggtttggtttcggacttgccatggcaagggaatgttgcaactgcttggttcgattcgtaatcatgaaccctttgtggtgtccaaaaaaaaaaaaaaaaaaaaaaaacttgaggggggggcccgtcccatttcccctatatgagtctattaccattcatggccgcgtttccacctctggcttggaaaccttgcgttcccacttattgccttgcgccttccccttcccactgggtattaccaaaggcccccgtccccttccaacttgccccctgatgcattggaatgtaccttattttgtaatttccttattttgta

SEQ ID NO: 33752 - DNA, 416 bp, Triticum aestivum
  Clone ID: PAT_TA_33752
gggtccacggagctggaggggaaggtgatgcgtgcgacagcgaccatgccggcaggcagggcagggttgaccgtggccatcatgatgtttccaagggagagcgaggcatccgccatcgcgtagctaaagaagtcgatgccccgggagaggttggccaccgttgccggtgtgaaagggccagatgagttcacttgtgtgttttacagtcttcagaattggagggtgagatgctacagcagtacagctgcaagttcccttgcttatccgtgaggctatatttcagaggtttgactgtgaccgaatttattcacaaagaagctaggcggtacttgtcagtatgcttgactaacaaatagcattatgatctggttttgttctctataccttattagttcatggatgtaacggctccatat

SEQ ID NO: 33753 - DNA, 1353 bp, Triticum aestivum
  unsure (1)..(1353): unsure at all n locations
  Clone ID: PAT_TA_33753
cttccgacatgccgcagtggaaggtgctccatggctgttttcgtgtcatcgggtacatttgatgggggccaaggcttccaagctggcgaggcttgtggaggacattgtggagagtgtcgccaaatgtgggtctgtccggctgtcactactggtggattgcggtgctggtacacggagatcaacgggaaggtggcaatcgccgggacccacttgagcctcatgcaggaggacatgtacgtactaacataaacaagatggcagataagttatctgctcttcagctcaaagtgacggaggtgaatgtgttgttcaccatgaagcagaatcactcctccaaagacctgctaggacagcaaggacaagtgcacgatggtgcaccgaagcatcacggtgaacatggtaatgtcaggttgttgatggagcgatacaaattggtttgaaggccgggtaccacgcctccgccaatatcgcgcgcanacattgttgagtactgatggtgtcaaagttggaccgtagctagcttgatttggagacatttcctgttaggacttaaactttggcttggaggcattgagctttcgctctaactagctttgttacttggtatacctccgtcagcgttcaggagccgggtagttgtggagcgggtcgtgcgagagacggtcggcgagcacaggctggaggggaaggtgatgcgtgcgacagcgaccatgccggcaggcagggcagggttgaccgtggccatcatgatgtttccaagggagagcgaggcatccgccatcgcgtagctaaagaagtcgatgccccgggagaggttggccaccgttgccggtgtgaaaggtgatagacctaaaggccggtgacaggttcgccgccgtcgcaccttctttgaacttggtggggacgtggaaggagagcggtggcgtcgtgaatagctcgacgcctgctgtcgcgaccacgaccgtggtcatgaccattgtgttggtaataaagataataattgtttacatatccctcagctttggaaacattagataaatatccaacttattattgaaaaatattgattcaagataaatggaacctttcctatatacaatgagcttcggaaacattagatacatatccaacttattattaaaacttttgattcaagataaatggaacctttcccatacgccgaatgagttcacttgtgtgttttacagtcttcagaattggagggtgagatgctacagcagtacagctgcaaattcccttgcttatccgtgaggcgatatttcaaaagtttgactgtgaccgaatttattcatagagaagctaagcggtacttgtcagtatgcttgactaaca

SEQ ID NO: 33754 - DNA, 705 bp, Triticum aestivum
  Clone ID: PAT_TA_33754
cttttccagtgggacgaaacaggaaacaggaaccagtccacatagccaatattcccacgatcatatcagaggcacgcgtaatatccaaacgaggatactctgcaccgcaaggcgcgcatctaggtacacatttctacttctagttatctacacgtgggcataatcattgtgataccatccataacttcactagaagactattcccgcatgattgccataagcaggcaattataggcaagtagatcttccccgtacactcctggccagggaagtggtcgagggtcaccgggccgagattcccccattagaacttggttaacaacttctttgaggccgggccatgtgattcatcaagcggtttgtggggtattctgaacacctttcgaagggcaacaagctgcgagtcgattagactttccagctcgttatcttcatcaaggttgcctgtgaattccatggctgtactgcacagcgttctctggacctcgcagaccaagtactgaacatacaaggcatcggaattgttaaaacgctgcctcctccgcatgaaacgctagctgaccttttcacaactctgaattgttaaaacgctgcctcctccgcactgaacctctagaccctttttcacaactgacatctggatcttcatcaaattcttctcttctgtgtagcaatcgcttccaatgtagaggggtgtttctaatt

SEQ ID NO: 33755 - DNA, 946 bp, Triticum aestivum
  Clone ID: PAT_TA_33755
tccctgcccggcatgccgcggccgagtgtcgaccagatacctggtccagaatccagatacccacctttcttcttcctctgcaagccggggcagattcacccactctgtacagcagtattccctcgccccccgccgaaagcgcgagcgaatcgccctcggtaagcgagcgcgacagcccgacgctggccgccctgtacagcatgaaggaggccgccctgctcgacaccgacggcaacttttatgatgtgaccgcgtatttggatgaccatcctgggggtgctgatgtgctgcttgccgtgactggtatggatggcaccgaggaatttgaagatgcgggccacagcaaggatgccaaggagttgatgaaagattacttcattggggagttggacttggacgaaacacctgacatgcctgagatggaggttttcacggaaagagcagggacaaggacttcgccagcaagctggcggcttacgcgtgtgcagtactgggccattccggtagccgcagttgggatatcagccgtgcttgctatattgtatgctcgaaggaagtgatgatcggttatagtttgattgaaggaccattttggggttaccaagacatttgaagatggttatggatgtagagaatatgtttatagctggttatggatggagagattatgtacttctgtccaaaggcggagacactgtattagcccttaggtacttgagtcaaatatttgtccacaaaattggtggtactattttatcaatatgtcattctatggatggattcatttcaagacctgaaccatgtgtgtgatgtaaaccctcttacaccttgaggcagctgcttggcacagatttcttccatgccattactgcttctatatttcttgttttcgtgggtgcgccacagtaatgctatatttgaatattgtgatttttccaaaaaaaaa

SEQ ID NO: 33756 - DNA, 653 bp, Triticum aestivum
  unsure (1)..(653): unsure at all n locations
  Clone ID: PAT_TA_33756
ggcgggggggggggggtggaaactaaatcatacacagagaatttgaacttgcagttgctgctatgtgtaccgattccatgtgttgtgcgtgctcattgcctgcgtggtgtgcttcatcctcaacctgcaggtgtccttcctnctantgaggagggggggggggggggnncttncccattnnangcattattcctgggcgctgctggcatcattgctgatgcttaccttcctccctcttgggcacatgagatgattcatcaacatcttctttgtgtctccatgaaagctctctctttttctcacatatctggttgatcatccatggactgccaaactgctaacaccttcactggagtttgcctggaggtgcaggagcatggacatgcacggtttcgcatgttgaacttctagcaatctcacgcctctgcaagccatagagcagctgagaggagggaccaccggccactatgtgttgtgacgttgggctgccagagctgtgcatggagaggctcaacggtgagtgcacaggagcggtggaagaacagttacggcctctggcggtgcctagagctagcacgaggtgccttggcttcttcgaccgatgctcagttggcgtatgccaacagtagaacttcctggcctttgaaactcgt

SEQ ID NO: 33757 - DNA, 924 bp, Triticum aestivum
  unsure (1)..(924): unsure at all n locations
  Clone ID: PAT_TA_33757
aaggaatattgttctcgggaaaaggagggaaggttgcgtgagagcaagcaatggccttcgctgacgcaggagcacggaggctcctgcgcggcgcaggcggcggtgttgctcgaggaatcgccgcccacccccgtcggcatgagcttcggcctcgacggcttgtggcagcttcatcgccggcctgttcgcgagcgtggctcacctgctcgtcctgccgttcgaggtgctcgggcactggctgcaggcggccgtcgccgccgtggcccacctggtcgtcctgccgttcccggccgtccggcacttgctgcagtccgccgccgccggcgtgagcttctgcttcgacagcctcgtcgccgcgcttgggagcgcggcccacgctctggtggtgccgttcgaggcgctctggcacctgctgcagtccgccgtcgctggcgtgagcttctgcttcgacaacctcgtcgccgcgctcgggagcgcggcccacgctctggcggtgccgttcgaaacgctctggcagtggatccaggccgcacccgcgagcatcagtttcggcttccacggtctggggcagctcatacacggctgcttcgacagcctcgtcgcggcgctcgggagcgcggcccacgcactggcggtgccgtttgaagcggtctggcagtggctgcaggccgccgccgcgggcgtcagttccggcttcgacgtcttctgggagcacatgcagggcatcttcgccggcgttcccgccgcgctggccagcgctgcccacagcctcgtcctcccattagagtctttctggcgggtgggtgcacaactccatcgccggcatcagccctcgatctggacggcttctggccgctcgtccagcgcttcgtcgacacggccgcgagcaaggcccacgagctcgtcccggccttgnaggcgttc

SEQ ID NO: 33758 - DNA, 854 bp, Triticum aestivum
  Clone ID: PAT_TA_33758
tccgaccctatgttcggcaatagagaaacatgctttggccttggctattgctccgacaggtgttaatacttcaacaactagcacagctacaatgcaagatataggatttgatccaaccggatgggaacttgctcttgtcacaacctcgagtagcaacaccaattcactggctgtggatagtaatttgggcggtggattcgacaaactcacattggacagcttgtacgacgatggaacctacaggcagatgcagcaacagttgccatacggttcagtacctcacaatcccttcatggcgagtgacccattcgcggtgtcgaatcaagtagcttccccgccatcggttcaaatggccgccatggcacagcagccccagcagatgcaaccaaatcccttcggaccaccgtcacacccacagcctgtgccaaacccattcctcgatgccggcttcggccctttcccggcagcaaatggaaatggaatgcacgcacaggccaacccgttcggaaccgcccaactcctatagcttcacaccatacagtcacagttacatacacgttgcgcaatgccaacccagattccagagctacatactgcgtgttgagaagttcaatctccttgcgtcacaaatgtcaatgccagctttgtcccgccatatctcgggcgttggctgcttgatcaattcttgtatagcctgtgcttattaaattttggtgtatattttttcaccgctttgacggttatggaagaccctctttgtaaaggatttcgttattgctgatgcagcatcacatgccaatgaaaacgtatatggggataaaagaaaaaaaaaaaaaaaaaaaaaaaaaaaaaaa

SEQ ID NO: 33759 - DNA, 861 bp, Triticum aestivum
  unsure (1)..(861): unsure at all n locations
  Clone ID: PAT_TA_33759
tccggnacggattctttcagnatttagcaaggtttttaagttcaagtttgtccatttgggaggtgatgaagtcgatacaagttgctggactaccacaccacgcattaaatcatggttggttcaacatggtatgaatgagtctgatgcctacagatattttgtcctaaaggctcaaaagattgcaatttcacatggctacgagattattaactgggaagaaacgtttaacaactttggagacaagttggaccgcaaaacggtggtgcataactggcttggaggtggagttgcagagaaagtggtttctgctggtctgagatgcattgtcagcaaccaggataagtggtacctagatcacctggatgctacatgggaaggattctatatgaatgaaccattgacaaatatctacaacccagagcaacagaagttgattcttggcggagaagtatgcatgtggggagaacacatagatgcatctgacattcaacaaaccatttggcctcgtgctgcagcagctgcagagcggctatggactcccgttgagaagctcgcgaaggacacaacggcggtcactgcaagattggcacacttcaggtgcttgctgaatgagagaggggtcgctgcagcgccgctggctggatatggccgcacagctccgtcggaaccaggatcctgtgtaaggcagtaggacattcataatgggggtaaataccattcatacaggaataaacatcagccgaggcatccttttttcaccgttctgggcaatgaagcccggacaaatgtactgattcaggatgttctgtgatgcaaggggatgtttcaatgatattgcgtcctctttcnaacgtggtaaaa

SEQ ID NO: 33760 - DNA, 889 bp, Triticum aestivum
  unsure (1)..(889): unsure at all n locations
  Clone ID: PAT_TA_33760
gccggcccgaccctccctcgtctcgcccaggccgacctaaagccgtccattccgtcgtctccatgctctagggacaacgagcacgcggggcctaccgcctacgtctccacccccaccgccggccgcatctcagagaatttcgaggatgtcgactccttcaaggaagaggctgatgagggacttcaagcggctgatgcaggaccctcctgcgggcataagcggggcgccgcaggacaacaacataatgctgtggaatgctgtgatttttggccctgacgatagcccgtgggacggaggtacgtttaagctgactctccagttcaatgaagaatatcctaataagccaccaacagttcggtttatttctcggatgtttcaccctaacatttatgctgatggaagcatatgcttagatattctacagaatcagtggagcccaatatatgatgtagctgctatacttacatctatccagtcgctgctgtgtgatcctaacccgaattcgcctgctaactcagaagctgcccgcatgttcagtgagaacaagcgagagtacaaccgcaaagtgcgggagattgttgagcagagctggacggcagactaataagctgagctcaccatgcgttctcatgcggtttctgtaccaaaatgtttgtaactaaaatggctgaactccgtcgttaccacctgaaacagcaacttgctttgttgcatcatttggctggacggctggagattgctctgtcatggcctgtgcctatactgtctgtatcttgaacacaaacattttgtaacgtcttgtgtgggtttgtaatgttctagtatcatatcatattgattctgaactcgggcacatatcttcactcactaaaaaaccccaggggggggn

SEQ ID NO: 33761 - DNA, 582 bp, Triticum aestivum
  Clone ID: PAT_TA_33761
tttttgctcagagagtgtgaccttttcttgagagaatattgttctggatacaatagagtactttttaaaatatgaacaagaataaagcaattgacacaaacaatctcatttgggacgatatacagtggccaagccctggtgcacggtcagctgaacagaagggccataggccatgaaatattgatcctggttcatgccgtacgttccttctcctctggcaaccacctcgccgtccacgtctacgatgccgccccttttcggatcctccacgagctgccccggcgataaccgaaaggatttcaccttgaggtacgtaacatgtggcgatttcacgtagctcccatcgctcatcttcagcagcagagccaaaagatcagccttcggacagtctttcagtatcaccgcgtccatgtagccatctgagaacttggcttcaggagctgccatggcgttctcggcagcccatggcacgttgtagacgcacacacccacaaacgggccatcgatggatctccagtctgaaccttgaaactcggccctaggaccttgataagagcacacccgagactcgccgttttgctc

SEQ ID NO: 33762 - DNA, 1561 bp, Triticum aestivum
  Clone ID: PAT_TA_33762
cccactcagcactccattccattgtccaacttccatccatttcccagatgacacaatccgccgagtgaaaccctaaccccggaacctcggatcgatcagacacagctccgccgcagcaatggccgccatcttctccgcctccggtcaccgcctgctctccaccgccgctgcggctgccgagttccccgtcccgatggcccgcatccgcaacctcgcccgcgcgggccgcctcgacgacatcgacgccgccgtcgcgccgctcgtgccgaccaaccccaaagctgtgatctccgccctctccgtggtcggcctctccgaccgggcctccgccatcctctccaccatcccgtcgcccaccgccgagcatctcaatgccctcctcgccccgctcctccgccgccgccgcctcgccgagcgcgtgcctgctctgttggacgcgcacccctcagcgccgcgcgacgcctttacgtggtccatcctcgccaagtccctctgcatcaacgaacgcgccgaccgcgcggtgtacctcctccacggggaggagccgccttccctccatctctacacggacatcatcgactcctactacaagcaaaagaagccccacagcgccgaggagctgtggcgcgagatggtcgaggaacgcggcatagcgcctgacgctgccgcttacaacgtcaggatcacctacaagtcggcaaccggcacggtggaggaggtgcaggagcttatccgagccatgggcgaggactcggggctgcggccggatgtcatctcctacaatgggctgatccgggtgctggggcggcacaagagggtggacgaggccctggaggtatacaggagcttgcaagagaagggggcggaggggaacactgaggcgaagtcggcaccggagtgcgcaacatacgcatgcatggtgggggcgctgtgcagcgaggggaggttgtcagaggcggagcacgggttctacgagggggtaaagcgcaagaaggtggcagatctgggcacggtgcgtaagctggtagtggctctcaaggaggctggcaagggtcgggcggcgaggcgggtggtggtcgggctacgcaagaagttccctgaccagttcgacggtccatggaaggagcttgagaaggatgccggcctcacaccgggtgccagcaacgaagaggaggaagtggaggaggacgagcagcagccagagaagacggcggcggcggcatgagcattccgggcaacatctggaggtgaccattttgtacttgtttgatgaatcgtgaggcagtatgccggtttaataagtaaatttttctgaggttacaatagacactcatacatagtttttggatgcggtgcctcgcggcagcaacgatccatagcctatatttgtgtacctgttgtccaactgccgacttgctactgaatgccagggccttttagacgaagtgcattcctatattggtagttgaatttacacggctcatgatggatttgctttcgctgatgagtgaccttatccataccagtaaaaaaaaaaaaagtcgacgcggccgcgaattcg

SEQ ID NO: 33763 - DNA, 1406 bp, Triticum aestivum
  Clone ID: PAT_TA_33763
ccaccgcacagggagacaccttatcatattgcgagactgggaccgcgtcccgattgcggctcggggcctcgacttctcacggctacgctcgctgacagtgtttggaaagtgggaatcattcttcgtctccaaaagtatgaggctgcttcgggtgcttgatctggaggacgcactgggtgtaaaggatgaagatcttgagaagatggtgaagcggctgcgtcgcctgaagtttctctctttacgaggatgcggtgagatattccatctgccaagctcgctcggcgatctcaggcagctccagactctgggatgtgaggcacacctccatactcaaactgccagcgagcatcacaaggctacagaagctgcagtacatccgcgccggcaccaccgcccgagaatcagcaccgcctgcctcatccagcaggctgccaaagttccacagacgccgcggcctgtttggtatcaaggtgcccaagggatcggaaaactgacggcgctgcacacgctcggcgtcgtcgacgtcggtgcttcgggagggaaggctgtagtggaagagctcaggaaactcacccagctgcgcaagctcggagtgtctggcatcaacaggcataacagcaaggacttcttctctgcaacctcaggccttgtgcatctggaatccttgctggtgcggctgggcaaggacagccaaggctgcctggacgaaatcaccctgccttgggagaacctgcggagcctcacactccacgggcttcaagacaagctgccaccatcaaagaacctcaggaagctcatgaagctggatctggagatggacgccttaaaggaagacgacatcaagttcctagccaacctaccggagctatgcatcctgcgtctccgggtcggacagcttcaggatggtaagctccattttcacgccgagatgtacggggaggagctggtcaccttcaagaaggtgaagatcctcgagatcgcctccggcgccagcgagctgcacgtgaccttcgggtcgaggtcgatgaagagcctcgagctgctgaagatcgactgctccagcgcgtcgtaccatctcacgggcctgaactttctgtccgagctcaaggaggtcttgctccagggtaccaatgatgaggcgatcaagagcaacttggagacccagcttgcaaaccatcccaaggcgcctaccgtgaagctggaggaactgccgcgttcatcctgaagggtcgacgccatctctgtttatttcacttgtttctgcttaccgtgagctctgatcccgtcgctgcaatcagtccttcagcttgtttacctttggttttttgtgcatcagtactgttgttgaaatctttacttttttttttgtgaaacggatgttgttgaaatcttgactgttacaagtt

SEQ ID NO: 33764 - DNA, 1211 bp, Triticum aestivum
  Clone ID: PAT_TA_33764
cgtccgcagggcttcagggttcaggcgaggtgcgacctacccgggacgacgtccgcctctccccttcgtctccgccgccggccagatctctttccgccccttctccggtgacccgctcggcgagacgaccggtcacaggatgcagtctttggcgcggacagtctgtcgagccggaacccgtggcaatcctctgaagctcatggattgcgcagctcctagagttgaacagtccttcgcggaacccctgaggtcttgcagctggattcgtcaaattgtgagtccgatcattccacgcgacggtgttcaggcatatggtttctgcacgagggctttggcggcgagggggttctcgacagtggggactgccgaggtttctgttgaggatgaagattccagctctcccatggttgagcacccgccgcgcattaagttcaagaggcctgacaagacggccaggcacattatgaatatcttgaacaaagaggcagtcgacaaagttcgtacagagaggaccattcctgatgtacagcctggatgtattgttcaaatgagagtgcaagttcctgagaacaagcgacgtgagtctacattgaaaggcatcgtcatagcaaggcgcaatgctgggatcgctacgactttcagattgcgtagattagtagctggcgttggtgttgagtctgtctttccactgtactcgccaaacatcaaagaaatcaagatcttagacaggaagaaagtcaggagagcaaagctgtattacctgagggacagaatgaatgcactgaagaaatgagacagcatcggcttggttgttgccattttgtttctgatgtggatctgcatggctttcctagtggctgcaattcgagaagcccgatgcttactcccagctcctagaactactgtttcgggtcaccatgcctggtttctggggcaagcgccagcagaaatacgcttatgtgatttgaaattaacaatgtggatctgtctccttttatgtttttagcaactagtgtaatgagaaagaaataaaaatgctctccttttctctaacttattgcttaagttggagaagcttgcacaaattttgttctaccgttggaccattccttgctgctatcaagatggttgtgttgcacacaactcaaagtagccttttatcatgaaattttcatgtataactttgatggactgtttgtaatgcaagaaat

SEQ ID NO: 33765 - DNA, 785 bp, Triticum aestivum
  Clone ID: PAT_TA_33765
ggaaaaagaaaaaaactgctgctgaccagccaccagtacaccacagattcagaggaggcaatcttcagctgcactcctctccatgagacccatcacccatggccatggccataagaccacggtgagctgagctgatagtgccaagccaaacccctccacagtccacaccctctcctcctcccgacaagcacagaactcgtcttttcctttctcccctccctcttttcccctcacctcacctcactgtgcggcgtggccactgccagtacaatccgctcactctttattcccccggccgcccttgtctcgttgcgtgtccctcctgcggttatggatcaagaaacctcacgagaaccccgccgcttcagccgtatgttgccgcattagtaggggcccagccctcgccggatcgtttctcgcgatcgcattgcatgcgctcttcctgatcttcgacgcggattggtttcatttccgtcgcgttgccggcggcgggattcggggcggcggcattttggctggtcgagggagaagagggacaatggtcggcggcggcgcacagtcggcgagcgccgcggaggtcgaagacatcgagctcggcgagcggcggcgcgcggacgagttcgtggacgacgacgaggagggcagccagtacttcacggacgcggaggaccggtcgtggccctcgcactcgcgccaagagtccgccgccttcgaggactgcatctcgcggtgcgcctccacccgcgccagctcctgcggcggcgccgacagcgacgcggacatcg

SEQ ID NO: 33766 - DNA, 687 bp, Triticum aestivum
  Clone ID: PAT_TA_33766
cgcggaggcccgaagaggagagaccgaaaggggagaccagcagaggcgagaggccgagaggggcgaggagagggcaacgccggcgtcatgaggcgactagaggagagcaccgtccccgacagcgccctcgatctctgtaatgaaactgaaatcctgctctacctgcaagcacacgcggattgccacaccctcctgtttgcttgctagaattgtcagcacaaagggattcctactgaaagttgcgtgtaaaaaaggagtcttcggaaatctgctgacgaacctaaggacaccttaaaagaaccagctggtgtcgcgtgtctcccctgcaccagaagtgttaactgctacaactgtgggcctccagaaactgcttatttgcagccgcccacgaagtgacaccttgtgcaggcgctgtacttcatacacgggggacctacctacggacagaggtggagggactgggtgactgaccaggggggaccccttgttagaacggagtgttagttctttgaactgaatcttttctggccctgtgttgctcatgacttgcgtttgtcttaaactgttagcttgttgtatctgtgttccgaagtttagggcaacttcatcactgtgggcttactgcttctgagcttgttctcttcaatctatatatatgcagatgttggtttgaccttgaaaaaaaaa

SEQ ID NO: 33767 - DNA, 525 bp, Triticum aestivum
  Clone ID: PAT_TA_33767
cccagcgtccgccccaccggcggcaggctgtgctggccggccatggcagctcgtcggccaatcgccgcacacagaatccacctcactttttccaccctcaggggttcatcaagctcctgctcctctgccaatcactagcaccacaccagtgcccccccccccccccccccccgcgctgctgctaccacgacgtagtgcaagctccaggacaagaggtgttggaaccggcagagggcggtgctgcgaccgttgtcatctaaagctggaatcaagaggtgcggctcctgcaagccccggccgcggtgctggaacgacggctatgtcgtgctacgacgggcagacgagatgctggaaccggccttggcgggagctacaatcagcggccttttttgctacaacggttcttttgttttgctggaattagcgaccttttttgctaggatctgtaatttgagatgttttttgctggaactatctctaatttttgctaccaccgtctatgatttttgctaccactggcctttt

SEQ ID NO: 33768 - DNA, 708 bp, Triticum aestivum
  Clone ID: PAT_TA_33768
gcttcacaagccaatacacacaccaatagtctcctttccagagctagctagcatcaatggcttctggtgctcagaagaagaggttgccgtcggcatggtgctggccatcctgttcatctctgcagctaatgcagaaccagcgcctgcagaaacttgcatcgacaagaccgaaaaagttggtcttgtcactgactgcatctgctccaagaactgtgcttgtgcaggaaagtgcatcttagaaggcggcgatggtggcgaaatccagaagtgctttgtcgaatgcgtgctgaaaaacgactgcaactgcaatgctaagcaccacagcgccgcagcccctcagtaaggagactcgtgattggagcttcttcagccatgctatgaggtctgcgtccacaagtccacagttaacatttgagtaaatttgtcatcgtgactaataatgttttatactaaataaacctctgatacgtacgttcttggcatgcgcttattgcttggagcgtatgtatgttgagaattggtttccgggtcacagctcatatatatatgcgcttattacttggagcgtatgtattgctgaaaaatgaatatgcatgtgtatttgtctgtttcgtcatttgggtcattgtaaaaataagttgtatgctggcgcatgacaacaagtgtatttggctactataatattattaataatatgatgtcttgttt

SEQ ID NO: 33769 - DNA, 872 bp, Triticum aestivum
  Clone ID: PAT_TA_33769
caattcactcaagccaatccacccaccaatagtctcctttccagattcacctaccaataatcgcttctggtgagcagaagatgctggatgtcgccagcatgatgggcttcttgttcttcaatgcagctggttgtggacgaaccaaggctggccatcatcttgaatgctgcaagacaggcagagttgggcgtctcaagaaacttccattgactagaaagaaaaaggttgtcttgccgcaaattgaacttgctccaggaggtgtgtgtttgcagaatagtgaatcttctttaggcggcgagggttggcgaaaaacagaagtgctttgcactacttgcggtgctgaaaattgactgcaacctcgcattagcgtaagctccacattgtcgcccgcagtccccgtcaagctaatgggagactccctagcaatttggagacttcttacatccacgttaatttgatggtcctggagtccaatcaatgtccaccaagtctaacattttagagcttaaatttaatgtcaaacctctttataccttggcgttcttcgggcgatgcgctttatttgcttggcagcgaatgtatgttgagagttggtttcccggtcacagcggtcacagcggtcacagctcatatatatgctgccagtcacgtgtacgatgacttgccacatgtattgctggaaatgaatatgtatgtgtatttgtccttttcatcatttgggtcattttaaaaataagttgtatgctggagcatgacaacaagtgtatttggctactataatattattaatgatatgatgtcttgtttaaactgaaaaaaaaaaaaaaaaactcgagacctcggccgcgaccacgctaatcactagtgaattc

SEQ ID NO: 33770 - DNA, 688 bp, Triticum aestivum
  unsure (1)..(688): unsure at all n locations
  Clone ID: PAT_TA_33770
ccacctcctccctcgnatccctgcgccngacaccagatctcgccgccgccgccccacgacctgtgttgccgtcgccactcctccgccgtcgatgcactccctccccatggcatgtgcgctccctcccctgccagcgcgctccctccctgcggccggcgcgctccctccccgcggctggcacgctcactccccggccggcgcgctccctccccgcggctggcacgctcactccccggccggcgcgctccctccccgcggtcggtacgctccctccccagcccgcgcgctccctccctgcggccggcgagctccctcccggacggcgcgctccctcctcgcggccggcgcgcgcctaccaattctcctttgcgaccggcgtggtccctccccgctgcagcccgcacctcctccatagatggcctgcaccggccgctatagcccatcgaggtggtggccgtcttcctcgaccccgatccacatctgcctgggcttctatggctgacctgcccaatcgccgacggattccttctccaaacagtacaatggccactcccgctctgcctccgacctcccttctcccccacacggcgaatgtcctgctccctaccacgcccataccgttctttctcccctagatgcatctggtctctcttcaattacaggtcagcaccagcgccgtgaacaaaaa

SEQ ID NO: 33771 - DNA, 683 bp, Triticum aestivum
  Clone ID: PAT_TA_33771
gttagattcgtgaggcgccttcttggctcgatctgcccgcggcggttccttctgcggctttcttgatctgaacttctctcttctttcttgtggtgatttcgccctgttgctggtaggttctcctggtgatgaggggacggtagatgggggccatggcggaggaggcggagcacgagggctgcgtggagaaccggcagcccctcgccgcgtcgagcgagtcggtgtccgagggcagcagctatggcggtgccggtgggcccgcgcggatgtcgccgcccgtgtccggctcggtgaattccatctccggtctcaggcgaacaagtgggcctataaggagagcgaagggtggctggacatcacaagaggatgaaacattgcggaaggcagttgaaactttcaatggtagaagctggaagaaaatagctgaattctttccggataggacagaggtacaatgtttacatcgatggcagaaggttcttaaccctgaactcatcaaaggtccttggactcaagaggaagatgataaaattattgatcttgtaaagaagtatggaccaacaaaatggtccgtcattgcaaggtcactacctggacgtataggcaagcaatgtcgagagaggtggcataatcatctgaatccagacatacggaaagatgcttggactgctgaggaggaacag

SEQ ID NO: 33772 - DNA, 655 bp, Triticum aestivum
  Clone ID: PAT_TA_33772
cgccgggcggattcctctgagatagaacatgaacagtacctaaatctgagcagaggcgcgagtggctgggacaagaggaggcgcgcatccagccgcggttccgggccggcggcactggcacgagtttcgccgccggtgcttatccagcgccggggcacagcgcgcaacactgtcggtgacgccctgcgccgtcgtgtattctccggatccaccacgggttgatgaaggatgtttggcgctatatttatctttatgacattttacatctcaagggaaacaatgcaaagaggccgcatcaatttatcgagtctatagatgaatgaatgaatgagagtgaagaggcgggtaacgcaatggtgaaaaaccaagaagtatcttggggcacaacttgtatggggtgattgttttgggtgcaagcgttatatgatattgagagctgcgatagtgcgatatggctacgaagactagttaattctgttgtcaacccatgtagcgaacttaatatcgggtacatttgcatttctcagacataaccatttatcgcatttaaaattagggaggtcaattgatgaatgtccgagctgtgatttacaaatttaaaatatttttataattggttcctaaaaaaaaaaaaaaaaaaaaaaaaaaaaaaaaa

SEQ ID NO: 33773 - DNA, 563 bp, Triticum aestivum
  unsure (1)..(563): unsure at all n locations
  Clone ID: PAT_TA_33773
gggtggggggggggggggttttagtatgtcgttgcgaatcatacattgcctttggaagccaagcaagatagagtacgcgcgcttgtagagcacaaattacattgaaaacgtcggcttaatcagccccccaaaagggcggcgaccggcgcagcggccgccggggcgatggtgggcgtggagaagacagcagtggccacggggccgccagcggggcgggagatctggaagaacaggcgcggggccgtctcgaacgcaacacgtgacatcagcccgccggcaacgcccggggcggccatggtaacgtggccgcagcacggcccgaccagcatggcaacgccatacaaccagccccagcaggaggagaggacctggacgagcgccttcnccacctgcgcggggggggtgcacaggatctgccagcagtaccaggccacgggcgcaacgcaaacgaccgcggggatggccatcacgtaagggggcgcgacnacggcggcgtccttgagccaccgccagaacgcctccaaggccgggaccagctcctgggccttgctcgcgggcgtgtc

SEQ ID NO: 33774 - DNA, 892 bp, Triticum aestivum
  unsure (1)..(892): unsure at all n locations
  Clone ID: PAT_TA_33774
ttcggcacgagggagagaggtaagggaagaggagaagatgatgctcgacaagggctccctggacctggtgctggtgccgtgcggcctgctcatcatgttcggctaccacctcatcctcctctaccggatcctccggcatccggccgtcaccgtcatcggctacgagaatcacaacaagctggcgtgggttcgccgcatggcccaggcggctccggaggagaccgggctggcgctgagcgtgatctccagcagtatcgcagcgtccacgaacctggcctcgctgtccatcgcgctgggctcgctcatcggcgcctgggtcagcagcacaagcaaggtgttcatgacggagctcgtctacggcgacaacagccaggcgacggcggcggtcaagtacatctccctcctcgtctgctttctggtgtccttcacttgcttcatccactccgcaaggtactacgtccaagccagcttcctggtgaccacgctggactcggacgtcccggcgagctacatgcagcatgcggtgatccggggcggcaacttctggtccatggggctccgagcactctacttcgcaacgacgctgctgatgtggatattcgggccaataccgatgttcgtctgctcagtgttcatggtggtcatcctacacatgctggacagcaactccctgccactgcaccagtaccagtttacagtcaggaaacggcctgatcagggggctctggcttctattctagctacaagccaaccaagtcctcgaaatgcgattatcaacaacccgatattaccgcctgtaacattcttcagttgatcatgtaaatattttgttacagaacctgcacgtacgtgccaagttccgtcacatgtgaggaannatcagccacacaat

SEQ ID NO: 33775 - DNA, 777 bp, Triticum aestivum
  Clone ID: PAT_TA_33775
gtactttaaacacaacttcggccttagagatgacatcggatggctatggcccaaatatcaaagtttcttcttcggccgtcgctgttctcgccgcctcccctctcgggcttaggccggcgtaaccaggttttgggccctactacaccctgcaatcaccagttgctttctgcgaaaattacatccggcttgccgaaatcgcataggtgatacttgctgccacttacgacgtacgtctacccccacctaaattgcttgtcggacttttcctgccacatcttgcggacggagagtagggcgagacagtgacccataagcagcatccttgtgcttttagtacactgggggtagagacgacgtcgaaggacaccttaaggcatgacgataagaaggctgtaggcacaatgacgagagcgtttccatcagtcagtacctgaagccgctgtcagcaccatatttgcttctcatgttgtagtgatcatacttcggatcgctgtagtctgccgctttcatctctaagggcttaggctctggatgcccagtcccataggtaacctccccactcttctcccgatgacggtgacggagccggtcttttgggacctttgcgcttgcttgaggtgtctcggttgaaccgtagaactcagcgtactcctgtctcttggtggacctgtgcttgcttgagagagtagaatccctgaatttcgatgatttgatgctcttatgagcctttgccacagtctcgttagcagcactaggagcatgggagcgtctcggtta

SEQ ID NO: 33776 - DNA, 735 bp, Triticum aestivum
  Clone ID: PAT_TA_33776
ttttgagctcaagcattcacaacattttatcttcattattttcggcaacattgttcgcaactgagctggcagtacattttccttgctaaagaagctgccacctcgtcctgtttatcaggacaataaacactggaacagagggtgggcatatagaaatctgcactgactgcacacagatcacaccaactcacaaggcaaaacatcaaagctaggaaatcacagcactaacataatcatgttcttcttcaaaccaagacaacaataatcgaggaacaagcgaacaacacatcttctactcttcgccgctatcttcactcaaatcttggggcgggcgggagatcctgatcagggttcctttcgtactgaaccgcgatcagggcaaatttaaggccgccgcgccgaccatatatttgtttacctcttcacagcttaacttcaccttttagcctgtttctccagatttgttgaacctaacccacatgtttgctgccgtaatggccttggagctttttattgagggaccgtccgctgcgaaactcaccccgggacgttgaagtggaagagccatgagatgacgaaggcgaagaccatgcatgccagaaggaagttgaggaaccgatgcccttgccaaaatctcctggtttcgtttggaaatgtatgcccagctgctgtggtgttcgattcgttcgactgctcgacaaactccggatcgcctaacacaaccacattgcatgc

SEQ ID NO: 33777 - DNA, 544 bp, Triticum aestivum
  Clone ID: PAT_TA_33777
tacagcagcccacgcgtccgcccacgcgtccgtgcggatttacatattgttgtaacaattcgagtatatttggattcttcactcagaagttgtgtttatttgtatgatattctgtactaaatttaagtttaattctccctatataaggattttttaataagaaattcatattagaccccttttctctggtctcctgcttcatattgtaatctgtcttacgtaagatacaatttatgtagcttgaacagctgtatgtgggtctttgtattacccaaatgaagcctacagctatacgcaggtggacacatctttctcgttggagcttgaagagacgtgagagctctatgattctggagaaatctgccgaacacatcttacctcagggaatacccgctgggaggctggtttacatgtacttgcttactaatctggataatcatttattagagcgctattttaatcagtttcgctacatattatggtgaacattacatccatttgtatcagttggttaaagataattagatatttattatatttgtgg

SEQ ID NO: 33778 - DNA, 1795 bp, Triticum aestivum
  Clone ID: PAT_TA_33778
gattagtggtagggagggactgcatcgttagcctcttgaatcattcttacatcattaccaccatcaccaattgctagagttaaagaaccagaggatttcaggatcccaacaagctgtgctttctgcaaaggtgtcatccgacagcatattgctgttcttgacatcatggccagcttagtgaaagattccagtgaacgcttcagaattatttcgagtgcccaaccatccaaaacgaatggaaacctagccgcgttctcctctgcggcacgcaacctttgtccccctctgagatatagaacaacaggggatacctctacaagtcagatctaggcctgacctgtagtttcctgaccgtgctcgcctcgatctcggggtaagctgaattcggcgtccatgatttgttccgatcacccgtttgttatctgattcccaggtttgtccttctgatcggcgagttggggcttgcggcgatcttggagaaaagacgggaggcaagctggatctgcgcacggaagcttccgatctgcccggctggcgtctcagatctgttgctgatctgatgcttcacggcggatctggttgttcccggcggtctcaagtcggcgcagcggctggcggcgagttttccggcaagcacgtgggatcccgtctgctcctctacctcgtgcgacgacggccaacggctctttgtgttgataataattattcgatgatatgtcgataattattagatctaagagatcggaggtgatgaaaggtaagaggatgtaacaagcgaggtgcttgtggagagggcggagaagagcggaaaaaaaaagagatgtgaacatctagaggcctttgccatgttgggtgcgctcgcatggcaggccgccaccataataaagatgttttttttgtctcggggggagatcgcacgggggttatcttgttttagccccgggttctcccccctgtgtgctggtgtgctccttttgtctgcacctctcgtccgatccgactacatggcacaacaattctaccgtcgcgaatcgatcatggagctacagacgaaagaacaaaggtacaatcgataatttacatacagctgaaccatatataatcattgacaccacaaatttcaatacatacaaggattatcttgaatccatacaagtaactttggtagatatagatatagagattgtgttgacacatcaccacaaatctgcaaccaactacagcagtccagcctaaacaaattgtttgcatgcggatttacatattgttgtaacaattcgagtatatttggattcttcactcagaagttgtgtttatttgtatgatattctgtactaaatttaagtttaattctccctatataaggattttttaataagaaatacatattagaccccttttctctggtctcctgcttcatattgtaatctgtcttacgtaatttatgtagcttgaacagctgtatgtgggtctttgtattacccaaaatgaagcctacagctatccgccggtgaacacatctttctcgttggagcttgaagagacgtgagtgctctatggttctggagaaatctgctgaacacatcttacctcaaggaattacccgctgggaggccggttaaaatgcactcagcctactaatctggataatcatttattagagcgctattttaaccagttttgctttacatattatggtgaacagtacatccatttgtatcagttggttaaacataattagatattatatttgtggatattctctatattgtatgatcggaacagtatagcatat

SEQ ID NO: 33779 - DNA, 750 bp, Triticum aestivum
  Clone ID: PAT_TA_33779
cagtccagcataatcaaatcttgcacatatgttcttcactcaaaattgtgtttatttgtatgatattctgaactaaatttaagtatttctctgtatggaaggatcatattatcctgtaagaacattttagaccctatttcttgtggtcagctgcttcataatgtaagatgtcttatgttagaaataatttatgtagcccccgtccgcgttcatgagctaccctcgaaagaccaaacttgaacagctgtaagtggtccgtgtattacccaaatgaagcttacagtacaattatcgctgcaccgtcgaatggatgtttctctcgttggagcttcgatggctgaagagacgtgaagagctatttgattctggacaaatctgtgaccgtgaatttccaccggcaggatcgtcagaagtacctactaatctggaaaatcatttattaagtcagatgtacctactaatctggaaaatcatttattaagtcagatgtacctactaatctggaaaatcattcattaagtcgcaatttgaacagttatgctactgttgtagcttaaacattacatcgatttggttcattggtttgtacataattttttattttttattttgtggaccttgtttcacaaattatggcacagctgttggttttatttattagatgatagttgatttggacagtttagcgtatggcaactattaaattgtttcattctattttggagtacttattgttttagactcgttcct

SEQ ID NO: 33780 - DNA, 1153 bp, Triticum aestivum
  unsure (1)..(1153): unsure at all n locations
  Clone ID: PAT_TA_33780
cccacgcgtccggagcatgtaacaagcgaggtgatcgtgccaagagggaaaaaggagtgaaaaaagagagatgtgacatctagaggcctttgccatgttgggtgcgctcgcatggcaggccgccaccgtaataaagatggttcttgtgtcccgggtgggagatcgcacgggggttattctgttttagccccggggtctccccccatcgtgtcctggtgtgctcctttgtctgcacctctcgtccgatccgatcttcctggcacaacgttctaccgtcgcgaatcgatcatggagctaccgaccaaagaccaaaggtacaatcgataatctacagctgaagcatacataaacttaagacaaattactgctctcgtaaattgtattctgttctgacatcgtttacacaggaattcgtaatcactggaacctatttaagttactctcatagttgtggtaaaattattcgtgtgattcgctgttgcattcgtgtgattcgctgttgcatatagtaccacatcacagctcanatttgcacttcaataacaatcggcggtccaaacgaccaaatcgctntggtatcagattcaatatattttattttttcctcagaatatggtatatgtgtcaggttgttattgtgtctaaatttatgttaatatatttgatgatcacaatttgatcttggtctcctatttcaatttgtaaactcttacctaatgtagcctgaacagctgtatgatcggattgtatagtacacaaatgaaatctacagttatcttccctggacctggacatcatatttgttctaatcgccattggctgaaccactatgaagaagcctgccttgattttggaatatgtgctcagcagaagaatctaacctgggacgtggacctcaattccggtcattgtaggcccagcagactttcagaaactggttaagatgtgctcttcatcagtaaattatgtgatatttgattcttctgcagttagtccgaagctggttaagatgtactcttcattagtaaattatgtactatttgattcttctgcagttagtccgtggttagttttagttcatacattgctttatgccacacataatttcatattgagcaagtctattttcaatcttctgaactatttttttccc

SEQ ID NO: 33781 - DNA, 2655 bp, Triticum aestivum
  unsure (1)..(2655): unsure at all n locations
  Clone ID: PAT_TA_33781
ccttgttatagagaagaacacgcctcttcctcccaaccacaactacctccatctcggcaaggtgagcccgtgactctctgtctaccatgattttttcctcctcgaaacccccgtgcgctctctggttcgcaggttcctcgtcgatcggcgggctgggcttgcggcgatcttggagcgagacgcgaggcggctgcatcttccgatctgcccgtccggcgactcagatctgttacctatctgatggcccgcggcggatctgggggttcccggcggtctagagttgactctgcggcgatgaaggcttcttctccgacgtgcacgtgtggatcccggcttccccgcttcgcgcgacgacgggcccacgcgtccgcgtagtccgcgaggaggaaacctagtcggcgcgttcccccgttctcctctgtggcacgcaaccctttgtcccctctagcatatagaacaacacgcctcgtccacccatacctctagaagtctagatctaggcctgacccgtagttttctgatcgtgttcgcttcgatctcggggtaagccgtgattggtttccatcattcgttccttttatccgtctgttatctgattctctggtctgggattctgggcggggggtcctctgcggcacgcaacctgtgtccccctccagatgtagaacaagacgcctcgtccgcccagtacctcgtaccaggtcaggatctaggccttgacctgtagttcccctaccgtgcgtcgcctggatctccgggtgagctgagttcggcgtccatgatttgttccgatcacccgtttgttatcttgattcccagggtttctccttctgcatcggcgaagttgagggcttgtcggcgatcttgtaaaataatatgacgggttcggtaatgctaggcatctggtctcgacggtgcaaagagttaccgatctgacctggctggtggtcttcaagatctgttgctgttctgatgcttcaacgggcggatctggatattccccagggcggtctcaagtccgggatctggcagcctggcggtcgatattttcccggacaatgcatcgtgggatcccgtctgctccttgctcaccttctctgcgatcgacgggccaacggctcctttagtgttgataattaagcggtatattcgtatggaattattcgataaagaaatctacaggtatcgatgaaaggtaagaagattgtagcaagcgtaagtgcttgtggatgaagggcggagaagaagcggaaaaaaaaagagattgagaacatctagaggcctttgccaatgttgggtgcgctcgcatgtcaggccgccaccataataaagatgtttttttgatctctttaaataggagcaattgtaaaaaatcaccttatagtcttggtactagcttcattatgtattgtagaattattcctagttgtacatatttttttcaatccgaatttttttatatatatttgatattgtttagtaatgttcatatttgaactgtctagtgaatggaatttcatattgattttctacattaaattttaactctttattattgttggctgaatagctgtaagatggcatattgtatagttttgaaagcaaaaatttaggtatctttattaagcgataatgaggcctttatttacccgactgtggataaatctatattaattggtgcttgcttggatgtaagtattctttggttgaggaagaatttttgtgtacacatcttacgtcattatattatccgcaaatctgtcgccgtaaatttacacagcctactattctggatattcattttaaagtggactattttatacagagttacttttaattactaatttgaaaatacatccatttattccagtgtacctactaatctggaaaatcattattaagtcgcaatttgaacagttatgctacaattgtagattctcggggggagatcgcacgggggttatcttgttttagccccgggttctcccccctgtgtgctggtgtgctcctttgtccgcacccctcgtccgatccgactacatggcacaacgttctaccgtcgcaaatcgttcatggagctaccctcgaaagaccaaaggtacaattgataatttacataccgctgaaccgtacataagctttgacaaagtacctatttcattcaaaaattatcttgaattcattcagaagttacttgcattaatatagagaaattgtacaacatcatcacaaatctgtactcgacaactacatgcagtccagcataatcaaatcttgcacatatgttcttcactcaaattgtttatttatgatattctgaactaaatttaagtatctctattatctacgaaagaacaaagcttgaacagctgtatgtgggtctttgtattacccaaatgacgcccacagctatacgcaggtggacactctttctcgttggagcttgaagacacgtgagagctctatgattctggagaaatctgccgaacactcttccccccagggaatccccgctgggaggctggttcacatgcactcgcttcactatnctggatactctttattagagcgctattttactcagttctcgccacatattatggtgcacattacccccattgtcaccagttggttaaagataattagatatttatt

SEQ ID NO: 33782 - DNA, 643 bp, Triticum aestivum
  Clone ID: PAT_TA_33782
tttttcaaaaaagtctcacatccatcaaaatttcataacctggggttctgtacttgcaaaaatttaactatcaaacatcatcacaacaacctgaagaaaaaaattggttctcattgacatatcaacaagcatgtacagagcacataatcagaacttgttctctacatcaacttcacactatggtgcccatcagtagctgagagaggtagggagaggttcctgtcggggcagggctcatcagaagatgaccgatttttctaccctggcctcttggagcactagacgaaggagaggcgggactgttgcaagctgctcctgctgatggcttcggggtggactatcgcgacgctcggtgagcaggcgagcatccacgcagttgggctacgcccctcagctcattatagtgagcagaagcaatttactaatagtagcagtagcaacttgtgctttgagaacaagaagccatgaagtggagagagggcttgaggcctgtgactcctgctccatttttcttttgcattttttcctgaaggatttctgaaactacacaataacagacacctttgagagcagaattttacaatggcagggtggcctcgacgcaaatggacgacggcgactttgatgaaaagagcctcgtgcc

SEQ ID NO: 33783 - DNA, 600 bp, Triticum aestivum
  unsure (1)..(600): unsure at all n locations
  Clone ID: PAT_TA_33783
nngtcagattttggacagtaaaacaacctctatttattattattactattacaaagagaagaacaaactagacaccccttccaatgagacccttattcagctatgagttactagctctatggtttaaatctttctacagttgggcttcttctatagctgaactcctatctgttaagtatacaagctgcaacgagcaaagtaaaatcttctatagagccaccatcaaaccaaatttaaagaccgtgtttgtacacccattgttaagagagatggcagggtgggcatgcattggcccttctctgttcagtccttcgatccgattgcgcaagtcgttttcctccaagagctgtgtttgatatgcgttttggtttgattggacatacaccagagccgatcacatcggcgagctctcaaggcctttctgctctactgtcatacttcatcagattggcatcagctcctgcacaatgtaggattaggttacatccatgtttgttgtatacgctatgttcttggttgaagtttccagctgggtaacatgcccgttaagttccttttccttcattattgaggcttcactcaaactatgtgtgctttgag

SEQ ID NO: 33784 - DNA, 831 bp, Triticum aestivum
  unsure (1)..(831): unsure at all n locations
  Clone ID: PAT_TA_33784
ttgacaagataggcagaattaaaagagacctacgtattccagttacacgcttnaaacatgtcatgggcaacatatgcactaacagtttcaaccaaaagactaaagagacatcagcaggttttttttccggggcagagacacttagggcctggataagcataatactctactggtggaattacgatcaccaatacaagtggttttgttgacagaagtactcataacacatctgctgactgaacttgcttctcctccaagcttacacatgttctaaaaggaacgtttggggggacgagtattcttctcccacaaatcggctaatggagagggagaaaccaactttattgactcgtattctcggcttgccacaacagcatcgattctctctgaaggaaccaaaaagtcgacacaggcttctttgagcttctggcagtcgtatcgatcagctagacgcagtacaacagccacattatcgacatcaaggttcaggcacaagatgcgttcacacataagcttcaacctatctagaccatattgatccgctgctgcaaatagatgctggaccacggcatttctttcagatctgtcaagatcatccattgtaggcaaggaatcagtgtaaacgaaatggagcagagcctcgaaaaccaccggttccatgcgatcaacggttatgtgccgcatcttgttctccttcatgggttcacttagctgcgctttgaaaactggcgacctggcagagagcactgccctgtgggcaggaaacatttctcctctaactttgaaggtcacatctgctctggacttatccttcagcatcttgccaaaatg

SEQ ID NO: 33785 - DNA, 1008 bp, Triticum aestivum
  Clone ID: PAT_TA_33785
cggacgcgtgggcggacgcgtgggtacctacctccccctccccttcacctcacctggcacgaacagaatcgtacccagatcacaagtgaaggggcggaattttctcacttgtatgccaagtcgcctcctcccgatccgcgtcccctccctcgccaagcccacagctctcagatttgctaaacatatggcttcaaatactggcaagaagctcattcagatcgacgtgagctcagatacagtgtgcccttggtgctttgttgggaaaaggaatcttgagaaagctatggagcaaaccatggacaagttcgatttcgaggttcgttggcatccattttttttgaaccctgatgcacctaaggaaggtgtcaagaaatctgatttctacaagaccaagtttggccctgtgcagtttgagcgtgcaactgctcgcatgagagagatgttccgaggacttggctttgaatatgacatgtcaggactcaccgggaatacaatggacagccataggctcataacacttgccggacaccaaggctacgataaacaaaatgctcttgtagacgaattattcgtcagttatttttgccaaggaaaatatattggtgataggcaagttcttatggatgctgcaagaaaggtgggcatagaaggagcagaagaacttctgctggaccctagcaaaggagtcgatgaggttaaggaagaactcaacaagtactcttctggcatttctggagtccctcactttgtgatcaatggaaaatatcaactcagtggtggtcagcctccaaacatattcatgagggcgttcgagactgctgccaaagatgcagctgaatgattgttcaaggaacttctttacggattatacttgtatgtacaaaaatagcaaaatattgtggtaaaaaggaataaaggatggcttgcaaaaaggaacaacaaaagttacaagtcatttatggttttattatgaaaaagataatttatgaatcctactatatttgcagt

SEQ ID NO: 33786 - DNA, 1400 bp, Triticum aestivum
  Clone ID: PAT_TA_33786
cttctgacaatgctgtacaaatctaaccaaaatttcatcggaaaacatgtggttaaatgtgaaaggtttttggagaaaaagctcctgctcaggtgataatccctaaagcccgagtggaggatgaagaatttttgttctccatgaggctaaaaactggcggcaagccttctggctcagtcatcatcttatcaggtgatggaaaagcgacggtggccatctattggaggggctccacccgactctatcaatttgatctgccttgggatgctggaaaggtttttgatgcttccattatcccgtctgctgaggacagggatgaaggagcttgggttgttctgacagaaaaggcaggaatctgggcaatacctgaaaaggctgtattagttggtggggttgagcctccagagcgcagcttatcacgaaaaggtagctgtaatgaagcggtcgctgaagagaaaaggagaagtcaagcattcagtgccagtattgttcccagaagagttagctctgaggcttggagtgctggagacaggcaaagaccagcattaactggcgtagcccagcaggctgtggttgatgaagaggctgagatgttacttaatcggctgtttcatgattttattttgtctggcgctgttcatgaggcacttcaaaagctcagagtagcaggggcatttgagaaagagggtgagatgaacgtatttgttcgagtaagcaaatctattgtaaacacattatctaagcactggacaacaactagagaagctgaatttcttgcttcaacaattgtttcatcccttgctgagaaacgtcaaaaacatgagaaattccttcaatttcttgtcttgtccaagtgccatgaagaactatcttcaaaacaaagagctgcaatgctaagtgtcatggaacatggagaaaagctctctggaatgatccatcttagagaattacaaaatgcccttagccagcagagttcaagcacacgtttatcacctcagtccaaaaccccaactgctggtgcactgtggaatctcattcagctggtcggtgagaaagctcgacggaacactgttctattaatggatcgtgataacgctgaagttttctacagtagagtttctgatatagaggatctattttattgtttgtcgcatcaacttcggtatatcataaccggagaagaacacccatctgttcagatgcaacgtgcacttgagttatcaaatgcctgtgtgaccttagttcaggcagcattgcactacagagcggagtacaaggactggtatccttctcctgaagggctgataacatggaacagtcagcctgtagtgcggtctggaatctggaacctggcatcatctgtgatggagcttttgagagaaccaggatctgcaggcatg

SEQ ID NO: 33787 - DNA, 628 bp, Triticum aestivum
  Clone ID: PAT_TA_33787
cacacctgcctagtgttaacatcttccacaagaaagatggctagttctaaagtaatgtgggtgttctgcctcctagctttactggctttcacttcttgttcttatcatgtacgagcagaagatcatgccactaaggagaaaaatgaggtgatggagtattgcaagaggtacatattcaaaaattacggcgatcagtttcctgacccccacaggaaatgttgccaaacagtaagagaatcaagacacatccatgctatacgccagaaattcacgcacgcggatttgcataagatcagtctagccaagtggctcatgttacatattggtgtggcaacagattgcacccagggactaattgcgcaggtttcatcgttccagattatagtgcgccaccacctccagaacactaaacgtaaggccggtccggtcaaataaggaaaggagtgttataatatggagcacttagtctaaggcagtcttatcgaacaaaggaagggatgctatgatattgatgctttatcataggacctctgcaataatgtatcttacttttaattttatgactaataaaaggactgcccgcatgttctctttgtgtttaaaaaaaaaaaaaaaaaaaaaaggcggc

SEQ ID NO: 33788 - DNA, 790 bp, Triticum aestivum
  Clone ID: PAT_TA_33788
cttccccttgccctaagaacaaggcgaaaaagtagcgcaccaccaatggcgactcccggggatggcgaggacgcgccgccgccgccgccggtgagcgcggcgggggctggaagcagcttgatcgcgaagctgcgggagcaatggaggagcacgaaagagcacgcggagacgtatccgtacgtgtggggctcctacatcctcgtctacggcgggctcggcgcgtacatcacctggcgatggtgcaagctccgccgcaccgaggaccgcgtccgcgccctccaggcccgcctccgccagctcgccgccgccgaggagtcgcaggccgcttccactccccctaccccatctcctcccctgccgccgccgccgactgggccgggcaagcccgcctccgcgccgtgaagagtaaggccccttaggcaacttcttgacttgaaatgttacaagttacagaacaatccctgcatcgttcgagatcgaggcattccttgcctctgtttactctgtgatcctggacctaaagaaatggtgggatctcgccccccaaaaagttggaaggtagaattctgtattcatactggagatcattctggagaaggttttaattgttgttattaatgtatgtttacccttcccactagggaattttgtcaccgtgaccttttctagccattccacatcgtatttgttgcgtttctgactgctggtctaaacagatacaatgtttcattgttttagttcatgtactcgtcgtatagttcttgataatactaatatttcaaccctaaaa

SEQ ID NO: 33789 - DNA, 1301 bp, Triticum aestivum
  Clone ID: PAT_TA_33789
ccgtccgcggacgcgtgggcggacgcgtgggtcttacgcctctgacgtctcttcctcctccccccctccgctccccccttgccttttgcagctctgcttgctcgcgtcgtgctgcaattgagatcgactcgtcggtggccgacccctcggcggcgagcaccggggttagggtttaggggcctggatccatggctcggcccatgggatccagcggcttcgaggctgccctagccgtgtgccccgccgccgcccaggcctactccaagtactgcggtattgtatctggatgcacaaatgcgaacccaagggaagggttggcggatctttcacgaactatagataatatggaaggaatgagggatggaatatttggtgatattcacaagctcatgtcagttcttgagttcgatgatgtgagccaattcaattccttctatgattttgtcttcttcatttctcgtgaaaatggccaaaagaatattactgttcagaaggctcttgcagcatggaggatagttcttgttggaaggttccgattgcttgaccggtggtgtaactttgttgagaagtaccaacgtcacaacatttctgaggacgcctggcagcagctactagctttcagcaggtgtgtaaacgaggatctggaaggttatgatccaagaggtgcttggcctgtcataattgatgattttgtggagcacatgcacagaatctaccgccctagtgactgctccagtgcaatggaatcacaatgcagcatttccaatacatttagaggtctaaatctattacctggatcaaagaggaaatgccctactcagtttaactccagtgaagagagcgtagagctctcagaagctcttagacactctgtccaacttaccccgtcgaagcgacttaaggaaagttctgcgcctactagatatggtgtttgggagcgagacgcaagtacccctttctttaacagcacaccagattgtcgcgaggacatgaatttacagaactcaagaggctgccttcagaactcacctcgtgttattgaggatggtttttcaaaagggttcgaaggttgcatttcaatgaaatgctcattttagtgcaatgaggaatgcatggcatcatcatttatgactgcccgttactccatatatttctgttttgcgtcaacaccattttgtatttgtacttaaagtcagtttcccagtggtgatattattttgtacacaaacagtgatgttatacatgtctgctatcgcagagaaaacggcttgtgattgttctttcctaaaaaaaaaaaaaaa

SEQ ID NO: 33790 - DNA, 600 bp, Triticum aestivum
  Clone ID: PAT_TA_33790
tggaatcctatcatgcgggggcaatggaggccggctgtgtgcgcccccctcggcggcggcgctgcctgctgggggcgtgcttgatctctcgctggatgggtgggatctgtctggctgcgggccgccccccatctgtctgcccgcgctggcctccaccacctcctccccctcctctttttgcgcctcctcgttgttgttgccccccgggagtgtcccgggtaaggtagaagaaacaaacgagctagagattgtattctgcgccttgcaaccgattgccggcttttgcaaatttggctagtttgtggtctagatgtcgtctttgacgttcctttgcggcgcagttgttctctatttcgctgtggctgcaaattagtcagcctgacgccggttcttattccgatcagtcttaagctgttctgccatgtcggtaagcacctctgtaccaaaatgcaaggtttttttaggttttgcatatggcttaaaaaatgtcttacattttattatggagggaaagtacaaatgagtaaaggttgtggttgagctgttaaagtgaaataaaacattaggcaacgccggcagctacattttctgatttaaaaa

SEQ ID NO: 33791 - DNA, 679 bp, Triticum aestivum
  unsure (1)..(679): unsure at all n locations
  Clone ID: PAT_TA_33791
ctcgtgccgaatttggcttctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggcggcggcggctacggccagggcggcggtggcggctacggccagggcggcggtggctacggcggccagcgtggtggcggcggctacggcggcggcggcggtggctagtgcggccagcgcggcggcgactccggcggccagtggaggaactgagcggcggngccctccagttatcgatctatctaccatctcgtcgtcttcgtcatc

SEQ ID NO: 33792 - DNA, 700 bp, Triticum aestivum
  Clone ID: PAT_TA_33792
cggctcgccgcccccctctccccgcgccgcccccccgccccccgctccccgcttccccaaggaaaggaaagagggcagagccatggccatggcggcgctgcgtgaggcctcccgccgcctggccttcacctccacgcgggtcctcgccggcgccgccacgcgcccgctgctcctcacgcactctcgcggcatcacacacaagctcttcatcggaggcttgtcacaatttgcaacggaagacagcctagcagaagctttcacgcgttatggccaagtattagaagcaaccattgtcacggataagatgaccagccgatcaaaaggattcggctttgtgaaatttgcctccgaggaagaagccaataaagcacgggaagagatgaacggcaaggtactgaatgggcgagttatatatgtcgacattgcaaaggccaaacaggaccgtgctgcagacgtagttccaatagcaagaggcccccctaagccagtcggcaacacctgaaaatgcgtgttgtgttgatgataatataaataaggtagattgcgacgctgttagagaaaagcctgtgtgtaattatgctgaactctttgtgttgcgccgacgtgtatttttcctgatgttttcgtcgcgcaagattgtgctgtttttttgggtccgccgcgacaacacatcgaagatcaaaaaaaaaaaaaaaaaaaa

SEQ ID NO: 33793 - DNA, 1223 bp, Triticum aestivum
  unsure (1)..(1223): unsure at all n locations
  Clone ID: PAT_TA_33793
ngaactaagaagatttgaagcggcagagatgattgcactgaggctctgaatctggatgaccgttatgttaaagcatactcacgcagaattactgcaagaaaggacttgggaagcttaaggaagcaatggatgatgctgaatttgctgtaagtgtcgatgctaacaatccagaattgaggaaacaatattctgagataaaggcactactcatggagaaaatggccaagagaagttcagttcaagctaagcatacaatttctgaatttgataaagctggggatagaaaaaatatcacttctcatgcaccaagtgatccccagaaggacagtttcatggaagttgatccgcctgggagagctgcggctgggatcagagaattatcaggtggtgcgtccaaaggaggatctggtgtaagcctcaaagacaataacatgcagaaacctggaccagaaatatcagtgcaagagcttgcatcacgtgctgcttcacgatatatatccaacactgtaaaaagtgtgaagacaccaaagacagcttatgattttgaggtttcttggagagctatctctgacgaccttacccagcaaatacagttgttaaagtcaattcgaccagagagacttccagagatttttaaggatgcactttcatcagcttttctgattgatatcgtgaagtgcacagcctcaattttccgggatgatgcagtgttagcagttagcattttggagaatttggcgaaagtttctcgctttgacttgatcatcatgtgcctctcacccatgcataaatctgaactgcggaagatatggggtcaaacattccttgtcgaaactgcatcaccaaatcaagttgaagccctcaggcggctgcaagccaaatacgttcaaggaggatggcatgatgacatgttcactatgagctaatgatgacttgatgaggttgtaaagacagttccctagagatccctctgccctctagtcacctactacctctgtcccttaatataagatgtttttgcagtttaaattgaactacaaaaacgttttatattaaggaagggagggagtatatcggaacacaattgtagaatgaatcttaattctagttggagcagtgaaccataggaggacttgattcagaaacatcaatggaaccatatgattgtgaattaaaattttgagatttcttggagatttgttattcgaaggttaaaaaaaaaa

SEQ ID NO: 33794 - DNA, 961 bp, Triticum aestivum
  Clone ID: PAT_TA_33794
ttcggcaagaggctaatgccatggtatctgttagcaagtttcccccctaggcgcgcgcctccgccgactgcacgccctaatcttgcctgtgcgcctcaagagctccccccaaaacaaagatggccggtttcggtgggctcgatcaagaggtgactctgccgcctcatctcatcgccactgagacgaacaacttgctggtcggcaagtacgagctgtcaaggcagctcgccgtggaggtgagggacttcttaggcgacagcggatgtggcatgccgtagtggttgtccgtgagctctagacaagaagtgacttgctacaaggtgactctgccgcctcatctcatcgccactgagacgaacaacttgctggtcggcaagtacgagctgtcaaaggcagctcgccgtggaggtgagggacttcttaggcgacgcggagtggcatgccctgttgaagggaaaagatgaactatcccaacgatccattgtgaaagccaagtttactgctgttatggaaatgattaaagaggagttgaaagagtgcaaagcctggcggatggtcctccaggagttttgatgccagttcctccagccattgccacctgggcggcacagtatggcctctgaagagatttttcgtttttcattatgaagacagtcagtattatctatagtgatgctatcaactaagactcctatttatgtggaattattttcttgagttcgttaagacaaaatttggatattattgcaatttgaatatgaactgtcatattcagttgtgttgtttaaatgatccaaagtggagaagtagcagcatgtgggttgcagatttttaaatgtcttttatgaattctagtatctcggataattggagaagctgttggtgttcctatcaaattgggtttctggaagtgatatattcatgtataaaaaagattgttggtgattctggctcaaaaaaa

SEQ ID NO: 33795 - DNA, 756 bp, Triticum aestivum
  unsure (1)..(756): unsure at all n locations
  Clone ID: PAT_TA_33795
gcacgaggctctctccaagcactcgctctttgtgtgagtgtgggacgggaaagttattatattatcttcagcgcggtcccggttcctccggccctccctcgcccccgcacacactcacactgcgggagagatggagcgcaatgtttcctggtagctgccttcttcctgctcgcctccccctgatttgaggcctccctccgcgtccgtttcctctgcaccagatctgcgctcctcctccgtggcctgctgcgtttcggtcgggaagtcagccatgagcaaggaggatgtgctcaagatacagacctgcgtgctcaaggtgaacatccactgcgacgggtgccagaagaaggtgaagaagatcctcagcaagatcgatggcgtgtaccagagcaccatcgacccggaggagggcaaggtgatggtgcccgggctcgcgcatccggacacgatgaggaacaagctcaacaagggcgggaacccggctgtgctgtggggctccaagcgcgcgcgggtcggcaaccagtgccagaagctccacctcgacggtaacggcggcggccgtaagggcgcagcacccaaggacgngcgcggcaaaggccatcccaaagatgccggcggcaaggcccacaagggcggcggcaaggacgccaagatggcgatgccgcagccgaccccgcagcagattcagcaaatgcagcagcagatgcagatgaagggcgcgccgaccccgcagcagctccagcagctgcaacagca

SEQ ID NO: 33796 - DNA, 1072 bp, Triticum aestivum
  unsure (1)..(1072): unsure at all n locations
  Clone ID: PAT_TA_33796
ttcggcacgagggcgagnagctgcgtcgacatcagcgatagcggcgagagctacgtcgacatcagcgacagcgacggcgacgaagaggacgacgatgaagaaggcagcagcgccgggaacgagggggaagcggaggcggaccggcccggcgcggatctgagcgaggctgcctgcacaaaaatcgccgatctcctccggcgagggagaaacctggatggtattaagttggcggagtgcaaagcatatttaaagaataatggtcttccccaagttggggacatagcaacttgtgtcgaaagaataatgctgcatcgtaggttcaaagacgaagatccagagaagatttatcctcggtcatccttttgtattaactgtaaaggcgatgtctgtcgaggtgatactgtcttattcaaacaaaagttcacgagaaaagcggcaaaaggctctcaaaatgtatggggaagcgaatagtagctgggaaagttattaaggaaagttatggtaaagacaagcagcaacacacatttactattcaagtgttctggagcaaaggagtaggaaaattaccacctttgtatctgctacttgtcaaaggacgcaatctatacagaatgatgactttccgtcaggcttgggcgaatgaagcgaataggttgaaggctctagaagaaaagcacagtagaggagatgctgcaaggcgtgtccgtgcttcaaatagacgtaattctagtggacacgctcttaagggcaagaaatcgaaggaaaaaggaaagcatcagtctcaacctggagggcctgatggtggatccaatatcactaaaggcagaaaacgtgctatgcaaacctccaattctgatcatcctgccaaaaaaattcaaaaagaagagcaccaagtgccttccgggaaaaacacactggtgatcatcggaaggcaaagacaaattctgcccccctggataagaacattggcaccagcactagcagttctcagctaaatgccaacacggagacaaatcatgccatcccgcagaaaaacctgcgaacagcaccagtcaacaatggtctgcgtaac

SEQ ID NO: 33797 - DNA, 1627 bp, Triticum aestivum
  unsure (1)..(1627): unsure at all n locations
  Clone ID: PAT_TA_33797
ttttacatctcttagtatcaacaaataagttggttacagtatatacttngaagattgcatcaggcacaaaatgcttggctaatcaaccggttaattgagttgtgcctacgaaggatcagtagaatagttggtttcttctaaaataaatgaggattagtttggttgccatgtaacggtaaggccagaatggtggtactgaaaagtggttctgtaatggtcatatgagttgtgcagttggaacttgattctttttaagttggagtggctaggttgtttatatgtattgcattatttttctacggcgtgctgttctttctaatgatttttttaaaagtttagtatttaagtttacggcattattctgcggcatattgttctttctacaacatactgttaatatcttattcttttcaacattacacggttaaaaccttctgtataagatcttgcgctttcaacatctgctcatggcgctgtgcgtattctgctatgaactgtttacattagagagttgtggtaccttcatttgtatggttccttttagctgatgttggttgctcatactgacaaaatgtgtgttaacaaatgattgcagagcagcagagaaacgtgtttctacgaatgtgccaaaactgatggatttaactacaggtattgcactattattctacaggtatcgttgtattgcattatccaactgtaagtctgttctaaactctaagcccgatgtaaatgtgatggaagattgggccatttaatttgaaccaaaaagggtgatatgctctcagttggttgaatctgtccagacctgaaaattagatatactttgaaagcttgatgtatgagtaggagatagttgataaaggtgtactcttgtaggagattattacctgcttctatgtggtgaacaaatgagtaagcagtttagttgataaaggtgtaggcaacacagcatttttgttccattttttggtttgtaagtcaaggatgtttagcctttgctgaatatgttaattgtgaaacagttttgatgcaatttttgaaccgttcaaaatgttttgtttgtgcagttcatggtaccatatctgcaggctacatcttgtgtagatttggctaccacattatatgatgttgtttcactttgctcagtcaaggtttcagtaaaaaaatgaattgaacatatttttgtagacatacaaaaacggtctgcattttttacatcaccctgacatccaattcaaactatattttctgcctagactgttgcatacctatgagatcatgggataactcagacatgagccggtgtccagtgtgcagtgagggtgagtaatgtggcatcagcctattctggacctgtgtattatactccttccgatcaaaattaagtgtcgttgttttagttcaaaaaccacgacacttattttggatcggagggagagcatttaagagattccttgcatacacatgattcagaaaagtacagtgtgggatgccattataaactcatgaagtctgatcctggtagtgacatgatttactctgtttgatcaaataggtcgaagccaaagctgttcttattgaatctcatgatgcccctgatgcttgctgctgtaagcannnnnnn

SEQ ID NO: 33798 - DNA, 797 bp, Triticum aestivum
  Clone ID: PAT_TA_33798
cgtccgcccacgcgtccgcggacgcgtgggtgaggtgaagctagaggcagagagatcagaggcgggaaggagcgggaagagagcaaggggcggccatggcgggcctgttggacaaggccaaggggttcgtcgccgacaagatcgcgcacatgcccaagccggaggcgtcgctggacaaggtgagcttcaagggcatgacccgcgaggccatcacggtgcacagccacgtcaacgtcaccaacccctactcccaccgcatccccatctgcgacatcgccttcaccctcaagtgcggcggcaaggaggtggcgagcggcacgatcccggtaggggccttttttttttttttttttataatccgaaaatatttgctctcattattgcgacatcgccttcaacctcaagtgcggcggcaaggaggtggcgagcggcacgatcccggacccgggctggatcgaggacagcggcgaggtcaccaagctggaggtgccggccaaggtgccctacgacttcctcatctctctcatgaaggatctgggcagggactgggacatcgactacgaactcctcgtcaagctcaccatcgacctccccatcatcggcaacttcaccatcccgctcgaaaccgccggcgagttcaagctgcccaccctcagcgacttcttcggcggcgccgccaagaccgaggaggccaccgcctagccataagctcgatctagctcgcagcttgctctgcatccgcatgcctgtactctaccgttccgcaataatgagagcaaatattttaggattacggc

SEQ ID NO: 33799 - DNA, 714 bp, Triticum aestivum
  Clone ID: PAT_TA_33799
aattcgcgggccgacagacgaaagaagggggcttcatccatcacatccagatcgaaactagaagcagagtaatcgagctaggattgaacagaggaggggaggaagaagcttagggggtgccggccatggcgagcctgatggacaaggccaaggggttcgtcgccgacaagatcgcgcacatgcccaagccggaggcgtcgctggacaaggtgaccttcaagggcatgacccgcgaggccatcaccgtgcacagccacgtcaacgtcaccaacccctactcccaccgcatccccatctgcgacatcgccttcaacctcaagtgcggcggcaaggaggtggcgagcggcacgatcccggacccgggctggatcgaggacagcggcgaggtcaccaagctggaggtgccggccaaggtgccctacgacttcctcatctctctcatgaaggatctgggcagggactgggacatcgactacgaactcctcgtcaagctcaccatcgacctccccatcatcggcaacttcaccatcccgctcgaaaccgccggcgagttcaagctgcccaccctcagcgacttcttcggcggcgccgccaagaccgaggaggccaccgcctagccataagctcgatctagctcgcagcttgctctgcatccgcatgcctgtactctaccgttgccgcaataatgagagcaaatattttcggatttctttc

SEQ ID NO: 33800 - DNA, 686 bp, Triticum aestivum
  Clone ID: PAT_TA_33800
gggttcctcatccatcacccgcgaggctgagcgatcgagctaggaagaagcggaagagaccagaggaggggaggaagaagcttggggttgccggccatggcgagcctgatggacaaggccaaggggttcgtcgccgacaagatcgcgcacatgcccaagccggaggcgtcgctggacaaggtgaccttcaagggcatgacccgcgaggccatcaccgtgcacagccacgtcaacgtcaccaacccctactcccaccgcatccccatctgcgacatctccttcaacctcaagtgcggcggcaaggaggtggcgagcggcacgatcccggacccgggctggatcgaggacagcggcgaggtcaccaagctggaggtgccggccaaggtgccctacgacttcctcatctcgctcatgaaggacctggggagggactgggacatcgactacgagctcctcgtcaagctcaccatcgacctccccatcatcggcaacttcaccatcccgctcgacaccgccggcgagttcaagctgcccaccctcagcgacttcttcggcggctccgccaagaccgaggaggccaccgcctaggcatgagctccatctagccctgctgtgcagtctgcatccgcatgcctgtactctgcgttcgtcacaataatgagagcaaatatgatgatttcattcca

SEQ ID NO: 33801 - DNA, 883 bp, Triticum aestivum
  Clone ID: PAT_TA_33801
gcacgtcgcccgcagccgccagcacattcacatcggtccaggaagagtctgaggtgaagctagaagcagagagagagagatcagaggcgggaaggagcgggaagagagcaagggtcggccatggcgggcctgttggacaaggccaaggggttcgtcgccgacaagatcgcgcacatgcccaagccggaggcgtcgctggacaaggtgagcttcaagggcatgtacccgcgacggccatcacggtgcacatgccacgtccacgtcaccaagcccctactcccaccgcatccccatctgcgacatcgccttcaccctcaagtgcggcggcaaggaggtggcgagcggcacgattcccggacccggggtggatcgaggacagcggcgaggtgaccaagctggaggtgccggccaaggtgccctacgacttcctcatctcgctcatgaaggacctgggcagggactgggcacatcgactacgagctcctcgtcaagctcaccatcgacctccccagcatccgcaacttcaccatcccgctcccgacacgccggcgagttcaagctgccacccctccgccgcttctctcggcggcgccccccagacagaggacgacaccgcctagccacccgaagccgcatgctagtacctgccagcttgctcctgcaacccgcatgcctgttctccgtcgacggtggccgcaacaatgagggcaaatactttcggtaagcttgatctagctcgcagcttgctctgcatccagcatgcctgtactctacctttgcagaaaaaatgagagcaaatattttcggatttcattccgctttgtctcgataaatttcgtcaaattaagatgccccgggatctcggtgatctgcaaaaaaaaaa

SEQ ID NO: 33802 - DNA, 1535 bp, Triticum aestivum
  Clone ID: PAT_TA_33802
cagacttctccttctatcacttcccctagctatcattaaaggcgttcagaagagctcgtctcctctctctccctccctccgcgttcttatcagtacgttgtccgcgcctaggcaccaaagtccaaagcaacagccatagctcgatctcgatccccggcgcgacgaaagaaaaagaagcggcggcaggtcgacaggtcgatcaactaaggtggatccccggaggcatgggaagaggcccctacccgccgacgaggaggaggaacagccgccaccgccgccgtcagcacccaagcacgagcaggtggaggagcagccgtatcaccacctcatcgcgcgcgctctgcagcagcaaggagctgccagcgccggcggaagcccgggagcagatgtggccgacccttccccgtcaccggaggcgtacgcgcagtactactactcggcgcgcgccgaccacgacgccaccgccatggtctccgctctgtcccacgtcatccgcgccacaccggaccagcaacaagcctactaccccgccggatccgccgctgtctcaggagaacagcagcatcagcacgatgcggcggcggccgcggccatcgctgaggaacaagggaggaagcggcactacagaggggtgaggcagcggccatggggaaagtgggcggcggagatccgggaccccaagaaagcggctcgtgtgtggctcggcacctttgacacggctgaggacgccgccatcgcctacgacgaagcggcgctgcgcttcaagggcaccaaggccaagctcaacttccccgagcgcgtccagggacgcaccgacctcggcttcgtcgtcacgcgcggcatacccgacagattgcagcaacaacaacactaccccgccaccgtgggggcgccggcaatgcggccaccgccgcaccagctgcagaccgtggtgccgtaccctgacctcatgcggtatgcacagctgttgcagggcgctggcagtgccgggggcgctgtcaacctgccgttcggcgccatgtcgcccccgtcgatgtcctcgtcggcgccgcacatactcgacttctcgacacagcagctcatccgagtgagcccggcgtctcccgcggcggcaatgtcgagctcaggcacaacggggccgtccacctcatcgtccacgactacggcatcgtcgccaggtgctgcatggccgtacactggggagcacaaaaataataaagactcgtgagagatcaatggatcgaaggtgcttgcgatccatcgggacatgtcttagcagtagatgaggaatacgcatgcattcatcatgcaataaggtgggtaagtgttggtcaattaattttgctggtgaacatttctttccttcttcttatccccaaatttgtttatctaaagctcttgttttgtttatttttactttaataatgggtgattttttttggcgggtaatgggtgactcttaactagctaggtactagttgtactaaattagtgacaagtaacatagaacagaaggagaccttgttccttggtct

SEQ ID NO: 33803 - DNA, 748 bp, Triticum aestivum
  Clone ID: PAT_TA_33803
gctaaggcacgcaaagcagtggaggagactaagctcggtagccaacggctataaatacctcaccaccttgttcgcaccatccaaagaaacacagagttccagcagagacgtgaaaccccagagtgctcccaccatggctgccatgtggtctcggatcatcggtctcctcctcctgctcccactcgggccctcctccgccatcaagttcccgctcataggcaacgtctaccctgatggccacttctatgctacgttgcagattggtcaccccttgaagccctacttcctggacatcgacactggcagcaacctcacttggctggagtgtgacctcccacatcagcgctgcaagggctgccacccgaggccagcacacccacattacaagccagcagctcataacttgatggtgagatgtcacagctggatatgtgctgagctacgcaaagacctgcctggtagccctaaatgccccaagaacgatccagatcgatgccactacgacatccagtatgtctccgggaagtcaaaaggtgtccttgtcaacgacatgatgtttatcaatgggagagatgataaaaactgctttttcggatgtggatacgagcaggaggaaccagtagatcagctcatcgccgtcgcctgtagatggcatccttggacttggaaggggaaatgtaggatttgtcgagcaactcacggtgcataacaagataaccaagaatgtcattggacattgactcagcat

SEQ ID NO: 33804 - DNA, 655 bp, Triticum aestivum
  Clone ID: PAT_TA_33804
cggccgctcgagccggccggccgggatcctcatacaatccagcttaaggtcttaatctgtcatagaaccctctcaatctttcacaggaaaactagatggatcggtccatgaaggtctttgcggtcgtcttcctgctccttgtggccacaggcttccagggagcggtgcaggttgctttggcgagggactgtacttcacagagccacaagtttgtgggggctgtgcctgagcgaccgcaactgtgcaagttgtttgcctgaccgacgtatttcaccggaggcaaggtgccgaccagccgagcgttgttgtttggtaccaaggggctgctagatggccctgtcatcttcttgcacacatgctatccgtgtaataataataactgctgaataataaagactatgatctgcatcaattcatatatgatgtctatgtgagtgctacaccaagaaatgatatgtaacatcgtatacttcgaaaatacatagcttccgtgtaataataactgaataatactagatctgaatctatgcatgtatgatgcatatgtgagtgctactcctagaagtacatgcacatcatataatccgaacaaagtttcagcggggaacagttcaagttgaaaaaaaaaaaaaaaacataaacatcgaagtaagcg

SEQ ID NO: 33805 - DNA, 617 bp, Triticum aestivum
  Clone ID: PAT_TA_33805
caaaacacagctcgttttaataggagaaaaggcaagagctgacaatgttgcagtctctacaaaggtttacagccgacaatggagatcagtatcacaaagtaaaatttactattgcatgaccatcacggaggaaaaattactactattccagtcaaccaaagaactccgacgattgcatggccacacaaagcaaaagcactgatgatttggaactccagcctacatacacgcctccctcaccgacatgatcacgagtccatgtccacaggctcatctgccggggcagcataggacagctccttgcccatgaccaccgccgtcatcatcagcttaccggcgtccggaaaagcgtcgtgctgcatcagcacctcctccaccgagaagcacttggcctcgaggcctcttgcgtgcacgtcctctttcctcaccgggagcacctcctcgaacgtgccatcgaacaccaccgcatccgagctgtagcacagcctcgaagcgttgaagaggaccgttccttggagagattcttggatgacctcgtcgctccagccttctgaaactgatgcctgtgagagctcgacccagtcatcctggtcggcctcggttcgtccagcaagcct

SEQ ID NO: 33806 - DNA, 1486 bp, Triticum aestivum
  unsure (1)..(1486): unsure at all n locations
  Clone ID: PAT_TA_33806
cgttcgtataccttaccccttccttctcggacgcgtgggcgagcttgcgcggcgcggggactcgaaacaaattcccggaggattccattcgtgcgcgggggggcgtgatcgcgagcttccattgcgggcgcggaatcgggtgccggtcgatcgaggagctccttcgattcggggatcggcttctccgcgggaattcgcctcccatgtcctgcagaatgcaagggtgcgaggcgcgggcctctgggctgggagctgggtgaggaggcatggagccatgggggcgggggtctcgagctttttcttcggcgcggcggcggaggctgcgccgggtgctgcgggcctgggcgacctgccggagctctgcgccgcgcaggtgctgctgcgcctcgacgcgccggagatctgccgcctggcgcgcctcaaccacgccttccgcggcgccgcgggggcagacttcgtgtgggaggccaagctgccggagaactaccgccacctgatcgggtacgtcgagggcgggggcgggcagggcaggcgacgggggcgccgggccgggacaagggagatcttcgcaaggctcgcgtggtccgccactttcgacgacggcaccaaggtagttttggcttgagaagagcaatggtagggtttgtatggcgctatccttcaaagtctctggtcataactggcatcgatgacaggagatattggacacacatgccgaccacagaatctaggttccagtccgtggcataccttcagcaaatctggtggtttgaagtggttggggagctcgatttctgcttccctgtgggaacctacagtttatacttcagggttcatcttgggaagttcagcaagcggtttggacgccgtgtttgcagcaccgagcacgtccacggctggaacaagaagccggtgcgcttccagctctccacctcggacggccagaatgcattatctcaatgctacctggatgagcccgggagctgggttctgtaccatgcaggcgattttgtttccacgaatcccggccaggcactgaagctgaagttctcgatggcgcagatcgactgcacgcacacgaaaggtggcctgtgcgtcgactcggtgcttgtgtaccccaagggctttcagcaagagaaggtggtgaccggcaagatctcagagatgcgatcgtcgtagttgtagtggtggtgcttgcactgctagagttgtagacaaacgcagcttgcagcccaatcctattatcaagttgggctctggtatgcaacggatgaaacgtctgtgtaaagaactgtagtctcagggtctgtgtggtcagctacgtccgagagtggtttgtgtgtcgtccagtcttcccatgggtaattttttttctctccctggtgctaaatgagactttgatgctgcggatgaaaccggttgtgttgaaatgagatcagaggttttgtttccaaaaaaaaaaaattgtcanaantccntttccttg

SEQ ID NO: 33807 - DNA, 665 bp, Triticum aestivum
  unsure (1)..(665): unsure at all n locations
  Clone ID: PAT_TA_33807
nnnnnnnngattagcgtggtcgcggccgaggtacagctagactaactggcatacagaaggccannnaagagaacattcagtgcagccttatctgggccaaagggtgccacgaccccaccctttcagaattggaaaggataattaagtttacaataagcatttggcccagcccaaatatatctgagtccaatacaccaactacctgctgccacgcacgctcgtctctcctcctttccccccaaatctaccaaaccttatctgttcttctttccctaaatcgaccagtcctctgttctcctccctcgcgcaaatcaaccaggtctttcactcgcgcttctcgctgctgccaaccgctggccgccggccttgccaacttccgctgccatccgtagcgagggccctccaggacgccacgacgggtgtggggtgtctgctgatgtttgctgcttcttctccttccctcactaccttctccgctcgtgttgcctgctgccgccgactgataaactaatcggtgaactgttgttgaagggccgaacgagcaagactgctgcaagaggaaggtaacactggcgaaacagcaaaccatggtccaggaaagcatatatgtagttattgaaggaaatatgccctagattggtcagtaaggtgtgtatttatttcct

SEQ ID NO: 33808 - DNA, 667 bp, Triticum aestivum
  Clone ID: PAT_TA_33808
atgaaaagatggaatattgctcaaagagtcgatcgtcttttgcgacctaatggatattttgtatattctgctccaccagcttatagaaaagataaagatttccctattatttgggagaggctaattaatatcacatcagcaatgtgttggaagcttattgctaagcatgttcagactgctatatggatcaaacctgaagatgaatcttgccgacagaaaaattctgatacggggatcctgaatatctgtgaccccagtgacacttcttcatggcaatctccattaatgaactgtgttcggttgaacacggaccaaccaaaaattcagaaactaccttccagacctgaacgcctgttattttattcgaggagtttggaaataataggagttactccagagaagtttgacaataataaccagttctggcgggaccaggttcgcaagtactggtcatttcttggtgttgaaaagactagcatacggaatatcatggacatgaatgctaattatggtggatttgctatggcactaagcactgatcctgtctggattatgaatatagtaccctatacaaccatcaacacactgcctgttatctatgaccgggggttaattggttcctaccatgactggtgtcagccattctcaacatatcctaggtcatatg

SEQ ID NO: 33809 - DNA, 373 bp, Triticum aestivum
  Clone ID: PAT_TA_33809
aggggaaggagggggaggagtgcatgcagaggaggctgctccacgacgcgcacctggactacatctacacgcagcacaagggcaggccatgagcgtggcatgggctagctcttccgtcgaggacgagtagacgatgctgggcattaagttgacagaaggaatcatctgaccacgatcatggtgattttaatcatatcttatcgatctacctgctgctgttttggctacacccaccgtgccgtggcccgtccatctatgcgtatgtgggtgggtctgccacatcgtcgtttgtacatcgatccatcgatcgttcgctaatagtctaatactagtatactactgtagtgctgtactccgtcttcttcttcaaaaa

SEQ ID NO: 33810 - DNA, 1112 bp, Triticum aestivum
  Clone ID: PAT_TA_33810
ggctcccgcagccaccgctcgcagcccctactcgctagtgccacactagcttacctgcatacaactctgcccttctctcctctcctcttcctcggacagcccagcccagtgtgcctagtttaagcaggaagtcgagatcaaaatgacggctcgccgctcgccgccgctcgctcctcgtgccctgcttctcctcccctcctcctcctacggccccgtcgggccccccgccccctcacggaccgacactgctgctgacgaggcggtggctgcggcggagacgaaggtggacgaggcgacggcagaggaggaggcgtgggggcacgggaaggaggaggaggagtgagtgccgcggaggctgcgccacgacgcgcccctggacgacatctaggcgcagcacaagggcaggccatgagcgtggcatgggctagctcttccgtcgaggtcgagtagacgatgctggccattaagttcgcaccaggactcgtccgacgacgatcacgatgatttgcatcatgtctggccgagctacctgcttctgttttggctacacccacggtgccgtggatcatgctgctatgcgtatttaggtgagcaacatcgtggtgagtataatgatccattcatccctcgcttgctgatcttcttgctccacttgtggccacatgcaccgtgccgctgcccgtctatcgatgggtatgtggctttgccgcatcgtcctttgtacatcgatccatccatcgctcgctcgctcgctaatagtctaatactagtatactactgtagttctgtactccgtcttcttcttcaagtatgtttgttgctggcttgccacatacagtagctcctagcactgttgggacttccatgtggatgtggtggtaagctgacggtgatctagctctagcttgctagcagcagcatgcaacgcaaggctggtttagttcctgactagtttaggattggttagtagactactttattagccttgatgattgattggcatggcatggcatgatgtgaagctgtgaacgagtgaacaagagcgtatccgtacttctgttgtttaaaagagtagtagtacttgtgtctgagatgcatacgcaaaaaaaaaa

SEQ ID NO: 33811 - DNA, 1167 bp, Triticum aestivum
  unsure (1)..(1167): unsure at all n locations
  Clone ID: PAT_TA_33811
cccacgcgtccgcccacgcgtgcgcnggctcttgggtttctttctccccggccagtacgtaggctgagaaactgctggcctctccgtagctagccttgctagctagtgtgtgtgtgtgtgtgtgtgtgtgtgtacatacctacctgcaggttccaagagagagggccgagagagagagagagagagacatgggtagcttgggatcggaggtcgaccatggcggcagggagatgttccatggtcacgccgaccccgtcgtcgatgagctcaacaagctggagaatctcctcagagaaaaggaacgagaactaggacacgcatacagtgaaataaaaggtctgaaggtgacagaagctctgaaggacaaggccattgctgagctgagcaaggagctgaagaaacaggacgagaagctgagcatcctggagaagcagcttgaacagaagaatctggatgtgaaaaggatatgcaatgagcgcaaggaagcgttgtctgcacagttcgctgccgaggcatcgctcaggaggatccactcggcccagagagacgaggaagtggttccctttgatgccatcatagggcccctggagtctgacatcaagaagtacaagcatgagattgcggtgctccaggatgacaaaaaggcgcttgaacggcacctgaagctcaatgaggcggcgttcgttgaggctggggacattctgcgtagcgcactcgagagagcgctgattgtagaggatgtccagaaccagaatattgtagctgaagaaacagatggagatcggccggcgaggagaacatgcttttggagaagagcaacaggcagaaggtcctggaaattgagaagctcacccacaccgttggtgagcttgaggagtccattcttgccagcagagacgttgccaacgctgtgcacttctaccagaaccaggctaccagattgaatgaggagaagaagacgctcgagagggagctggctcgagctaaagtctacgtcaaccgtgtggcgacaacaacagcaaacgaatggaaggacgatgctgataaattgatgccggttaagaggtggctggaagaacgaagactcctgcagggagagatacaacggctgcgcgacaagatagccatagcagagaggtctgcaaaggtggaagcccaacttaatga

SEQ ID NO: 33812 - DNA, 730 bp, Triticum aestivum
  Clone ID: PAT_TA_33812
aaaggtttccaattgcctggctcatctctttggctgcttccaccagcgaaccatactttgagcacagtcttgccctgtctcattgacaaaacatcgaagcagttcggctcgcctcaccgcttcattccccatatcactctgagttcagagataacagcatctaagcatgagccagatcctcaggcctggctcgactcactcgatctgccgcctatcaaggatgtgattgtaaagttcgaacgtctgggcagcgaagacgtcttctttcggaaactgtacatcaagtgcgagaagcttgatgggatcaagcaactagcaaagcagtcccggaagcaagtcgatgggtttgaagaggaaagcaaggcgaaagcttgggccgaggacgagtacaatccacatctgagcttgatgtatcacgacattcctcaaatcgacgacacaggtctggcatcagtggatttgcttggtgttaatcttgacgggacaggagacctcggaggttggactggcggcagggtggtgatagtacctaccgacaagtcgattgatcagtggcagccaataggtgaaagggtgttctgatgtagtgacatacaagtcacaacatcatagccagtggaatgtgttttgcacatgcctcacgagtagattgggtcgaagaaaggaaggccatccatgtatctaagtgtggctggtgtcaccaccccaatcaacactccagtaagaattc

SEQ ID NO: 33813 - DNA, 596 bp, Triticum aestivum
  Clone ID: PAT_TA_33813
gccacaagatgaaccacatcattgaactaaaacgaggcacaattacattccgaagacagcaggctggataagactccgctccatcagagaggaataccagtagctaggctgccatacctacggatcagttagcaacgacaggagagatgctcctgcacatcatgctacataggctgccgcggcactagtgctaccatggcgggaagaggtttatcagttatactacggcagttacaacacaagagacctccatcacagaccaacatatgatgtgtcttgcagccttccaaaacagaaattcgccatgaatatatctttacacatctgtagaagcaaaatgaatcgcctcacgctcggcatccaggccacttaacctcctgcttggtttatcaaacttggagaagtgcttaaacatgatggacgcctgctcttggatgatgcttctggcttcaactaactgagcttcaagctcaagttcacgctcggtaacttccgaggacacttcagcgcctttgggagcatgggggacggggggggttggggccttggctgagagcatgggggggggggagactggggcggtgtggggggggtgg

SEQ ID NO: 33814 - DNA, 1796 bp, Triticum aestivum
  Clone ID: PAT_TA_33814
gaccgcaaaagcgatgtaacggcgcgtagacaccgccaacgcccgccacaaccaaagtcggactcgttttccaccggcagccacaactccccaactcgcagcctgatggaacatatgagattcatttcatttcacaaatccatctggctgccaaactagaaaacttcctaccaaacaaaatatcctatgatgaatgtgttttcgtttcatttcaaatgaaatgaaaaccgaggtgccaaacgagctataacagttgccacaagatgaaccacatcattgaactaaaacgaggcacaattacattccgaagacagcaggctgcataagactccgctccatcagaggaataccagtagcggcagccatacctacgggattatcagttagcaacggcaggagagatgctcctgcacatcatgctacataggctgccgcggcactagtgctaccatggcaggaagagacctccatcacagaccaaaatgatgtgccttgcagccttccagaacagaaattcaccatgaatatatctttacacatctgtagaagcagaaagaatcgcctcacgctcggcatccaggccacttaacctccttggtttatcagacttggagaagtgcttagacatgatggacgcctgctcttggatgatgcttctggcttcaactaactgagcttcaagctcaagttcacgctcggtaacttccgaggtcacttcagcacctttttgagcatcttgaagttgcgtcattcgtgcctttactgaagccattttagtgcgcaaactctcctctatctggtctctggccatgtgaaagggcaagtcaaagacatccgtcttgcccccaagtggggactggggagaccctgcctcctgtcttccattaccagcaacagcaggctgtgatgatccagttggagcattaaggaactcacgcatatccatctgcatcgaacgtaacagtgcccgcaaatcagcattctcctggactagttcttgcttcttcacttcatatgcatcaacaatcattttgtagtagtcattgtcattcttttttccagtccatgttccacgctgtcgtccctctttctgcaacaagttcattatttccattcctgaacgtgatgattcctttttcttctccatcaatacttggtttagcttctcctgcaatttgatgtattccttttctttcttcttcgtttcatgaatttgttgggtgcgtacttgctgatttccaataaccattttttgaaattcgtcacgttcctgctgcagcttctcaatatgagctttcagagctgcggtgtttttggcctccgttcgggtcaaagtggccaactctcgatcttttgctgccaattgggcatccatcctttcgatcttggcttccagtcttgaaatatcagactgcatacgttgccgtagatcattggtcgattcccggaattcgatgtctctctggcgctgctgcagcagtgcatacatgcagttgcatgttcttgcaatagataccggatcggtggcaaataggtcgagcgaggccgggaaaccgaaggtaacgagcgtctgattgaggtacttggcgcagtgctcgaggttccccgcgtcggcgaatgtccccacatcgccgctcatgccgacgggaggcggtggctgctggtgaaggttcgacgaggcccggagctcgaagcgcgatgacaccgacatgggcggaggccggagggggaggcggggtagagagagatctggcgagcggactcgttggcgggcggcggacgaggccggagcaacc

SEQ ID NO: 33815 - DNA, 1863 bp, Triticum aestivum
  Clone ID: PAT_TA_33815
gccggacgcgtccggacgctccacgcgatcccctcaccccagcaccggcggcgcacagctcgacgacccgagcgatcctgcggaggcggcagccatggtgcacgtcaacttctaccgcaactatgggaagaccttcaagaagccaaggcgtccgtatgagaaggagcgtcttgacgctgagctggaagctggttggggattacggtctgcggcccaagcgtgagctataccatgtgcagtacgccctcagccgcaagcagcatcctgacagggagcggctcaccctggatgagaagaacccccgccgtagctttgagggtgcagcgctcctccgccgcatgcaccactagggtcttcccactgaggaacagcacaagcgtgattatgtgcttgccctcacttgttgggcaaattccccccgcgcccgtctccagaccatcgtctttcaaaatggggaaggccaagaaaatcgatcttcgtgcgtgcccttattattgcagcgcttcatccgggcttggtaacgcgactatcaaccttccttctttcatggagtggtcgaagtcaaaccaatccagtcctctttttcctccccacaccacatggcggcacgtcacggttgggaaagcagctgaacaacataagtctctcatggggtggggggacactgagagacaggtcgacttcacgatcaccagccccctgggtggtgtccaacctggaagagagaagcggaataacctgaagaaggtttcaggtggcggagtttacgacggtgttggggattaggactttgcgaatgtcctggtcccgcttctataccgttacttaagtgttgagattgtcttgtggaacttgcaacgggaaatgtttaaaattgtggttgctcctagaaatttagaggtgaagtgctttcgttgcttcagctatcgattctaaaattaaacttatggaagctggttggggagtacggtctgcgggccaagcgtgagctctatcgtgtgcagtatgccctcagccgcatccgaaatgctgccagggagctgctcactctggatgagaagaacccccgccgtatctttgagggtgcggctctcctccgccgcatgaaccgctacggtcttctcactgaggaacagaacaagcttgattacgtgcttgccctcactgttgacaacttcctccagcgccgtctccagaccatcgtcttcaagaatggcatggccaagtcaatccatcatgctcgtgtccttatcagacagcgccacatcagggttggaaagcagctcgtcaacattccttctttcatggtgagggtggacactgagaaacacgtcgacttctcgctcaccagcccccttggtggtggccaacctggaagagtgaagcggaagaaccagaagaaggcctcaggtggtggtggtgatgacggcgaggaggaggaagactaagcgctcagcctcgacccgcataacttccgttgcagaaatgttgagattgccttgtggatcttgcaacgggaaatgattcaaactttggttcgttcttagaaacttagtggtgtagagctttcgttgcttcagaatcatttggctatcgattctaaaattaaacttatgtttgttggttttgcttggttagtgactaccgagcagaagaagtgaactcagtgatgctgcttcgttttttgtgaaccaaacgtatcttgttatcgatttgacaggcctggttctgagttattttactctgcatgaagtgttactgttgtccttgctatccttctcttttgtctggttggctaggttggtgtgtcgaccgaatgatcagaataagtgctatatagtactctttccaaggctataaaaa

SEQ ID NO: 33816 - DNA, 1000 bp, Triticum aestivum
  unsure (1)..(1000): unsure at all n locations
  Clone ID: PAT_TA_33816
gcacgaggcaattcaattcactccatcaaccacacgtacccacccccagcaacaacagctcaccgtcacacctcaaaccaacccgaaggtgtgtcctcctccggccctcccccgttccaaatggcggcggcggcggcaaagcccgtgccagtggagcggctcgggcagcgactggtggcgccggcggctccgacgccggagagccctctgcgcctgtcgtggctcgaccgctaccccactcaagatggcactcatcgagtcgctgcacgtgttcaagcccgacatggccagggagggtgacagccccgcgagggcggtggagcaggccctggcgagggcgctggtggagtactacccgctggcgggccgcctcacggtgaccgacgccggcgagctgcaggtggactgcagcgacggtggcgtgtggttcattgaggctgccgtcaggtgtcggctagaggacgtggactatctcgagtacccgctcgccgtcgacaaggacgagctgctcccccacccgcgccccaagcccagccgtgaggaggagagcaagctcatcttgcttgtccaggtcacgacgttcgattgcggcggcttcgtggtggggttccggttcagccacgcggtggccgacgggcccggggcggcgcagttcatgggcgcggtgggggagctggcgcgcggggcgggccgcatctcggtggcaccggtgtggggccgcgacgcgatccctgatccggcgagcgccctcgtcggcagcctcccggaccccgcgggcgccaagcggctcgaatacctcgccatagacatctccgccgactacatcaaccacttcaagggccagttcgcggcggccaccggcggcgcccggtgctcagcgttcgaggtgctcatcgccaaggcctggcagagccgcacgcgcgccgcttgcttcgacgaggactcccccgtacacaccttcttggcgatgaacgcnaaanccgccggggcgnctccctnn

SEQ ID NO: 33817 - DNA, 788 bp, Triticum aestivum
  Clone ID: PAT_TA_33817
attcccgtcgaggcccagcacctacgggtcaggtagggccgtaccttaggcccatagccaccttgaagcccgaaccgctggaatctagccagaaccagggatcaagtagggccgtaccttaggaagtagccattgcgaggttcgaatcgactggaatcggggaagagcagagcaaatcatctgcggaagggcagggattggcgtgcaggattcggagcgggaggaatctgagtaaagatggctgaagtgaggattgccagcaggacggctgtagccgatcgctctggcggtggattcttcgtgaggagggtggcgtctcccggagccgtggtggacaagggcgccgtcaagccgcttgctcgtcgggtcccgtcaccgtcgagcaacaaggagaacgtgccaccagcgtgggctgcgtggactgcacccaagaggaggagctccctgcccgagtggtacccaaggaccccactccgcgatatcacatcagtcatcaaggtgataaacatttcctcttgtggtgcctagtccagggttatacaggaactattcacgacagtatcatctagcttatgctagttttgtaccttgctgagatttatgcaacatctgacctggtgtatcgaatttgtacatcaacagtgtagtttgtgggccgcaatctcagtttacttttcaggtgttctctttcagcaaaaaatttgtgtatcaagttttactccacgttcagtcatatatccattataaattatcatattttggaacgataaaaaaaaaaaaaaaaaaaa

SEQ ID NO: 33818 - DNA, 1045 bp, Triticum aestivum
  unsure (1)..(1045): unsure at all n locations
  Clone ID: PAT_TA_33818
gatcacccatatttagccgttcccccgaccaaagggaacctaagcggtagtcccgctgccccggcgatccccctggatcgcctggattccccgtgccgcggggctccgccacgagctgggaaagaccgaccgagacagcggggaggtgactcgcaggcgtcggtatccccgtgaggcggaacagaagaagcctctttcctctttggaaatgctggaaccctcaggaagctgaacaaccatataaagctgtttttgcgaaaagagagaacttcagggatattgctgttactccttctatgttcatggatcacttaccatggaggtgtcggtttgctatgcagagaactctggaaggccaaccgtcacagcgtttagctaattctgattcacctgtacaacatttagtctgaccagggcaaaaatttgccatccatgctcgaagactatttgaggaacaagtcatcctatgccgcaagcatgtttttataacctgcagctatttctctgtatacaagatatatgtctggcgatggttccgctctaacattttgctgagcttattgacactgccagactgccttggcatgggcatgcaccaacccggtgatatactatctggctgaaaggaaatctgatgacttcatactcagcaatactgcacatcaatcaacaatatcctctacttatctacttgcctggcagtttcctgcattgatcgatggcgccgcggccatatacccctgcttagtacctgattgttctcattcatttttttttgcagcagcgcctgcttgttcatatccattttttcaattcatgccaacatgtacatatttacacagcagagatagctagatttaccgactaacaagtgacaataaaaatgtggttgttttaacctagaggttaataaaacactctgacagttctgtcaaaaaaaaactcnnggggggnccggncccaattgcccttanggggcnnttacaaatnaatggcccnnttttnaacntnnnactgggaaaaccctggggttcccaatttatng

SEQ ID NO: 33819 - DNA, 642 bp, Triticum aestivum
  Clone ID: PAT_TA_33819
gttctgtgtcattgcgtctgtctttagttaatactacttgatactagtacatatagatgtggtgtgctaatccttttgtgaagtggagtcatgccagctgaagattgttgatcttcttttttttgtttatttttcaactttcagcatggttactctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaagaacccaattttacttccccggccttgcaacgtaaaattttttttttggggcccccaaaattaaatccctgggccgggttttaacaccgggggaatgggaaaacccctggggtccccaaattaaatccctttgaaaaaaatccccttttccccagttgggtaaaaaaaaaaaagcccccccccattcccctttccaaaaatttgcccaccctaaatggaaaagggacccccccttttaccggcccttaaaccccgggggggggggggtttccccccaggggaccctttacattggccagggccttagcccccgctcttttggttttttccctttcttt

SEQ ID NO: 33820 - DNA, 799 bp, Triticum aestivum
  unsure (1)..(799): unsure at all n locations
  Clone ID: PAT_TA_33820
ctccaatgtctgcattttcatccacaagtctcccncaaacatccctgaggtgaaaattccagaggacatgactgtaaacattgcactatcactgcggcatgagatcaaccggggcttctttaccttgagagagattggtcatggtcgtgatctgaagaaattcctcattgtgactggagggctctggcttctttctgttcttgggagctgctgcaactttttgacattgtcatatatagtctttgtggtgctgtacactgtgccagttctgtatgagaagtacgatgacaaggttgatgcttttggtgagaaggccatgatcgaattgaagaagtattatgccatctttgaagagaaggtcctgtcgaagatcccgaagaacaagaagcactagatcacaagagttaccctgccgcgtattgccatctgtgttaccctcaacttgtcgcctcattttgaaggatggttctgtgtcattgcgtctgtctttagttaatactactttgatagtacatatagatgtggtgtgctgatctttttgtggagtttccggctgaagattgttgatcttcatttttttgtttattttccaactttcagcatggttactctatccgggagccagaaatgttatggcattacctgttctagtgcctagtgaactttgtgatatactgcgtagtgatttatccagttttcttccttccttccatttaataggtactccctctataaagaaatataagaccatttagatattagtgatttataaactatcttatagcagtattttctttac

SEQ ID NO: 33821 - DNA, 1260 bp, Triticum aestivum
  Clone ID: PAT_TA_33821
cccacgcgttcgcccacgcgtccgcggacgcgtgggcggacgcgtgcgcgcagccaagggggaaaagaaagaaaaggaaaaccaaccagaagaaaagctcgggaggagagcgtggggggactagggagcatggcggagcacaaggaggagccggtggcggagtccatgatggacaagatctccgacaagttccacggcggggactcctcgtcgtcgtcctcggactcggacgacgagaagaaggggtcggcggcgggcgtcaaggccaagatctaccgcctcttcggccgcgagaagcccgtccacgccgtcctcggcggcggcaagcctgctgatcttgttctatggaggaacaagaaggtctccggaggggtgcttgctggcgctactgccatctggctgctgttcgaggtcatggagtaccatctgctcaccttggtgggccactgcctcatcctctccctggcaaccctcttcctctattccaatgtctgcattttcatccacaagtctcccccgaacatccctgaggtgaaaatcccggaggacatgactgtaaacattgcactatcactgcggcctttagatcaaccggggcttctttaccttgagagagactggtcgagggtcgtgatctgaagaaattcctcattgtgattggagggctctggcttcttcctggtcgtgggagttgctgcatcttttttacattggagtttctggtattttgtttgacatatgtcatacatagtctttgtggtgctgtacactgtgccagttctgtatgagaagtacgatgacataggagttgatgcttttggtgagaaggccatgatcgaattgaagaagtattatgccaccctagagaagagaaggtcctgtcgaacatccctgagagcgctgtttagaagaacatattagcactatatgacggagtgtttccctgccgcttatgtccattctgtgttaatctcaacttgtcacttcaattttgagggatggttctgtgtcagtgcgtctgtctttagttaatatactacttgatagtacatatagatgtggtgtgctgatctttttgtgaagtggagtcatgcactttttgtttatttttcaactttcagcatggttactctatccgggagccagaaatgttatggcattacctgttctagtgcctagtgatatactgcgtagtgatttataaaaaaaaataaacacattagatataatgggttctccctctataaagaataagaccgt

SEQ ID NO: 33822 - DNA, 672 bp, Triticum aestivum
  Clone ID: PAT_TA_33822
ttttacattgctaggtacagtagtttatatgaaatgatttgttaatggcaggggtggttcttcaatcttcagggaatcaagtggtagcatcagatgctgacatgcatggaaggtagcagtatatgtatttgtagcaaatcatcatcgcccataaataaatcatctcttgcccgcttcctctgtccggttgtcaactcaaattgctttggttcacaaattcgtttcatcgtacatctaggtacactagaactgagagactactttccttgaatggctcatgcgagtaaactgacaatagtattcatccaagatgcagtagtatatgtatcttcatagagatgtagatgcatagatagttcaatagtgcacatgttcattgacagggatgtagatgtagtatacaacccgaggttacattgacaagttggtccatgatgctcccaggaaaaagaaaatatgatatattgtttcacactatcatccatagtgaaacttgtatttaatatttctttgttttgcaatgctgaatattttgggaacacacagtaagatgtaatctacggattcaccaaatcagcttgaacattgttatcatgcttcgtatgatttggtaatgatttcagaacatggaatggggcaaaataaagttgaaaccatgtactgttcctcaca

SEQ ID NO: 33823 - DNA, 797 bp, Triticum aestivum
  Clone ID: PAT_TA_33823
gtactagaaattattccttgcatcgaacgctcaagcaagtacacatacatagtagcatacacactagcctagttggggagcactcgcaggtggcaagctggcgagagggaacttcttgaacacgaccaccggaggctcacgcccatctttctttacggtcagccacctttggccggcgtagtcgaacaacacaagatcgcggcatggcgcattgaagcacgatgtcagcttgtacccggtgccatgcctctcgacgcggaataggaaactttgttccatgcatgtgcctgccgacggttggcatccgttcatccctctgaagcagctggcggacacatgcgtctggttcgtgttctctccatggacgtaccaccggagatggtgcttgcaccaggtgaccacgcctttaaattcgatcacgacatcggtcgagaggcggattgacgcctccttgctagagccatcgctcgcctccgccggcttgatcgacacatgcacgcctctcatcccgccaaattgcttgcacggtgtcagggtcgcatgcttatgacattcctcactccgaaatgagccaacggagatacaatggtcgctcagattgcgatctgctgccatgatggtgtacatgttgttacctgttagctcgtggccatctatgtcgtagactggtggtggctgagcttgcgcagcgttgcacggagtggtcagctgcaaggccacagccaagccagagagtgagaggatgaccaagaaacaaaagtgctccctgtgtatgaaagtattaaccggacgcgtgg

SEQ ID NO: 33824 - DNA, 682 bp, Triticum aestivum
  Clone ID: PAT_TA_33824
gtacggcgcgacaacaaacactccgatccatctattatccagtcctcatccgtcacgttgctaccgacatacgcgtgcgaggcgatcctcgtcgtgctcctcctggtcgccgcggcgtgcgcggggaggagcgaggaggaggacccggaggttacggcgtgcaggcagcagtgcgccgggcagcggcagttcggcgcagaggaggggggatccggcgctgacggggtgcaagcagcagtgcggagggcagcggcagttcggcgcggaggagcggcggtactgcgtggcggcatgcgacgagtacggccggatgaagagccgccgggaggaggatgagggtcgccgcagcacggagaaggagcgcgaccggtgcctgcacgagtgccgcgccggcccgcgcaaaccgggctgcgagcagaggtgcatcgacgagtacgagcgggccacccaccaaggcaccaagacggacgacgcctgacaaggaggacgtcgacgttgttgttgcttactgcggaatattaccgagtcgagcgagttgaagcaatcaagcttgcttcgggtagaaaaaagatgtgcaagttcaagttcaggtcaacaaataaacctttggctttgtgaaatgtactatttggtttgatgcctaaacaataatatagagatgaggccttcgtgattctccttt

SEQ ID NO: 33825 - DNA, 1096 bp, Triticum aestivum
  Clone ID: PAT_TA_33825
gtttatttaatatgctgagtgattccagtcatgagataaggcagcaagcagatgcagcactttcagagtttctgcaggaaataaaaaattcaccaaatgtagattatggtcgtatggctgaaattcttgttaggagggcaggctctcctgatgaattcactcgtttgacatctatcacatggatcaatgagttcgtgaagcttggtggggaacaactagtcccttactatgctgatatcttgggagctatcttgccatgcatctctgacgaggaggagaaaattcgagtggttgcacgtgaaactaatgaggaacttcgagctataaaagctgatcaagccgagggatttgacattggagcgattcttgtgatcgcaaagagagaattgaatagcgaacatgaagccactcggattgaggcattgcactggttttccactttactagttcgaggtcgtgctgagttctcggcatacctggatggcatttttgaaccacttctaaatgcactctccgatccttcagatgcggttgtccttttagtgttggaagttcatgcacgcatagctgaagagtatcatcacttccaacatctcatgtcttacttaatccatactttccacaacaatcatgttcttctggagaagcgtggtgctttgattgtgcgtcgactttgtgttctacagggtgctgaaaaagtttatcgagagttttctactattcttcagactgaaggtgaccttgattttgcctccaccatggttcaggcattgaatttgattttgctcacatctactgaacttgcggagctgcggtctcttcttaaaaagtcattggtggatacttgtgggaaggacttatttctatctttatacgcttcttggtgccactctccaatggctaccatcagtttgtgcttacttgctcaggcatacaatcatgcgagttctgttattcagtctctgggagaagaagacataaatgtgaagtttctggtgcagcttgataaattgatccgtctattagagactccagtatttgcttacttgcgtttacagcttcttgagcctggaaaacacacgtggcttctgaaaac

SEQ ID NO: 33826 - DNA, 918 bp, Triticum aestivum
  Clone ID: PAT_TA_33826
aaaatgtattgatgctgccccagctgaactgcccatcctaccacctttggttgatattctcaacaagggcatgagtacatcagaggatactgcagcagctgcttctgtggcatttaagtatatatgtgaagactgcaggggaaagttctcgggttcattggatggccttttccagatctatcatgttgcaataagtggagttggtggttacaaagtttcttcagaggactcattgcatttggttgaagccttaagtgtcgttatcacgacgcttccgcaagaccatgctagaagagccctggagttaatctgcatgccaataattaatagcttgcaggaaataatccagcaaggtgaaagtgctcttcaacaagttcctgctcggcatttaaccgttcacatagaccggttgtcgaccatttttagcaatgtgaaacttccagaagtagttgctgaagctgtcaatagatactggtccactctgaagattatctttgatcatcgggcatgggatacacggaccatggagtctctatgccgatcttgcaaatttgctgtaaggacatgtgggaggtccatgggaatcaccattggtgcaatgctgctagaaatccaaacactatatcagcaacacaatcagtcttgcttcctttacttatccagtgaagttattaagatatttggatctgatccatcttgtgcgagctatcttacatgtctgatacagacactctttaatcatacaatacaactgctcagaactattcaagattttacagctagacccgacatagctgatgattgctttctgcttgcgtcaagatgtattcgctactgtgctgatctatttgtacctacagagatttttccaagattggttgattgtgcaatggctggtgtaactatacaacataggga

SEQ ID NO: 33827 - DNA, 850 bp, Triticum aestivum
  unsure (1)..(850): unsure at all n locations
  Clone ID: PAT_TA_33827
cacctgctgcacggctcgtcccctcctctctccacccgtctcccccacccaccggtgaaggcaagctcccgcttcttcttccgtcccaatcgcgagattgggtgagtgaccgcgcttccgccgtgccgttcgccgaatcccaggctgacagacgaacagtccggattcagggctccactgatacctgatagaatcagcgagcgagcatgggtggtgttggatggaggagacttggctccaagctgcggcagagatggggctgggagagccgcctccgcgcccggggcttctcttccgctcctgccgctccacctccaccccacatggagagtgttggattcatagggcttggaaacatgggctcccacatggcaaggaacctggtgagggctggatacagagtgtcagttcatgatatcaatgaggatgccatgaacaagttctcggacgatggaattcccacgaagcggtcgccgcttgaagtgtccgagtcgagcgatgtcgtaatcaccatgctaccttcctctgcacatgtcttagatgtatacagtggagggaacggcttgctcggtaatggggggcaccttggaccgtggttatacatagattcatctacagttgatcctcagacatcaagaaagatatctatggacatgtcaaggtgcatgccatggacaagaaaggtacgccgaaaaaccgattatgatggatgccctgtcccccggagggnttcctgccgcaaaagtgggacactgacttcanngggggtngttaanaagaacatcattgcaacaaagccntctttccgcaaagggggaaaactgtntacngcggggggctggaatggccg

SEQ ID NO: 33828 - DNA, 1342 bp, Triticum aestivum
  unsure (1)..(1342): unsure at all n locations
  Clone ID: PAT_TA_33828
gcgggtcacggactcacggggggcccgtcgagccccaccgcagctcccgcgcccgcgccacgtgacctcgcctggccgccaccgcccgccacgttcctacgccgccgcctcccgagagcggccggtgtccgcctggcggcacatctactgcgccagaggcgacagcagaggcttcggctgccgcgtcgtcttcctcgggttcattattttagcccccgtccctccccaccttctgcctcctcgcccccaccccaccgcaccggcccctgttccctcccctgcggagcacgcgcgcgcgcgtttcttccattccgcgcgcgcgcgtttcttccattccgcgcgctcgccggcggaggcctccatggacataacagaggtgacggtggtgcaccacgtcgcgctggtgctggccgcgctctgggccgccgggaacgccgggtgggcgcacccggcgctcttcctcctcgccctcgtctacatcttcgcggtaaatgcacggtacacgatgagactgaagaagcgattacagtttgaggaaaagaaaagtgccaaccaaagaaggctcctctctgatgcagagacagtgcggtggctaaattatgctgttgagaagatgtggccagtttgcatggaaagggttgcatcccagcagttccttttgcccatattcccctggttcataagcaagttcaaaccatggaccgcaaggaaagcagagatccaaagcctttacttgggtcggaatccgccgatgtttacagatatcagggtcgtcagtcaatcgactgatgatgaccatctggttctggagctaggaatgaacttccttgctgcagatgatatggatgcaaggatggctgtacaactgaggaagagattcgggtttggtattacagcaaacatgcatataactggcatgcatattgaaggcaaggtccttgttggtgtgaggtttcttcaacagtggccctttattgggcgtgtacgagtatgctttgttgagcctccatacttccagatgacagtgaagccgctatttagtcatgggcttgacgtgactgaacttccaggaatttctggatggcttgacagaatgttggatgttgcctttggacagaccctagttgagcctaacatgctagttattgatatggagaagttttgcctcaagagtcggaatctacagataattggtttactgttatgagaagccacctattgcgcatgccaaggtagaatcatggaggggggctgacatgaaacttccngatccaaatggtttaacnggacccgtnantnaaaaggcaactttggaccataccgtttccaagacaaagatcaa

SEQ ID NO: 33829 - DNA, 703 bp, Triticum aestivum
  unsure (1)..(703): unsure at all n locations
  Clone ID: PAT_TA_33829
gcgggggcatgcaataggaaggctagctactactgttgtagtaccacagtagccgagttcgtgcgtgtctcaactgtttcctagcctaacaagctgatcgagcttccgaagatggcgcggcagcgtacgtgctctgcctccgcgctcgcgctcgccgtggcgttggtcgtcggagtcctggcgtccatccctgtcgaggtggaatccatcggcgtgtgcaacgggatgcaaggcgacagccagtccctgccatcgcgggccgacgtggtgcagttctacgggaccaagggcatcagcgccatgcgcatctacgccccggaccccgagacgctccaggccctcggcgacaccggcatcgacctcatcatggacgtgggcaacggcaacctttccgccctcgcctccgacgccggcttggcggcgtcctgggtccaagaaaacgtgctggcctacccgcgcgtcagcatcaagtatatcgccgccggcaacgaggtggaaggcggcgacacgcagaacatcgtccgggccatgacgaacctcaacgccgcgctctccaaggccagccgccctgacgtgaaggtgtccacggcggtcaagatgagcgtgctcgcgtcctcctcgcctccctccagcggcgtgttcaaagacgcgtatatgccgggggtccaagttgctgctcccaaaggaaccacannactattcn

SEQ ID NO: 33830 - DNA, 744 bp, Triticum aestivum
  Clone ID: PAT_TA_33830
agcatgctgacaaggtagttgcacaacttttctctttctccttgcttaatcctgcaaagcgtgtgcgcttagcggcaggtgccgtgaagagcctattgtctcgccaagatgttggtgttcctgagatagatagagtggtagagatcttagaggtcgtatccggtgatctcaaggagttcctgatgctcctacagaactgtcagccgatccaacgccctttggctactaatatctttgtcgaggggcagatgttcggtcgacatgtcgagaaagagaggatcatcaacttcctactgcatgatggtggtccatcaactggggggaaactgggtgtgctcccgattgttggcagcatgggagtcgggaagaccacccttgcgcagcatgtctgcgatgatgagagggtgcgcaaccacttcccaataattttgtattccaatttctcatacaccagagcaatggctcgggatgaggcggtgtttgttcttggatccaaacacacagttggagatgctcaaaaattcatcgagtcactacatgtacttaaggagaaatgcctcaccaagaggttcttgatggtatttgaagatgttgacatgggcaaaaaacagatgctagaagagttactgccaatcttgagacatggcagattcgggagcaggatcataatcaccacagacacggggggatgtcgccagcttgggaactgtgcagccaatcaatctgaaggttatgccgcatcag

SEQ ID NO: 33831 - DNA, 861 bp, Triticum aestivum
  unsure (1)..(861): unsure at all n locations
  Clone ID: PAT_TA_33831
gaacccccttcccacgcagnacgcacgcagccccactcccctatccattcccccactccggaccccattcctcttgccacatcgaggtcctcgccggcgacccggcgacgagcgcaaggggacggcgaggagaggtcctggccggtgacccggcgacgagcgcgaggggacggcgaggagaggacctggccgacgacccggcaacgagcgcgagagggcgaggaggagaggtcctggccgacgacagactcgcccgcccgctcctccgacgacggagcgcacgacaagggcacaacagagtggcggggggagcctgtcgagggcccgacgagatgatgtcctggccggcgacggactcgcccggccactccttcgacgatcagctggaggtcgccagcgtccacatcgtcgtcgtccgcaacgccggcggcctcgatgcttggggctgggcttgcctccgctgcaccgccctctgcacaaggaggtgcagagcgacacaccatcccaggcgtagcgccctacccccgggcggtgcggctcatccaattcggagagcttcagttccctcgacagaccggcgacgagctacgtgcggggtgagaacccaatgttcagaaacctgaaacctgactactagttcatgcaaaacccaatgttcagaaccgaagtagttgctattttgttcctctctggaacctgaccatatttgtgcacttcatgcaaaatcactagatcctagattcctaacctatctaccatttcaattttcttatcatgatgtttagcaaaacatgccaatttcttacattattacaaattcttacaccatggcaacttttataattgatagttcattcaaaa

SEQ ID NO: 33832 - DNA, 439 bp, Triticum aestivum
  Clone ID: PAT_TA_33832
cactgaataattaagtcggcctcgccagtattggcaaacactgagcatcggctataggagatccaccatggtgaacaccgttagacagatgccgggttttgccaacacaatgaattatgagggcgatatgcaaatatcgaccatgcgttcttatctcaaaagtgctcgggagtccgttcaccaaagtgtgaatagccgaaataagtcagatgtttcggctgaggataaattccatagcgttgattttgatggtacgatcgaagaatatggatgagacgcctcttggagtctcctatatgaaaattgtcgtccttgcctacgggctttacacttgtactcccttatttctactagcttcgcaataggagatgtgatgccgctcatgactcgaggatttcccttaggaacccaggccatgttcctcttctccagctctttg

SEQ ID NO: 33833 - DNA, 696 bp, Triticum aestivum
  Clone ID: PAT_TA_33833
gagaagacgaaagaaggggagatcaaggagctccgctacagccctgactcggagatccaaacccaggattcctgagctcctcatacctacaaattattaggtcgtgcttttcggcttccttctgtctccttagctttccccatttattgcaaccttctcaaatctcaagattccaactggtcaaggaagtgaagaacaaggacagaaggacatggatgccttaagttcaatgctcgacaaggcgaaagacaaggtgaaaagcaaccctgatgtgatggagaaagtcaattcggtcctcgacaaggttaagaaccacccagaagtcatggagaaagttgctgaggttttacatctgggaaaacgtgaatccaaagagaaagaacccgaggccgaggacaagacaaaagaaggcgagacctctgccgacaagacccaagactcaaacatcctagaccaggccgtggaagaaattcaggctgttgtggcagctgtgcagcagcaggaaacaaccggggatgaaactcaagttccagtcgaggctgctgccgaaactgacgctccagctcaagaagaaaaacgggaggtggagaaagacaaccccaagaaccgaatcgacttccttggattcttcgccatgatctttgagagggtctgctccccagctgacaggaagaagactagttccgtgtcagctgc

SEQ ID NO: 33834 - DNA, 1136 bp, Triticum aestivum
  Clone ID: PAT_TA_33834
gcctccgccgccgggcctcgcctgacacggagctccaaccccagaattcttgagctcctcatccctgcaacctatgctcttctgccctacgaattcctagggcgtgcttagcggcccccttttatcgcctcagcctcacacatctagtgtccccctggtcaatctcgtgaatccgacggagaaaagaatagcggtcccttaagtaccatgctggaagaggacctggcctgcctcggagatccaaacccagaattcttgagcttctcttctcctacaaattattagaaggtcgtgcttctcggcttccttctgtctccttagctttccccatttattgcaaccttctcaaatctcaagattccaactggtcaaggaagtgaagaagaagaagaagaagaagaagaagaacaaggagagaaggacatggatgccttaagttcgatgctcgacaaggcgaaagacaaggtgaaaagcaaccctgatgtgatggagaaagtcaattcggtcctcgacaaggtgaagaaccacccagaagtcatggagaaagttgctgaggttttacatctgggaaaacgtgaatccaaagagaaagagcccgaggccgaggacaaggcaaaagaaggcgagacctctgccgacaagacccaagactcaaacatcctagaccaggccgtggaagaaattcaggctgttgtagcagctgtgcagcagcaggaaacaaccggggatgaaactcaagttccagtcgaggctgctgccgaaactgacgctccagctcaagaagaaaaacgggaggtggagaaagacaaccccaagaaccgaatcgacttccttggattcttcgccatgatctttgagaggttctgctccccagctgacaagaagaaagactagttccgtgtcagctgccagatttatccatttgtctttatcaaaactgaatggtctgcatatggggtggctgtggatggatgctgtacagtttgcagttgtgtgttcttttgtgatttatttcattttgggattgtccttaatgttgatggatgcaacaaaaaaatgtgtttcatttttgtgtaattactgtcactcatggatttgatcctatttatgcgaatcaaaggatttaattcaatttc

SEQ ID NO: 33835 - DNA, 1088 bp, Triticum aestivum
  unsure (1)..(1088): unsure at all n locations
  Clone ID: PAT_TA_33835
ngtttgatccgtaagctcganattaaccctcactaaagggaacaaaagctggagctccaccgcggtggcggccgctctagaactagtggatccccccctccccccacattatcccttccccaccaccgacgccgccatccacatccagaggccagagccatcgtctcgtttcccggcatggagtccatgctcttgagggcctcccgtgactttgctcgcgccgccagcaagatcgcgtcggctggtcggtgggcagcgccggtgacagcggctcgatcagccccctcagatctgaggagccgcctctccttccacagcggcaccggtggtaacacacccatctccaccgacgcaccaccggacgaaatgtcgtcgcccgcttccttcacccccctcccaggtaaggtgaaaattctgccttcagacgaggacgttgagtcagaggaagccctgtgggccttgtatctgcgctggtgcaacactttgaaccagaagcgtgaccatgatgagatggttcgccggtttgatgtattcaaggacactgttcggatggtccaccgtgtcaacaaggctaaattgccttacactctgaaagtaagtgaattcgctgatgggaagctacaagagtccatgagtccaaaagtgtttgatgaattcgcaactcatgcaaagggtggtggatctcgccctttggcaaatcgtcggaaggaaggggatctcatcattgaaactggtgaagatgtgccagaatatccccaaatgtacttcaagttctctgaatctggagattccatcatccccttggaatgaatcattggagaagcacacgatacatgaataggagaaatgcatcacactcgagtttggagaagaaaaaaggatacaaggacaaagatagatcagtattctgctctaaagctgaaactctttgtgggatccatgttacttgattctattatggacgtatgaattggttgtatatatttacattaatgttgtcaagttagggtatagcaataggcatggtttcctatcaaggtacttgttttgaataagacttgcaatttaaaaaaaaagtcgacgcggcg

SEQ ID NO: 33836 - DNA, 685 bp, Triticum aestivum
  unsure (1)..(685): unsure at all n locations
  Clone ID: PAT_TA_33836
ngacgacgtaggnaaaactcacgattatagtggccctgaacaacatnnctcaaacagaaaaaaacttccaccaagacaatatcccgagaatccaaccatcagaatgacctccccaatccccctggccaaatcaatcctccaactgactctcacctccgccctatctggctacggcctcttcctctcctaccaaaacataacgcgcctccaacaatacgagcaacaaagcgaaaaggccgcagaatggagtaacaccgctgcagagcgtctgcacaagactcgcacgacacaaacgagtgggacgatcagtttaattgtatccttcctaacccccatcatcgctctctcgacatcaaactcaacatacttggtctcggcggcggcggcgaatacagcagtcctcatgttttcgcgtcagcacatggcgaatttctggaacgagaaggaacaaacgcgcatcccgtttgttcagaagttcaatgacgcggtgaggggaagcgagcaggtcgttcagatactcgggcttttgggtgcgagctgggcggttacggctgtggggtggggagtcatggggcaagggtggttgtgaagagagcatgaggacggggggtgataatgcattatggctagatgaatcatgaatcgtatcctatccaaacaaaaaaaaaaaaaaaaaggcggccgc

SEQ ID NO: 33837 - DNA, 808 bp, Triticum aestivum
  Clone ID: PAT_TA_33837
ccccgcgtccgcatctctagggttctcgccgtcgatggttgcttttggtgggggtttgcttcgggggaggcgcgagggagcggaagcggcgatggcgagcagcggcggggcggtgagggaggtggggtcgaaggcggagctggacacggcggtcggcggcgcactggccgccgcggtgcatttctgggcagcctggtgcgaggcctccaagtagatggacgaggtcttcgccaacgccgtcgacttcccccacgcgctcttcctcaggggtgaagcgaacttgaatacgtttcgtggaattttggcaattactcaactactaactaaaatagaaggcctggtggttccagtggttccatcgacacatggtgtgtcagcatttgcctatttacctgaagggcctgccaagagggtcgccaatatcagtgtgctttgtgctacagaaatggatttttaaaaacttgtagcacatggtgtcctgggaatcctggctatgtaaatttcacctcccctattcaaagatatgtggacctgctacctcattatcaggggaagtgttggttatgcttgtgtgcatactcacttgggaagttgtttaagtaggggaggaagcaaacacaaggatggactcactatgaaccatgaagacagggatccacatcaactggatgatttagctctcattttgtataactgatgtatcatagttgcatcttttaactgtccttttgtgaacctgatgtatggtgtcttggcggttatgtctagaatagactgaagtgtatgtacctcggccgcgaccacgcta

SEQ ID NO: 33838 - DNA, 713 bp, Triticum aestivum
  Clone ID: PAT_TA_33838
cgggccgactcgcagggcatctgcatgaacataaacgggtgggagaatatgatcttcattggcatcaacgctgctatcagtgttcgagtctccaatgagctgggcgcaggccgtccaatggcagccatgcacgctgtcatcgtcatcattgccgagtcgctgctcatcgggctgctatgcatggtcctcgtcttgatcttcagagataacttcgccatcatctacagcaccgatttggagctccagcatgccgtctccaagatcgccggactccttggcttgaccaggtacctcaacagcgtgcagcctgtggtttcaggggttgctgttggaggaggatggcaaggccttgttgcatacatcaacctaggctgctactacgttctcggattgcccttgggctatcttctcggctacaagttcaactatggagttggggggatttgggctggtatgctttgcgggattgcacttcagacactgattttactcttcatagtgtggagaacagattggaatgcagaggctgcgctagcttcaagccgtgtgcaaaagtggggtggcaccgatggaaccaagcctctcctggaagatgactagatcacctaaacattatctcttcttaagaatgtcttcgtattgatgatatcatatatcattgagaaatttttagtaccaacaatagggtatgaaaccaggaacgctcaagatta

SEQ ID NO: 33839 - DNA, 755 bp, Triticum aestivum
  Clone ID: PAT_TA_33839
atgattaaggatgggcgggtccccattgccctgggcgctgcccgtccatcgccggcgatgctcgccctccccgggggcgtccgcccgtcgtggctctgggggccgctctccttggccctcgggtgcctcgtctgagtcttcggcgcctgcgtctacactagcgatgtggagctccggcaggccgtctccaagattgcaggactgcttggcttgaccatggtgctcaacagcgtgcagcctgtgctttcaggggtggccattggaggaggatggcaaggccttgttgcatacatcaaccttggctgctactacattttcgggttgccattgggatatctcctcggctacaagttcaactatggagttggggggatttgggctggcatgctttgcggggttgcacttcagacattgattttgctcgtcatagtgtggagaacagattggaacgcagaggcggcgctagcttcaagccgtgtccgaaagtggggtggcaccgaagcaaccaaacctctcctggaagagaattagatcacataagcatttgtttatctccccctttattctttaacattgttcgtctttgtactgatcacaccatataccatggaaattcttcgagtatcaatagggtatggtaaccaggttgaataactatatgtcttgcatggttatacgagcccgaatagtgtacacatttttgtatgcgggtgccagaagtttgttctattatctgaaagaattatcatgagcgg

SEQ ID NO: 33840 - DNA, 918 bp, Triticum aestivum
  unsure (1)..(918): unsure at all n locations
  Clone ID: PAT_TA_33840
ggagtaagagatgcagatcgacacctcgatttattttccaaaacaggaagacaatctggaaacttggttgccgagaagcaaaccgaactaacaatatgtacaaagaagactccaaccttgtctgggcactgtttaactaacaactaaattcaatcaattggaggacattattgttttatttaaaccggcgacaagtttgctgggatgactacaggatcacttctcatccttccccgtgtaaaagtggcgaaacgcgcatgaaaagtccttgaattcacagccctcgtcacataacttccggtaaatgtcaagtgcttcagaacccatgggacatttgaagccaactccagatgcagaggccatggccaaatccaaatctttagccattagtttggaggtgaaaccaccatcataattcctcgccgatggcactcccgccattaccccaggaactgggttatatgtgtcactactccagcatcgggcgctagagcaattgaatatatctgtgagagtgcttgctttgatcccaagattctgaccaagagcaaaggcctcagagactccaagcatgctgatagccatggccctattgttacacatctttgcagccgagccatttccagccccgccgcagtagatcagctttttgcccattgcgagaagtaacggctttgctgctatgtatgtttcttctaaaccacccacctatatatcattcctttgcaccaaagtaagacacaagcccttgtatgtaatactagtttttccccaacaaagtctctgtattttctggcggtaacaataagttctgcgaagcaaggaatggtaccatgaaagtcagtgtcccagcttctgcggcaggaacaccnccagagacaggagcatccagccctcgtgccgaattncctgcagncc

SEQ ID NO: 33841 - DNA, 630 bp, Triticum aestivum
  unsure (1)..(630): unsure at all n locations
  Clone ID: PAT_TA_33841
gaaataaattcagaataaatgcgagcatcaggatttaaactctgatgtgttggaaataccactgtccacctaaccatctcaactagagattggttcgctacattcctctcatgtgccaaccaaaaacatcctttagtaatgcaggtggtatacgattaatatttacggacacacttcgtctaacacaacaaaaggatgctactttgtccattctacagcgcagtttggttcatgtaactacctacaaacgtcaacctctatgtactactacccagattctacagcgctttgtccttgccgtcagccaaggactccgcagcatcacccacagcgcccctgcgtgcaggaaaagaatcaactctcgtcacatcgagatcgccttcctcctcgtttctccattcgtcttccttgcccttgtcaaggcccttcctgctgagcatgctcttcaggttatgagcggctttccctgcatgtttcaccatatgcgccgccttcttcctcagctgtccctttgtcgggctctcgtccccggccctctcggggctggagtgcgcgtcatctgacctccgctccatgctgctgctccccgcgtcttcgtcgactgacatacgttaccnacaccctgctttc

SEQ ID NO: 33842 - DNA, 1590 bp, Triticum aestivum
  Clone ID: PAT_TA_33842
cccacgccccagaattaatcgaacccatcccaccggggaagaagaagaagaagaaggagcctctccttctccttttagcttcgaatcatccttcccctccccctccccctccctccctcccacctcatctcgccgcgacgaagcttccaaaacccccaaaaggatcccccaatcttcgcctctgcctccggcccgatcaagctctctgcagcggctgccgcgcggctcggcccgggatccatggagaggtacgagctgctcaaggacatcggcgccggcaacttcggcgtcgcgcggctgatgcggaacaaggagaccaaggagctcgtcgccatgaagtacatcccacggggcctcaagattgacgagaatgtggcgacggagatcataaaccaccggtcgctgcggcatcccaacataatccgattcaaggaggtggtggtcacgccgacgcacctggcgattgtgatggaagtacgcggccggcggcgagctcttcgaccggatctgcaacgccgggaggttcagcgaggacgaggccaggtacttcttccagcagctcatctgcggcgtgagttactgccacttcatgcaaatttgccaccgggacctgaagctggagaacactctgctcgacggcagcccggcgccccgcctcaagatctgcgacttcggttattcaaagtcgtcgttgctgcactcgaagcccaagtcgacggtcggcacgccggcgtacatcgccccggaggtgctctcccgccgggaatacgacggcaagacagccgatgtgtggtcttgtggagtgaccctttatgtgatgctagtcggcggttacccttttgaagggatcctgatgaccccaagaacttcagaaagaccattgggagaataatgtcaatccaatacaaaataccggagtatgtccacgtatcccaagactgcaagcaactccttgccagtatttttgtcgcaaaccctgcaaagagaataacaatgagggagatcaggaaccacccttggttcttgaagaacttaccaagagagctcacggaagctgcccaagcaatgtactacaagagagacaacagcgccccgacctactcggtccagtccgtggaggagatcatgaagatcgtggaggaggcgcagaaaccgcctccttccaccactccggtggcgggtttcgggtgggcggaggaggacgagcaggaggatggcaagaagccagaggaggaagcggaggaggaagacgaagaagatgagtatgagaagcagttgaatgaggtccgtgccagcggcgagttccacatcagctagctgatgggggtgcttcactggcgtgagaaggccacagaccggggataaaatttgtcatatagtttgtagtttgtgttttgttctcgagtttttctcttcattcttgtctccggttctgcaacagtgtaaattaccaaagtggttccgtcgctgtctttacaatgactgattaagctagcattgcggaaacataatgtatggaataaatcatcttattgagcatgttcttgcactcctccttccatatagaagaaactgtcgacgcggccgcga

SEQ ID NO: 33843 - DNA, 626 bp, Triticum aestivum
  unsure (1)..(626): unsure at all n locations
  Clone ID: PAT_TA_33843
accttttttctctcttttttttaatattctattccttcttggcactatcttcattctcggacaacatgcacttgcacgcgggacaaccaatcttatttagcacaaggtacattgtaataattatttgccacatgccttggggaaaagatgtttctactggcatcttgacacttctttttttgcttgttattcaatagaatgacttactcatgaagtgtaccatttatcacgctcccggtagatcctctattcccttatgcaacgaatctcaatatccttcaagacatgcttatcttggaggactcgaatcaatgcatcttgagctagttctatccatcaaccttatctccaaaaatttgccatcactgatcaactttacattgctgtcgatgtcttctttattcacagtaatttcaccaaccagcaaggtaggaagacaagctcagtcttgttacagatgaaaaattttagaagctgggataacaatctttcaatacctcacatctcttggaagaattgctcatctagtttatcatgcctctccccatcatgattcactacatgttcaggtccgcttgcaattagcctaatactcctcttcaggtgtagcttttcctgaggggggn

SEQ ID NO: 33844 - DNA, 631 bp, Triticum aestivum
  Clone ID: PAT_TA_33844
tttgcgtggtcgcggccgtgggtttcgttgagtgggctcattttttttgtagtctgtaggcgacaacaagcaattgttctcgtcgctctgaaatagcgtggtcgcggccgaggtacagtatacacgacctagtgtggtctcggctgatgtacagtatacacgaccccctagagtctagactcatatgaacaagtcgccggatttacccggcatcactctatgtaacgtaattgccaccccaaaatgctatgctctggttatttgcttcttctatatgcagaccgcctatgtaatctgacgttgtatagaggcggtctctacctggccggcgtgaagtagatacaaatggactgcttgatcttcgccagcgcgagcagcgacgacgggaatatccatatcccgtcgccgcagatgaggcccgaggcgacggccgacctgcccgggcggccgctcgacccacgcacatgtcgatggcgaagctggcgccgacgaggaacggcacggccatggccatgggcagcggcacgaacctcccgaaccgccccggccatgggctccctcgccaggttggccagcacggccggcaggaagtcccccgcgcggtgctgcaggcagtgctgcggcagcgccg

SEQ ID NO: 33845 - DNA, 888 bp, Triticum aestivum
  Clone ID: PAT_TA_33845
ttttgttctttttcttttttttttttgatttgccatgtatgatctcagaaacctgaagatcaagcttgcaaagattttggtttttggtactacagaatcatgtttattttcactatacaaaactggtcttaatatctcgaatatatacactacctgagccgtaaaaagaccataatccttgcttacatttttttggtatatatatgctactactgaatgttctccattatatcaaacctccgggtctagaatgattcgaactctggtcgacattggagctgaactcgttatcgttatgtctattgtcctgcttgattggctcacatatgttgatgtcgtgtctctctcggcacacccatggatcagcgcagcgggctgcttaggctccattggtaagcttatactttcagagttcagcattgcagcaacatctgtcatggtgggccgatctgttggatcttcctgagcacaaagtagtgccacctgagcacatttcgttatctcagagacttcatatccatcccctaacaatggatccacaagctcatgcaacttttggtccttccacatacgccaggcatctcgtacaagatcaccaacccctcgcttgtcgagtatggtattctttcggccactaataatcaccagaaccaaaacgccaaagctgaacacatctgtcttcatcgagtaaactcctcgagatgcatactccggagccttgtaaccactggttcccacgaccctactcgtgcgctcttctgctagttctgaactcagagctctagctgatccaaaatcagcaatctttgggagcatgttacaatccaagaggacattatgtggtttcaagtctctgtggacaagccagaacatggagtgcttatgcag

SEQ ID NO: 33846 - DNA, 971 bp, Triticum aestivum
  Clone ID: PAT_TA_33846
gtggcgtcaagataatgctgccggcagtggtggtggtggtgtcaaggattatgtgatggaatggattaggtcggagatcaagaaggagagaccaaagagcgattggatttccggagcgtctacgaccacccctaccacctcagcagaaaagaagaaaccaaagcgtagggcacgggagtggtggcgtgaggagtatgccgaggaactcaccaagaagcaaaaacggcaggcaattgctaagtcaaagagtgatgctggcgtgatgactggcttgcagtggtgggagaaggattgtgatttagaggagaagggacgttcaaggtggaggatgatgaaaagctggagtcggaggagcagcaatggcaatggcaatagcaccattgattggtgggctgacggtgtaaggagtagcaaagattgggctagtacagaatttgtacctaagagtggtggagcagtgagcagcacaccaagcatgcgtggcacagtctgttatgtggctcctgagtatggtggcggcgggcctctatcagagaaatgcgatatgtacagcttcggtgttttggtgttagttcttatttctggactgagtcgtaggattcttacgtcttcgcccctgtctgaccttgtgacggcctgtcccatgtctgagtttgaccatcccagtctgatttcatgggcgcttgatctcgcccatgttggccgcttgcttgatcttgtggactctgcactcctggatgttaaccgtgaacaagcgctgctatgcctcactgtcgcactcctgtgtatccataagtctccaatccgtcgcccaacaagccacgaggcacttgaaaagctctctggtgaaggtgaaccaccatatctccctgtacaattctcaacgtcgcctcctggtgggttccccttcagatccctcacgaaatgcctctgagttcactttgttggttatatgccaatggtaatgtccc

SEQ ID NO: 33847 - DNA, 2329 bp, Triticum aestivum
  Clone ID: PAT_TA_33847
cggcacggctgttggttccgctcttagaagacctgctctcccccctgcgtatggccccctcatcagagaaaacaagcgcgacgtgcccatcgcagctgccgggactttaactcgcttctgtcggatccggtgcagaccgtcctccgcatccagacacaatcttaccggcgacgcctcgcgacctcctcagctcctctcccccttcgccgccgctgccaccgcggggacccgctctgatcccgtcagttgtagaagtaactgattagcctgatggctatggtcgatgagcctctctatccaattgccgtgctgatagatgagcttaaaaatgaagatattcaattgcgcctgaactccatcagaagactttccactattgcacgggcacttggagaagaaagaaccaggaaggaactgattcctttcctcagcgaaaacaatgatgatgaagatgaggtgcttcttgcaatggctgaagaattgggtgtgttcattccttatgttgggggtgtagagcactgctcatgttttagctcccaccattggcagacattgatcttacggttggaggaaacctgtgtccgagacaaagcagttgagtcgttgtgccgtattggtgcacatgatgaaagaaaatgacattgttgactatttcattgcagtagtaaagaggctagccggctggtgagtggtttacagctcgatgtatcatcctgtggtcttttccatatagcctatccaagtgccacccgattccgttgaaaagcagaactgcgaactatttaaggctcatttatgccaagatgacatgcctatggtcacaagggcagatgtatcaaatctgaggaagtttgctgccactgttggacagagccatttgaagatagaaaccatttatatctttgatggtcttacccgagattgtcaagattatgttattttattagcaatgaaacactctgcaggttttgtaaaatcgatacaatgccaagattgtggacccaatatcctaccagtaatagtctgtttcttccaggttcaatctttgcctctccattatatggttgcagaccatttatatgagctctgcgaggcttttggtcctgagtgttcaagagccgagcagctacctgcatttgttcgcctcctccgtgataatgaggctgaagtgcggatagcagctgccggaaaagttactaagttctgtaggatattaagtccacagcttgcaattcagcacattctgcctctgggtgaaggaattgtcatcagattcgtctcagcatgttcgctcagctttggcttcagtcatcatgggaatggccccttgtcttggggaaggatgctaccattgaacaacttcttcctatttttctttctttgctgaaggatgaatttcctgatgttcgactcaacataatcagcaagcttgatcaagttaatcaggtcattggaattgacttgctgtcgcaatctctattgccggctattgtagaacttgcggaggataggcactggagggttcgccttgcaataattgagtacatccctctgctggctagtcagttaggtgttgggttttttgatgacaagctgggggcactttgcatgcaatggttggaagataaggttttctcgatcagagaagctgccgcaaacaacttgaagcgcctggcggaggagtttggtccagagtgggcaatgcaacatataattcctcaggtgttggagaagataaacaacccacattatctgtatcgcatgaccatcctgcaagctatctcattgctagcccctgtcatgggtgcagaaataacatgccaaaagctgctccctgttgtcattaattcctcgaaggacagagtgccgaacatcaaattcaatgttgcgaaagttctgcagtcgcttgtaccaatccttgatcaatctgtcgctgagaagactgtgaagccatgccttgtcgagctgagcgaggaccctgatgtggatgtacgatactatgcaaaccaggcccttcaggcgtgtgaccagatcatgatgtctagctaactaagctactgtcgtcacgttctttagaagctattcttagtccagcttggagtacatgtaatttacccttaagagtccgagagttctttctagcccagtaacttacctatacttccatgctgataatggatgggctatgttccccttttgttgttattaatattgtataattgagcaacgagacacgttgtttcgatggtgtgcttaaattgatagtttgaacttgatttctgtcattcaaaaagttgggtgcattttaccgaatgcaaccatgctccgt

SEQ ID NO: 33848 - DNA, 1379 bp, Triticum aestivum
  unsure (1)..(1379): unsure at all n locations
  Clone ID: PAT_TA_33848
ccacgcgtccgcctctctctctctctctctcgtcggtgcgagcgctcccgccctcgcccgtcggtccgcgcgccgctcgctcgtcccccactgatatcaaacaatggcggaacacttggcttcgatatttggtacagagaaagacagggtcaactgtccattttacttcaagcgtcccgcttcccccctctctctctctctctctcgtcggtgcgagcgcagctgtcgacgaccctcctccgactcgtcgcttcacaggcttgtggtcagcttgactgatatcaaacaatggcggaacacttggcttcaatatttggtacagagaaagacagggtcaactgtccattttacttcaagattggagcttgtcgtcatggcgatcgctgctctcgcatccataacaggccaaccatatcacctactattgtgctcatgaacatgtatcagcgccctgatatgattacccctggggttgatgctcaaggccagccgatagatcctcgcaagatgcaggagcattttgaagatttttatgaggatatctttgaggaactgagcaagtttggtgagattgagaccctcaacgtctgtgacaacctttctgatcacatgataggcaatgtgtatgtccagttcagagaggaagatcaggcagcagcagctcataccgcccttcagggacgcttttactctggtcgcctaataattgttgacttctctcctgtgacggacttccgtgaagcgacctgcaggcagtatgaggagaacacctgcactcgtggtgggcactgcaatttcatgcatgtgaagcagataggtaaggatctcaggaagaaactctttgggcgctacaggagatcgcaacgaggaaggagccgcagcccaagcccacaccataggagagagcgtcgtgaccgtgatgactatcgtggccgtgatgatttccgtcgtggtggtggcggcggtggacggaggggtgggagcagcaggcatgaaaggcacgacgatggaggaaggcgtaggtatggaggcagccctccgaggcgtgcaagaagccctgtgagggagaacagcgaggagcgcagggccaagatcgaacagtggaatcgtgagagggagacgaagtaagggtgaccactgtcgtctgggtgtgtcctgtgccgttcttctatatattggatttcgttctgtagttgctactattcttgatttgcttttctgttcctgtaatttaggtgacttcactttgagactttaaattgtcactagtgtgctgctggagacttacattttagctacttcgaacttaatcctactagtttcccatttttctgaataatggctgttctaaaaaaaaaaaaaaacccccnnnaaaaaaa

SEQ ID NO: 33849 - DNA, 235 bp, Triticum aestivum
  Clone ID: PAT_TA_33849
ggaaagtgaagcttctctctctaggatggctggcgttgtcgttcctatgttgagcgttcctgtgatactttgtactccacccaggctgatatgcatgtagcttgtcgttgtggtcatttgaggatatgtaacgtctgttgtccatctatgaacccagacccagtaaatccattctgtctactccgtgcaagatgtttgatcaagatgatgagcttattggttgtgtttaagattg

SEQ ID NO: 33850 - DNA, 851 bp, Triticum aestivum
  Clone ID: PAT_TA_33850
gtcggcacggggggcaccctccagccgtctccctcttcccccgcgacgtatctagggtttttacctccccgctccgcctgcccccacgcgcttccctccagaagcttctagacacttccagtcggaggaggagctcacgccgcacaagcacccatgtcgtccaccaaggagcagcgtatcatgacccagcccatcaacctcatctttcggttcttccagagcaaagcgcgcatccagatctggcttttcgagcagaaggatatgcggatcgagggtcgtatcatcggctttgttgagtacatgaacctggctctcgaggatgctgaggaaatcaacattaagaagaacaccaggaaatcgttgggaaggataatcttgaaaggcgacaacataactctgatgatgaacactggaaagggaagcttctctcttcagtatggctgggcgttgtcgttcctggtgttgaagcattcctgtgatactttgtgctccaacccaggctgacatgcatgtagcttgtcgttgtgttcactgaggatatgtaacgtctgttgtctatctattaacccagcccccagtaaatcaattctgtctaccccatgcaagatggttgttcaagatgaatagcttaaccgttgtgttgtatttatatgaatcgagacccagtaaatccattctgtcgactccgtgcaagatgtttgatcaagatgatgagcttatcggttgcgtttaagattgacatgaacagaccttgttgactttttctgttgttgagcttattagttactatgactgtatgttatgtttttttcactgcttatgagtgaaacgcttgatttccctcgtgctgt

SEQ ID NO: 33851 - DNA, 923 bp, Triticum aestivum
  Clone ID: PAT_TA_33851
ccacgcgtccgtctgcctctatataggcagaattgattgcacgtagtgcatatcatggagttgggttggtcaaattaatgggaagaagcactggattcatagccatgcatgcttctctttctagcggacagattgatgtctgcctaatacctgagtatcttttacacttgatggagaacatggtgtcttggcacatcttgagcatttactggaaaccaagggattttgtgtggtttgtgtggctgaaggtgcaggacaggatttactgcaaaaatcaaatgcaacagatgcatcaggaaatgtgatacttagtgattttggcgtccacatgcaacaaaagatcaagaaacatttcaaggacattggtgttctagctgatgtgaagtacatcgacccaacatatatggtccgggcatgtcgtgcaaatgcatctgatgccatcttgtgcactgtgcttgggcaaaatgctgtccatggagcatttgctgggttcagcggcatcacatcaggtatttgcaacacacattatgcctacctcccgatcacagaagtcatcacaacaccgaagcatgtgaacccaaatagcaggatgtggcaccgatgtctcacgtccactggccaaccggacttccactgactcgcgtttagcgtttacttctctgcacaggctaaactcgttgaattaacatatttttgcttacccacagactagtcacagctgaaagattagtcacggtgcaagctaccaacatgttaacaataatgtaatactgagaaggaactcaatcggcttgtttcacatcagccccatttttgtccatgaacaacagagctgcacaaagctcaagttgtcccgaataatctgtaatgcactgtccaaccattgaccatccataattctaaaacgaagctatttgcttcag

SEQ ID NO: 33852 - DNA, 420 bp, Triticum aestivum
  Clone ID: PAT_TA_33852
actaaaataagggtgtactgtctggtggtttgggagatttggtatgagcccagtcgtcgcatctttcacaatttggagttatcagctgtgacagtggcaggccatgcaacttcacaaggccgatgttggaaggacgatgacgcatggcacgtcatttagcatagtagtctagcttagtgaaccctgatcattttgtttgtactttttatataaactctcttatgcatgcaagttctgtattaagcgtttttattttgtgttttcctttttcatgtgagttctcttgatcagttcctgattgtgagatgttttgagactaatatacttagcaaattattttagcaatattttgtcttggttgatcaggtttaaagtattgtagattgctatcttcgagatactattatgtgatatgaaaaa

SEQ ID NO: 33853 - DNA, 757 bp, Triticum aestivum
  Clone ID: PAT_TA_33853
ttcccgggccgactatgtacagacacagagagcgcgaggtaggctgatcagggaggtccaggagagcttcacggttgacgcgttcatcggcaacgcgaccgactgggagctcgtttgtctgggaaacctcgtggggttgcccatcgtcgtggtgcctacgggcttcaagagcatcgaacacccaccaaaaggcaacacgaggagacgaaccacagtgacgacgggcatatatgctccccctgaccatgaccacattgctctagcgttggcgatggcgtaccagtccgtcaccgatcaccacaaacaacggccaccgattgacgcaaactagaaaatacacaagtgattagccggctgatgaaatggtattgagaagaaaactccgtgtgctgtttcccttgagacaaataaaatatttctacggcggcagagggccatagattgtgaagttacattgggggatgcacggatcctcgctggagcgacacgccacaaattctgccactgattggagagaagtgcaaactggagtgggggcaaatcagtggagtgatggtacttcttgtgtaatagatctgaaaactttaagcatttttcatcgaaaagtgcaagcaaactctcgtgagattggtacacttgagcggggggccctggcccctgctgggcgcgccgcacctccgcccctgcatggaccaagtttttagtcatggccaaaatattggcaggattcttttagccacaaaaaaaaaaaaaaaaa

SEQ ID NO: 33854 - DNA, 1093 bp, Triticum aestivum
  unsure (1)..(1093): unsure at all n locations
  Clone ID: PAT_TA_33854
ccacgcgtccgcctcctcccaccccaccccaccccaccccacgctccactcccatcaatccaaatccaaatagcaccccatggcgtcgtcgatgcgccgccctgccgactggttcctgcacgactgggtcgagaggctcgacactcagcgtccgccgactccgacgcctccccgccacgcctccggctgcaaggccggccgcggcggaggctctcctccttcgccgccgcggcgagcaccccgagtaccttccccaccacgcccgtcggcgcggcggggccggtgccaggtccactacgggatccagtcagccgcgccaccgcaccggctccaggcgcgcgtcacctccccggcggaccaccggaacgcctccgcgttcagacagcggaatccctcctcgcgctcgcctgtgcacagaggactcaacgtcttcaatcgattcgctctcttagcgatggcgagtgactacgagagggagtttccggtgttgcctgctgcaaccggaagcatcagcgacaaggaggcgaagcagcggggggaatctcctatcaagcattcgaacaacaagctccggggaggcgttaggagggctccgcaggtgcagcacgttacgaaggccgtcgccgagcccgcggtcaaggccaagggagacgctgagctgacgaagggcgagagccagggccacgccgaggcggggatcaaggtcgagggccacgccgagctggcgaagggcgagagcgagcgccaagccgaggcgccgatcaaggccaagggccacgccgaactggcgaagggcgagagcgagggccaagccgaggcgtcgatcaaggtcgagggccaggccgagctgacgaagggcgagagcgaggaccacgccgatgcggcgaccaaggccgcgggcgacgccaaggtgtcggtcaagagcgacaaggccgcacgcaacgtccccgacctcgccggcgagctcaatggccaggacttcttcgtcggttcgattctagtaagatgcggccccccagttgccgttgtcncgggaggtgttgagggctgtccgtcgcggaggcctgncggaggcagtgggggagtacatgct

SEQ ID NO: 33855 - DNA, 1268 bp, Triticum aestivum
  Clone ID: PAT_TA_33855
gctcgagcctccccccttcttcctcctgccggcctcccccccggctggctggcgctcggccccccgcgctccccgcgctggtggcggcggtgcgctcatccgtgcctccctgtgcccgcccctccgcctgggtgtcgacctgggctgccaccgctcccacccgcacttccgctcggtcccctcctgcctcctcacctcttcttcctcctgccggcccccctcccgcctggcgggctcctcgggctctgcctccggcgccttccacgccgaggagggcgccgcctggccctgctccgatgctggccaggtgtcctccgacgtgccggccgccagggcgacccaggcgacccccagtgccgagggggcccccgcgcgccccggcacggagggccccgcccccggcccccgccccccagcgcgcgctccccgccgccgcgctccgccccaagcgcacagttacggcggcaagccggagaagaccaagcacgtcaagttcggcatggatgacgacgaacgaatcgatcggcacggccccggaccgcaagtgcacggtcacggcggcaagccggacaagaccaagcacgtccagttcggcatggaggacgacgaacgaatcgatcggcgcggtcaccacgaccaaggccacggacaaggacatggacatggacacggcaatggccacggcggcaagccgaaggtggtaactaccacggcgatgtcacggaatgaggccccgcgcgcccagcagccggcgtccatgacggccatggcgccgatgcggatgccgacgccggcgcctagcatgacgatgatgccgcaggcgatggccacgccgtccatctggccggccgccccctgggtgggggtacagcgcacccgcatacggacacgggtacgccggaggggcacctgccggcgggtactacggcgggcccgtgtatgaccacggcgcgtacggggcgtacgtcggagggtacggcaggaatccgtaccagccgcagtgctacgaggaggagcctagtgctgggtgcagcgtcatgtgatgagctgaacacgcacacggagcgcacatcaaaaccttgctcgcttgctcagtttgtgcctgtcacgttggtgtgtgtggtgtgaaacgataggcggcaagtagatacgttaactctttctgtgtataccacgcattgtatctactctgtagtcttcccctaacttgttgtaacaacctatataatcctattctgtaatcttcccctaacttgttgtaacaacct

SEQ ID NO: 33856 - DNA, 947 bp, Triticum aestivum
  Clone ID: PAT_TA_33856
gctcggcccccgcccccagcttccacccgtaggcgcctcctaattttgagttgaaacagactgcaccaccacgtgctagggcaccgaagcctggccgacacaagccatccggttctgtcactgctgcttctgcggatagctccgtctcatgtgagagccgacggcgcacaagtaatccagccaaggtaaacagaggtggggaaagtaataagcctcgggttactgctagcggacccggccggagattggtcacaaaagctccctccgtagcatctatcactgcaaaggctgaaacgagacctatcgctacaaagcagaaaacgtccaagacaaaaccaaaagtttcaagagaaaaggtacagcagctgcaagagaacccagtagaaatccctcctgcagaaccttctgccttggaagggcttgctgctgaaccaagtgttgaagatgagacaggacttcgctcgactgcccctccggtcacttcaaatgaggtactggtccatggctgatctgtcgcgcattttattttattttcgtcctccttgcagtcctgtgaatagtgaggtgtgtgcttccttggaaagttgaatcgctcaaagtatcgtggaattattatttttgtagtagctatcttttttcttcagcttgtcattgagcatgcagtgtatattgaatttttacgtggggaacatgattgcaatttgtggaattcatttgtgttcagaaattagtatcagttatcttttaaaaacgaaaaaatcaaagtatcgtggaattattatttctgtagtagctatcttttttcttcagcttctcattgagcatgcggtgtatattgcttgaaaatttcatgttcaaactttttgagttcttgtgtatattgaatttgtacgtggggaacatgaatgcaacttgtggaattcatttgtgttcaaaaaaaaaaaaaa

SEQ ID NO: 33857 - DNA, 749 bp, Triticum aestivum
  Clone ID: PAT_TA_33857
gcttgtgtaatatttctaattctgtaatgattctgcttgtagataaaacaattgtcccaaagagtgctaatgatgtgaaactgataagtggaggcaaaattctagaaaatgacaagaatattgcacagtgcagagcaccttttggtgatcttcccagcactgttataacaatgcatgtcgttgtccagccatcatccgcgaagtcaaaaccagagaaaatgattgtggatgaaatatgaaaatgttgacatgaaagtcatggagctctgcgcttctatccatgggaagtcagtttgacaagaagacgaacaagttgcctaagaccactcgctgctcttgtactatactatgaatgtcaagtgtaccgtcgacaataatttgtgtgcccgccaagagaaacgactggacagaagaggaacatccagcacccaagatgtgtcgtgtattgttgtgaggtgatattgtaactgtaagctagatactacacaagagtcggtccagtccctctgtcgctagggcaatagcgtcgctttgtcttgttttacccaacaaaggatgtttctatatgatgtacaagatacacacacattgctggtgctgttgctgttgtggaggggaaggacctgttgttcgtggccgtgctaagttgggttaaaaagggtcaaggttgttgggtgtgtcacgcaacctgattgtttgttctcacttgagactctgtgaaatgatgttttactccttgttccctgttc

SEQ ID NO: 33858 - DNA, 1009 bp, Triticum aestivum
  Clone ID: PAT_TA_33858
gcagttgctaagcgtctcctcttctctcctgctcctcctctcctaccctcgttgcctcccaccaaaccctaaaccaagctccgaatccctcccgtctctacccccaccgagctcgcaagttcttgattggagcagccgagcccagctcagattccccgcggggtcccgggagtattcgaggtcttggcgggaggccaagaaatggcggagggggaggagaccaaggtggagggaacgagagaggaagagagagcggatgcaggggcgggagcggaggaggaggaggtagaggtgaagttccggctcttcgacggctctgacatcggccccatccgctgcaacgccgctgctaccaccgtcgccgcactcaaggaccgcgtcgttgccgattggcccaaagataaaacaattgtcccaaagagtgctaatgatgtgaaactgataagtggaggcaaaattctagaaaatgacaagaatattgcacagtgcagagcaccttttggtgatcttcccagcactgttataacaatgcatgttgttgtccagccatcatccgcaaagtcaaaaccagacaagaagacgaacaagttgcctaagaccactcgctgctcttgtaccatactatgaatgtcaagtgtactccgtcgacaataatttgtgtgcccaccaagagagacgactggacagaagtggaacatccagcacccaagacgtgtcgtgtattgttgtgaggtgatattgtaactgtaagctagatactacacaagagtcggtccggtccctctgtcgctagggcaatagcgtcgctttgtcttgttttacccaacaaaggatgtttctatatgatgtacaagatacacacacattgctggtgctgttgctgttgtggaggtgaaccatgcgctgttgggttacgtgccaagaagggtgaaaaatgggtcacgcagttgggttgttcattcacccttgagacttgttctcacgatgtcttacgcaatatgtttactcc

SEQ ID NO: 33859 - DNA, 1403 bp, Triticum aestivum
  Clone ID: PAT_TA_33859
ttaccagcaattgactacagaataacagattcattggctgattctcctaatacaaaccaaaggcatgttgaagagttggtgcgccttcctgaaagttttctttgttacactccttctccagaagctgggccggtttgtcccacaccagcaatctcaaatggtttcgtcacgtttggtagttttaacaatctagcaaagatcacaccgaaagttatgcaagtttgggccagaatattatgtgcagtccctaactcacggcttgtggttaagtgcaagccattctgctgtgacagtatacgacagaaatttttatcgacacttgaggagttgggtttggagtcactacgagttgatttactaccactcatccatctcaaccatgaccacatgcaagcatattccttaatggacatcagcctagatacgtttccatatgctgggactaccactacatgtgaatctctttacatgggggttccatgtgttacaatggctggttcagttcatgctcataatgttggtgttagcctactcactaaagttgggttggggaggctggttgccaaaacggaggatgaatatgttagcttggcactggagttggcatcagatgtaagtgccttagaagaactgaggaagagcctccgggaactgatgataaaatcaccagtttgtgacggagagagtttcacacgcggcctggaatctgcataccgaagcatgtggcataggtactgtgatggggattcaccagctctcaggcgcttagaagtgttggcgggcgaagacttggacaagacggctgtgaaacttgtagatcttaaagcacagagagcgaatgctactgcagaggaagataaccagtccccaataaagaaggttgacgccatgtccaagggaggtgagccccaaataatggcaaacgatgtgagttcacctgaaggtaaccaggccctcgtgacggcgaaggcgcagccccaaataatggtgaatggtgtgagttcacctcactccccttcggggagatgcgaagcaaatgggcatagcagccgatgaccaatgggaggctccattgatgcaggcacacactgatgtattataggttgagatttgccattgatgtatcgtcacgaagtcgctgctgggggtcaatataggtgttctggttgttgaccctggaaacggatgtggttgtgaaacactggtgacccctgacttgtagccagatgtaatataattcgtgggggatgcttagtctgatttgtagatcaaggtgtatgagtaaagagtatatgccaagttgagttggcatggtagaaacagagagaaaggcgttggttgtatatgtaggaacagcttctagattctctaaaatttaactgaggctatttcaacttcgaaaa

SEQ ID NO: 33860 - DNA, 672 bp, Triticum aestivum
  unsure (1)..(672): unsure at all n locations
  Clone ID: PAT_TA_33860
cgtggccgacgccggcgggngcgtggcgcggggnataaaccacgcgccgtggttcggggtgactctggcggacttcgtcatgccggccttcctcttcatcatcggcgtctccgccgccctcgtcttcaagaaaacaccaaacaagatagcaacaactaagaaggctgcattcagggctatcaagcttttcatcttgggcgtaattttgcaaggaggatacattcatggacggcacaaattaacttatggagtcgatttggattatattcgattgctaggtgtgttacagctattggatactttctagcagcaatttctgagatttggcttgtgaacaatacttcggtcgattcgccagtatcatttgtgaagaagtacttcgtggagtggatcatggccataatcatttcagctctgtacattggcttggtatttggcctctatgttccaaattgggaatttaaagttcagactagcaattcgaccttttcaaatccaagcaatgatgttgggttcaaaacgattcagtgtggacttagaggtagtcttggaccaccttgcaatgcagttggctttgtagatcgggttttgcttggggaaagtcacctgtacaagaatccagtgtacaaaagaactaaggaatgcagtattaattcccctgattatggaccg

SEQ ID NO: 33861 - DNA, 1427 bp, Triticum aestivum
  Clone ID: PAT_TA_33861
ggtgtgtgcgggtcccttagattgagcccccctgtgctcgtatgtacccctctctactgggaacctgcgctgggccccctccgccggggcggccgcgcttgatctcgcgccccccccgggcgaccgtcctaatacaagagggcaaactccgccgccctgctccactcactcctctccaccgcctggacgccgcgccgccgcctcgaccgagcctcggccacgcggctcgccccgtcccccggcctgtcctgccgctcccgccggccgacgcgctccgtgcgcccgatggcgtcgtcgacgaccgcggcccgggccgacgcggcgccgccggggctgaaggagggcatcgcggggctctacgacgagtcgtccggcctgtgggagagcatctggggcgagcacatgcaccacggcttctacgactccggcgaggccgcctccatgtccgaccaccgccgcgcccagatccgcatgatcgaggaggccctcgccttcgccgccgtccccgacgatccgacaaacaaaccgaaaacgattgttgatgttggatgcggaatcggtggtagctcaagatacctggcgaacaaatatggagcacaatgctctgggatcacattgagcccagtgcaagccgagagaggaaatgccctcgcagcagcgcaggggttgtcggacaaggcttctttccaagttgctgatgctctggagcaaccatttcctgatgggcagtttgatcttgtctggtctatggagagtggtgagcacatgccgaacaaacagaagtttgtaagcgagctggcacgcgtcgcagctccaggagcaactatcatcatcgtgacctggtgccataggaacctcgcgccgtcggaggactcactgaaacctgacgagctgaatcttttgaaaaagatttgtgatgcatattacctcccggattggtgctcgccctcggattatgtcaagattgccgagtcattgtctcttgaggatatcaaaacggccgactggtctgaaaacgtggccccgttctggcctgctgtcatccaatcagcactgacatggaaaggcctcacttctctactaaggagtggatggaagacgataaagggagcactggtgatgcctctcatgatccaaggctacaagaaaggcctcattaagttcagcatcatcacctgccacaaaccccaagcagccatagaaggagaacctgaggccgcatcgcccagtgtagaatagaacccatgtgattggaatagactcggcttgctgtcgccttgtagctgaataatttcgtgttaccgtgcctctgtatctgcaactggaagtgccatatgagaatggttcctaaagcaaaattctcctcagattcatcagatcattactgtacttaaaaaaagggaagcctgccagattgcgcgctgttg

SEQ ID NO: 33862 - DNA, 529 bp, Triticum aestivum
  unsure (1)..(529): unsure at all n locations
  Clone ID: PAT_TA_33862
nggggttnccccacgagggcggtgtgctcgttttagttagtgggtccttcactgtccctgatgccatgaagcgtagatttactcagtcgttcttccttgctccacaaaaaggaggctattttgttctgaatgatgtgcttagatacattccggttgagccagaaacaccacctgtcaaggttcaagtgcttccgttgatagattatttctgggtatgatgatatcgccggtgaagtcatgaatcaatctacagaaagcatcagcaatgaagtcgtgaatgacagatagtcacgtctcggcagtgcactactagctttcctagagtgcaagtttatccatctatagattatatttgcttttgcaacaactgggtgtgaaaagttgaccatttgcggatgtcttagcactgtacatacatcatctattatcggacaagtagacaactgaatatatctattatattcatctcaaaagactatatgtgcatgttaaggaacatggacaaatttttattctgggaaacagaaaa

SEQ ID NO: 33863 - DNA, 394 bp, Triticum aestivum
  unsure (1)..(394): unsure at all n locations
  Clone ID: PAT_TA_33863
naggccaaccaatagcagggagaaggcatcgtacgaaggactcagtcaatgtacacatttctgcagcatttgcaggagggaaggacacaaaagaactacatgtcctgacagaggggacgcaccaaaaaagccgaggaaacctggttgatgcaagaactgcggaatcgaaggtcaccgtcggaaaacatgcacgaggccattggggttcgctgcaaactaattttcaacattcatgtcttatggtttgccgatcggaatttactagtttgttgtactacgaactgctctttgcatgcttatctccacttagatgatattcatagttgcatgatgaaaaaagattatgtagtgtcagctgttcgtccatgctctatgacaatgtagcaagataaaa

SEQ ID NO: 33864 - DNA, 1184 bp, Triticum aestivum
  Clone ID: PAT_TA_33864
cacaagcaaggctgtacagcctggattcttaacttcgatgcttcggagagtcagttcagagcggattctggagtatcagagagaaatcaagggtaaaacattactttgagtatgaagatctgaatggaccagtgaatcaaatatggcgccaagtttccatgaaagcaccacttatcaagctgttgattaaccggaacaaacgcctagttgaaagaggcactaatgaaactgattgctcgtgcatctgttcaacaccgagcgagatatctactgctggctaggcaataggatggtttttgtggcctgaaggaatgcactcatccaaattttgcctgcatcctgctggagatactccctcggcctgcagattgtttgatgcacttgtcagtttatgtgttcctgttatagttagtgatcacatcgagttaccattcgaagatgttatagactacagtaatatctcaatttttgttgacacaagcaaggctgtacagcctggattcttaacttcgatgcttcggagagtcagttcagagcggattctggagtatcagagagaaatacaaagggtaaaacattactttgagtatgaagatctgaatggaccagtgaatcaaatatggcgccaagtttccatgaaagcaccacttatcaagctgttgattaaccggaacaaacgcctagttgaaagaggcactaatgaaactgattgctcgtgcatctgttcaacaccgagcgagatatctactgctggctaggcaataggatggtttttgtggcctgaaggaaacttttgtgcctacattgcctgaattttggatgttgcagcgctatacatatatacggacagcaaggaccccttttcagttcctgattgtacatatcctgctaatgcccttcagttcttcagtagatattacaatggagtccgcatttgaagaacaccgttttgattggtgtttttgtatttgtttgttttatgttgttagcttgtcaggatgtcatgttaaatcagaatgtcttattcacaacattgattacagcgtgtcttagggagacatccaagttgtaataggaattatctaagggaagcaatcttgagatattgcttatcgtatctgaagtctgagcaatgtagtttttttttcctgaaccttactctgaagaatcaagtattgataaaa

SEQ ID NO: 33865 - DNA, 1972 bp, Triticum aestivum
  unsure (1)..(1972): unsure at all n locations
  Clone ID: PAT_TA_33865
tcagtcagtatgatgccacaaaagtccgggctgttactagattattgctttcacctaaaagggcagactccagtttgctcagaacaaaatttgaaataggcctgagcgataacccgtgtgaagcactagtgctttctcaccaggataggcttgtctcgaacatacggcttcttcgttcaacatatggttttatcccaccagctagagcaccgccgataaatgtctgttgttcagatcggaattttgcctacaagttaacagatgagatgcatgatccctggatcaagaagctgtttctgggatttgctcgcatttccgagtttaatggtcctagaataccgaatggtcataatactttgatacaggaagtatgtactgatttgcccatccctgagccgatgctacagttaccgtacaggatattcgggtcatctccgcctatgagtaattttgatccagctaaaatgctcacggattctgggaagctccacacgttagataaactactgcggcaactccgagctgaaaatcaccgtgtgctcctatttgctcagatgactaaaatgttggacatccttgaggactacatgaatttcaggaaattcaagtatttcagactggatgggtcttctgcaatttctgatcgtcgtgacatggtccggaatttccagaacaggaatgatatatttgtcttcttgctaagtacaagagctgggggactaggaattgatttgactgctgctgacacggttatattttacgaaattgactggaatccgacacaagaccagcaggcaatggatagaacacacagacttggtcagacgaaggaggtaaccgtgtatagacttatatgcaaagacactattgaggagaaaatcttgcaaagggcaaagcagaagaatgcagtgcaagagttggttatgaaagggaaacaagttcaggatgatcatctgatgagacaagaggatgttgtttcattacttcttgatgatacacagattgcacacaaattgaaagaaatatcaatgcaggcaaaggatcgactaaagaagaggcgagcaaaggccatcaaggttgacaaagaaggagatttgaagcttgaagacttggatgatccaactgaagaacctgtagaacaagataatacaaccagcaaaaagaaaaagggctcgcacaagaaacctccaaagtcacaggataataatggtgcggatggcgatgttcccgagagtggtcctgtcgaagatgaggagcatattgcttctctgaggcctaaaagatcaaagagactagtgaggagcacgggtgaggataaggaacccgttgctgcttgtgatgttgagaaacctgcagatgcagctgaaaacaatgacaacaatgatgcagaagagttgcaataccagactccttcagcctagttgacctactgggttgacctgatgagaacataagatgcgaatggcaagactctaatttgtggtgttgagtaggagcatcaaagatggcacccagaggaggagctctggatctgcttaaggtgttacgcagttcaataagtattttaactgtgctgtgcagcttcttttcagaaacctgggactgcaacttgggtgcagttgcagtgagctgagcccaatgatggctgttactgccagcccttatccctgctgttggcgatgctcgctctagccattttgtaaataagcattagcaatgttccgtcacatataggaataattttgctgtgtaaagagagtagtgatgtagagttttgttaggctaaaaatgaacatggcaggaaatatctgctgtgcttccgagttggaaacatctatcacttaatttatgactttatttagtccgtccaatagatgttaagtgtgtctattactccctccgtttcgaaaattaacagtgagatgccaggggtttgccaaatcacttgttnattgtgtacttaatttatacg

SEQ ID NO: 33866 - DNA, 849 bp, Triticum aestivum
  unsure (1)..(849): unsure at all n locations
  Clone ID: PAT_TA_33866
ttcccctctcgacgctcgttagctcacatcccactccaccaccgccgacctcaccgcccggaattctatggcctacacctcctccctccacctctccaagcacctcctcctccccaagccccaccgcgccaggccttcctcctccaggtcgccgtccttcgtccgggcggccagggtcgtcaacggcgccccgcacgtcaacgggcactccaagaaggcgcccaacggcaaggtacagatcaacggcgacggcaagaagggggccggcgtcgtcaacgggaagacgcacgtgaacggccatgaccggatccacctgtcggtgaccacgggcggcgggggccaggacgggacgggcctccgcgtggcgtaccagggcgcgccgggcgcgtacagcgagttcgcggccaagacggcgctgcccgggtgcgagaccgtgccgtgccgcgccttcgcggacgcgctggcggccgtggaccgcggcctggtcgaccgggccatcctccccgtggagtccaccatggagggcaccgcgctgcggaactacgacctcctgctgcggcacgacctggtggtggcgcaggagatcaacctcttcgtgcactactgcctcctggccatgcccggggtgcgcgccaccgaggtgcgccgggtcatcagccaccccatggcgctcgcgcactgcggccggcgcccctcgcgcgcctcgggggtgtccgccgcccggcccggggacgcgggcgcgccccgccgggggcccggcgctccatacattgctgccctccacagccgccatcgccaagcccgccgcgccgccgacctctacgggcctccgacgtcctcgcgcaangt

SEQ ID NO: 33867 - DNA, 885 bp, Triticum aestivum
  Clone ID: PAT_TA_33867
ccttctgcctgcacaccgcaaccaccctctcttgatatactgccaccggacagcatcacttccacaagcaaatggcgccggtgaaggtgttcgggccggccgcgtcgacgaacgtggcgagggtgctcgtctgcctggaggaggtgggcgccgagtacgagcttgtcgacatcgacttccccggcaaggggcataagcgccctgagcacctcgccaggaatccgtttgggcaggtcccagcttttcaagatggcgatctcatcctcttcgagtcacgcgccattgctaaatacgtgcttcgcaaatacaagtcggagcaagtggacttgttgagggagagcaatctggaggaagctgccatggtagacatatggacagaggtcgaaatacatcaataccacccggccctctcaccgatcgtgctggagtgcttcatatacccgaccttacgcggtcttcccacgaatcaaaggattgtggacgaaagcttggtgaaggcgaagaaggttctagaaatctatgaagcccacctgtccaaacacaagtatttagccggtgatttcgtcagctttgcagatctgaaccatttcgcgtgtactttctacctcatggatgcgacgccttatgcgtctctgttcaactcctaccctcacgtgaaagcgtggtgggaggatctgatgtccaggccgtccatgaagaagctcggtgcaggtatgaccacgagggtttagctacaagcaattgcacgaatcatatgctgcttctggtttgaatttcttctcctccgcattgtggcaacatcgaatgatttgaaggttcacttgtgtaatcccacgcgcacctcggctctcactcaatcttcacaagctatactttgtagtaaaa

SEQ ID NO: 33868 - DNA, 394 bp, Triticum aestivum
  Clone ID: PAT_TA_33868
caaagtctgtacaaagacggagaagtacttcaaccgcacgtgtaccctcccatactttagcttcccaccgctgttatcggaaccaactatctgatcaactgctctgagctcgctggccttgatcttgcttggacctgaaccatacatctggagtaggatggcggatgttcaagatggtgctgatgtagtttgatatgtccgtgttaagtgtcatatgtatgtaagcaggatatggtatcagcaagttgactttgcctgacaatgacgtctaagactggtattgttgtttgtgttggaagattggctaggctagtggtgctgactttggttatattctcatgtgccagtactagattttctctagatgagtggatgggtttgttcatctctaaaa

SEQ ID NO: 33869 - DNA, 731 bp, Triticum aestivum
  Clone ID: PAT_TA_33869
gctggagtgaccatttgatggtgctggacacgcgcactttgaggttttcgattgtcgataacctcactggctaccatgcggagctcagtgatcttcctgaccagagctttggttatcgtcgcgcaaatgcccttgttatgggccgagaaggagcccttgagatgttttctcttgtgtgtcaacacgggtcatttgccatctaccatacctctctgcagaataattcccaagaatggaagctagagaagattatacagctgcctgggcagtatcatgactataacatttccacggtgggtgcagccgagggattcttgttcttccgaggcgctccagaaggtattcatattgggaatgtggattcttactcaatggaggtcaagacttatgaaattaccaaagtctgtacggagatggacaatatctacaatcccagacgcgccctcccattctttagcttcccaccgctgttatcggaaccaactatctgatcaactgatctgagctcgcttgctagtcgttttggtcttgcttgggcgatctacacctggggttggatggcggatgttcaagattgtcctgttgtggtttgacatgtctgtattagtatgaatgtaagcaggatatgctgtcagcaagttgagtttgaccaacactggggtctaacactccggtttatattatgtactgatgtttgtgttgcaagacttcggcttatgttccctctttta

SEQ ID NO: 33870 - DNA, 923 bp, Triticum aestivum
  Clone ID: PAT_TA_33870
gaggctgaaatctgtcaagaaaggtgggcgatggttctaacatgatggagaccttttgcctgccataaacataagactgacaacacagatgacccgtcatcaatcagcgtcatgtctgcgccatgacaataggactgatgtcagattctcatgatgtgagaacaagcaaatgcagaaccacaggtcatgtgccacactcactagttggtaccggtggattgcgagtctgactatttcccggaagaaaagaaaaggtcactttcaagagatggtctccctgaagaggcaaatattgtgagggaccaatacctggaagaaaaagccacctcacgactaagcaacacatgactaatgccgtgttaacgtcagattatcgtgatgtgatgacaatcttcagccagtacaccagttttttgcctcatccactgggtggtagttatttgttcatagggttacactattccccggaagaaaagaaaaggtcacctccaatagatggcaaagtttccctgaagaggcaaatattgtgagtctgaccatttcctggaagaaaaagccacctcacctgtaagcctcactatgataattccgatttaaccaatcgattatgtgatgccatgtgtttcttcatccagtatacctgtttctcagttgaccgggagggtgaacgttatttgttcatatggttactcagatcacccaccatttacatgggtatttacatggattacatgcaaagtccaacttataactgttggataaatgttgttcttcgtcttgtttgtgggaaccaacatgggaagagtttaagctagtagtacaatagctatactcttacattattgtaattccaatgtgtaaaatatgaaggggttcaactgcttaatattttcattttccatcggcaaaaaaaaaaaaaaaaa

SEQ ID NO: 33871 - DNA, 1089 bp, Triticum aestivum
  unsure (1)..(1089): unsure at all n locations
  Clone ID: PAT_TA_33871
ctctcattgctgccgcaaccanatctagagcagctgcaaaagcggcgattgtgggcgcgacatcgcccccgtccatggtgaactcggcggagccgccgcctgcggctttcccaccagatctcaccaaggaaggtggtgttagggaggcgggtggcggggccgcgaaggtagatccaacgccatcgagtgcccaccgagggaggctgatgtcgctgccatcaatgctcaagccctgggggagccaacggcggctgcggtgcgttcccgtcaaccgccatggagaaaccatcgctccggacacgggatcctcctcgaatcagcaatatgaggtaagcgagaggctacagcttggccttggcaacgtggcagaggcatcgggcaccggcaaccccgctgtcaacaagtaccctgaagtcaccgaggcggtttctccacagccgttgaaggcacgccgtggccgcccgcgtcgccttgctatgccatccctcgcagccatgactgtcgcgagtgcgtcgccgcaggcattcgagcgcgagcggcggtcggtccgcgcagatgcgctcaagaggccgcgattctccatatcactctccaaggaggagattgaggaagacatctacggcctcaccggcgcactcccgcgtagccgccctcgcggtcggccccgcaaagtgcaaaagcagatcgatctgctatttcccggcgcgcggttatcgcatatcaacatggagtcctaccgggtgccggacaatcgctgaccctgtcaactcaacaagcgcctccacccaacagtaagcaagcaaagtgaattcgcagatcacagttcacattcaattcggtgctgccattgttagctacataatccatcgattaattgttcagatagagtcagagttggtatgtatggatcccaccaggaaactagttgtaagcagcaagtgatgacttgttagtgatttctaattttgagttgtactccgtgatattcatttccgtaatagcactagtggtggttcgttactttggtatcatcagcaattgaaaggacgtaatgtggtgtaccagtaattgcattgctcttgatgctcg

SEQ ID NO: 33872 - DNA, 1019 bp, Triticum aestivum
  Clone ID: PAT_TA_33872
gcgggcaaacttcgttctaaagcccagttctggatttgggtgctgctccagcctccagagaccaaagtcggagtaggcgctagatagaagacctgcacgaactcataccgtctacgcaatcttctggaaaaaaaacgaaaacgaaacgtcggcgcaacggacaacggacttcgactcggagacagcaatcacgctgtagtttcaagacgaacttctttcttaaaatcgagcaggagcaatcgccgaaccacgcccgctgcctcagtccgaccacggcccgctcctcgatttcgcaaggtgaacatgcgcacgatgggtttgggattgggagcgccgttcttcctcctcgtcctcctcttgctggccgctggcactggagctgtgccgcaggacaagagggttcgcaggaattatgttcttctcgatctcaatacaatcgagatccgcccaaatgacaaggaggaaattgcctctagcaaaattcctgtctctggtgagagtggcagcacagtatgctcaacttgtgagaatttgacaaataaagctgtcagttatcttagtgataaacaaacacaagatgagatcatggagattcttcatggtgcctgttctcagacattctccttagaacagaagtgccttgagatggtggactcgtatgcaactcttctcttcgccaagatcactgaaatcaagccagacgagttctgcaaacagtatggcctctgtagggacgtatcttttctgtctgttgcgaaaagtgaaagcacttgcacattttgccgccacctcgttgatgaagttctctcgaaaatgagagatcctgacgctcagtttgagatacttcaacttctcatcaaggagtgcaacaaggttaaaggtcatgtgcaggagtgcaagagaatggttctggaatacgttcccctcatcctggtcaacggtgagaagctcctcgagaagaggatgtatgcactcttatgcaagcctgtgacgccagcaaaacgagagccggcggatcg

SEQ ID NO: 33873 - DNA, 1536 bp, Triticum aestivum
  Clone ID: PAT_TA_33873
cgcgcgcggcaccggcccgtaatttccgtggggacccacgcgtgcgaaaatgttgtggacttaaaaaaaacagagacgaatgttcgaggcattctgaagtctgaactagtctggcctcaatggccctggaaaaaactgccctcaatgtcccgcgcgcgcgggctcccctcccctccgttgtctcgacgccccccctgtgccgccgccccccgcgccacgttcgagagaccaaagtcggagtaggcgctagatagaagacctgcacgaactcataccgtctacgcaatcttctgaagaaagaaaaaaaacgaaacgtcggcgcaacggacaaccgacttcgactcggagacagcaatcatgctgtaatttcaagacgaacttcttaaaatcgagcaggagcaattgccgaattccgcccgctgtctcagcccgaccactcccggttcctcgttcgcacaagggcaacgtgcttgcgatcgccgtgcttcttgctcgccccgttcttgctggccgccggctctgggagctatgccgccggtcaagctgtttcgcaggaattgagtttttctaagaattacggtcttctccttctggataccattgagttccacccaaatgacaaaggagaaattacctctagcaaaattcctgcctcggttgagagtggtaacccagtatgctcaacttgtgagaacttgacaaataaagctgtcagtcaatcttagtgagaaacagacacaagatgagatcatggagatccttcatggtgcgtgttctcagacattctccttaagaacggaagtgtcttgagatggtggaactcctatgcaactcttctcttgaaatcaagccagacgagttctgcaaacagtatggcctctgaagggacgtatcgtttctgtctgttgcgaaaagtgaaagcacttgcacattttgccgccacctcgtcgatgaagttctctcgaaaatgagagatcctgacgctcagtttgagatacttcaacttctcatcaaggagtgcaacaaggttaaaggtcatgtgcaggagtgcaagagaatggttctggaatacgttcccctcatcctggtcaacggtgagaagctcctcgagaagaaggatgtatgcactcttatgcaagcctgtgacgccagcaaaacgagagccggcggatcgttcttcgatggggaactgaggagcgatgcttgatgacagaaacacacatcacttgtagggatggtggaaacagggtgatgaggtgattgttgtacatataagttggctctgttctttgaaacgtccttatactagcattagggagaggtacgaagagattgcgcaacactctgtcaagttattgtgtatgagctcgtgctactactactatctataaaaaacaatgaaggtcataccttctgttgattggttttaaattgtgctacaactactatttataaaaacgcaacaaaggtcatacctttttttttacaagaggggggggaaaaactcgagggggggcccggtacccaattcgccct

SEQ ID NO: 33874 - DNA, 667 bp, Triticum aestivum
  Clone ID: PAT_TA_33874
cgagttcctagtcctttccccactcaatttcggggcgcaaatctcattctcttcggtgcgcaagaaaattgagcggatgccgtctcgtctcctccacattatccgcgcttgattaatctgcactgcgcacgcccagcaacgcgacaaggaatctcgctgccctgccattacactacaaaatcccacctgctcccctgtttcttggttcccttcttctccacatcaccccccacacccacctttcccctctgcggcggcgcacgagggatctggagaagacgagaagatgatggggaggaaggccctggactacgaggagctcaacgagaacgtcaagaaggtgcagtacgccgtgcgcggggagctctacctccgcgcctccgagctccagaaggagggcaagaggatcatcttcaccaacgtcggcaacccgcacgccctcggccagaagccactcaccttcccccgccaggtggtggcgctctgccaggctcccttcctgctcgatgatcccaacgtcggcctcatcttccccgccgatgccatcgcgagggccaagcactacctctccctcgcgcccggcggtttaggtgcttacagtgactcccgaggtatccctggggttaggcaggaagttgccgagttcattcagaggcgggatgggtat

SEQ ID NO: 33875 - DNA, 2036 bp, Triticum aestivum
  Clone ID: PAT_TA_33875
ggctctcctccactgagatgctagtcttttccccactgcaatttcgggggcgcaaattatattccccagcacagtcaacttgagcgaataccgtccagtaaccgccgtattttccgcgcttcattaaccggccttgatcacgcttatcgtggcgcctccgtaaacctggagatatgtcgtgccagaagtcctctgctgcaagtaagtctatccgttgaatctttaaggaggaggccacaactccccccacacccacctttccccctctgcggcggcgcacgagggatctgcctccgtccgggagaaagacgagaagatgatggggaggaaggccctggactacgaggagctcaacgagaaacgtcaagaaggtgcagtacgccggtgcgcggggaagctctacctccgcgcctccgagcctacagaaaggagggcaagatgtatcatcttcaccaacgtcggcaacccgcacgccgtagggccaggaacgccactcaccttcccccgcctaggttgtggcgctctgccaggctcccttcctcctcggtctgatcccaacgtcggcctcatcttccccgccggtgccatcgccagggccaagcactacctcagccctcgcgccgcggcggtttaagtgcttacagtgactccggaggtatccatgaggttagccatggagttgccgagttcatacaggcgagtgatgggtatgaaaattatccagagctttttaactatactgaagaagcctgcgatggtgatacgcaaatgcttaacgcgattaaaagatacaagagggaagggttctgtgtccctagtttaccaatactcgtgttattctattgcgatgtccctcataggtggtactcttgtcccgtaatatttggaagaagaggctaactggggacttgatcttgtcagtacccggcaatcagttgcagaagcacggtcaaagggaatcactgttcgagcaatggtgataataaacccaggaaaccctactggtcaatgcctgagtgaagcaaatattagggaacttttgaacttctgctatcaggaaaacttggttctgcttgcagatgaagtttatcaacagaatgtttatcaagatgagcgtccgtttataagtgcaagaaaggttatgtttgacatgggtcctccagtaagcagggaagttcagctgatttctttccatactgtgtccaaaggatattggggagagtgtggacagcgtggtgggtactttgaaatgacaaatattcctcccaagactgtcgacgagatttataaggttgcatcaatcgcgctgagtccaaatgttcctgggcagatctttatggggcttatggtgaaccctcctaaacctggagacatctcgtacctgaagtattctgctgaaagtaagtctatccttgaatctttgaggaggagggcacaaataatgacagacggtttcaatagttgccgaaatgttgtctgcaatttcacagaaggagctatgtattctttcccgcaaatacgcctgccgcaaagagctatggatgtagccaaaagcgctggcaaagcgcctgatgtttactactgcctcaagcttctggaagccactggaatttccactgttccaggctcaggttttggtcagaaagaaggggtgttccatctgaggacgacgatcctgcccgcggaggaggacatgccggcgatcatgtcgagcttcaagaagttcaacgactcattcatggagcaataccagaaccactcgaggctgtgaagagagaagaaaacaaagcatctacatataatataatgctgctcttttctaccagcaattgaagttgattaattagctgtaagctgtaactatggtgaagaaaactggttgctatgcttgatatgtatagggggaaattatatgcggaaatgttcggtccatttactacatatgatgatactgtaattgttggctccaataattgatccataataaataattaaacaacctttgttaaaaaaaaaaaaaacaaaaaaaacttaag

SEQ ID NO: 33876 - DNA, 445 bp, Triticum aestivum
  unsure (1)..(445): unsure at all n locations
  Clone ID: PAT_TA_33876
ggagaatnnttgaagaacaattgaggatgaanggatccntgatggcccaccatgtagagcctccatgaagaactccggtaataaaagaatgatagaaaggaagggaagttgaaagaacaaggtgatccttgcaatgatttagatgaagctttggaatgatataattgaaataacttggagctccggaaagaaaagatgaacaacttggaaccgagaatttgatatcatgaacgaactccgaaagaaggaataaatcacttggaggaaacaagaataagaattatgttatgcgtatccttcaccgatataaattgatgacaagcaacggatttttgcatactacttattctcgtagaaaggattaagatagatattgcgcaaacttgggtaaggtctcatcgaaccacgggtaggattganacaacgaataaattgatatgataac

SEQ ID NO: 33877 - DNA, 686 bp, Triticum aestivum
  Clone ID: PAT_TA_33877
actacacaaaagcaatagttttattgtttagaggactgatcgcatacaatatcggtggttcaaaagtgaccaaatgatagtacttgctaatataaaccaccaagtgattcaaaaggaacaacaccacagaggatatgtcaagaacaaatcaacaagagcagcatgcggaatgacccgtcgatgatgtgcaacatcctaatccatggaatgacccgtcgatgatgtgcaacatcctaatccatggaatgacccgtcaatgatgtgcaacatcctaatccatgagagcgtctctcctcctgtaacgcccgatgctagattagtcccctaagaggccccaactgggcaatggagatgaacggcttcttttatctgctgaccaccatatcattcgtcatcgtcacctcccacgcctcgcccgccacagactgagctacacaagcatggtataaaattcgtcgttgcaaatttgagtcgatgcccctgtaaggttgtaacttcaaacaacaagtcatgttgcattttctcgccccattctcgtcatagcaagcaaatatcacataaaccgataaaaatttaaaacatccatgtgggccgttccaaggtctcttagattctgacattaacatgatactatactgacatttggtgtaagtggtattgttttagaatgacgaggtggtcctcac

SEQ ID NO: 33878 - DNA, 765 bp, Triticum aestivum
  Clone ID: PAT_TA_33878
ttttttttttttaaaagttactgtgcactttgtttttactgtggtgggcaggaccggcatatattgtacagtactccgtagcaaagaatggtggcatatcgtgatggaccatgtccaaacacatcgatttagcaatccagtatttacagggaaagtggctatgtcacaggggcataacaaatgtttctacagtttcaggtaaacgcctttcatgtggaggaagcaggcggccaagcaccagaagatgatctccacgaggacgaacgccaaggtgccccaacgtttcgaatggaagatggcctggagcagacactccgtggcatccaccaggttgttctcgggtgaccgccagtagaacccttgaataagcgcagggaagagctcacaagctgccaggacatagactataagcgcattcatgcccatccactggaacagaattaatggcttcttgatgtggataacatcgactatgcagtatagcagcaacagaaggaacccagatactcgaccagccagcagcatgtagctcactgtatacaaaggcttgctgaaaggcatacctaatagttgtaataaaaatcctgagactgttaacaccgttgaagctagcagccatgacatcattcgctgtgaatgagtcttgcaatgaatcaagacatggccaaaatgcaacccaacaaagcaactcactgcagccatcaatgtacttaataaaccctctgggtcaaagggagccaggcaccagtctggcgcattcggagg

SEQ ID NO: 33879 - DNA, 1251 bp, Triticum aestivum
  Clone ID: PAT_TA_33879
gaggaattcggcacgaggcttcgcgccggcgcgggaaacggcggcggcggcgaggcgcgggtccagggagcggagctgcggggatgagctcgtcgacgacgtccggccagacgtccggcgagggcgacgaggcgccggacctggtctgcgtggtggactgcgtccatggcatggtcgacgccctctcctgcgtccgctggaacaagcatcagggcgcggtggtggagctgtcggagcacggcatcgtggtcaccgtggaggagagcggctgcctccaggccaaggtctacctcaagaccgagctgtttgcggagtacgactatggtgcggaggggcgtccacggttcggcctcagcctggggctcctcgtcgactgcctcaacatgtttaccgtccccgggttcgcctcccccgtcgagatccggtaccctggccccgacatgcagcttctcctcaggtcagtggggtctccagatgcatgtatacatgcagaaatcagaaccagaattcctgatactgtcgcctgggattaccattttgagcatgcagggaacactccagtcacttttactgttaagtctgccatcctgaaagaatcaattgatgaccttgagtggccaggctccagcattcagattcattttcatccagaccccccttcagtaatatttaaaggcgaagggcatggtgacttggagattgaattctcctactatgcaaataccgatcttctaattgcattccagtgtgaccaagaactgtcctacaggtataagtacaagtttcttcgtgccactacctcgaatgttccaagtagcgtcttgaaggagaatcgtgggagtaaagtgacgattgggaggggagggatgctcaaaatccagcacctggtttcagttgcaaggctaggtacgcaatcctaccataattttgctggaggggctcaacagccaagccggattgcttttatcgaattctttgtgaagccggaggaggatgattaaaggacaaatgattcctagcatgtattgtatataggttattttgctgggcctgtgtcatctatgaggtctggctgtatcttcagtacttatggaactgaaggtcatggtattcttttcctgtcagatgacttgtcgtaacctactagtctcagctctggatctttcttttatgctgattagttaaattatatggaaatgaagaaagtccatgccatcgttcttcttccttccaaaaaaaaaccccaacccc

SEQ ID NO: 33880 - DNA, 1271 bp, Triticum aestivum
  Clone ID: PAT_TA_33880
gccggccgtgcttggtccctcgcctcttcgctagctcacagcttactcctgctccagagaacttctgcttgctgcctcgtaccctagctagcaaggcaagctagccggtcgatctatactaggaaggaagggctaatggccggtagggatagggacccgctggtggttggcagggttgtgggggacgtgctggaccccttcgtccggaccaccaacctcagggtgaccttcgggaacaggaccgtgtccaacggctgcgagctcaagccgtccatggtcgcccagcagcccagggttgaggtgggcggcaatgagatgaggaccttctacacactcgtgatggtagacccagatgctccaagtccaagcgatcccaaccttagggagtatctccactggcttgtgacagatatccccggtacaactggtgcgtcgttcgggcaggaggtgatgtgctacgagagccctcgtccgaccatggggatccaccgcttcgtgctcgtactcttccagcagctcgggcggcagacggtgtacgcccccgggtggcgccagaacttcaacaccagggacttcgccgagctctacaacctcggcccgcctgtcgccgccgtctacttcaactgccagcgtgaggccggctccggcggcaggaggatgtacaattgatctacccacggccctcgtacgccaccagcccgccgccaagtcagcaaattatccaacgtggctagtttactagtatatagtttgtgataagaagccagccacgaattaagcattatctatatattggcaacacatacactacatatatgcatactatgatcgatgtaaaactagccgtacgcatatatgcatatcaacggctaattaattaattaaggggggatgaaccctagatcaatggcttggtactgcactatatatatagtctgcaataaactgatgccaatagtatacagcacacaatattggaggagctacacgccatgtgcaacttagagctacctggtacatatctgcaggttggtcttgactcttgtgtgttcacttatgcgtgcatgaacatcagtcaatcatatagacatagttatgcatgggagacaaacatgtaattgacagatactgctacaagacacagtgatatgtacacacttagcgcagtagcaaagcacatgcatgtgttgggccttgtacaacttcctcatgatgatggcaatataatcaagtgtcaagttatgtaaaaaaaaaaaaaaaaaaggccccta

SEQ ID NO: 33881 - DNA, 1146 bp, Triticum aestivum
  Clone ID: PAT_TA_33881
tggattcaggcctagattgtgatactccttctgcaagtgattcaagctcacagtctagcaattcaacgaagccttctggtcagtcaggcgagaataccaacatggatgaggaggattatatttgctcgacaccctcgagctcaagaacagatacaaagcaccagcaccagtacaatgctgctaattactcgaagaagcctcttcaggcatcattggccttttggcctcaatgggcttatgaaatgtatgacccatattcacttgcctgtagagctgctgatttgtggagactgataatcaaaacgccaagcattgatgagcttgtaaaaaaaccagatcttttgtcattttacatcggaaaccaacttccagtatcggaaactgtgagacaaaaattgctggagattaatggggtttcgtatcgcctacgaagggagatccagcttctaaaggcctgtgatctcataaaatgtggatactgcaagtccgaaatagcaaaacacagcgatgtggtggtgatgtctagcgatgggcctcttggtacttatgtcaacaatcatgggtacgtgcatgcaacgattactgtgaacaatgcaacggggcttgctctcgagggggatcccacagaagaacacagctggtttccagggtacgcttggactatcgcgtcgtgtgcgtcctgcggttccagcataggttggctgttcagtaccaccaagaggcatctgcacccgaaatccttctgggggatccgcagctcccagattgcggatgttgtagatgtagaacaacaacaggaggaagaatgatgccgttctccatgtacagcgagccctgtcttgacttgtgccgtcttcttttcctccgtttccgcagacttagaacctagagtgagagtgtggcgcctgcgccatccttgtcgcgctctcgtttttagcctagacccatatatacccgcctttcacctaacaaccaccctcttcttggccttgttgtgtgtattgtctgcttgtgtgtgcgcgtagcccgtttcagaaaccttctgagatgcatgtagtgtacacacctaggctggataataagttttccggatgctaaacaaagcatgtctgtggaagtctgtacttaaataagtgtgttatgttg

SEQ ID NO: 33882 - DNA, 2907 bp, Triticum aestivum
  Clone ID: PAT_TA_33882
gcctgtccccgttgtcctggatacggacgtcttgccgtcggctgaccaacccattgcttacgcacgtctccctattcgaggggctcgaatgacggccgcgctctgcggttcccctccgcggcggggtccaggtgcgtgggtggattcgttctgccccgatttcccctactctgccttccctgctgttgccggggttccctcgacctctggggttgatagcacggcttcttgacctgctatcggccggtttggatggatctaaaccaatccatttttttctatatacatacaacatgccgacggttaaacaacttattagaaacgcaagacagccaatacgaaatgctcgaaaaacggccgcgcttaaaggatgccctcagcgtcgaggtacatgggccgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggtcaaaaagccaaaaaaataagtgattttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctatgtatgtagacacatggatccgtacatctcgatcggaaaagaatcaatagaaggagaatcggacgatatctttctcgaaacaaacaaaaaaaaaaaaaaaaaaaaaaaagggcccctacgggtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcctctttctaaagagattcgattcggaactcttatatgtccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacagattccgtcctagcggaaaaggaggaaacggataccaattaaagtgagaaacaattcatactcgatctcataatcctatagattctgtggaagaaagcatcgacagataaaacattcttaccatgccatgcccttggtgtagtaagcgtttgctatcagggcacaaaatcctttccactgatgcaagacatccgccgacaccggtggggtggtagaccacctgatgaccgtcggctgtggcgtgcacaagattgtaatgaacactatactgagccacaggatgcactcctttacctcaaaagaacgaactttgaagctcaagcttgttcctccataggattgcaggccttcgatcttgacaccagaattttttatatccataagttcctttctaagcccctcttctgtacagcctagggcatatgcttgcaccccagcactaacaaacccctgcaaaacatttaaaggtcctcgatcaatgacattcttatactgcttgaacaggctggttgctatattacgcgacgagcggaagtcctcgtccgatgaagcattaacatgaaaccgatgcagccagtgccgtgtagttctctcatttaagcttctctgaagataatggctgactctggtaaagttaactctgaagctggaaacaatgtgtggtttctgtacatgatggtcttcgacggaactacaaattgtgttgcaacccaataaattgctacacgaaccagcggcgtttttcgggaacggtttcagctcttggtaagcaccgggcctgacgaacagaacgggtccgtgtagcgtcggcatggctgaacgctcatcaagctgcggcaagctgctcacgcatttctccagcaacaggagaagatttcagaagccgcgggtaactcaaatcgccggaggaggcggggagcgaccggaagctggcctgagaatccgcgggaagacggagaaggggattgtg

SEQ ID NO: 33883 - DNA, 1049 bp, Triticum aestivum
  unsure (1)..(1049): unsure at all n locations
  Clone ID: PAT_TA_33883
gcgggctgtcggcccacgcgatggcggcggctccctgcgcgctctgccgccgcgccccgcggcgcccgccgtggcgagtgcgactagggaggggaggagggggagtgagcgcccgcccgccagccgagcgatggtgtctaacaagtcaaacaaagaccgccgttcgtggatgaggaaagagggggctgggtcggggaagaaggatctttctcttgtttatactgaaaccaagtggcttatgggtaaaaatcaaaggtttacatggaccacgtaatatacactgctcttttctctttctatgtatggaaaaagagatggggaaagctctatttgtgttaatatattgaagaatatgactaccgatttgcccaagaacctgttgtctggtgagtaacggataggcgataagagcgatcttctacagaaacatttctattgatacgttgaattgatggaattgggcatgcgtctgggacaaggagaaaaccaatcttataagcttagactttccaagttcaggccaggatgttaagtcgaagcatgtacttgtaaaaaaacttgaagctgtgagagaacatccatttcaatggtggagcgtgttcgtgtgcgggcggggcaggacctttggcctagcaaacgtcctctggataggttcggatggaacaatgagtgtcgcctcgcctggacctatgtgtttgctattgttcttacgagtggtcctatgcgcagcatgtccaggtagcaacaaggtggtgcggattgtaatgctctctgagacaaatggataccttcagaatacattggggcaaatagtgttactgtctgctgttgttgtcatatgtgagtgcaattgttcttcctgaagacctatggcagcattccaggggaacatgtgtgtcgaaattgtaatgctctcgctctctagacaaatggacaatatcatagtacagggttgagaactgccattgctaatgatgttggtacccaaacatgtgtaagttgtgatgtttcagacaggttgctgtcgtncttcggcaccatgtgcagga

SEQ ID NO: 33884 - DNA, 1242 bp, Triticum aestivum
  Clone ID: PAT_TA_33884
gcacgaggatcaagcaaggcggcctgacctgtcttcagatgtcagcggccaatccgttctaaactcggttccccggacagttcagccacaacccccttccatccccggctcgtgcgcgatccggccgcgctccgacctcgccgcgggcgatgtcctcctccgtttccgtcgcggcggagtgggacctcctctctgaccgtttctaccgccgcatcaccatctactcccccctcccctggtcctccccggccaccaccaccgcctcccccgccgccggcggcagctccggggtcggccgcctcgacctctcgacccacatcgtcgccgccgctcccttcggcggcccgattgccgccgtccgcgacgactccaagatcgtgcagctccactccgagccctcgcgtcgtcgcctcctcctcttctcctcatccggccacccactcgcctcctccccttggacgccccacctcccccgcctccactcgctcgccttctccagctccctcaacctcctcgccctcctctccgatggttccctcctccgtttccgcctccccgatctgaatcccattactagctccagccccgtgcccctgctgccgcctgcctcaggcggcgtcgccgacgctgttttctggggaggcggcgtggctatccttaccgaggacaaccgcgtcgtggtcaccaccgacatcgaagtcgacgacccgcacccgcgggagctcgccgacccgggcgttgccgaggacgagcaggtgctgtgtatggccgtggtggagccacagctcgtcatgtccgggagtccagaggttctgcttgcagttggcgatcgggtagtggcagttgacgaggatggcgtgcaggtgctcggagaggccctggagattggacccgtgcagaaaatggcggtgtcaccaaacggaaagctgcttgcagcgtttgcacatgatgggcgcttgctcgtaatccccacggatttttccaggatcatattcgagtatgagtgtgattctgcattaccaccggatcaaattgcttggtgtgggttggacagtgtgctcctttactggtctgaagtgcttttgatggttggacccaatggagatccagtgcagtacaattatgatgaacctgtaatgctcattccagagtgtgatggcgtaagaatcctcacaaattcaagtatggaatttctacaccgagttccagattctactacattaatttttggcattggaagca

SEQ ID NO: 33885 - DNA, 1461 bp, Triticum aestivum
  Clone ID: PAT_TA_33885
ccacgcgtccggtgtatttgacagaattctgcatgctataaactctgcaatagaggctgaacatgatgtgagaacattggcatattggttgtccaactcgtctgcattaacagttctccttcaacgatcattcaaaactactaggaccgcactctcaaccccgcaaaggcgaagattttcgtctgagaggacatttcatacaagtcaaacttcaaatgctgggcttgcttatctcggcgggcaatcagttgttggagctaccggattaccccaagttgaagcaaaatatccagctttgctctttaaacagcagcttgtggatctaattgagaaggtttacggtatgataagtgacagcgtgaagaaggaactaaaccctttacttgaattgtgcatccaggatccacgaacttctcactcaaatctggcaaaaagcaatacaaatggcttgggacaacagaaccaattagcacattggttaagcatcgtgaaagtcctcgccaactatttggatgtattaaaggcgaaccatgtcccatcaattttggtgcataaattgttcgtacagatattttcactgattgatgttcagctatttaacaggctccttttgcggcgtgagtgctgttcatttagcaacggggaatatgtcaaagctggactagctgagctaaaacactggtctgataatgctactcgagagtttgcaggttcggcctgggaggcattgaagcatatcagacaggctgttgatttcttggtgatttctcttaagccaatgagaacactaagagagatacgtgctgatgtgtgccaagccctcagcatacagcagctagagcgcatagttggtatgtacttggatgacgtcaatggttcaaacactatttcagcagagttcgcatcaagcttgaaagctgcagcgcgtgaggaagcaaatactgtcacaactttctctatactgctagatgatgattctagtatacctttttcactcgatgatattacaaagacaatgccaatcattgagatggctgatgatgacttgctaccgtttgtccgtgaaaacccaggctttgcgtttttattgcaaagaggggaatagttatttttctcaccgtggagccttcggcagctgtggataaatcaggagttcctgtttgtaggttgtacagtatgcgtgattctttttataccagatagcaagccatcgtgccggcccgcccggccgcgcgtaggtatctgatttcgattgattggttcgttgattgtaaatttgtgtccagtttttcatgccatgttttcttttcaattatgttgggcttgtataccaaggggacaagggaaaagtccctgtataagcttagtataatacaaagttttgctgtaattagtgaagctgtacgtgtgttgtaaattgttacagaaaatgagttctgctggtatagaataatggcattg

SEQ ID NO: 33886 - DNA, 686 bp, Triticum aestivum
  unsure (1)..(686): unsure at all n locations
  Clone ID: PAT_TA_33886
catcacatctcatcggntaagttcatccacctcccgactttgcctgagctgttgtgctctagatccatacgaggcgtccacgagcttgttttcgagggggtcgggcagagctacaagagtgggaggcggaggggagctggtctacatcaaagatattgggaggcggaggggcggcatggcgactagctgcacagcaggatgcaagccgcgatggtgctactacatgatacaaccggcaggatggggagctgcaacccctggctagcggagctgcaaccgaggcgtggtcgaactgcatccagtgacggccgccaaacggctagctacaaatggcggttcccagagctgcaaccgcccgttggtcgagctgcataccgcgacacacccgacggcgagctgcaaccgtgcagtacaagctgatggacgagacggcggcgacaagctgcaataggtgatctggattgctggatctggttttgctggaacaagtgtcttttttgctggaactagtaatcctttttgctacaatctttttcttttgtttgctacaatcgaatcaatgggagtcaccctgttgttatttttgctggaaccagcatttatttttgctggaactagcaattttttggctacaatcaaccacccaagttctcctgctgagattgattttgctggcaccgataaaa

SEQ ID NO: 33887 - DNA, 606 bp, Triticum aestivum
  Clone ID: PAT_TA_33887
gttggttccccttgttgcttcgacttttctcgccgtccgatccaagatcgtgcggaccacagctcgagccgccggcaattgcatagtccgcgaggaccccgacgctcgaacccaccctctccggcccgtccctcctccccgcgtccgacgacctgctccgccgcgccgatcgaccccgtctcacccacgctgccgccggtgatccgggaggcagtcgaggggacagcgcgcgaccggaggggatgcggcagcagcggggcgtcggcaggggcgggggccggcgggatcccgggctgctgaccagggtggtggacaaggtcttccgcttcgtccgcctcgccgagttcgagatcctcttcgtcctcttcttcttcatcgccttcatcctcttcaaggatctcatgtctcgaccagactacaaccagatctttgtcaagaagcctgatcaagatgaccgctggccttagagggtaggaaatcataaaaatgttcttattgtagtgtaatcatcttttcttactgtgttgcggtatgtacattctgtagaggctcatttaaatttccttgttatgactacttattcgatactttaaagatgcttttgac

SEQ ID NO: 33888 - DNA, 950 bp, Triticum aestivum
  Clone ID: PAT_TA_33888
ccgtggggccggtacgcggcggagatccgcgacccggccaagaaggcgcgggtatggctcggcaccttcgactccgccgaggacgccgcccgcgcctacgacgccgccgcgcgcatgctgcgcgggcccaaggccaagaccaacttccccctctcccttccccatcaccaccaactacaggccagctactcgccctaccccgtcgccgccgccgccgctgtcccgacgtcggtcgccgcggcggcggccaggccagcctgcagcagcctgagctccaccgtcgagtccttcggcggcccgcgggcgcggccggtgctcccaccgcggcctccgccgccgccgatcctcgacggtgactgccatagcgactgcgggtcctcggcctcggtggtggacgacgattgcgcggacgccgccgcctcgccgtcctgcggtctcctgctcccgttcgacctcaacctgcccccggagtttggcggcgttgcatgtaacgacgacgacgagctgaagctgacggcgctgcggctctgaagtcagaaccaccggctggtggttagagaaaaaggataaggagaaaaatatttggttcttcccttctctccatagccagcacgatccacctccacgctgttgttgctgttgctgtttacatgatctgatgatgattaatatggcctgatctaccaatcggcctgcttgttgccgctggtagcggtgattattgccgactaccgccggcagctcgctgtggttgttgtaatatagcaacgttttacttgcttcctcttgtgaggaagtagacacctaaagtaacttattttctttttagccacatgtgttactgttactcatttaggctcatttgtttcgaattgagaacaatggaaaacaaagttttgtttatgagaatggtactgggtgcttaaatgctagaaaattcgagctaaaaa

SEQ ID NO: 33889 - DNA, 1185 bp, Triticum aestivum
  Clone ID: PAT_TA_33889
cccgcgcccgctcccccctctcccccccggccccgtgatggcccgctaccgccgccgcctggccccccaccccacgccccctcccaggcataattctccctagcatctttcttaccactagtattagtaggaggacctcctcctgttgctgctggagtggttgcttgtgtggtagagaggagaggagagggagatggaaggaggaggcgcggacggggtgacgagggtgctgctggtggacgactccccggtggacaggaaggtggtggaactggtgctcggcagcaacaccttcgccggctccttccacgtcgtcgccgtggacagcgccaagaaggccatggagttcctggggctcaaggacggcaaggagcaggccgtcgacatggtgctcactgactactgcatgcctgagatgaccggctacgacctcctcaaagccatcaaggccatgagtcctctcaagcctatcccggtggtcgtcatgtcgtcggagaacgagccccagaggatcagcagatgcctcaaggctggtgctgaagattacatcgtcaagcctcttcagagcaaggatgtgccgcgcctgaggagctgctcgaacgtgaaacccaaggaccctccatgcagcactgtgagcaagagcgcggaccatatagctgctgtcgatggcaagtcgtcgctgcgacggcgagcacacctcaccgatattgccatggtcctccactcgtcgagcgccgggctctcgcactacttcccgttcctcttcaagttcatcctgctggtctacgccatcctgtgcgtcggcgagctcctgcacagatggtccaacggctgcttcctctcctacctgaggtgatggtgccgcggtccagtgacatgctgcagctctgcaaggagtagctcgtgtgtcgtagcttatgagtgagcagtgaacctccatgtttcaacaaccatggatggagctttaggagtagattcgttgctttgagattctccgggcgggcgtcggttcttggccttgttgggctggcgagtcgaggaagaaccccttgtatccatccttgtacaaaacgcacaatgaggcaggcgtgcccatttttccattcacatttgtgatgtgaaagaagatgtccaatgctcccagaatctcattactaatttccatggacattttcaggcgatgag

SEQ ID NO: 33890 - DNA, 1054 bp, Triticum aestivum
  Clone ID: PAT_TA_33890
ctcccacttctcccccacccctccaacccaaacccatctcagctcgtccgtccccctcttcttcgccactggacacgaccgcaaaccctaggcgtcgccgtcctccgaggccccaagatcagctgatggagcagcttgaccaagaagcccagtccagagctcacttggaggaggagcttgtcaaggagaggcaggccaacgctcttttgcaggagcagcttcgaaagaagaacgaagatgaagccgcgtacaagcagcagatagcaactctcacgcagaggaatcaagctgaagcaaagaaaagcaagagtgacgtggccaagctccaagacgagataaggaagctcactggtgttcttaaggctaggcatgaggaagacaagctgagctgggagcgcattcaaggcgtcttgaaggcttgggatgatcgcaaagctgctcgtgaagcttcaacttcttctggtgacaaaggaccaagcaagaagaatgctggagctggggtcaagacttctcgaacaggtggcaagtgaggtttacagggcatcacaaggatttgatagcaaacagctagtacgtcaagccgcagccttcactcactcagcttgggttagcaccgtatctctaattggcggagacgaactccaatccacccacttcatttgtttcccaaggagggtcatcagcgagtccgctctccccaaggtagttaaaaggcgtaggtacgcattcccctgcaccaatgtaccgaagcattttacctttaatcactagatgggctcgagccagggtcctattttcattctccatgacttcaaagctgcttctctttatcaatgaggatcaacgttgtgaggattcaagcctgaggctgctttggtggtgcggatttgtctccacaggcgttgatctccttgtaataggcctagtctgcttgttgatgcctgttttgcttaggtgacactcctgttgtgcgcctccctcctgctggcttttgtttagagggcttaactcctgcgttggatgctggatcttattactttgggctttgttagtt

SEQ ID NO: 33891 - DNA, 708 bp, Triticum aestivum
  Clone ID: PAT_TA_33891
acgtcgccgtctctgccagccctcaacatggcgccctcctctcttctcgtcgcttccaccgccacagctctcctcctcctcttcctgtcggcgtgctcgtgccgcgcggccggcaacagcccgagcgccgtggtgctgccggtgaggaaggacggcgcgacggggcagtacctgaccggcttccggcagcgcacgccccaggtgccggtgacggccgtgctcgacctcgggggcggcacgctctgggtggactgcgacgccgggtacgtgtcctcgtcctacgcgcgcgtgccgtgcgcgtccaagctgtgccgcctcgccaagactggcgcctgcgccaccagctgcgtcggcaagccgtccccggggtgcctcaacgacacctgcggcgggttcccggagaacaccgtcacgcgcatcagcaccggcgggaacctcatcaccgacgtgctgtcggtgcccaccaccttccgcccggcgccggggccgctcgccaccgcgccggcgttcctgttcacgtgcggagccacgttcctgaccgagggcctcgccgccggtgccaccggcatggcgtcgctcagccgcgcccgcttcgcgctcccgacgcagctcgccgccaccttccgcttctcccgcaagttcgcgctctgcctcacgtcgaccctcggcgaccggggtcgtcgtcttcggcgacgcgccctacgcgtt

SEQ ID NO: 33892 - DNA, 419 bp, Triticum aestivum
  Clone ID: PAT_TA_33892
cgggtcgacgggcggctctttggattaagcaggacaccagaagaccaaagtgcacaaaaaccagcgtataatcaatcacagatcaattccacgccaagcaactctcagatccctcgtggatcagcaagcaaatatttttggcgcaaccataacgctgccttttctgtatattgttcaactctgaaaaaactcccgtagaaaagttgaaacctgcccattatatacgcgacacccacgctgaccaaatacttctcctaattggactcgtacagatccaaacaaaccagacaaaatctagcaaccgacctatactccttttccgatttaaaagctcacgtacagactccaaagactacgtactaggactctccaattgcaaggaaactaaataaatattccggccatgttgataacatagt

SEQ ID NO: 33893 - DNA, 692 bp, Triticum aestivum
  Clone ID: PAT_TA_33893
gaaaaaaagaagtaaccctctcctgaggaaagacgagcagatgttcagtctgatgccgttgatcttattagctgactgctctgacaaaaatgttgaaactgtaggtcaattacaactgcaatatgtgaatgcttttgtacattctgtttcctgttccaagcatcaaaacatattcaatctacagtgtctcaacctgaatcgctagatgacagcggcatctagttcatcaaaaacattggcactttggctcctcccaagtaccataagtcgatatttcggcacaaaatatgcctgactcacggttagttcagcatctaaccattgccgccccaacgacgtttccttgcaggtcgctgattcttgacatcgtccgcaccacacgcaactgctaacagttcatccttgccattgtcttgctccttttgggtaacagtaacagcttctttgaacctctcccttctcttctgcatcttttccattaccttaagtatgtgtttctcgtcgcattcccttgtagctccattgtcgcaaatatcttttgaggttgcattaatcatctctaactgaccgcctgagcttgcttcaatcactgatttcaatgctgtgtttcttggcttgttaggttttctgtttggagcagtatcctgatggtcctcttcaatcacttctccctcctcaatctcatcttcttc

SEQ ID NO: 33894 - DNA, 973 bp, Triticum aestivum
  unsure (1)..(973): unsure at all n locations
  Clone ID: PAT_TA_33894
cctttataccatttttttagcaacagcaggacccccaaagaatagttgctttgttgcatctatacccatctggaccaatatcatttgcacaggatgcacgactacaacagctgaatattgacaaagttacacagctacatttttacaacaggaggccgaatagttacagcgggcactccatgactaacctagagcttgtgttcactccgactcccgatgcctggtagcaacaaccaggcaaaacagctgggactgggatcacatgtgcctcaatgcgatcgccggaacctaaaccacatgtacagtcgcgctttcctccccaacctcgctaccgatcagcagtgtcagcaatctatgttagcacacggccatcgccgtatctttgttatatccccagctagctctccattgcgctctcggcgtcgtcgagcacgtccgccctttcatcaggaaggttggctcacacctccaggagctcgtctggccagtggagggtatgtgaggatgccgacgtcttcgattcttcccttgcgctttgtctgctatctgcgccacgtcacttcctgaattcatacctgttttttgtactccatcttcctcgccttgtcccttgatggtaccctagatccattgggcgcttggattacgtccgtggtaatcaggagcgactttctttgtcactggtttaagaaacagcaatgatatagcagtttggttccgcaagtggtcaactatcttctccaatatgttggagagctcaacctctcctcctctgcgtcgcttcgctgatggagcataatccgtcatatcagctggagtacgtctctttgatgctcgatctctttcaggtaccttcctgtcatttctgtatggcctgtgatcaagaatgtcagcatctcgaaattcatcctcgttctttttncttgcttttcttnctttgcctnctggagctncttnccncccggctataaat

SEQ ID NO: 33895 - DNA, 2534 bp, Triticum aestivum
  Clone ID: PAT_TA_33895
ccccggctaccgctcccctcgctctccatcccctccgggccatcgccgcctgaatccttcactagggttagggtttacgtaacgaacccgcgccatggctaccttcacttcccaggtcagcgcgatggctggcgcctccccgtcgtgctctctcttcgtgagccggcggcggccggcggtcatgcccctgcagatgcgggttgctcgtggcgggcggccgcgcgggttggcgatgcgggtgacgtgcgagaaggtggtgggaatcgacctgggcaccaccaactccgccgtcgcggcgatggagggcggtaagccgactgtgatcaccaacgccgagggccagcggacgacgccgtcggtggtggcgtacaccaagggaggagaacggctagtgggccagattgccaagaggcaggccgtcgtcaacccggagaacaccttcttttccgtcaagcgcttcattggacgcaagatggctgaggtagatgacgaggccaagcaggtctcgtataacgttgtgcgcgatgagaacggaaacgtcaagctcgactgccctgctatcggcaagcagttcgcagcggaagagatatccgcgcaggtattgaggaaattggtggacgatgcatcttaatttctgaatgacaaaattacgtacacccaactctcagtgctggtggacgctggctctactgatgccgcaactgagcctggtgctggatcaagaacagcaagaaatggaccaaataaatgagctgttatcaacgcgtatttctcagatagcaaataaaggatggacaatgaagagtggtgtgttgtacgtggatcctggtacatttgatgactgtgaatttggggttgggagatggtgtatttgaggtgctttccacatctgggcacacacacttaggtggagatgactttgataagaaaattgtagattggcttgctagcaccttcaagaatgatgaaggcatcgatcttcttaaggataaacaagcccttcagcgtcttactgaggcagcagaaaaagctaagatggaattgtcaacgctcacacaggcgaacattagcttgccattcataactgctactgctgatgggcccaaacacattgaggcaaccctttctagagctaaattcgaggaactgtgttcagatctgattgataggcttaaaactcctgttaataacgccttgaaagatgccaagctatctgttagtaatctagatgaagtgattcttgtgggtggatccacccgaatccctgcagtgcaagaaactgttaggaagattacaggcaaggatcccaatgttacagtcaaccctgatgaggttgtttctcttggggcggccgtacagggtggagttttggctggagatgtgaaggatgttgttcttcttgatgttactccattgtcaattggtttggagacgttgggtggagtgatgacgaagattatccccaggaatacaacactgcccacctccaaatcagaggtattctcaacggctgctgatggacagacaagtgttgagattaatgtcctccagggagagagagagtttgtcagggacaacaagtctcttggaagcttccgactggatgggatccctcccgcaccacgtggtgtaccacaaattgaagtgaagtttgacattgatgccaatggcattctgtcagtagcagctgttgataagggtactggaaagaagcaggatatcaccatcactggtgctagtacactaccaaaggacgaggtcgagagaatggtagaagaagccgacaagtttgcccaggaggacaaagagaaaagagatgctattgacaccaagaaccaagcagactctgtggtgtaccagacggagaagcaactgaaggagcttggggacaaggtccctgctcctgtgaaagagaaggttgatgtaaagctccaggaactgaaagatgccattgctggtggatcgacacagaacatgaaaactgccatggaggctttgaaccaggaggtaatgcagatcggacaggctatgtacaaccaaactagtgccggtggtgctggctctactgatgctgaaactgagcctggtgctggatcaacaagctcaggaaagggaccaaatgatggagatgttatcgacgcggacttcacagatagcaattaaaggatggtcaatggatcgtggtgagtgatacatagaccctgagttatattctgagtggcattctagggttgaggatgttatttttgtatctcggctccatgtatctacaagatgtttattcagtatatgaaatttggtagcggtaggaatcaacaacgtttgctagagtgatcttgaatcaagtatacccctctggtaatgcaaagatgcaaaaggattttggtcgaaacagtagcatattccctaaaaagtaaactagccatgtttaggttagcaataaacgaagtttcatggtgtacctaatgttatcgttatataacagatcatggtgcatctaagtttcatggtttatctattgggatttttattat

SEQ ID NO: 33896 - DNA, 604 bp, Triticum aestivum
  unsure (1)..(604): unsure at all n locations
  Clone ID: PAT_TA_33896
tttttttttttttttttttttaggacaatcgttcgatctcctgttgattattcaaacagccaaaacagaacccaaggggaaacacaacacacaaacaaatttcgattgcagtctgaatgacgcaagcacccagatcatcttctgcgatcccatccggatgccatttgttctttctacccaaggcggaagttgttgcaggtggtctggcggaagagcagggaggagctgaacccgagccgcgaccgctgcagatcgaactccagcaggttgtcctccatcatgtggcccccgaccaccaccgacgtccgcggggccgcgccgccgtccaccacgccaaggcacagcgcgccacccttgacgggcaccatccgagttggccccgaacaccacccacgacgccggctcgctctgcagcaccagctcgaccgtcggcacggccgggcccacgcgcgtgctccccaccttgctcccgtcgtagcaaagcttgaacggcgccaccggccgcacgcncggggattatggccgtctccgccgccaaagcgtccttgaccgccttgtgggatggaggtctcancacggtgtagggcgcacgttctaacttggg

SEQ ID NO: 33897 - DNA, 645 bp, Triticum aestivum
  Clone ID: PAT_TA_33897
gtttttgttggctgctccaaatggaagaagctcaatgattctgactatactctgacagaaaatgtatttgggaagcagagaaagtatacataggccaagaacttactacaactgtttggtttcagagctccaaatgttacagtcttgacctgggctcagagtttcctggtatatgcagcgcttcataatggccacaaccatgatagaggactcggattgggtcttctttcccatactcctggccatactccgcgatcgctatcaaaccaccagctgcttcttcgcgcatataaacagtgatcggcatctgaagaacgtgagaagccatgagcaattctggctctcctccccacacatgtggcttcctaatctgagagacatatgtatcgaaatcaccctcaataaaccattcagtctctgtccgtctcttgataaactcatcagcaaccttgagacctgggtctccggatccggcagcggcaggggagatgcgaggatggggctgcggcggggacgcgggtagcaggggaagggttggtggaggccggagaagctcagcctccgccccgcggaggcgggccgaggcggaggggattggtctactctccgccggatggagccgagtaggcgacgatggccgtgggc

SEQ ID NO: 33898 - DNA, 914 bp, Triticum aestivum
  unsure (1)..(914): unsure at all n locations
  Clone ID: PAT_TA_33898
tcaggtgggattcacatgattttaaccctaagagtgatttgcaaaaatctgattgagtgggtcactaatgtcaaaatgttatgtaatggcaccgaggctaaaatattaactttgttagttacatgtcactgtctgctaattatgcaggtatccgagtttggttatgtatctgacacggcatctaaatttaagcctgacaaaagaaggatagtctccgactgcaaattagattattattatgatgcaaaatcttacccaaatatgcctttctaatttttttttggattttttcgtattaatctattgccaacttgcaccctatttttgtacctcctttccaccatatactcttagatgtttaccttttaatgttggtcttgatatgcaggcacaagaagcgatgctctggtagctattatagagttggaaaatcaccaccaggctgtgtagaactagggggttctataggtagcttttgccacaagacctagtagttcatctagaaatgtccggaccacttttcattttgtttcattactagtataagttgcatagagtaatagtgttacttattgtttttgacagcttcaggtgaagaaacacttgatgaacgcaaggctgccagatcagccagtggaagttggcatgccaaacatacatcaaataagtcggggacaagcaataaacatgagctggaagatgcatcagctgagttccttcatcctactgatgacgcaattaacaaatcaggtctgggctactctttgggggacaggtgtattaagaaaatcaaattatccaaggacgttcgctttggcaacctgacaagcaaaactgttcagcaagcaccaaagcgaccaagaacagatacagcaaaaaggaannaagagtgatgtagttaaaacccaaccccc

SEQ ID NO: 33899 - DNA, 1353 bp, Triticum aestivum
  Clone ID: PAT_TA_33899
atccacctccatccagccatgctgtcctccaagtcttctttacatgttgctctaatccttgtggtcacgctgacagatgtgctaccgctggtatcttcttcacgtggcctcgttgcggtacccactgatggggcactggaggactctctgctgatgatggagaggttccatggctggatggcaaagcatggcaagtcgtatgcgggagtcgaggagaaactgcggcggtttgacatattccgcaggaacgtagagttcatcgaggcggcgaaccgagatggcaggctctcgtacaccctcggggtgaaccagttcgccgacctcacccacgaggagttccttgccacgcacaccagccgccgtgtggtgccgtcagaggagatggtgattacaactcgcgctggcgttgttgtcgagggtgccaactgtaagccggcgccaaatgttgtgcctggtagcatcaattgggtgaatcaaagcaaagtcaccccagtcaaaaatcaaggaaaagtatgcggggcttgctgggctttttctgccgtggccacgatcgaaagcgcctacgcaatcgccaagcgaggcgagccgccggttctgtccgagcaggagctcatcgactgtgacacattcgacagaggctgcacgagcggcgagatgtacaatgcctacttctgggtcttgaggaacggcggcatcgccaacagctcaacgtacccctacaaagagactgacggcaagtgcgagagagggaaactgcaggaacacgcggccacgatcagggactacaaattcgtcaaacacaactgcgaggagcagctcatggcagccgtggcggtgcgacccgtcgccgtcgggttcgactccaacgacgaatgcttcaagttctaccaagctggtttgtacgacggcatgtgcatcaagcacggggaatactttggcccgtgctcgtccaacgaccgcatccactccttggccattgtcgggtacgccggcaaggggggcgacagggtcgagtactggatcgccaggaactcgtggggcgagaagtggggaaagaagggctacgtctggctgaagaaggatgttgatgagccggaaggcctctgcggccttgcaattcagccggtatatcctatagtctgatctgatctgacgaggtcgactgcactgggcgtgcatgaaacctacggaaatggcattcacctatattttgggttgctctgtatgcatggatgcgcctactatattttactacatatatattcatctcccgccaataaaactatatgtccttgtatccatttatgcacgtttatgcatatcttgaataaattggacggattggttatcccc

SEQ ID NO: 33900 - DNA, 1750 bp, Triticum aestivum
  unsure (1)..(1750): unsure at all n locations
  Clone ID: PAT_TA_33900
ctaaagacccccccccagacaggtcactgaatgtgataactacttgcattcacaaagtcctatatacctggccaacggacaaagctattggacatacttaaccagcatgtgtaggagtgtggccatccggattttttcaatgctgcatgtgatagaagaagactttgtggacctaaggagaagatgctgaagcaatgtagtaattttaagctgttgcacagtttacggaaatggctacgcagacaaaagaacaacattcctatttttgataactgtataataatttagagtaaatttgagtcttatatgtatttgcagggcatgaatatgtgccaaagtaatggtagtattaaattagaagacgggatgcgacagacagcatagagtaatgatgttgaacagaataataagagactttttgcaaagcagaagtgctagcgggctttgaatgagaacgggcagctccagctacatgtatcgtgtcttacagcgatagataagggggagctactgggcatgccaagggtcgagcaggccggagaggtcaaaatgatccagacgatcatcagcgacgaggaccttctgaaggtgatgggccgcagcgacctcaccggcgcgcgtgcagccgctgatgccgccccgcacttccccctcaaagggcctggctgggaggtcgtgggtggctgccgggcggcggcatgctctcggcgctcacctgctgagccccgcgcccgccccagtcaccgggcctggcaacgacgaccgacgccctcggtatcctggtgctccgatggctttgttcggtcgcctgtgttcaaggccgatgtttttgtccacactgatgttccccctgaaaggacctgtctgggacctcgcgttggccccccagggcggtggtcgggtggtcccggcgctcacctgcttagtcccgtcacggcagcgcatccacgccggctaaccacctcgggtgattcgtctggctctcagctagctacttgtcgctgctgggttagtctggtccgccgaagtcttccccgaccgcatggcatatgtgatacagtatggggtaacatatctcgaaaagaatccaaaagtaagtaattattgaccgggcgttgcacccgtagattaggtgctctaactaaacttgagcccgcaccttcttccccatttgctttgggtcagcaagctatactgtatgtagtaagactgttatgcacttagggtagtctattctgaaggaggttgtaagtgtgttgccagaactctgccatataacagtctcgtaataggagaaaataattaccgcggtaagcgtacattttttacatacatcttgccggtcgaaatgcctatccgatccgacctcacgacggccagttcctgtaccaagccagcccaggcggagacgagcccgctgatccccagacgtgacggcgtggttgcagaacgggttgggctcgatgtccgcgacgccgatgaccaggtccgccaggttcgccgccgtccccatcagccgcatcacccggtccgcccggatctccccacctcgccctccctctcctcccccgcctcgcccccccccgccgccgcgcccctccgcccgctccccccctgatcccgcgcctgggcgataggagtctactccctgcccgaggcgaccaactcccgggcccgcacggcactccccccggaggcccgaatgcaaaagcttcgccgcggggcgcccaaggncaacccggaccnaagt

SEQ ID NO: 33901 - DNA, 693 bp, Triticum aestivum
  Clone ID: PAT_TA_33901
gttggccacatcccaattctgttgagggacggatcatcaagaaagcttttggaaagttgaagctagagcacgttgtgatagggaagggacagttccagcaagacgccgccaagcctaacgccttagatgagggagagctgctggcgcttctgagggacgagcaggccgaagaagacaggatgatccagacggacatcagcgacgaggacctcctgaaggtgatggaccggagcgacctcaccggcgcgcgtgcagcggcagatgctgccccgcacttccccctgaaaggacctggctgggaggtcgtggtggctgccgggggcggtatgctctcagcgctcaccagctgagccccgggcccgctccagtgaccggcctgtcaacggcgaccgacgccttggtattctggtgcttcggctttgttcgtcgcctgtgttaaggccgatgtttttgtgaacatgatgtggacatgacaacggcatcctaccccccctaagtaattatggacgaccgaggcgttgcagtgtgtactgtactgcaccccctagattaggagctgatcgatcctttggcgagctgtgttgtgatgtaactcgagctcgtgccttcatccaaggcaaccgacgacctagtagctatgtaagactcttatggtagtagtctgtgctgaattagtcttgagatagactgcta

SEQ ID NO: 33902 - DNA, 1229 bp, Triticum aestivum
  Clone ID: PAT_TA_33902
ttgacctcgctgccaagaacggcgatgtatttttcatcacagaggtgatggcgaaggagggagaggagatggatcaggggcggattaagctagaggaagaagaggaggcccggaagagagaagaggccgcaaggcaggcctttgacccgaaggcaaagttcagcaagttggatgaactgctgacgcagacacagctctattctgaatttctccttgagaagatggagcagatcacagatgttaagccgactgctgttgaaattaaagatgaagaggaaccagtggaagagcaaaagaaaggacggggcaggaagaggaaagcggagaactctaagccacagtacaatgacaagaaggctaaaacggcagtggtagccatgctttcaagatctcgcgaagatcgctctgctgatgatggcactctcacggaagaagaaaagtgggaaagagagcaagccaaccttgttccattgttgactgggggaaagttgaaatcttaccagataaagggtgttaagtggctaatatcactgtggcaaaatgggcttaatgggatactggctgatcaaatgggccttggtaaaacaatccagacaattgcatttcttgctcatcttaaagggaatggtctgcatggcccatacatggttattgctcccctttccaccctgtcaaactggttgaacgagctaacgaggtttgctccatctataaatggtctgatttatcatggagataaagtggctcggacagagctaaggagaaaacacatgcctaaaattgttggtcctgattttccaacaatatccgcttcatatgagatggccatgtttgatgcaaagtttcttgctaattataagtggaagtatgttgttgtggatgaggggcatcggctgaaaaataccaagtgcaaattactgagggagttgaggcgcatcccaatggataacaagcttcttttgactggaacacctcttcagaataatctagctgagctgtggtctctattgaacttcattttgcctgatatattctcatcccatgaggaatttgagtcatggtttgatttttctgggaaggctgatgaggaactagaggaagaaactgatgagaagaaaagaggccttgttgtctcaaagcttcattccattttgcgcccattccttttaaggcggttgaatgaggatgtagaacacattctttcacgaaagaaagagataatcatttat

SEQ ID NO: 33903 - DNA, 427 bp, Triticum aestivum
  Clone ID: PAT_TA_33903
cgcacgcttcacttcatccccattaactacctcgcaagtcgttccagtgatacgtgcgccgcttcgatcgtccttggacaagaacaacggagtccccggcggagcgggaagccatgccgttgccgcggagcaaggctaggaggaagggcttccggtcgcagctggagcaggaggtgctgcggctgcaggaggtgctgcgggaggagacggcgctgcacgccatcctcgacaacgcgctcgaccacgccgccgtcaccctcgccgacatgtcctacctccccacccacgcccaggagctgctctccaacatctccgccatggaggccgccgtctccacgctggaggaggagatggtcgccctgcacttccagctcatccaggagcgcaacgagcggcgcctcgtcgagtaccgcgccaacgccaagca

SEQ ID NO: 33904 - DNA, 817 bp, Triticum aestivum
  Clone ID: PAT_TA_33904
tggaatccccacttttatttctcctgcccggcctcggggcagcccttgcgccgcccgctagcgccgcccgctagcgccgccgctcgcgtcggcttccatggagaagttacggtggatgcccgtagtgctacgatctctcaggtcctactcggcgaaggcccctatctccaccagagctcctcgtcttccgactggcaaacaggtgctccaaggtgtcgcatccgaccatctgaagttacgagatagcatggaaaccctagacaaaggctatctcttttcgcgtagagacgcatgtaatctgggaacgtcacagagaggtgcaatatctcgtcttacccatatgcccacgcaccgcagcaccaatcaatggcctacacccatccgaaggcatcttctgacacggagttattcttcaaagggaactgatccaaaagatgactttgactggcatacacatattgcaacgggaaacttctcttatagagggcaactcacactcggcattaagatgatcagtctgcaagagcacttggtcaagaacccgatgctcgaaacaagaccagtttacggtgatcgcaatggcaagtacaaaacttttgtcaaggatatcgctaagtctcactgctggaatatgattaattctctctcagagtttcacaggatcggactatgtattgtggacctagatcactccaaaattgtaatctgtgatggtgttgcaagattttcaccagacatcctattcgttgctgcaacagagcagctcatcaaggataatttcctgaagctggcgaagatcatcaagcatgtactgttc

SEQ ID NO: 33905 - DNA, 751 bp, Triticum aestivum
  Clone ID: PAT_TA_33905
ttcacagtaagaagctctgatggcctcctggctctttacaattctatgctctccttcctgatcatccatatctaattataggcctaacagatggcactcttcatttgtccagctccgctagttttaggcttgtgaggatcattgacttacgctgtcccaaagatcgcagcgccaatctgatgggatcagacacggctgtcattgaacaagagcggcactgtcaatcatggatatacaccctatacaacatcgtgggattatcagtgaaggggaggctatacatggtcgatgcagcgagattggacgttgcttggtaagcacaactagacatcttccaagaacccaaagaggatttgccaggtgcagtgtcaaggacaggaaatacgaattccacacaggcgtccgaggaatgcgatgggatataacaatagattagtgcttacagaaattcgcccccaaagaaaataatttagcaagtgattacaccagcatgagtaacagaatgaaagctaaatctatttgtgcgaaaacagatggatgaagagcagaaaataaggattgtgggtggatgttggctaatcctctccactgattttttgttgttgtgaaactgatggtctctacactgatatatacactgcatatattgcttggtaaaattttggacagatggagaactcgtgtgcttttcttattcttgtatgagaaattataggcaagaccttaaaccgcaattgtctaaggacacgtc

SEQ ID NO: 33906 - DNA, 2103 bp, Triticum aestivum
  unsure (1)..(2103): unsure at all n locations
  Clone ID: PAT_TA_33906
cccacgtgtccggcgagttccgcggatcatctgtgctctgcaattaccggtctgtctgttccgcggatcatctgtttgtaaagctgtcagtggttgagccagcttggtgattgacagcggctcgacagcagcgatggaaaaggagacgagcagctccagcgacgtttctgcttctcatgtaggtcgtgttaggaatcgaagacgcgctaatgaggttacgacagatgggaataaagccgatggacagactttgcttgtcagcgatcggaacaagtacaagtcaatgcttatccgtacatattctactgtgtggatgattggcggctttgcattcctagtttatatgggtcatctttatatctgggccatggtggttgtcattcaaatattcatggcgacagagctttttaatctactcagaaaatccagtgaagagaagcaactgccagggttcaggctcctgaattggcacttctttttcacagcaatgttgtttacatatggacgctttcttagtcgggagcttgttaacacagtatcttcagatcacttgttgtataagctcgtcagcggcctaataaagtatcagatgtttatttgctattttctttatatttcaggatttgtatggtttattttgacactgaagaaaaagacatacaaataccagttcaaacagtatgcctggacacacatgatccttttaacggtttttgcgcaatcttctttcacggttgcaaatatattcgaaggaatgttctggtttcttctacctgcttcgctcattgtgatcaatgacattgctgcctatttatttgggttctttctcgggagaacaccattgatcaagctatctccaaagaaaacatgggaaggctttattggtgcatcagtgacaaccatcatctctgctttcctgttagcaaatgtaatgggtcgtttccagtggtttacatgcccaagaaaggacctgtcgacaggatggcttacctgtgatcccggttctatgtttaagccagagcattactttttgggggattgggtgccacaatggtttccatggaaagaagttttccttttacccgtgcagtggcatgctttagcccttggtttgtttgcatcgataatagcaccatttggaggatttttcgcaagtggcttcaagagggcttttaaaataaaggattttggcgacagtatacctggacatggtggaattactgaccgaatggattgtcaaatggtcatggcagtctttgcatacatatatcaccaatcctttatctcgccccacaatttctctgttgacacaatcttggatcagattgtaagaaacctaacctatgaggagcagaaatccttataccagcaactaggagagatcttccgtgaaaggcagtttatgcaaagctgaagatttatttgcgcgtgaaccacacaaccacacaagacagctgcgtatggttcattatgtagtttagatctatgtacagcatcatagctcctctgtaccgtgatagactgatgtccttatccaaaccattgtacagaacggagtgtggatagggtttaggttcttgatccgctctccacttatgttgcttcttttaatcatctgcgctaattctctccttgttcgttatcatcggtgttcttgtaaaaacagagctggaaatgcttattcgtgtatatcactttgtcgttcaaaataaaggattttggcgacagcatacctgggcatggtggaatcactgaccgaatggactgtcaaatggttatggcagtttttgcatacatataccaccaatcgttcatctcgccccacaatttctctgttgacgcaatcttggatcagatcttaagaaacctgacgtacgaggagcagagaaacttgtatgagcaacttcgggagatgttgggcaacttatgcaaagcntgataaactcgctgcccccccatgaaaagcacacaacacaagacagtaggctggctgtgtatgtatctatttgagtgctcgctcggttcgccgtcatgaatgtagctctagattcaccgtgtacagcatcgtcgtcgtagctcctttgtacccttgtgatgggagtg

SEQ ID NO: 33907 - DNA, 631 bp, Triticum aestivum
  unsure (1)..(631): unsure at all n locations
  Clone ID: PAT_TA_33907
naatcaatatactaccactgcagtagtactgtatgcatttttctcaggatctcggttctttgacaattccaagcccctcagtcctttagaccacatgattaaagcttttgactttggtaggaaatggaacaactcatgagcaggaatatgaaaggaacagtgaacccgacaatgtgaccatagtgcacaggaaaaacacagattacagatatctatatgttgtgagttaacctgacaatatgaccatggtacacagaaatacgcagattacagatatttatatattgtgaattaacctgacaatgtgtccatagtgctcccaagcaaaactgcgttttacaccaaatgttcatttcagatgacgatgggccatgagtgtacaaacctaacttacctatgtgcaaatgtttcaggatgcaggcgtcgctggacatcggctgctggccggcgctgtggggcagaggccgcgaccaccaccgtaacaagccagtctgagagtcttcttcttcttccatgcacatacagccggtgtagtggtaccactacttgtagcctgagacttgttgtgcagctaatccgagccttcttttttctgctcacacctgtaaattatgctctgtttttgtaaaaa

SEQ ID NO: 33908 - DNA, 1418 bp, Triticum aestivum
  unsure (1)..(1418): unsure at all n locations
  Clone ID: PAT_TA_33908
cttaagcaacacgtggccttaccccacacgctgccttaccacacacccctcggccctagcagcacacgcccacacgccacacagcctagccatgtctcggcccgcgttaagcatcctcgccccccccgccgtgagcagcgccgccgccgctccccccggcctcgacgcccgcgccctcgccggcgacgttgccaccgccgtcgacgctgccatggcgtcgaggcacgacaagtggatggcggagcacgggcgcgcgtgcgccgacgaggaggagcacgccgcggccgcgttcatcgattcgtttaccgccgcgaaggtcagcggccagcggctggccaccagcaggttcgccgacctcaccggccaagaatcccgcgccgcgaggaccggcctccggagtccggtggctggccgcggggagcggcgccggcgggttcaggtacgagaacttcagcctggccgacgcggctgggagcatggactggagggccatgggcgccgtcaccggcgtcaaggaccaaggctcttgcggctgttgctgggcgttctcggcggtggcggcggtggaagggctgaccaagatccgcacggggcggttggtgtcgctgtcggagcagcagctggtggactgcgacgtgaacggcgacgacgagggctgcgccggcggcctcatggacaacgccttcgagtacatggtccgccgcggcggcctcaccacggagtcgtcctacccgtaccgcggcacggacgggtcgtgccgccgctcggcctcggccgcgtccatccgggggtacgaggacgtgccggccaacaacgagggccgcgctgatggcggccgtggcgcaccagcccgtgtccgtggccatcaacggcggcgacagcgtgttccggttctaccacagcggcgtgctgggcgggtccggctgcggcacggagctcaaccacgccatcacggcggtcgggtacggcacggcgggcgacggcaccaagtactggatcatgaagaactcgtggggcgggtcctggggcgagggcggctacgtcaggatccgccgcggcgtgcgcggcgagggcgtctgcggcctcgcccagctcgcgtcctaccctgtcaagctcgctaccttgccgtatggttagtgtctggtccgctacgctataaccccccgctcctgcctgccacgcccaccgcttatccgttcgaccacactagctcctcgttgttaaatgggctgaagtttttcgtgtgtgtgtgggtccccatagttgtggtccgtagttgctatcttggttctgcaacgtcccaatcaaagtatgtgcggggttgcttgtantgttgtacgtactgcntgtgcatgtatcatgaaacatgatgaatttgtacngactggcttgtaanttgtaacncaaaaaatgttttg

SEQ ID NO: 33909 - DNA, 1575 bp, Triticum aestivum
  unsure (1)..(1575): unsure at all n locations
  Clone ID: PAT_TA_33909
ccacgcgtccggatactgttgatgaaaagtctatcgaaggagctcagaatatgctgctagattctctgaattgcattgttctagctagcggttcagatgatgaaccaaatcaatctgacacgaattcaagaagaaatacaagcaatagtatggcaagtagtgataaatcagtgcttaggagtcatggatgcaatgatcattcttccaatatcaatgtatctccacctgttcaacattctccaaatgttaccaatgcaaatgtggatttgcatgatactgcaggtacacattcagggagtaaaaggaaaagtgcatctccagttaatgaggaaggaagaaagcttgatttcagtcaagttgagaagcaactcgagtctgttcctgaactaatgaagaaactaattcgaccaaagtctaccacaatcaccgaatcgattgacaaggaaaaaagcatgagtttcaagcatttcgcgaatacagatcctccagtttgaactaatccaaaagttcgttatacgcagaccacactgaacaaggtcnnngagtgttacgaagaaataattgtccccccacgcgcccgggttgaaatctacaatgaatggtgaaaaatcgttgaacaatcaaatcatggcaccaagccaaggtcattttcaactgcgtgatgagaagtctgatggcactccaaggccatgggcaaatgcaaattctccaaatcgcactgattttctaggtgaaacttcacagcctggtggtcctgtcactaagattgatttagattctcgtggactgtctagccctgggaagtcccctgatgttgagatattatatgaagtcaagaaagacgacagattgaacaacttcatagctacttctgatgtgatttataatgacaaaatcaacagtcattctgctagtaaatctggaagagagctcagtaggtatggaccaaagaggattcttaaccctagcaaatataatgcttctccttatgtcaaccagaaatcatcgagataccctgttacaacaagaatgattcaattacatgatgctattgtcactttgtctcttgatgaagattacaaatacaaaacatgcatagactatggcaaagttacagtgacatacttttccgttggtacttcttttgcaactaatggccttgttgacacgtatactataaatgcttggtgtcacaaattgtctctagataataggccaaaggagtctaaagttcaccattttttcaccttatctctgaacatctactattgatggactcatatgaaactcaggaattgtatgaacagaagtccagtatggttcagagatgttttcagctagctaacggtgcaaggctaatccatacttgcgatgaggttcactttgcaactttgcatagaaagcattggtttccattttgttggtcttgttaaacatgaaaatgtttggaattctagactcagcatttgatggagagagtgattttcaccaacatgtgtttggatattctgataccaaatttcaaaaagggttggngacctggttggggagctcaagaaatcttaactggaaaaa

SEQ ID NO: 33910 - DNA, 806 bp, Triticum aestivum
  Clone ID: PAT_TA_33910
accaaactcgttttgccggccggcaccgccgggagtccgtcgtcgaccgatctgcctccactccgcctaagaggcgcagagttctcagagagctgggccagatctatcaatggaaggggaatactatgattccctggtcgcacgatttggcgaacaaggatccctcatcgaaggattcgggagggaagccgaaggcccggacgcatatcggacacagcttcgtcagcggatgtcccaggatttcctgttgaggaacctggaagagcggaggcgagccgccgacgatgtatgcagtgacccagcctctaaaaaggccatgttgggtctgcaggtgctgaccgtgggagaaacaagggaacaggactgcgccgtatgcctcgaggaattcgtcgacggcggcaagaagctcagaatgatgccctgctaccactccttccatcagcgatgcatcttcgactggcttcgccttaaccgcatctgccctgtctgccgcttcgcgctggccccacagtcagacgacgacagcaacaaggatctgggactgcctgagaaagtcgaatagctcgacagtttgccggaagttgaattgaagtgtgcagcccttgcaagccacgactgtgctagcaggttgtattcatcttcttttctgttatgttctgttttttattggattatcgatcaaaagcttgtagtttgaaccaaaattacttttttcagcttgaaaacttagtagatcttctctctgttatgtacaatacgagcaaaatttcatctttatgcatcaaaccttcattttctctaagaat

SEQ ID NO: 33911 - DNA, 535 bp, Triticum aestivum
  Clone ID: PAT_TA_33911
atggagcgaagagtcgaggccgcccaccattgccgcgctgtgcgtgctcctcctcctggtgctgctgcccggggaggtggccgccaagtccaagttctgcaagtgcttcgacgactgcttccctgggtgcacgaacgaccacgtgccgcgcttcctctgccaactgttctgcgccaacaagtgcagccccaaccaggccgccgtcagcggcgacgccatgtgcaggatggcctgcaacaagctgaacatcaaaatctgcggctggtcagcggcgcccgccgatgcagctgatgcggccagctgcgaggaaaactgcaacaagaaatggagccagaattaaggcccacaattaagctgttacgttttaggagaagtaaaaagatatctgaagggcttgttgatcgatcatgggattgtagccatatatgtatgatgttgaacctctctgtgattgtagcagcaaccaataaaataaatatctggatatttaaggcatatatactacacaatataaagttgatttggcatttcaaaa

SEQ ID NO: 33912 - DNA, 656 bp, Triticum aestivum
  Clone ID: PAT_TA_33912
ccctccccccgcatcagctctcttctctcctcccttgatcccgaagaagaagaagaagccgtagcttgcacgaggaaggagatggaggcgaagaggtcgaggccggccgccatggctgcgctgtgcgtgctcctcctcctggtgcttctccccgggcaggtggccgccaagtccaagttctgcaagtgcttcgacgactgcttccccgtgtgcgtggacgaccacgttccgcgcttcctctgcaaagtgttctgcgccaacaagtgcagccccaaccaggccgccgtcagtggcgacgccatgtgcaggatggcctgcaacaagctggacatcaaaatctgcggctggtcagcggcgccggccgatgcagctgatgcggccgtctgcgtggagaactgcaacaagaaatggagccagaattaaggcccacgattaagctgttacgttttaggagaagtaaaaaaatatctgaagggcttgtcgatcatgtgatcattacatatatatgatgttgaacctctgctctccgtgattgtagcaacaaccaataaaatgagtatctcgatatgtaacttgtaaggcataatacacaacataaagttaatttggcttcgatttggcatttcccaaaaaaaaaaaaaaaaaaaaaaaaaaaa

SEQ ID NO: 33913 - DNA, 1216 bp, Triticum aestivum
  Clone ID: PAT_TA_33913
tcgggcagttttacagtacctacctagtgttgctggagttctcctgtgtggacagctaaagcttattgagcctgataggctgaatttgaggaccatgtggaagttcttacctgctgctgttatgttctacatctcaatcttcacaaacagcgagctcctgatgcatgccaatgtggacactttcatcgtgtttcggtctgctgtgccgatatttgtggccattggggagacactttaccttcaccaaccatgcccatcattcaagacatggctctcactttccactatacttggtggaagtgtgatatatgttttcacagataaccagttcaccctgactgcttacagctgggcaatagcctatctagcgagcatgtctattgacttcgtgtacatcaaacacgtcgtcatgaccatcgggttgaacacatggggccttgtgctctacaacaaccttgaggctctgctcttgttcccccttgagctccttataatgggagagtttaatcagatgaaggtggacagctccaagatgacaacaaactggctatcgttcgacgtggtccttcctgttgctctgtcatgcctgtttgggttatctatatccttctttggattctcctgcagacgggccatctctgctactggatttacggtgctcggtatagtgaacaagctcctgaccgtcgtgatcaatctgcttatctgggacaagcatgcgtcccttgtggggacaattgggctcttgatatgcatgtctggtggtgttctctaccagcaatcggccacaaagcccaaggtgcccaagatcgagccaaaggaagaggacgatgaagaggggcagaatttgctgcagattcagcccgggcatgagagcaacccaagtcaaaagcattcctcataagcttactttaccttccctcgacaacccattcgtggtatatctcagatgagaaatcttgaacatgctgtagaacatcggcgtttcaagagaaactaaatttcattctacaatacctttgttattgtatactgtttttcattggttagacaggattgtggtggtggtgtagggtaccagacacctcaacatactagggtcgaatcccctgtatactgaaccatgtatgctatttaccatattccaagaatacaatggatgtacttattcgcttcaaaaaaaaaaaaaaaaaaaaaaaaggggggcggttttaaa

SEQ ID NO: 33914 - DNA, 1741 bp, Triticum aestivum
  Clone ID: PAT_TA_33914
tcttctgtttgtcttgtggcttcctagcaatcccgctacccaagtcttatagtgatagtacataacacaacacattaaaatacatacatagcgcacgcacacactatacttatacacagagttgtgtgtacttttactaacccaattaatatatgtgtgctattgacatggcccacctatccaactattcattactcagtcattcatgatcgatgttgttaatgtcttgagatcggccgcatccttaatgagcctgatggagtcagcaaaatcatctaaaagcttatgacaatctgggaattgttcgtcatcaactgccagagttacccggatagtgctaccgtaatttaggaagtgcatgatcagtgcctgtggttgcccgtaggcggtgattgccatgaaggaaattgggtgcccacatagcgttatatgttcagatggcccaacaacatttgataagagtgtgcttgtacgtgtggcaaataggcggaagataaaagctcctgtctttgcgccaaagtatttcaccaaaaattgaacaaccacttgtataaacttcacttctaaagagctctttttcctatgcatagacctttttgccttgcgaacatactcaaggggatcattgtgcaaggcaatatgaaatggatagatgagactgctaagtcggttccccctctcgaccttggtaacgtatgtttgtcgactagagattggccttgtgttgacagggaggattgatcgcaagcagattctctttgtgttagtgtctccggacttcctaaagtaatattgtgaaagagctgctgaagtcacaccaactagcacatcgttgatagtgcagttcatgacagtcttgatgagcttgatatcgtcaaggctaaagcttcgatgcacgaagcgcttgcgacggcgagacccgctggcatctggcatatgcgtgaacatcgtacggggatctctcaagaacaataccgtcgcagcaagcaatgcgacatccaccagcgtgtgccatgccaacacaaaatatgaccaaacccacgccaggtaatggcttgacaaagacaacggaggtcgtgtccgctgttgatagatcgcgccggtccttctgggcggcggtggcatggccggcagcctagttgggtcagccgtgctgcatgccgaagccatgaagagtgtcatgatggacatggcgtcaccgatggagtggtgcaggcggagcaccaccgtagaggccgcgccggaggtcttcaagttgaggaagtggaactcccaaagcgggcgtcccctgtccatagggagtgtggacaacatcgctacatagtcctccacggccttttccgggttagaagccacggcagcaggatcgaacgtcgggacgatgatgtgttcgtccacgttcaccgctgtttgcacccatcgcggcttgccatccttgggtccatccattatttgaatgctgcagaagcgtgaggaacgagtaatcagctctgtttcgatgccggagcggaagacgggcaggttcaccggcgtgctgagccccatcacgatgacgatgcagacacccatctcctccaagattcttccggtagggctcatgggttcctccgccgtggaattgtcagcaccttccgtctctgccgacacacggacagagagcggacggcttggcggactggctacgttcgctgttacttccatcagtagcttgctcgatcccacgcgtccgcggacgcgtggg

SEQ ID NO: 33915 - DNA, 720 bp, Triticum aestivum
  Clone ID: PAT_TA_33915
tttttttttttttttttttttttttggaacttcaaaatttcagtgctgtcataaagcaacttttcaagtgaggtatattaccacttatgaaattacaggtaactgcatactaactatttcagtaacaggatgactggtgcagatgttagaacactgagtgaattcatgatgactactgatgatgccaaaaaagaaaaaggataaaaggcactgcacgactcctgcagtctggagttactcggtggttttatgtcttgcatttactgacgactgctgcactgcgctgaagaaccccatgaaggaatctaactgagcttaattctatctatactcttgacaagtaacacggcccctttcccatggtggagctgcacattagctccgggtgaagagaacttgcacaaatatgacaagtagctggtcagcatgttactacctccgcatcatttcttgacaagaaacagctcagcaacactgctgcaggacccagctggccgagcacggaaaaagaaggcgtcaacctgtgttcgctcaagcttgccgatcgagtgaaggccatactgcatatctgccttgtattttgggaactcagaatccataatatcctcaaacatatgctctgtatacagaacctcccctgtagtagtatccacgctatcatccatcttatgaagactcacagacacctgtagctatgcactaactttccggacgagtggg

SEQ ID NO: 33916 - DNA, 1528 bp, Triticum aestivum
  unsure (1)..(1528): unsure at all n locations
  Clone ID: PAT_TA_33916
ctcgngccgctgaaattcttaatttttcaaaaatttatctcattgaaataattaaaaattaagaatgggtttagttggttaanttctcgtgcgtattcggctcgcgagggaacgaagttattttattacctaactaaagatatttataaaataaaaaaaaaaaaagttgaatcattttactttctattcataattcatttttatatttctttaaaacaaagatgaaacagctctcttgttccataattaactgattgagtgaattccaatgaaaacctatgtttataagaaattatcgaatagtccttacttcatatagaactaaaatcctaatgactataaattacctaagttttagaatgtcttgtttaagagactcagtattttttgttttgattggaattcctttcctttatggaataccattctgaacttaattaactattttcattttcccttctttttatccccccgtcttatcttatatgggggataggcttccataccatatatctatatatggagtatacttgatatataaatagatataaatagatttaaatgagaaacccttctatatattctatattattaaaaaacaaaaaaaaaatatataaagaaaaaatgttaaaaaattcttgttgtcttatccgcattagacaaaatgaagtaaaaaataattcaaaatttaagtatctttcagtatctaagtataaatactaataaaaagaagaaagaaggattgatttgcagcaatagatgtctttcacatacaactagaaaaaagtaatttcctttttgaatggcagttccaaaaaaacgtacttcaatgtcaaaaaagcgtattcgtaaaaatatttggaagaaaaagacttatttttccatagtacaatcttattctttagtaaaatcaagatcattttcgagcggtaatgagcatccaaaaccaaagggtttttctgggcaacaaacaaataataagatttttgaataatatgaattgacttatcaaaaaagaattccaattatttaataattttgattcttctttgaatgtacttttatgtgtcgaattactcggtacaatattcttagaacaaaaaacccctcttatatatacaagaaaaaaaaggttggggtcgtagaccggccccggcggccgcttgtcctctctagggacttctcataattttcataataaaatatgaggattctattatgaaaattatgaaaagtggagtattcttacaataggacttacaacttctacctatcttctccaaaatcataaggttagtaaatcttattaataagagcataaagactttcattctagaaattttgaaaaaatccaaaaagccttttctatttatccattttaatttcatcattaaatagaaaccctttttggattttttcaantgtattgaaagaattttcaaaatgtaaacgagaaattaattagaaaaaattagttcataattgcaagttagaaaaaagaagttccaactctttccaagcagtgttg

SEQ ID NO: 33917 - DNA, 514 bp, Triticum aestivum
  Clone ID: PAT_TA_33917
ttttttttttttttttttttttttgacatgcaaacatatcaaaagcattgcacattacagtaagtgtcaacagaaaaattcacttgtacatcgcacattacatttcaaaatattcctaagaatttatcttctttaatacatgtccgatgctacaagcaaaaaaagcctatgtatcttccagcaccatttctgttgctacctaaaagcaaactccaccacagctgcttcttctccattaccaacctcagtttcaacagcatgactagaactcaagaaccaactttttatggtcatttttgatattatggtcagtgaacatcatttcattcgccattcttattcggatgtttgcgatatcttcatccttcactatatcatgcatcaatatcctgggcttccaatgcttcagaaagagtgttgtatatatgccacaatcaagctcattgctttgtttaggtacatcaataaagtgcgtggtccaatttctccagttaagatttcttgagctcccata

SEQ ID NO: 33918 - DNA, 553 bp, Triticum aestivum
  Clone ID: PAT_TA_33918
cgtccgcccacgcgtccgatccaccgtcgcccaccgtcacccacccccaccgccacccaccgtcgcccaccccctccgccgacgaccctcaccatcgagcccacgcccagatccgcgctctctagtactcgcccgcaaccctcacccgtggctagggtttcggccgccacccctaaattcgtcgggatctgccacatccagcgacagcgaggccagaggtggccggatctggcaccggtggatgggatgacgacgatggcaggaggggcgaacctccatgggacgggtcgccaccatggagatggagctccttctcccctaccacgcaacctccctcccagcgccaatagagcaccggctaccatgacgcgacagcgctgtcgcaagcctcgcggggctgtgcatctcgtcgtctgccacgccctaccaggagctacatcacccacacgtctcctctgaagaaggggacgatggcttgtgcgtcggcgtggttggctccagctccccgccgacctatgacttcacatgcggtcgccgtctttcgaccacaggt

SEQ ID NO: 33919 - DNA, 551 bp, Triticum aestivum
  Clone ID: PAT_TA_33919
catgggcaacgggcagccaaacagggtggacagcctgaggatcgccttcaggaaagcaggggaagccgccaagggagccgctctggccagcgacgccttcttcccattcgcttggaaggatgccgtggaggaagcgtgcgagaacggcatcggcacgattgcgcagcccggcggcagcatgagggacaaggacgccgtcgactgctgcaacaagtacggggtctccctcctgttcaccggcgtccgccacttcaggcactgagcctaacctgagtccgtatggtcatatcaccggtctactgtcagtcagtccgccgtgggaacttgcggatgtttgtcgcaataagacagacgcaggtgattctgagtccaactaggattagttgtatgacggtggcgaaagcattttgccacgtacgcaagtgaggacgcctaggtgttcgtcacattgctgagccagcagcggctgcgtaataacaaggtcggaaaaccaggggccatgtactagctaaagtaagcaaaaagtgtgtttgtattcagacgtcgacatg

SEQ ID NO: 33920 - DNA, 1647 bp, Triticum aestivum
  unsure (1)..(1647): unsure at all n locations
  Clone ID: PAT_TA_33920
ggcgctgacacccacaacttgccccctccccggccacccccttctctcccgccaggaggtagccgccgccgccgccgccgccaccagcgcgcatggtttgcgccgccgtctcactagccggcggaagtgccactgccactgccacctccctctcccgccggccagcgctcggcctccgcagccgccgcctgctctgggcgcgcgcgatgagccacgtcgcgccgcggctcagctccgccacggtcggggcccccacgcccgaccacgaccaacggcccggcagggccagggctgtggctgcgcaagcaggaccgaggcaagcactgatatcactgtcggataaaacggacttggccaatcttggaaacggtcttgagagcttggggttttctatcatctccactggaggtacagcgtctagtctggaagcagccggagtgaatgttacaaaagctgaacagattacaaattgtcccgaaatgcttgatggaagagtaaaaacattgcaccccagtatacatggtggtattcttgcccgaagagaccaggagcattatcttaaagcattgaatgagcatggcatagggacatttgatgtgggntgtggtgaaatttgtatccattctatgataaggtcacctctggtacaatttcttttgaggatggcattgaaaatattgatattggtgggcctacattgatccgggctgcagcgaagaatcataaggatgttcttgttgttgtggatcatcatgattaccctgctctattgaaatatctacaagaaaagcaagcggacccacagttccgcaggatgctggcatggaaagctttccagcatgtggcttcttatgattcagccgtctcagagtggttgtggaagcaatcgagcggtggagaaatatttcccccaagctttactgttcccctctcaatgaagtctacacttcgttatggtgaaaatcctcatcaaaaggccgcattttacggtgacaggagtctttctctagtcaatgccggtggtattgcaacatcatttcagcaccatggaaaggaaatgtcttataacaattacttggatgctgatgctgcatggaattgtgtgtcagagtttgaaaatcctacttgtgttgtggttaagcacaccaatccgtgcggtgttgcatcccggcaggatgttcttgaggcatacaggttggccgtaagggcagatcctgtgagtgcatttggcggaatcgttgcattcaacaccacagttgacgaggatcttgcaaaggagattcgcgagtttagaagtcctacagatggcgagactcggatgttctatgagatcgtggtggcaccaggatacacagagaagggcctcgaggtcctcaaagggaaatccaagacgttgaggatccttgaggcaaagagaagtggggaaaacatgctgtcgctcatgcaggtcagtggtaggttggctagctcaagagtccgacgatctaaccccagaagacatcaccttcacgacgggttctgagagagctccgacggacagtgagctatcggatgccaagttcgcctggctctgcgtgaagcacgtcaagagcaacgccattgtgattgccaaggataattgcatgctgggcatggggagcgggcagc

SEQ ID NO: 33921 - DNA, 857 bp, Triticum aestivum
  Clone ID: PAT_TA_33921
cgcccctgaccacgaccaccaccccatccatccacccatcttcccccagtttcctttcgggaagtagtagcaggggagcaggagcagaaggcgatggcggacgtgcagatgggcagcggcacggagacggagaccttcgcgttccaggcggagatcaaccagctgctcttgctcatcatcaacaccttctactccaacaaggagatcttcctccgcgatctcatctccaactcatcagatgcgcttgacaagatctggttcgagagcctcacggacaagagtcagtggcagaccatgcgaacaacctgggcaccatcgtgggctcgggcaccaaggagttcatggaggctctgcagggccggggccgtggctgcgccagcaggagtgaagcaagcgctgatatctttgtcggatacaacagacttggctaatctcggaaacaaccttcagagcttggggttctctatcatctccactggtggtacagcgtcaagcttggaagcagctggagtgaatgtgagaaaagttgaatagcttacacattttcctgaaatgattttggccttcattcatcaaaagttggtgtacaaggaactccaggagaagaatcttgaagtaaataatttatatagataaggatcttatgttgtcgtggtggctgctgctgtgaccgaagatcaaaagaagcctggagatgtgcatcatagttttagttgatgttgccaccatgttttggtgcatgtgtatttgattgtatgtacacttgatggaccgtgcagtcgtgtatgtgctgtttgagtttcatttagtgatttctggatttgatcatttaattcagagaagtattgattgtttgc

SEQ ID NO: 33922 - DNA, 2174 bp, Triticum aestivum
  Clone ID: PAT_TA_33922
ggggaccgcgctgctcctcctcttcctcaaccctcggtgccaccatcttcccgggcttccgaggcgcgccacgcacaccccccccatgccgcggctgcgctcccggatcggaccaatcttccgccccttcaggtcctgcagcaccgccccgtagatggccaatgagggcactgccggcggggagcggtgagggaagcggtccgatggactcgacagctggcccccattcagcaccggcgaaggccgtagttaggcgagccgagcgtgtcgcgagaccgtgcaccaaaacgcgaccgtttaaggagctggattccgagcaggaggcgcagcagcgggcaaagctcgttgactgacgcggactattgcagcttcttatggtcttggtgggcattatgttgagttcatttaagcgcgtgtcactgaatttgataaacgtggtccactatttcacacctgagtgaaatcagtcttgggagcgttcctgagagagcctcgacggacaggggtgttgtctgatgccgaggatgcctggagcatcttttaaaacgccggaaatgacgacagcatgattgccaaggacaacggtatggtgggcatgggaagcgggcagccaaaaagtgtggacagcctgaggatcgttttcagatgagctggggaagctgccaagggggccgccctggccagcgatgccttcttcccattcgcttggaaggatgccgtggaggaggcgtgcgagaatggcatcggcacgatcgcgcagcctggcggcagcatgagggacaaggacgccgttgactgctgctataagtacggcgtgtccctcctcttcaccggcgtccgccacttcaggcactgagcctaacctgagcacttaaggctatatcaccggtctatcggtagtttgtcgcaataagacagacgcaggtgattctgagtccaactaggattaattgtatgacggtggcgaaagcattttaccacgtacgctcgcgagttcgcctaggtgttcgtcacattcctgagccagcaacggctgggtaataacaaagtccgaaaacttgggtcctgatactagctggaataagcaaaaactgtgtttgtattcagacgtcgacatgaatccaagttcagcaactcgtgctgtgctgcacccatgccaggatgttctttgaggcatacaggttggccgtaaaggcagatcctgtgagtgcatttggcggaatcgttgcattcaacaccacaattgacgaggatcttgcaaaggagattcgcgagtttagaagtcctacagatggcgagactcggatgttctatgagatcgtggtggcaccaggatacacagagaagggccttgaggtcctcaaagggaaatcgaagacgttgaggatccttgaggcaaagagaagtgggaaaaacatgctgtcgctcaggcaggtcaggtggtggttggctagctcaagaatctgacgatctaaccccagaagacatcaccttcacgacgggttctgagagagctccgacggacagtgagctctcggatgccaagttcgcctggctctgtgtgaagcacgtcaagagcaacgccattgtgattgccaaggacaactgcatgctgggcatgggtagcgggcagccaaacagggtggacagcctgaggatcgccttcaggaaagcaggggaggctgccaagggagctgctctggccagcgacgccttcttcccattcgcttggaaggatgccgtggaggaggcgtgcgagaatggcatcggcacgatcgcgcagcccggcggcagcatgagggacaaggatgccgttgactgctgcaataagtacggcgtgtccctcctcttcaccggcgtccgccacttcaggcactgagcctaacctgagcacttaaggccatatcaccggtctatcggtagtttgtcgcaataagacaggcgcaggtgattctgagtccaactaggattaattgtatgacggtggcgaaatcattttgccacgtacgcaagtgaggacgcctaggtgttcgtcacattgctgagccagcagtggctgggtaataacaaggtcagaaaaccaggggccatgtactagctaaacgaagcaaaaactgtgtttgtattcagacgtcgacatgaatccaacttgtgaggccattcttgaccttttc

SEQ ID NO: 33923 - DNA, 667 bp, Triticum aestivum
  Clone ID: PAT_TA_33923
cctcaccctgttgatcctgctatgtgctacctgcaaaattgctggacgcaacatcaatgtagctctgatccagaacctggttcttggatgcaacacgcattgtcctggacaggggtctatggtaggttccaccgctgcaagttctcaaactctcaagacaaattcagataacatgggttgggagttcgcaaccttgatttatcctctagatttatcgcgagtgaagtgcaagttgtgtggaaaagagatgtttggagggatcaataggatgaagcaacatattgctcagattagggggcaagtcacaccctgcacggtggctaacgcggatcagcaaaagaggtgtagggaagcttgtgaggcatcatgaccaaaccgtccagatcagtatctaacgttgttgaggtggctgctgctgtgaccgaagatcagaagaagcctggagatgtgcacaatagttttagttgatgttgccaccatgttttggtgcatgtgtatttctttttgattgtttgcacccttgatggatcgtgcaaacgtgtatgtgctgttgtgagtttcattgagtgatttctggatttgatcgaattattgattgttagctgttgaaatgtgtaaaagaaatatgtgaatgaaaaggctgaatgttctattggatcgaatatat

SEQ ID NO: 33924 - DNA, 518 bp, Triticum aestivum
  Clone ID: PAT_TA_33924
tttttagttctccagcaatcttacgaaatagctgacattcccatgttgaagcaaacatcgaccatggacattcctaatatggctccgcactgtagatgcacaagagcaatatgctacccaacatgttcaaacaaaatgataataaggggcgtatggtctagaaagtaccatggtgaagatgttagcatgcccagatgtgagcaaatggattgcattttagtcattttccaaacaccctcagtgctagtgcataaacatctttcttctttgctgatgtagcttcggccaccaatttcaccgccgttgaaagagcatgcccttttgccatcaattctctgagttcatgctcaagaaaatcatcagatggtgtttcatcaattgaaactgagttcccatctatgaggatggtgatttctccctttggctgtcgagatgcaaaggcttcatttgcttcgcctagggttcctcgccaaaactcttcatgcaatttggtaatctcctcggccgcgaccacgcta

SEQ ID NO: 33925 - DNA, 601 bp, Triticum aestivum
  unsure (1)..(601): unsure at all n locations
  Clone ID: PAT_TA_33925
cnnnnnnnnnnnnnnnnnnnttttttttttttttttttttttttcagtttagtctccactaccgcagcatcaaactagccacggtttaagtgcttcaataacggtgtataatggttcagtaaaaatctgagctccaatataagatggaagtatttcccttccagaacatcttttttggctataaaaagaagaaggcaggctactgggagggagtcaacaggacagggagctggcgtctgcaatatttactgaaccatgcatttgaaaagatattgaaccaaagaacagtcaaaaacttgaatagcagcccacagctcaatttcgaccagttattctgctgtctaactttatccttttcgagccgttttgttgctcctgctgccttgaagtggcagatgactcatgtagaaacgtgcaattagctccgttgcgacaccctctcgggccgttgaagtaggcacatggtcttgttggcctcgttttcgtatctctgttcaccatagaagcaccgttcatagcatcaataccattagtttggggaggagcagattgatggtacattccaaactgccttccatgttgttcaaatgattcctgcctc

SEQ ID NO: 33926 - DNA, 798 bp, Triticum aestivum
  Clone ID: PAT_TA_33926
ttttttttttttttttttggagcactcaagcgtcatcttattaatttattccgaaattgcatttccaatcaatattctatgcactgccactgcaccacacatgctcccaagataccattgttacaacatctgatagaaaattttcaataaaccaaaggtttcacacggtatgttaggctagtccatctcagattactgcattctgacctccacaccagcatctaccagatgctctttcactgctagaatgggaacctctttccgatggaaaatgccagcggcaagggcagcagaagcgtttgttttctcaaagacttcagaaaaatgttccactgaaccagcaccactgcttgcaatgacaggaattgtcacagcatccgacaccattttgatcaaatctatatcaaatccaccaccctgaccatcacaatcaatgcagttgagtagtatttctcctgcgcccaattcttccacagcttttgctagttcatatgctcctataggccggctatcacgcccaccacttactgtgcactgataccatgcatattcttctcctaatggacctttactggacacttttacagttctaaattgcacctcatctggacttttgacatatactcttcgaggatcaatacttacaactacagcctgatttccatatactctagaaatttgctccaagctgcttttccctgtcttcacaccagtctgtaaataggcttcagcagcaaaacagcatcacttccattgaaatcttgtcagcaccagacctgaaatattctgatgctacta

SEQ ID NO: 33927 - DNA, 824 bp, Triticum aestivum
  unsure (1)..(824): unsure at all n locations
  Clone ID: PAT_TA_33927
ngaaacactcccttggcctcctcctccggtccgcccacacgccacccccaactcacgatcgatcgctagcctcgccggagcatgaggggttcacggtggtgctgctgctgcttcggccggggcggcggcggggccgggcggtcggggagcgtgggcgacgacgggctggtgtgggacgtgggcctcaaggcgcacgcctccggcgagtactccgtcgccgtggcccaggccaacgaggcgctcgaggaccaggcgcaggtgctcgtctcccccgccgccacgctcgtcggcgtctacgacggccacggcggccccgacgccgcccgcttcgtcaacgcgcgtctcttctccctcatccaagagttcgcgtcccagagcgggggcatctcggcgcaggtgatcaagagggccttcggcgccacggaggaggcgttcatgggcatggtggagaagtcgtggccgtcgcagccgcggctcctgtccgtcggctcctgctgcctggtgggcgccatcgaggacggcacgctccacgtcgccaacctcggcgactcgcgcgccgtgctcggccgcctcgccagcacgggcgggaagaagcggagggcggtggtggcggagcggctgtcacgggaccacaaaacggccccgaccaagaaaggtgccggccgggaagttggcggaaggccnacccggaccaacccgnaanaatcttgatttagcnaaccaccggngtggtggngggntcaaagggggattaatncaaggttngtcccgcctccaaatcgggggaacgcgtaacccttaaaagcggcccngaccttgtggaa

SEQ ID NO: 33928 - DNA, 1065 bp, Triticum aestivum
  Clone ID: PAT_TA_33928
atcgctgctctcctccttcctcccacgcacaggttagaaggggaagaaagcaggtctaggtgctacaccggcgcggcggcagagcgatgcacaaccatctctcttgaagaaatggagagtgttgaagctgcaaatgggaactccgggagagttgggatcattgtttggaccaatgccatgacaaaaaccatgcttggttttttggctggtcttgttgctgatgtgaagagaacgtcaagtggattcagggatgtgcatcatagataatgtgctgctgttttgaacgagcaattcaagctttttgtcaccggagagcaagtcaaaaaccatctcaagaagtggaggaagatttggacgaaggtggtcaatttgaagaatttaagtggagctctatgggatgaagatacttgcacaattaggctcagcgaggagcactatgcagggcattgtatgagctaatgcccccttcctgaatgccccaattgagcactatcatgccatggctggcatttatgggacaattggggccaaggggatgaatgccagatctggcaatgatcttctttccactgatctcgaagacgaggagaacggtgaggtcaacacgtcaccaaatgttggtgagtcttctctccccaaagcaccgccaaaaaagaaggctaagtctacacattgccaggttttgatgaagagcacgtagcccactactatgcgcatcttgtggacaacccaaagactgcaagagccttaatgaaactttcccaaaccaacaaatctgtttgggtgagtaggtatatcaagaagaacttttaaattcaatatggttgtatggttgtcaagtatgtgaacttggcacgtatgcttctagtgcactttggttgcttttggagagcttcgtacatgaactagacgtgtgtggctgtcaagtatgacttggacatgtatggctctattgcactttgcttgcttttggagagcttcgtatgtgaactacacatgtatggctgtcaaatgtgtttaactatgtgcaccttgttgaaatctgtgttttatgtgttgtcaaaa

SEQ ID NO: 33929 - DNA, 641 bp, Triticum aestivum
  unsure (1)..(641): unsure at all n locations
  Clone ID: PAT_TA_33929
cccgtgatggcgcgcacagcactcatctccagctgccgcagcaccggggccgccgcatcctcctcgtctccctctcctcgcgcgcgtatatatacccgcgcctcctcttcctcttcccgcccaccgctcctcgcctctccgcctcctccccgatccactcctcgtcggtgttcgattaagactcttgcggcggtcaagggagcgtcgttgtccggctggcggagcgcgagggaggagaaggagttggagatgacgatcgagtcgtccgtgcggctcgccggcggggagctgtcggtccgcgggcgcacggtgctgtccggcgtgccggacgcggtgtcggcgtcgcccgcggcggcccggggccccgtcgacggcgtcttcctcggcgccgacctcgccggcccggcctcccgccacgtcgtctccctcggccacatgaggggcgtgcggttcatggcgtgcttccggttcaagatgtggtggatggcgcagaggatgggggacaagggcggggacgtcccgcacgagacgcagttcctgctggtggagtccagggccatcggcggcgaggaggacgacgcgtcgtacgtcgtgttcctcccgctcgtggagcggcgcgttccngggccagcctccaggcc

SEQ ID NO: 33930 - DNA, 1115 bp, Triticum aestivum
  Clone ID: PAT_TA_33930
agtggatccccgggctgcaggtgactgggcgggtactacgacgcgggcgacaacgtcaagttcgggttcccgatggcgtttacgacgacgctcatgtcgtgggggctcatcgacttcggcaagaacttcgggtcgcacggcggggaggcccgggcggcggtgcggtgggcgacggactacctgatgaaggcgacggcgacgcccaacacggtgtacgtgcaggtgggggacgccttccacgaccactcgtgctgggagcggcccgaggacatggacaccccgcgcaccgtctacaaggtggacccccagcacccgggctccgacgtcgccgccgagaccgccgccgccctcgccgccggctccatcgtcttccgcgaggccgacccggcctactccaagcgcctgctcgaccgcgccatctccgtgtttgagttcgcggacaagtaccgtggggcgtacagcagcagcctgtactcggcggtgtgcccgtgctactgcgactacgacgggtaccaggacgagctgctgtggggggcggcgtggctgcacaaggcgtcgcgccagcgggtgtaccgcgactacatcaagaagaacgaggtggcgctcggcgccagcgactccatcaacgagttcggctgggacaacaagcacgccggcatcaacatcctcatctccaaggaggtgctgatgggcaaggactccttcttcaagtcgttccgggtgaacgccgacaacttcatctgcaccctcctccccggcatctccaaccacccccagatcgagtactccccaggtgggctgctgttcaaggtgggcaacagcaacatgcagcacgtgacgtcgctgtcgttcctcctgctcgcctacgccaactacgccagccacgccaacgcgcgggtgccgtgcggcggctcctccgcctcgccggtcgtgctccgccgcgtcgccaagcgccaggtggactacatcctaaccgacaacccgctgcgcatgtcgtacatggtggggtatggccccgccttcccgcggcgcagacgccagcgcccggtttcgctcctgtcccaggtggactacatccttggcgacaacccgctgcgcatgtcgtacatggtggg

SEQ ID NO: 33931 - DNA, 1411 bp, Triticum aestivum
  Clone ID: PAT_TA_33931
ccctccccgcctcctccctccctgcagagcggcagagaatgccgaacgaggagctacggaaggacctgagcaacaccgccatatcgtcggcgccggagtggcgccggcgggtacgagcccctcccaggcaactgcgtaaaaataatcccatggtcttttactaaccagcaacgcacaccaccacgaatgatagggttaatgctggcagcctcaatcacccggccaccaacccccactcccaccccagcatcttctctcctcgcctcgccgtcgacgacccccacccagccgtcgtagccacccgctgcaactccgcaagccatggagaagccgtcgcacgtagccaccgccgacgggaagcaggcatcgcacaggattgcggtggtcactggtggaaacaagggagtcggcctggaggtgtgccggcagcttgccgcccaaggtgtgactgtcattctcacagcgagggacgagaagagagggaaggatgccgtcgagtcgatctgccgtgaatccaacctctccaacgttgtcttccaccagctcgacgtccgggatgacagcagtgtcgcctctctagcgcgacacatcgagagcagatatggagagcttgacatcttggttaacaatgcagcagttgtaggagttgcagcagatgaggaagaactcagagtgctaaaccgttacgtcggggaacgaccttcaggggaagttggcaatctgctcaaaggcatgttccagcaaacctatgaggtggcacgggactgtctcgacaccaattactacggatgcaaacgggttacagaagcccttcttcctctactgaaactatccaaagtcgggagcgaagatcgttaacgcctcctcccttgcgtcagagctgaagagaatgccgaacgaggagctacggaaggacctgagcaacatcgacatctgggacgaggcgcggatcgaggcggtgctcaacaccttcatggatgacctgaagaatggacggctcgaagaggcagggtggccggcgatgctgccggcatacagcgtgtcgaagatggtgatcaacctctacacgaggatcctggcgaggcggtacccagagatgcgcgtcaactgcgtgcgccccggctttgtcaggaccgacatcaactggaacctggggaccctgacgccggagcagggcgcgaggggcccggtcatgctggccctgctccctcaggacggaccgaccgggtgctacttcgatcagacggagatggtgaatgtctggtagtgtctgttcactggattgtctgcagctacgttatggtaagttcatctttctgtgtcatgcctgaggccattggccaggacagttttctcttcttgcattttcgatatgaataaatagttcaagaccaaaaaaaaaaaaaaaaaa

SEQ ID NO: 33932 - DNA, 998 bp, Triticum aestivum
  Clone ID: PAT_TA_33932
gacaaaaggggatcgatgtgggacaaaaaaaacggcaagtaatcaacccttgaccagacatcaactatgcaccgaatccaaggcaatccatgctcttttttagctgcgattgatgctccaaataacttgacatgcggcacatgcagcgccggcctaccgtgagcaacttcaggaagccaagagttccttcttcaagacaaggcaagtcttctagatatggctctgctcgatcaattatcactacacaccagcggctgtcgtgcacgcagaatctactatggcacaacacaagcggaataacattgcttcggcaggcaccgtatgtaccttggcgctctcgccggttagctcaagacggacaccccgtggacgtggtgtgcacgcccggactctgctcgtgccggcaccccttgatgcagaagggtgtgtcccctctgtacatgaagacgtcgccgtcgcgcgccagacgcttggcgtagaacgcgcacgcgtgcagcgccggcatgccgggctcgccctccggctcgtggcgcgtaggtcggcggcgatgacctcgttgctcttggcgaccccaatccatgcctggctccacaaccggcgcctcacctccggttggccgttgcagtagggcccgcactccaggcagaagccgccccgccgcgaagcctggccccgttccttagctcgggcagcacgaacgcgtcccccctgccttggtttgtacgagtctacaccggcggcaagcagtggggcgcggggcgtgactggcggtaaagtggaggcaagcaatggataaggggggacggaacgagcccgttatccctttaagataggactgccgccccctttctcataaacggaaggacttttttgcaaaaaggccagcgatgtcaaccagaagcaatcggctggtttattagtaggtaaagatataagaggtgtgatcctattctttatgaggactaaccatcacgaatttaaagcaaaaccccaaaacc

SEQ ID NO: 33933 - DNA, 846 bp, Triticum aestivum
  Clone ID: PAT_TA_33933
gaccacttccacccacggctcacctgaagatcacatactactcgtcaatctttgctgggcagttggcatcgatggctcctgccgggaacaggggcgcccgcgcggtcgcgccggcggtgctggtgctggcgctcgcgctggccccacggggcgacttggcagcctttgcttgcgccacggggaacgacgggctcatgccgggcctcgggtgcctgcagtggggcggggccgtgcctcgggcgcgtggcgccgggatcggtggcgctggggctggggcggcggggcacgaccgcgcgccgcgcctgcctgcgcctgcctcacgaccgtggccgccgccgcggcgggcgggccgtacctcggccgcgccgcggggctgcccggcaggtgcggcgtccagccgcccttcaagatcgaccccaacgtcaactgcaacgcggtataaattgagcacgcagctctacagcgtgcggaacatgcacggtcgttatgcgatgccacaagatataccattgtggaacgttctactgtacgtacgtacgtaccctgcagatgtactacctctgtacaagtacaagttctcccaactataagtattttggtacagagggacgtctatacatgagtcgacggcggataatcgcgccatatgtccttccattatgtggtgttgtgtaaaccagtgtgtgatgagggagttacctcctaggaataatcgttggatttgggactgtgatctgcttctgtaaacagcagcaattttacttcttcattcgctttccctcctatgaataatcgttggatttgtgagtgtgatcgcccgattatctcaacagtaattttacttct

SEQ ID NO: 33934 - DNA, 861 bp, Triticum aestivum
  Clone ID: PAT_TA_33934
ggcgccggggccacaggtctcctttccctttttgctgccgatcgagaaccgccaggggcgcgcagcgcagctacaaatacgccaccaacctcccccccgacccgctgatcccatccaattccccaaacccaaagaaagtcatccaacaatcactgcaagagattaggaacctcgtcgaccggagatggagaagatgagctcgtcggtgcagtcctgggtggaccagcacaagctcgccaccgtcggggcgatgtggacgacggcggttggcgcctcggtggcgtgcggccggcggcggggcaaggcggcggggttcacggtcgctgccgcgctcgggcggagcggcgctggcgcaccactactacgcagcgaaacggagggaggaggaggcgaggtgcttcgagctggacttctactcgcagctgccggcggccaccggcgaagacggccaggagaacgagcggtggacctactagcagatcagacgttcagatcacggccggccggccggccgtggatcgaaacgagacgatgatgatgacgaccaattaggagtaccagttaattaatagcccatgacgtggcgcggctcatttgcctaatccatccagcggggaagacgggattatcttatctgctttgtactatccatccagcaagtggcgttgttgtctccatcatctagtaggtgtgatgggggtgggggtagtattagttccctcttctctatgtctatgattgaaggaaccaagaaacccagcgatgcattgcaagattatagtagatagaattctgtctgtttggataaagttgatccgaataaacaacaacaagaaaaaaaaagcatccaaaaaaaaaaaa

SEQ ID NO: 33935 - DNA, 862 bp, Triticum aestivum
  Clone ID: PAT_TA_33935
gcgatggggggtgtctgacccctgctcgcaccccccgcctccgcctctgacgtagatttgattatttatttatctttgtggtaggtgactatctaaaataaattttgcataatagatattagccattaaagatgaccagctccatgattaataagtgaggctgcttactttgttaagtacctattttgttatttcagcattatacatgattaatgctttgatggtaagtgtaataaacacatgattgctgtacatgaatccatgattattttctttgggagatactatatttttctttgtaataagtgtaatgattacatctatttatgtgcaataacattgcagaatattcgatagagaactcagcaatcaaacctatgtacatgttaacatgtgagggtgcaaccgaatagctgtacatgaatctgaaacaagaggaagaaccgaggattcttcaagaagcttcttctattcgtgcacaatggcgtcgtagtcaaggttcaatcgacacatggtgtgtaagcattgcctatctacctaaagggtatgcaggagcgttgccaacatcaatgtgctttgtgctgcagaaatggattttcaaaaacctccagcacatggtgtcctgggaatttctggatatgtcgacctgctagctcattatgaggaaagacaggcaagaggacgaggaaacatgaagcccgtggtttgtgtaaatgggatattttgtgtaatggtgactgaatcgttggagatgcactttatatatcattttgtaaactcgcattgtgtctgacaaaatgaaccatattgtaatggatgaactatttacatctgaaattaattaatgtgttattgttaaaaa

SEQ ID NO: 33936 - DNA, 1549 bp, Triticum aestivum
  Clone ID: PAT_TA_33936
gctccggggcaaagcaaaccgtagccggtccgcgcccccgcttctccctgcctataccgccttcctgcgcagcgccgccgaaatcccttcgggttcttctccttctcctgctctcccacctctcgtgctcggccgcttcctcttccccgttcctgagcgagcgggcgattcttccttccgtggccgttccctcgtcgtgtccgacctctcctcgacggcccgcgtgggcgcctcggggccatgggcgggcgcgatttggaggacggccgcccgccgtccaatctgcagcgcttcctcgactgcaccaccccgacagtcgacacgcacattctccccaagaccaatggccggctgtccaatgacgcgtggcaccatgccgacgccgacagcgtcgagtacttcaacctcgccgacctgtgggagcagtactacgagtggagcgcgtacggcgccggagccaccgtgcagctgcacggaggggacaaagtggttcagtactacgtcccgtacttgtcagggatacagctatacaccaacaaagtcctgaatgcatccaggagttttggtgaggattatggcatggacttctggagcgatgatgacgacaatgagaagatgtcaagatcctggagttcaacatctgacgactcatttaactgcgacgtggtaggggggaacaggaggcgacctggccatttgtactttgagttctttgaagtttgctctccttatggaaggatccccctcatggataaggtatatgaattatcccagggctttcctgggttgacatcgctgaagagtgtcgacctttcgcctgtcagttggatgtcagttgcctggtatcctatctaccacattccctaccaacgcaatgtgaaggacttgtctgcgtgcttcctaacttaccataccatttcctcttcatttcaagatcacacaccggagaccatgacctatggctcagctgccagtgggaaacagaatgaccagaaggccaacactgtatcactagccccgtttggactcgcagcaaacaagatacagggctctctgtggaccaacccccggacaggagatcataagaggatcgtctccctcttcggcgcagcagactcctggcttaagcagcttggagtccggcaccatgacttcaactacttcgtcactcaccccatgtgaactactaatttgcccccgcagtagacttgaaatcgtcgaaactgcttacaccaccgacaaggggcacaaaccatctaccgtgtatcgccctcgtaaaagttgagtctaacattcgtgggataggtttatacggcttgattgcagcacataacaaatgtatcaggacttgaaaggttttgtgtttcttggctgaagatgtaactaatgtgcacagaagttttggtactagtctgatatatccagctcttgtggttgggtgcatattgtagctacctgcctcgccatgtgtactcaactagcctatatatggaggttgtgtgcccaggatgaactgcttttgcagagtcctgttttctggggaaaaaaa

SEQ ID NO: 33937 - DNA, 1227 bp, Triticum aestivum
  Clone ID: PAT_TA_33937
gcacgaggccaaaaaaaaggaggtctcgcggcacctgctctgaccctccaaagcccgacgccggagccgtccgcccgtggtaggacaaaggagatgtcgtcggcggcgcagcagctgccgcggacggagtcgcggacgctgtcggggcacgagggcgcggtgctcgccgttcgcttcaaccacgacggcaagtactgcctgagctgcggcaaggaccgcaccgtccgcctctggaacccccacaccggcgcccacgtcaagacctataaatcccacggtcgcgaggttcgcgacgtgaacgcgtcctcggacaacgccaagctggtgtcgtgcggcggggacaagcagatcttctactgggatgttgcctccggcaaagtcatccgcaagttccgcggccacaacagcgaggtcaattcagtgaagtttaatgagcacaacactgttgtactgtcagctggttatgaccgttcggtgcgtgcatttgactgcaggtcacagagcagtgatccgattcagacaattgatacttttcaagacagtgtaatgtcagttaatgtaaccaacaccgaaataattgctggcagtgttgatggtactgtccgaacatttgatattcgcatgggcagggagactgtcgataacctgggtcatcctgtcaactgtatatctttgtcgaatgaccgcaattgcctttggctaacttgttggattctaccgtgaggcttcttgacaagaactctggggaaatgttccaagagtacaaggcccatatatgcaagtccttcaagatggattgcggcctgaccaaggatgaagcatttggtatcggcggtatccaggacgggtttggttttctttggggaattagtggttgcccctattggttgcgactttccgagcccttagtgctgtggtcaccagcgtcacttatcacccaacaaagacctgcatgttgacgtcatctgtcgatgggaccattcgtgtttggacctgaagatagaaattgctgatgtgtgttatccctactgatgcgcctatgacagtgttcttcctatcatccatctatgtagtttcaaggattcagaagcataatgtgtactactccatgtgacattctgacatgagaacagactcaaggattcatatgcgcaatccctttttgagaaacgttgttgctactatgttggattcttcatggatatgtagtagcttttttttttcttt

SEQ ID NO: 33938 - DNA, 571 bp, Triticum aestivum
  Clone ID: PAT_TA_33938
ctaaaaacaagaccattattattttgacgtaaaatgaaacacggaaataggcagaacagaacagacaggattttggagggggcaaagcaacctctgaattgatcacagaagaagcttgagcacagagtaccacttaattctcttcacaccaacacgacacggcactgcttatctacttatctacacaactaattaaacataaataatcctcttaattcgacgcggaaagcaaagaacgcatgctcccgtatcttccgttccagagagcaaaagtcgccgaaaattaacaccgctagcacgtttacggaaccacacatccacgtcgctgaccgactgaccggctggcggatcgatcagcgcagcacgggcctggtcgggtcgtccccgtggtcgtcggggccgagcgagaacacgtcgacgggggcgcgcgtgccgtcgatcccgccggcgccggccgtcggctgcggcgtgccctcgcacctgctgtcgaggaagagcacgacgacggtgatgtcgtcgtggaagcgccgccggcggcccttctcgatggccgcgatgctctcgtacttga

SEQ ID NO: 33939 - DNA, 1797 bp, Triticum aestivum
  unsure (1)..(1797): unsure at all n locations
  Clone ID: PAT_TA_33939
gccagtcagaacatggtgctcagtcagtggcgctgtcaggtggttacatagatgatgaggaccatggggagtggttcctgtatactggaagtggtggaagagatctaagtgggaacaagcgaacaaacaaggaacagtcttcgggtccgaagtgggaccaggcgaacgctcctcggcccctctgctgctcggagggttgccctgtcgggggcggcccggccccctaggtgcagcgtgcgtcacccgctccgggttctgcggtcccccatggtggagccttctgcattggctcctgctgctggtgggcgggtggtcggggtccacacgagggcggcaggctgctcgtcgttcggtgcgccggggacccacctcctcggcccggtcctcttcgtgcggtccggccatgaccccgccccagggtccaggggccgccaggggctccggccatggccgctgccccggattcaggagctgcagggtgcgactgacatcactgaacgggcaggatccccctcctgggactatgttgaaaatgaaggctggaagtgggtgaagcctccgccaatcagcaagaagcccgcccagtcaggcgatcctgaaactgacaagcaattcaggaaataccagaagcgtgctcatatgtctatgaacgaaaggctgttgaaggagtttggctgttccatttgcaagaatctgatgaacgaacctcgcccccccccctgtggtcataacttctgcaaagcttgcttgaccgctgcgtttggcgacgagggttctatgagggaaagaagcaggggcggcctgcactctgcgggcgcagaagattgtgaagaactgcccctcctgcccgactgacatttgcgacttcctggagaacccgcagattaacattgagatgaaggatctgatcgacaacctgcttgccaaggccgccaaggagaagccagacgcggagggatctgctgaggaaaatgatgatgaggaggatgctctggagaaggaagaggaggatgacagcagcctgaatgaggaagagaatgatgatggtgctgagaacaaggctggagaagaggatgctgtcgtcacaatcgtggttgaggccaaggatgagctgaagaagcctctgaagcgcaagggagctgaggaggaggccaaagatgagaagaagatcaagaccactgctgctgctcctgatgtggaaaatgcagctgaagaagacgccgagatggttgaaaaggaggaagaagaaggtgcccagaaggctcagaagaagcgcaaggggcgtgctggggctgcaggtactgcagctggcggcggtaagaggaagagggccggccctgctgctgccgaagagaaggccgccgcagctggtggcggtaagaggaagaaggcaagccctgctgctgcagctgaggagacccctgctgctgcgagcacccctcgccgtgcgaccaggagcggcggcgtggtggtggctggtgggagccctgcttccaggaccaggagcaacaccaaggccgacaactgaaggcggcggtggaggaggagcggcgccgaggctgatgcccaccattgaagaagaagctccgttttttggctggtcgtgtattattatatatatagtttacatttgcaagactgctttatccacttgtctcttgtctggagactggaattggaacttggttgctgatgctgccgctggcagccgttttgggtcggaaccttgtagttaagttgataccgtaccgtaccccctcctgctatatggatccttnatattatctatcaggtaag

SEQ ID NO: 33940 - DNA, 610 bp, Triticum aestivum
  unsure (1)..(610): unsure at all n locations
  Clone ID: PAT_TA_33940
gcttgacagnagagcntcgtntttgcncatcaggcgatatccntgtcgggaanttnctgggacggagcgtcgagcgcgcgtgtactcctgtgactgcngcgcccngtggccggcgccgagcgtctcgaggacgcactgcacgtccaccttgacgccgtcgacgccggcggcggcgaggtacgcgtggagctcgtcgtagaagcggtgcacggcctgcgggtgcacgaggccgagcccctgcagggtgagcacgtcggtcttcatgttgggctcgttctccgccacgcccggcgagatcttggggaactgcatggacgagcgatacgcctccatcccggcgacgcccggccgcacgccgccccagtagccggtgatggcgtgccagacgtacacgtacttgagcccgtacttctccttggccgcgcgcaccagcgtctcgatgccggtggcggtggccgggtcgtcgccgctctggaacttgctgttctccttgatgccggtgagccggggaaggggcggcgacttgccggcctcgcccgcagagtccaagtcggggctctgtttgtcggtcccgaccgactgccagccgtcgtcgatgatgacgaacttc

SEQ ID NO: 33941 - DNA, 648 bp, Triticum aestivum
  unsure (1)..(648): unsure at all n locations
  Clone ID: PAT_TA_33941
aagaggataagacaatgcaagaggaaaatttattattggattaaacaacgaactaacaacattccacgaacccaattattgctaatgaagtcacaggtgcctgcctatttcactttggtaaaggagaggagctggcgtttttttgtcaactcctgctcgtacaactccgccttgtagttaccgtcttccccacgaaagtgtgtcacatcgataatgagctcatagttcatgtcggacacctgtttttgtcgaccgctcaacaccttgttgaacttaactgtgcagttcacatgcttgttgaactccgacactgcccattcaccgagctcctggatgtggtcatcatttatgtttacgattggctcccacccatcctctacttgatgtcccatcaattgatgtcccatcgaatctccacaacgcgtggccgatgtgctgatagcatacatgaccacgacaacaacaacaatgaggatgccggttgtcctcatggcgtatgaactttgcgccgaagacactattagttggttaatggtgttttgagctttttatgagggactttggtgaacttcacggacgcgtggcacaattccacacaaatacgagccggaagcataaagtgtnaagcctgggtgnctaatgagtgag

SEQ ID NO: 33942 - DNA, 721 bp, Triticum aestivum
  unsure (1)..(721): unsure at all n locations
  Clone ID: PAT_TA_33942
aaaangcaacngtatgtacgtcctttgtttgtttttctgggttggttagctattcatcttgtagctaatcaatcatgtacggcgatcatcaaccaatcctcgcgatctcacgtgcaccgctgcactctctgcacgacgatccaattccaaccgacccatcccaccccaccaacaccaatgcgtccgtgtcctactcccggctcaggtacgcggccgcgaacgccagctccctggcggacttggggctggcgggctggtccaggaagtagacgtgccgctcgccggcggtctcgtaccgcaccacctcgccgcgccacccgctgccgttgagcgccgcggcgtacgcctccccgcgggcctcgaagttgtccagccccgacgtggtcaccgccacgcgggcgcacgccagcctccgcagcgccgacgccggcgccgccagcgggttgatcagcgggtcgtcgatgccgtaccgcccaccgcacacgaacgaccacgtctcctcgtaccgccgccgcgtcgccgggtccctcgtctccgcgcccacgggccgcttcccccagaagtaggggtccaggagcagcacgcccaggatggccgcgccgccctccagcccgctcccgctcccggcgcgcatcgccatgttgtgcgcgatgttggcgcccgcgctgtcgcccgcgaggaagaggcgggagaggttcccgcggtcccgcagccacggctc

SEQ ID NO: 33943 - DNA, 633 bp, Triticum aestivum
  unsure (1)..(633): unsure at all n locations
  Clone ID: PAT_TA_33943
gtcgctcggtggcctcacgcagatgaacttcagcaacaaccagctcaccggcgnagaaccggcggggttgggctccatgccggtgctcaccctgctcgacctctcgtccaaccaactctccggcagcatcccgcgagcgctgggatcactaaggctgaaccagctaaacctgtcatccaataacctcgccggcgaggtcccggaggcgctcgctgtccccgcctacgaccgaagcttcctgggcaaccgcgcgctctgcacgggcgcggcgtcgtcggggaacctcgccggcgtgagctcgtgcgcagccaggtcatccgacaaggtatcaccaggccttcgcaccggccttgtcgccgccgccgccgcgctactcgtggtcatcgcggcgctcgccttcttcatcgtccgcgacaccaagaggcggaaggggctcgcgccgcccgaagaggcctggaagctcacccctttccagccgctggacttcggcgagggccccgtgctgcgcgggctcgccgacgagaacctcatcggcaagggcgggtcgggngcgggtgtaccgcgtggagtgccccagccggagcggcgcgagcggcggcacggtggtggccgtgaagcgcatctggaccggcg

SEQ ID NO: 33944 - DNA, 881 bp, Triticum aestivum
  Clone ID: PAT_TA_33944
cgcaggccgcccggggggcccgccagaggccgcagcagaagccttagcaggagtgacagtgataggcgcagcccaagccccaagagacggcgccatgatgtgcacgctagccgtagcaggactagaagtcggagccggagcaggagcagaagcaggagcaggaacaggagccggagcaggagttacactaggaatcgtcgtgctagccgcagcaggagtcgtagccctggcgctagacggaggcctgaaagaagagctggctctgggtctacacgtcctgactctgcccacccagtggagaagaaaagctcacccaatgctcacccttcaaatgaccacaagagtcgcagtgtcgacccttcaaatgactatcaggcggaggatgggaagatgggaaaggttgatctggatcggtcgcccagtccgcaggagcaggatgacaagtctgctccatatagtcctgtgtataatggcgaaggaggcagggggtcaatgagccctaatggcgagccagtggtggatgctaaacctgtggaagtctctgtgagcagcaagaagagggaggatgaagaggaaggaatgagaggagaatatgatgaggagggtgtgatagccgatgatgacactcgagcaagaccagctgtgcagtgcagctgtgaagaacggcgatgattagtgacaaggctttgaacgatgaatttgctatccatgtaacaatttatgttaaaaactttttggttggtacggttctttgtgctgtaacattcagcttgcatttgctgtttgttatgaacccgagtccatgatcctgtatttgttatctccacttctttttacagcattctttttgttgatttattgtccaaaaaaaaaaaaaaaaa

SEQ ID NO: 33945 - DNA, 926 bp, Triticum aestivum
  unsure (1)..(926): unsure at all n locations
  Clone ID: PAT_TA_33945
actttcanaaaaagtccctcctcctcctcctagtcctacatccctcgaccatctcggttcccggcgacgtcggccatgtcataccagacccttgagctaacgctgatctcggcgagcgatctcaagaaggtcacattcttctcccgcatgcacatttacgccattgcctccatctccggtggtgattcccgcatgcctacccatggcattggcacccaagtcgaccacaccaatggtccaaaccccacatggaatgccatgctccatttgccgatccctgcatgtgttgatacgcgcgggctcgtcctccatgtgtcgctacgctcggaggcgctcttcttcggccaccatgacgttggtgaagtatttgtgccccttaatgatcttttggcaggcacaaataacactaatgacccaaagaccatgagctaccaagtgcggcgacccatgtctggccgtgcccacggtgttctctacttcagctacaagttcaccggcatcaaagctgctcctgcaagcgctacagagaacaaacaagggcagtacgtcaaatactctggggactctggggtggcaatgcccagacccatggtgcccgtcaccgcatacccacaaccgcatgccacattttcatacccaccaaacgcagtgtatccacccccgtacatgtataatactgctccagcaccggcaaagatgtactatgtgtatgcgccagcaacgactatggctgcaccggcaaggcatgcgggagggattggaatgggcctcgcctcgggctcctcggtggcgcggccggcgggatgatggcatgatgctcggtgacttggagtctgatgccgtataattaaggaggatgtccttgtaaatctctaatgtgaatcgaaaatgagtgagcaaagcgaaaaaaaaaaaacccaaacccc

SEQ ID NO: 33946 - DNA, 893 bp, Triticum aestivum
  Clone ID: PAT_TA_33946
ggcacgagggctagcaaggtcagcagttgactacatggtctgtctcctgtcggacatttttatgcccacgtatgatggcccgagcaacttcgcaaacaatctcatgggtcatcgcctatactatggtttccgaaccacaatcacgccaaacaggaaggccctcgctccgatattcatggacatggaggaagggcgtgcatctggatatgaggagaggatcaggcaggtcatgttcaacacccattttggcgccccccacaagcgcatccatccagagtctttctacacaaactcatggccagagtgcttctgccagatgaaagctgggaatcaagctgaccggtgcccacccgacaatgtaaatgatgttcttgaaagtcagttccagaataaagaggatgtggaagcggaagctactaatcaaactgactccaccagctaaatggaaactggagtttagccaaggtttattgattggggacagattgtttctcagacctgcgtatggcatttttggaggaaggattgatggctctatatccatgtaggcgatcatgttcaactcaagatttagttgttgagattgttagcctgggagggtcggaaccagattttgggtaggttttgtcatgtagagttctggggaagaaaaaacatatgaacgttatgaatttgctgggagggtcagaaccagattttagatcactactaaaagatcttatatttgtttacagaggtactccctccgttcacaaatataagatgttctatgagcaactcttttttttaaatggaatgtatatagacacgttttagtgtgtttgttcgcccatttcactctgtgtgtagtctatattgaaatatatccaagacatcttatatttgtgaacgaa

SEQ ID NO: 33947 - DNA, 533 bp, Triticum aestivum
  unsure (1)..(533): unsure at all n locations
  Clone ID: PAT_TA_33947
tccggnaccgccgaactccacacaacgaacgattaccgttaaccacacaatcgcacatcatggataccgctaaggcacccgtcaagctcgtcaaggtcacccgtgtccttggccgaaccggctcccgtggtggtgtcacccaatgccgtgtcgagttcatggacgaccagacccgttccatcatccgtaacgtcaagggcccagtccgcgagaacgacatcctctgcctgctcgagtccgaacgtgaggccaggcgtctgcgataagcgcgcaccagtcgggaatcaaggagcggcatttctttcggttacggagttcttgcgaaagctatgggcatcgatacggactactacatgacggaatgatgcaggtgtggcgctgagaaagcgctgtgcctgggggggttgtggagatgattcggatacgaacatcacgaaaagatgacatggggttcactccggactaaatcaataccattcgacctctcaaaaaaaaaaaaaaaaaaaaaaaaaaaaaaaaaaaaccccaaaccc

SEQ ID NO: 33948 - DNA, 1080 bp, Triticum aestivum
  Clone ID: PAT_TA_33948
gacgtgcccccgcagacctgaacgtcgatgtctcgccagctctcccccagctccctcccctccaccgccggtccgccgccgcgacagctcgccgtggcctccgaccccaagaccgactgccgatctcctctgctcgggcctacgggactgggatcggaaaccgggacaagtgccggtactgattgacaccgagcagagcgcatcgccatcgccattgccggcggcgacgggatgaagatcctggtggcggtgaagcgggtggtggactacgcggtgaaggtgcgggtccggccggaccggacggccgtggacacgggcagcgtcaagatgtccatgaaccccttctgcgagatcgccgtggaggaggcgctgcggctccgcgaggccggcgccgcctccgaggtcgtcgccgccaccgtcggccccgcgcaggccgccgacacgctccgcaccgcgctcgccatgggcgccgaccgcgccgtccacgtcctccacgaccccgaccccgcccgcccgctcctcccgctcgccgtcgccaagatcctccgcgccctcgcgctccaggagacccccggcctcctcatcctcggcaagcaggcaattgatgatgattgcaaccaaacaggacaaatgctagctgcattgctcaactggccgcagggtaccttcgcatcaaaggtgataattgacaaggataagcaaaaagctactgttgagcgagaggtcgatggtggaactgagacaatctgcttggatttacctgcagtgatcacgactgatctgagactgaaccagccccggtacgcgacgctgcccaacataatgaaggcgaagtcgaaggtgatcaagaaagtcacccccgcagacctgaacgtcgacgtcaggtcagacatggaggtgctccgggtggacgagccgccaaagaggaaagccggggtgatcctctcgtcggttgacgagctccttgacaaactgaagcacgaagcccgtgtcctgtaaatggatcacacatgtgcattcaaataaatcgcgactccagatgctcctgccatttgaaatgaaaataaggagatgctaaaa

SEQ ID NO: 33949 - DNA, 287 bp, Triticum aestivum
  Clone ID: PAT_TA_33949
ttcaacagccccaccctggatcggcaccccaaggcgtcggcctactggttcagagacctgctgcagcactgatatatatggagtgcttctgaattacccaaccatcctgatgttgtcatcatcttgctgagtttatgcctactgttgttcgaatggaaccatatgcctactgttgttcgaatggaaccataattcagacttcagagcatgctttgctctaccaaatgagaataaaagttggcatgatatttgagtgttgcaaaataaatgaaacatacattgtctga

SEQ ID NO: 33950 - DNA, 1440 bp, Triticum aestivum
  Clone ID: PAT_TA_33950
gggccttccatctgggacgcgttcgcccacgtcccaggcaacattgcgggcaatcaaaatgcagacgttactacggatcagtaccatcgctacaaggaagatgttaatctcatgaaaggattaaacttcgacgcctatcggttttctatctcatggtccagaatcttcccagatggtgacggaaaagttaacaaagaaggcgtcgcgtattacaataatctgataaactaccttcttcagaaaggcattactccttatatcaatctttaccactacgatctccctcttgcactcgagaagaagtatggaggctggttaaatgcaaagacggtgggactatttgcagactatgctgacttttgttttaagacctttggcgatcgtgtaaagcactggtttacattcaacgaaccaaggatagttgcgcttcttggttacgatgtagggtcgaatcctcctcagagatgcagcaaatgcgctgccggtggcaactcagcaacagaaccttacatcgttgctcacaattttctcttagctcatggttatgcagttgcaagatccggactaagtatcaggcagctcagaaggggaaggttggaatagttctggacttcaactggtatgaggctcttaccaactcaactgaagaccaagcagcggctcaaagagccagggacttccatgttggctggtttgtcgacccgctgataaacgggcattacccgcagataatgcaagaccttgtgaaagagaggttgcccaggttcactcccgatgaagctaaattggtcaagggctcagcagactacattgggatcaaccagtacacggctagcctgatgaagggccagaaattgacgcagcagacgccgaccagctactcagccgattggcaggttacctatgcctttgagagaaatggcaaaccgattggaccaaaggcgaattctaactggctttacatcgtgccgtcggggatgtacgggtgcgtgcactacctcagccagaagtatggaaacccagctattgtcataaccgaaaacggaatggatcagccggggggcctcacccgcgaccagtacttgcgggacgcgacgagggtccggtactaccggagctacctcggcgagctgaaaaaggccatcgacggcggcgccaacgtcctcgggtacttcgcgtggtctctcctcgacaactttgagtggatttccggctactcctccaagttcggcatcgtttacgttgacttcaacagccccaacctgtaccggcaccccaaggggtcggcctactggttcaaagaccttttgcaacactgatgttgtcatcatcatcatccccatgatcattttgagtttgtgcccactgttgttcgaatggaaccataattcagactgctaccagatggaaataaaagttggcatgatatttttagtgttt

SEQ ID NO: 33951 - DNA, 1797 bp, Triticum aestivum
  Clone ID: PAT_TA_33951
ggtgggtgtgaacagtgagcaagagtgtgccaccgcgtcgtgcgagcgcgcgagcggggtttgtcggtcggccgcgagatggccgcgaggtccgcggtgctgctgctgctcgcgctggtggcggcggcgtgccatggcgtgggagccgcgggcgcgggggcgtcgccgcgccggcccaactggctgggcgggctgagcagggcgtccttctcccaagggcttcgtcttcgggacagctgcgtcgcatggccaggcggcgggcggggccgcccctggccaccgcgggacttccttcgcccacgccttcgccaacgttcccggaaatataaaggcagacgttactacggatcagtatcatcgctacaaggaagatgttaatctcatgaaaggattgaatttcgatgcctaccggttttctatctcatggtccagaatcttcccagatggtgacggaaaagttaaccaagaaggcgtcgcgtattacaataatctgataaactaccttcttcagaaaggcattactccttatatcaatctttaccactacgatctccctctggcgcttgagaagaagtatggaggctggttaaatgcaaagacggtgggactgtttgcagactacgctgatttttgttttaagacctttggcgatcgtgtaaagcactggtttacattcaacgaaccaaggatagttgcgcttcttggttacgaagtagggtcgaatcctcctcagagctgcagcaaatgcgctgccggtggttaactcgcaacagaaccttacatcgtcgctcacaattttctcttagcacatggttatgcagttgcaagactagcctgatgaagggccagaaattgacgcaggaaaggtcgaacagctactgaactgaatgggaggttacctattcctttgagagaaataggcaaacccggattctaaaaaagccggggttttcacttgggctttgatttcgcgacccgctgataaacggacgtgacccacacactacgcaagaccctggaagagaggaaacccacgcgtactcgccatgacaagaaaacgggcacggggtcagcggagggtaccctcacccaccaaccagtacacggctagcctcaggacgggcgataaagtgccgcacgagacccagctcagctacccggggcgaggcgaccgatgacataggcattttgagcgaaatggtagaccgattggcccataggcaaattctaaactggtctccgacatcgtcccgtgggtgggtgtacggctgcgtgcagaacttcagacccccagcatggaaccccacctaaagtcgtaagtgtaaacggaatggattcgcccgggagcattactcgggagcactacatgagggtcccgatgagcctccggttctaccggcgatccctcggcgggctgaaaaaggccatcgatggcgctgccaacgtcctcggctactttgcgcggtatcttctcgacagctttcgagtgaagcacccaatattgctacaatttaggtagactgcaacacgacctcacctggcccccccaggcccagccccccaaggcgtcggccttctggttcagagtccttctgcagccctgatatattttcatcatcttcatcatcttgctaagtttctgccgacgtttgttcgaatggagccataattcagactttaggagcattttttgctctgccaaactataataagaatggaaccataattcagacttcagagcatgctttgctctaccaaatgagaataaaagttggcatgaaaattgagtgttgcaaa

SEQ ID NO: 33952 - DNA, 564 bp, Triticum aestivum
  Clone ID: PAT_TA_33952
tgatgatggaaggccaaccccaattttgcagcttatggtgcaacgaatgaaggtgtggtgcaccttacaaagtctctacagcctggcatggttacgactgatcttcttatgtctggtgctaccgcaaagcaagcaaagtttttcatcaatatattagctgaaactcctgatgtggttgcggattaccttgttccaaacatcagagaaatccctaccaagcaatccatgaagccgacttacattcgctttctcacaggcttgaaagcctactccagaatattttcaagaattgcttttggtgctcgtaggaacaagtatgttgccgaggattagttttcttactgccatcttccaacccagaagaaacctagggatattcttgttatcatattttagaagcccattcttttcctgtaaaaataggatgtatcactgagggcatcttgagaacacagcaatgtacccctcatatatacaatacatgtaatttgattacacctcatcaaattacagttcatctggattatttatggaccttatgatctagttgcatgttgcattttc

SEQ ID NO: 33953 - DNA, 1103 bp, Triticum aestivum
  Clone ID: PAT_TA_33953
ctgcggctcgagcggctcctctggctggatcgagctcttgaccttctggcacgcccgcccgttgcatgggttccgtgtcaagggcccttgccattttttgtggcgtccctgcccaggctgcccacctgctggatccgccgcctccattggcgactccccgtcctgccccgcggctccgcacggcccagccgctgtcgcgggcccttggggctcctccgccacccgtcggtgtcgtcggcggcgtgggcggatccggcccgactccaggcgccggcccgtctccggcggcaacctcccccttctgccccaagtgccgcatctgccgccactattggagactccttgtcaagcaccacggctacgcagatcgaagccgctgtcacgtgccgaagagtcaccatcgccagccatcggtttcttctgcggcaatggctaatccagcccaacttcaggcgcgggccggtctccgtcgacaagcaccgtcttctgccacaagaaccgccacccattccgaatcccagcaggaccaccccctgctatccaatactgtggagagcttgaaaaatactgtcactagggtaatgaagaaaagttctatcaacaccatgtgaacaagttgtatgcaatgttctgacgcaaaaaaccagatatcaaatactatgtctgcaccatcaacaaaacattcgcaaagccaggccaacggatgtattttcaggtccactacaccaaagaaaagctggaagagtacatcaaaccagatggtaacacactcaaggtcagactcgcaaacatcaatctgcgcaccaattgtcgtatcatgctgggaacagacaagagagccacaataaccacaaactggtcggagttccaccgccgtgcaaacatccatgaaggacgtatctgcaccttccctttcaaggttaccgcagagcaccgcttggctctcatcgtccatgtcctctagatggaccatctacagcaacacgtgtcttctgcacgcattgtctatcatcgtaagaacatctaatttgcctctatgataagatgaaccttacttgtggtttccaacgatgccatacgttgcctttgtacaactgtcggcc

SEQ ID NO: 33954 - DNA, 627 bp, Triticum aestivum
  Clone ID: PAT_TA_33954
cgagtacttcgtggcgagggtgaccgagtacgcggtggtgggcaggctgctggtgccatcggcggcggaggctgtgctgtcggcggcgaaggcggacgggtacagggcgccggagctgcagacgatgaagcggtgcgcgccccggacggacgtgtacgcgttcgggatactgctgctggagctgctgatggggaagaagccctcctcggcggcgaacggaggcgacgacctgccgtcgctggtgaaggcggcggtgctcgaggagacgacgacggaggtgttcgacccggaggtggcgaaaggcgtgcggaacccggcggaggagggcctcgtgcaggccctgaagctggctatgggttgctgcgcgccggtggcggcggcgaggccgagcatggcggaggtggtgcggcagctcgaggagaaccggcccaagagcagccggtcggcgctgtacagccccgccgagacgaggagcgatgccggcacgccgctatacagctagcatttacgaagcttaatgaatccgtccatgatggtcttcttgtacctttggtcgatcgccataccggcaacattgattgatcggtttccgccttgatgaatcagtcaggaatcctacctgttcct

SEQ ID NO: 33955 - DNA, 1065 bp, Triticum aestivum
  unsure (1)..(1065): unsure at all n locations
  Clone ID: PAT_TA_33955
anaagaaaaganaaattcgacaagaagacaggtacgcttctcgcaggctagggcagacgtgaggaagagggtcaagggccggtttgtcaaagccggcgaagcatacgactatgatccgctcaacgatacacgaagctactgaagcccaaatgccattggctatatccatccagtgtcagactagcaacaatataaccttcggcagctcatgtggtgtcgctcgcactaagaaaaagaaagagaagaccagcaattgtgccggacagcgcagccggaaaagcgttaaaaaaaacaccagctggtgagttggaaaatactacagatagagaagctgcaaacacgcaggaagtccaggttgtgccgctgctccattttctttctccttggaagtggatggagcgtgcgtgcatatatcattttcttcttggtgggtggtttcgatcaccctccaccatctgcgcattaatccaatacaattacagggacaagtcctcccagctcaccacccaccgcatgcgtgggcatatacctgccactgcttccgtgtgcggtgcgctggctgccaggtcctgattaattatactcgtgtagtttcttcctgtaacattatttgtttatgacgcaggcgctggcagccttgtttaaaaacgaactggggtgcctgttataacttgtaaagtctgttcctgtaattttaaagatgctgggtatgaagtggaagcttccatgtatgtcagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaagaaccaaattttacttcccggggttgggaagaaaaaattttttttttggggcccccaaatttaattcactgggcgggtttttaaaacggggggattggaaaaaccctggggttacccaaattaaatccttttgaaaaaaacccctttttccccggtgggg

SEQ ID NO: 33956 - DNA, 415 bp, Triticum aestivum
  unsure (1)..(415): unsure at all n locations
  Clone ID: PAT_TA_33956
natcaggagcggtataatactccctccatcccgacactatgatagtgtaaaaaatgatctcacattttgggacggagggagtatgatatagggaaatgagaaactttgctatgcaaaagagaagactcagcaatcttgcgcaagatagtttgtctttgatatgaaatatttttgtacagttttgggcggcattatgttattgagcatggcatttttgcggggagagataatgtgctagcctggctttgtttttcggctgttgctgggatttgtatctctgcttgatgcttgtcaatagtgtaaactagtaggtgggaatggctgtaagtgtacattttgtaacgcgttgttatagtgctcaaaaaaaataaccatatagggccattagcttctcttgtggaggaaatcattgact

SEQ ID NO: 33957 - DNA, 910 bp, Triticum aestivum
  unsure (1)..(910): unsure at all n locations
  Clone ID: PAT_TA_33957
ctcaagcgagcccctcatccctaggcaggtttgcgggcgccctcgtaagatccttgctttgccctgatcctggtgttggtgcgctctccaggtcgtcggccaagagggagccccagggcgtgctggacctggaggctgacctcgccttcttccgttcgcagcaccggcacccggtcaacgcccccgtgcacgcggtccccgcggcgcccctcctcttccgcaacctcctcagcgtctacttcctgcccctgccccttccgctccccccgcccctcgccctctccctcgcttacgcccccgcctaccgcgccgcctaccccctcgccggcctccgcgccgggctcctccgccgtcgccccccgcgcggctgcccgcgccccgcccgccctcccccggccccgcgccggcgtcgaagcccgtgccgcccacctggggttctcgcgctcgtgcatggtcgtgttggccacgcatcgctcctgctcgacctgacaattcctcggccatggagagttagctccgggcggtgttcctgtgagtgaccttcccccggtttctctaatggagcaattcccaattctgctgcagatacttaacaagcaattaggctaggagccatacaatgggattgagcaagaacgtggataagaatgatggaggctgatcacagggagagcagaaagctcgagcagaagaaggtcaactaaatggatatcataaggtttattcatatattatgtagcaatttgtgattgtctaccatttgtgatgtttatgcatggaatattagaaatttctggaataaaataaacagtggaattttctgtataaactcctactccaatccccgggataaatgctcctgctcacgttgcaaccccgcgtcctggctgcaggtttgcangctccaaca

SEQ ID NO: 33958 - DNA, 695 bp, Triticum aestivum
  Clone ID: PAT_TA_33958
caccgcgctctgggcaagcccgtgctccgtcctcctcctcacgatgctcttcatggccgtcacctccgctggctccgcagagctcgtcgccgtctcctccctcttcacctacgacatctaccgcacctacgtcaacccgggcgcctccggtaagcagatcctcctcgtgtccagggccgtcatcctcgccttcggatgctccatgggcgtcctggccgtcgtcctcaacctcgtgggcgtgtccctcgggtggatgtacctggccatgggcgtcctcgtgggctccgccgtcatccccatcgctctgctgctgctctggagcaaggccaacgccttcggcgccatgctcggcaccatcagcggctgcgtcctcggcgtgatcgtctggctcacggtggccaaggtgcagtacggccgcgtcaacctggacaccaccggccggaacgcgcccatgctggcgggcaacctggtgtccatactgctgggcggggccgtgcacggcgtgtgcagcctggtgtcgccgcagaactacgactgggagagcagcaggcggatcacgacggtggagagcgtggccgccgaagacgacgacgagctccaggaggcgaagctggtgcacgccaagcggtggatcgtcaagtggggcctggtgttcacggtcgtgatcgtggtgctgtggccggcgctgtcggtgc

SEQ ID NO: 33959 - DNA, 745 bp, Triticum aestivum
  Clone ID: PAT_TA_33959
cgtctcctccgcctacagcctactccgtaacacggcgaaggagctcgtgtgggtggatgctccggcggcgtgcccggagacagcgggcggaggagctcgtgtgtgcctgccctgacggagaggagcggaagatgctcctggagtgggagcacagcgctctcaagcgctcgtgctccgggggctccggcgacgtacaaggagctgcatgagcgcagagaggagcttatcttttgttagatatgtttcatgcctcctcgagctcgaccacccatggctacgcactgctaaggcagtggatcccttccggcagagaaaaaagaccagctcccagctgtgagggtcaaactggaacatgatcccttggatatgttggtgaaggccttcgagatgagcgggcggttatgcctcgccgtaaaagtgcccggcttccctccgactcttcagttatgggttatgtctctgccaccgcaggaccagtgggccgacagtgacgacaaaaagttgtgctgggatttgcactacagcttcaccgcatactacaccaacaataatgtaccgactagcgtttggtttgacaatggcgagaagacgttgtgcgtcaggcaagaggatgtcttgttcaagcatggcatgagaggacgctcgccggagccgtctcgatattcttattgtccagaatgcgaccagcgactcgagctacatatggaacattttgaggggctatcgccccagcttgctctcaaaa

SEQ ID NO: 33960 - DNA, 1254 bp, Triticum aestivum
  Clone ID: PAT_TA_33960
ctgcaggaattcggcaccagcaacgcccttatcctcttccttcccacccactcgtccccatttctcgcccccatttctctctctctctctctctctctctctctctctctcagttaccgggggcgagtcctccctctctcttccctggcggttctccggcgttgttgccgactgcgattctcagcggtgcacgggcggaggcagaggctcggagccggaggctcgcacgcgtcacacggcagtcggatctcgatgccgcgaccttgtcgatgacggcgagaagaggaacccatgcacgccgtggtggtaccgtgattcggtgggacggagctgccggaggcgaggcacggaggtgctcgtgcgggccgtttgcatccaccccctcgacatgtggtggtggtctggtggacggtggataggtctcgccgacggcatcccgatgcgcggccgtgtcgacggtggtggttagagcggctgcgcgcttggtgaagccgtagtgtttttgggccggagttgatgctcgggtgtgccggcgccccatctggtgctggagggagatgctcgtacgcgccagcaagagcccgccataggtgtggatcctacaccttccgtcgcatccccacgtctcctccgcctacagcctactccgtaacacggcgaaggagctcgtgtgggtggatgctccggcggcgtgcccggagacaacgggtggaggagctcgtgtgtgcctgccctgacggagaggagcggaagatgctcctggagtgggagcacaacgctcgtgctctggcggctccggcgacgtacaagcagctgcatgagcgcagagaggagcttatcttttgttatatatgtttcatgcctcctcgagctcgaccacccgcggctacgcactgctaaggcattggatcccttccggcaggtagcatattgcccatccctgtcgcggcgttcgggccggggtggtcctcccaccgaacgaaattgttcgtggagtcatccctcctaccgaacgagggagttcggtctgggaggtccccaggccgaacgcacgcgcgttatcggcgtccataggttttgacccataacttggtaatgtttttgtaaagtgggagcgcgaccacccgaagagaacataaacgaagtcctcccttcttacctccctagtttactagcgggcaatcgcggtgccgtttcctcccccgtgttcccctggggggccctttcacacattttttggtcatgttatgtagt

SEQ ID NO: 33961 - DNA, 1198 bp, Triticum aestivum
  Clone ID: PAT_TA_33961
cgttctgcacagctggacagccacaccacctacccatcctcccagccaacacagctggcacaggtagagggaggtgagggagtcacagcactgcgctgcatcgaagcactgcactgacggagggatgaccaaggacgtggagatggcggcgcggacgccgcggcaagggcgccgtcgccggcccctcccccggcccctctccgccggcgcagggcgggcgacgacggcgtggaccacgacggcaagcagctacgcacagcgagcgcatggacagcgagcgcgcacatcggctccggcgtgctctcccccgccgggctctcggcgcagctcggctgggtcgtggggccagtcaccctcaggctcttcgcggcgatcacctactacacctccggcctcctcgcctacggctacctcgcgggcgatgcgcacaccgggaagccgctcaacacctacagggactccgtcgccatggacgccgtcccaccgcaagtgtgggcctgtggtgtttttcagtacgtcaacttggtcgggactgcaatcgggtacacgatcacagcgtccatcagcgcggctgctataaacaaggccaactgcttccacaagaaacggccgggcggccgactgcggcgtgtacgactccatgtacatggcggtgttcggggtcgtccagatcttcttctcccaggtccccaacttccacgacctgtggtggctctccatcctcgcggcggtcatgtcgttcacctacgcctccatcgccgtcggcctctccctggcgcagaccatatcaggccctaccggcaaggccaccctgaccggcaccgaggttggagtggacgttgattcggcccagaagatctggctcgcgttccaggcgctcggcgacatcgccttcgcctactcctactccatgatcctcatagaaatccaggacacggtgaggtcaccgccggcggagaacaagacgatgaagaaggcgaccctggtgggagtctccaccacgacggccttctacatgctgtgcggctgcctcggctacgcggcgttcggcaacggcgccaaggggaacatcctcaccggcttcggcttctacgagccctactggctcatcgacttcgccaacgtctgcatcgtggtgcacctggtgggcgcctaccaggtgttctgccagcccatcttcgccgccgtcgagggcttc

SEQ ID NO: 33962 - DNA, 669 bp, Triticum aestivum
  Clone ID: PAT_TA_33962
cataactacgagtcaatatctaaaatcccattaagcaatccaatagccatgaggacatcgagcttccttctcatcgttgctgccgcattcctctacgccatcgcctcacccgccacgggctgtggggaatggatgggcaaccaattgcggaacacaacaatagagaatggattggaaccaatcagaaacatcaacgaccaacgcatccaggtgctcggcaattgggcggtgttggagttcggaaagtacacaaattgtgtgctcaagttcaacaaggtggtgagtggcagacaacaacatgcatttttattgtactacaaactcatcatcgatgcatcggacgtccgcggggtagacggcaagtacaaggcaagggtgctcgtgcaggagggggttcacagaccccatctcttctcctttgccaaggtgaactaggcgggtggcagtaacaacaatagttataattgtgatgttgcaaatatgtttgctgggtttctaatcgaataataaatattcctgttgcattgccatgcattttggaacatatcaaattgcattaaaaaaatctgcaacttgactatgataagaccagatgttctttttacaggacaacatgattaagctttcccatataaatttgcaggtagcatttgcgtgcgacaatgaaca

SEQ ID NO: 33963 - DNA, 507 bp, Triticum aestivum
  Clone ID: PAT_TA_33963
cttttgaaatcatgagccaaatgcctggaaaaatgagcgagatgcctcagttgggagttgcggtgaatgaaaaccttgctagttacttgctcccagatcttacaatggcacaagttcttggaaatagccatttgaaggaggagccaagaggatggtgagtcacagccaaagcaggtcacagatgaggcagatactgaaacttcatcggtagttcggcgaattataggaagataaatagtgctccagcatgtatgccagatggcgacgaatagagtcaccaaggaaccttgtttcctctatctggaagcaaaggagaggtgagtggtgactgaggaaccactctgcattgcattgcgacaagcctgtatattggtggctgaacattggtcgagcagtgatggtttcaggaaattgcagtttttctcgtcctgctgcacctgtagagtaaatactagtagaagatgtagcaacaacaagaagctaataagaactagctacatagcaaaa

SEQ ID NO: 33964 - DNA, 739 bp, Triticum aestivum
  Clone ID: PAT_TA_33964
accactcatcctgttcagacggatacaggagtctcttcctttgtgccgcatcatgccattcaaaacagtcaatatctatctggagcctcggagatggatcgtatagtacagcttgtactggaagaaaataatcggcttcttactcagatagacacaaatattcaagcatttcaggctcaaaataacatcgatctcttcaatcgcgtgcgaaggaacattgatggcctcttgaaaatcatgagccaaatgccgggaaaaatgagtcagatgcctcagttgggagttgcggtgaatgaaaaccttgccagttacttgctcccagatcttacaatggcacaagttcttggaaatagccatttgaaggaggagccaagaggatggtgagtcgcagccaaagcaggtcacagatgaggaagatactgaaacttcatcggtagttcggcgagttataggaagataaatactgcttcagcatgtacaccagatggcgacgaatagagtcaccaaggaaccttgtttcctctatctggaagcaaaggagaggcgagtggtgactgaggaaccactctgcattgcattgcgacaagcctgtatattggtggctgaacatttgatcgagccggggcgcgtgccggatcttgtagtttttctcgtcctgctgcacctgcaaatgttgactctttttttgggtttctcctccagagagtagagtaaatacaaccagctcataagcagtaat

SEQ ID NO: 33965 - DNA, 1174 bp, Triticum aestivum
  Clone ID: PAT_TA_33965
gcacgagccctccccccgcttccgtttccgtttcgtcgccgccgtcgccccctcgccgcggcggcggagtcgcccgcactcgctgcgcgcaggaacgatgagccgacgtagtaacggccgcaccatctacgtgggcaacctccccgaggacatccgcgagagagagattgaggatctcttctacaagtatggtcctattgtcgatatcgatctgaaaattcctccaaggcctcctgtttatgcttttgtcgagttcgaagacccacgtgatgctgatgatgcaatttatggccgtgatggatatgactttgatggccacaaattgcgggtggagttagctcatggggggaaaggcccttattttattcgaccaagcagctatagtagttctggacgtcatggtgcagttaggcgttctgattaccgcgttattgttaccggattaccttcttcagcatcatggcaagatctcaaggatcatatgcggcgagctggtgatgtctgtttctctgatgtttatcctgaggctggagcaattactggaatagttgagtataccaactacgaagacatgaaacatgcgataagaaagcttgatgattcagagttccgtaatgcattttcacgagcatatatcagggtgagggagtacaatgctaggcgtagccgctcttactcgagaggtagaagccgaagctgctcttactcaagaagcagaagtcacagttatagcaggagcaagagtccaaggtctagatctgcttctcggtctccttcacctgttaaagcaaggtcatcatcaagatccctatcacctgccgctcctgcccatgacaagtctgcaagcaggagccccgtcaggagcagaagtttaccccgttctcagtctcctgtgaaatctgagtgaagccagatgcactcgaagtcagggaaaaaaaacatatcaggatttgttggattaggacaatataatatggattgtgggtgctctgtcccaagaagtaccattgctgttccttggaaggaaaaacgtcaactttgtggtttgagatcaatgtaggagtctggtgttgttttacttctgcactcagttgcgagaacgtaaaagcgtgaactcatggctttaactttagtatgctatagtttcgcgtcaaaaaacttcatgccacagcag

SEQ ID NO: 33966 - DNA, 681 bp, Triticum aestivum
  unsure (1)..(681): unsure at all n locations
  Clone ID: PAT_TA_33966
aagggtccttncttnggtggaatttgaggcatgtgggcctttgtatacccagtgnaagggnttctgnagggttaattggaacccagntttcccgtnggagttnaaannacgccgtggcggggtatagactcattnagggggaattggtaccgggcccccccttggttttttttntttttgtttttctctgtcttcagaataatactagcattgtctgaatttgatccaactgctcatctcaaggctggcacacagtgtacaaaaatccaccattgtcatctgctctgctctgctatgaaactccacagtcttgctagttacagtactactgtaccttacaactatattttgtcagacgacatcatcgaagctacccttgccgtcagcggcgtcggagagttgtttccggcgactgccccctctcactgctggcagcagcggggcggcgtcgtactcggagacggccgtcttctcgtcgacggttttccggtgcgcctgctcgcaccgcagcagtatctgcagcacgtccttcatggtcggccgcgtcgacggctgggcgccggtgcagatgatgccgagcttgaacacgacctcaaagtcgtcactttgcctggcgtcgccgatgcactcgtccgccgcgtcggcgatgctcttccccgactgcaggtgccgccacgccca

SEQ ID NO: 33967 - DNA, 435 bp, Triticum aestivum
  Clone ID: PAT_TA_33967
gggccgaatgtcctttcagatcttacgaggagaagataattgccctggccttgtggttctttcaaagttaaaactgagcattgagttatgggggaggaagtcaagcagtgatggtattgtctcatgggtgctgcagaaatgtgttcaactggacgagctcttttcaagacccgcgcgcaggaaaaatgtcatcctgttggcggggtatgatgaggacacaaatgcgatatttctgtcttcggattctcatgatttcatcctccagctcgagtcggtgcagttcagatatattggaaggagagaatgcacacacttcagaatgtattatccgtatacaaatttctacattgcagagaggccacgtgagtctaggattaaagaagagtgagttgcatttctctcgtggcaactgggtctgccgacataaaagccgtc

SEQ ID NO: 33968 - DNA, 713 bp, Triticum aestivum
  Clone ID: PAT_TA_33968
gacccctttatcagcctcggtttcgagggaaacacgagttgccagatctcccggatccgccccttccccgacccgaatcgcgcggagatggacgccggcggcgccgacctgaggagcagcatcaagaagtggaagatcatctacccggtgtacctcaactccaagaagacggtggccgagggccgccgcatcgccgccgccaaggcctgccccgaccccacctgcatcgagatcgccgacagctgcgcctacctcaagatccctcgcgccattgagttggataaggcgtacccgcgggatttcttccaggtggggagagtgagggtgcagctcaccaatgatgacggctccccagtcaaccctgcaatcagaacaaagaagcagctaatgatccaaatagcagagctggtccccaagcatcatgggaggactaagaagcaggaaccagtggcaggtccatcagttacaactactaacaagaaaaataagaagaagaagtagcattctgtgttgttttttctgttcatagaaagttttctagaaaattcatcagagggagttcttggttgtctgtctgctatgaggcctgaaaaactgtgaattttctgaattttcttattttatatggtgacttctgcaaccgttttgcttgttgccttgaaaggccaaaagtggggactacttaagaaaaaaaaaaaaaaaaaaggccccta

SEQ ID NO: 33969 - DNA, 875 bp, Triticum aestivum
  Clone ID: PAT_TA_33969
ccggtacgcaccgggcttcccttcttccagggcctgacccgcccacgaccgcgcctcccctgacccgaacgcgccctgcctggatcccgccgtggcccgcacccccggatccgccccttccccgacccgaaacgcgcggagatggaccccggcggcacccgaatcggcgccgaccggaggcggggcggcgcggaccggaggagcagcttcccggtgtgcctcaacatctacccggtggtccccaagtcccgccgcacggcggccgccaggcgccgctccgccgccgcctgcgtctgccccgaccccacctgcgtcgagatcaccgacagctgcggctatctaatgatcactaggcccattgagctggataactcacacccgcggaattgctaccgggcggggaagcagagggggcagctcaccaatgatgacggcccaccaggcaacaatgcaagcacaacaaagaagcaactaataatccaaatagcaaagctggtccgcaggaataatgggaggactaagatgcaggaaccagtagctggtccatcaaattacaaatactaagaagaagaataagcattcgatgtagttttttctgttctttgaatgttcttaaaaagttttctcgaaaagaggtcttgggtatctgtttgctatgtggcctctaaaactccgaattttctgtaatttttatttattttgtatatttttgcgagacttttgcttgttgccttcgaaaggctaaaagtggggactacctactgttgtttgcagcattgggagtgtgagtttgcagatgatttcagtttggtacttgcaaatccaaaggagatatactttgttagaaactagtatgaatggatggagttcccctg

SEQ ID NO: 33970 - DNA, 1024 bp, Triticum aestivum
  unsure (1)..(1024): unsure at all n locations
  Clone ID: PAT_TA_33970
tttttttttttttttttttttttttacccaagaggccctgttggccatgttgttgtctatcataagttcaaccggatcaacacaattcaaaacacaattacaacgaccgttctggtgaccacgaaggccttccagaattccgaaaccgaatatcagaaaggcgctccatggtcaccataaatacacaactctggggaggactggatggggaaaaagtttattgcgacgggtccaaaacgaacaaggggatcattcattatcgaaactcaggagcatctcaaaacttgggcggcccgtcgcgtttttaccgcacgggttgctggttgtaatggctcttctccttcttctttgccgccgcgagcctggcggtcctggctgccgcctctgccgcggcgatctttgcagctgtgtccgtctccttgcccgacttcttcttcttcatcgacgccatcttctttaggcgctccttgacatccacagccgtgtcttcctcgggttctgcactggcagcctcctccgacacttcagcttcctttgcctcctttgcgctcttgtccttcttgttcttcttcttcttggcattcttgctctctaaaggggcaggtgcgtcttcctttctctctccatcaccagcttggctcgcacctttcttctctcgcacctttcttctcagcattgttgtttccatcttgcgcagcatcgcttgtgttttcagaaattcccaactcagctaacacagcatcaagttcagccagctccttctttttcaactcctttttggacagctgcctttctgtctctttaggtgctgctgcaactttcttcacatcaggatcagcagcttccacttcatgctcaggttcatcctcagcaccatcctcagcctcatcatcatgctcctcatcctcactttcaatttcctccggcagggcggcgtggacagcatcgacctcgtcctcctcctcctccgcggcccttttggcggcggcgnggtcgttcccccagatgggcgcggggggcgcgg

SEQ ID NO: 33971 - DNA, 587 bp, Triticum aestivum
  Clone ID: PAT_TA_33971
ttttttgattttttatgaaggcaggcagtaaaactccaaattggcaacagtattaagttccatcctgggtccaggtccggtcttccacatttcacaatccaaacttccaaggaaaccccaaatcctaacatattaagttccgatacatgcatgaattcacatctcacatccaagttccaaggatatcggtcaaccaaataagagtcacatacatacatgcatgaaacatggcaaaattaaactgaaattctggtctatttattaaccttaagtggacaaaatcactaattatgcatgatcacgaaagattacccaagacattcatttattaacctctgatcttctacatgcattaatatgcacgctctcttcattcttgatcgatcatgcagtcaccttaccttgagagctttccatgcatttcttgttgtttctcttgacgatagatcgatcctgctgtaggttgctacttcagctcggcagggttgctacgccagggccgacgccgaggaagtcccgagtgctcagcttgccgtcgtgcacggggaaagccccgccgctgccgaacgccccggcgcgaccgccgg

SEQ ID NO: 33972 - DNA, 446 bp, Triticum aestivum
  Clone ID: PAT_TA_33972
accagtgccaagggcaagaccgacgtgcagtacatcatcctcgacagggtgatgcagcagccatcagcagcatcgtcaggaggggcatgctggatgagctcaagaagaccctggtcaggaggagcattcaggtaagaacagagcaacacaaattgtcatgtttctaagggaaatagagcatgctttgtgatatgaacaatggctgatttatcgttttgtaaacctaaactttccaacaaacttgcgagaaatttatattcagatggcacatggaaatttatattcagatgatatggctacttcatattagggagatattttcgagtggagagcatattaagttaccatcagttttcttgacataccaaattgatgttggaaccgtatgcattggtaatgttaattaattgccatggcaaaaatactttttaataaagtcgccatca

SEQ ID NO: 33973 - DNA, 1164 bp, Triticum aestivum
  unsure (1)..(1164): unsure at all n locations
  Clone ID: PAT_TA_33973
ctacctctggnaaactggnnagcaacgcaggtgttccgcttttgcaggggcgtaaaagcagcggcgaccgtgagagtgagaccgatgcatcggaaggcgctgctggaggcgctcgcggaggagctgcctccgggcaccatcaggttctcgtccaagctcgcctcgatcgccaccgagaaggcgcagggttccccggagatcgccgtcctacggttagacgacggtacggtgatccgatccaaggtgctgatcgggtgcgacggggtgcactccgtggtgtcgcagtggctgggcctgtcggagccggcgagctcaggccggtccgccgtccgcgggctcgccgtgtacccggacgggcacggcctgaagaaggagctccggcagttcctctcggagggtctgagggccggcatggtgcccatcagcgacaccgatgtctactggtatcctcgtcaacaacaccgtccctgcagagcaggaggccggcacggaccccgccaagatcctgcgggaggtcacggacaacctgggcaggcacatgccggcggagtacctggacgtggcgcgccactccgactccggcaacctgtcgtgggcgccactgctgtaccgcgccccccgggccatcctcaggggtccggcggcccgcgggccggtcacggtggccggcgacgcgttccacccgatgacccccgacatggcgcagggcgggtgctccgcgctggaagacgcggtggtgctcgcgcgcgctttgtctcgggcggccacgcccgccgacggcgtggcctcctacgtggctgagcggcgtggccgggctgcctggctggtcgccggggcatacctgtcgggctgggtccagcagggcgggaccaacgtccggggcgtgcgagggtacatggtcaggctgtttcgcgactggatcttttacaggttcttgttccccaggctcgccgatacaatgtggttcgattgcggcgacctggtggagccaaacgcggagggcaagacccactccgagtaaactaaatgccatattgcgttatactccctccgccaatgatgtgttatatagcccgtgcagacgtgaccttaccaattcacatgaaaatatgtgtgttttttatagtactacttcatattaattatcgttgatttaaaaaaaaa

SEQ ID NO: 33974 - DNA, 902 bp, Triticum aestivum
  Clone ID: PAT_TA_33974
cgtccgcccacgcgtccgccaacggatcggattcgatttggatttctagggtttgctcatcctcatccccatcccctcctccgtggccgtccgtcgtcttccccacctccgatcaaatttgtgatttttcatcgatttccataagatatgatccccaactccttcgacaccttcctctgatctgtccccccaggaaatcccacatccagattccacatactatggtgcgccgccgcccgtcttcctcctcctcctcctcgtcgccgatgctccacaagaacctccgcgcgctcggccccggcctcaatccgtttgcccccttcggcatgggcaactactcccgctaatccccccctccctcccctctcctcaagctctgatttgcttttctccccggatccgatttgcttctccccccttctcgttcttgattggattggattggattggattgctcctctctctgcttgcttggtcggcttcgtttggatctgcttgcgagattaggcaagggggccatggtgcagctccgcagctcgctcagcatgacccgggcgcgtacccgcagcgactcggacgacgccgacgaccgcggctggagccagctccacgtcgccgcccgcaagggcaacctcaaggaggtgagacgtctcctgaatgaaggcatgaatgtcaatgcacccacatggggaccaaagtctcctggcgctactccgctgcaccttgctgctcagggcgggcatgtgaaaatcatggatgaactattggagcgcggtgcaaatattgatgcccgaacaaaaggagcttgcggctggactcccctgcacattgctgccaaggaaagaaacaagagggtggtcaggttccttgtcgagaacggcgcattcctgccccctgacctg

SEQ ID NO: 33975 - DNA, 1750 bp, Triticum aestivum
  unsure (1)..(1750): unsure at all n locations
  Clone ID: PAT_TA_33975
gcacgtggtcgtcttcttggggctcctcctcttcgaccgtaacctcctgggtctcgctcattccccttccccacccccgcttccttcgtcgttcgtcttcttcctcaactccggtccggcagacaatttcccaacctcctccgacgccttcgttccccgtctcccgccaccccccgaaaagacctgcccatgcttcgacatcctcaggcgcgccgccgcccgtcttcctcctctacctccccgtcgccgcttctccaccagcacctccgcgcgctcggccccagccccaatccctctgcccccttcggcatgggcatctcctccctctaatctcccccctcccctccccctatcctcctgctcatctttcttcccctgtatccgatttccttcttccccccttctcgtttttgctttgattggattgttgctctctgtgcttgattgcttggttggtttggatctgcatgcgagatcggctcactgggctagcttggtgcagctccgcaggctcgctcagcaatgacccgggcgcgcgctcgcggcggtgactcggacgacgccgacgaccgcggctggaaccagctccacgtcgccgcccgcaagggcaacctcaaggaggtgagacgtctcctgaatgaagggatggatgtcaatgcacccgcatggggaccaaagtctcctggcgctactccgctgcaccttgctgctcagggcgggcatgtgaaaatcatggatgaactactggagcgcggtgcaaatatcgatgcccgaacaaaaggagcttgtggctggactcccctgcacattgctgccaaggaaagaaacaagagggtggtcaggttccttgtcgagaatggcgcattcctgccccctgacctgaacgaccacaggttcaacccacccctccactactgctctgggctggagtgggcgtacgagatgaagcgcatgcaggacgagagtgactcgggcggcgaagcttccttcagctcgtccaactagtgaaaagtgatctatccgcaggggattctgcggatctttgggttatgagtgcttgtttttaattatgaaatccacccttcctagcttatgtgccgagcctgcgaggagctacgtccaagtgaaagcaggctgatgctggtattgtatgtgtatacaagaataaatacggtgccgtcacgaggtcctggagttgctgctgtgctgccctgtagtttacctggtatattctggtacatcggtgaccaggctgcagtgatctcagattggaatatccgtctctatgaaggaacatccttcgtaaacatacgttgtcgaacctttgctttgtttgccggacaagtattgtacatctgattggtttgtttgaaatgagaacacatgtttttgacaaatgtgttttttttttgtctgaagctattgttgtgtttatttggaactgatatggtctttcgatcaattaaatatgtatgttgtggcatatcatacgccccacaagtctctcgccgtcgcgtcctatncaagaagaaagtcnntgttcggacccccgtgtagtaaagatcggngcacctggacatnagagatccaatgagcatgctcgcaaacccnaatgatanttgtgaggnataaaggagcatggnatccgggctgtcatncacacaaggcggtgaacatgcctaangccttaattttcccaancaggaggncccttaaaaggnggttccccccgttttccnanagggcaccc

SEQ ID NO: 33976 - DNA, 967 bp, Triticum aestivum
  unsure (1)..(967): unsure at all n locations
  Clone ID: PAT_TA_33976
ggtctttgtactggttagcactctccagccgaattcatgagcgcctcagcctttcttgatattaggccattttcaatttttagcaccttcataatctatgcgttctttgctatataaaatgatgttatattagtaagttggcagtttagcttttgagcacgctcatgatctctgaagtcattgccgtgctgaattaaaaatcacaaggcagaattcctttgatacttataaatttaaaggttgtgaacacttgttactaggtgattgttgaacattgtttgttcaaaaagactctagcttgcttttttttacacataaaccatgccaaaataagtatggtttcggaaatcttaatcacttactatttgaatatatttagtttttatatcttactaatctattaatttagtcggaatcttgaccctcgattacgctcattttctctgaatttactgcttattatgtattaaataacactagtgtgttttcatcagatacatatagtcgttatgggtgagaacactcgttttcaggagattgcattaatgtcgttcattcgtacacaccatacctggctattttatatatatacacgcaccgggaattccaaagtagttgattattctattagcacagtccccacagttcgagaagcctctcatgggctgtatgcccgtctgccctccgaatttcttttgtctatgggctagtttcatctgcctctagctgaaagtctttcaaatccagtcattctcctcgcctaacttaatttttgatggctcatcggcattgggattcccttcatcagggtattacatactccgccaagtgtatatataaaatccaagnaaggaacattccctccatgtgtnacatacctacctananagcgnactctgcnatccaaanatttgntatccataaganaccatcangttcaagangntcaaangngnttattgcacac

SEQ ID NO: 33977 - DNA, 440 bp, Triticum aestivum
  Clone ID: PAT_TA_33977
attcggcacacggcgccggcggtgcgcacgccgcggtcggcgggtgcagcgatgatgggtccctgtcgtcgctgtcggggtacaacaacaaccagaaggcggacttcgccggctacctggacgcggacgcgctgcacggtggtgttatcccgtcggcagtggcggagcttgagcataagcataatccaagaggggaccattggttgaaggggagcaaattaatgggaggaaggggctaatctttagtttatgttaaggattaattataatcctaataatccatgcttaacaaccgccttaggtaagtaaccgtcattggttaccgcctttatggtgtcctttgtaaaggtcgcgtccgttcaacgcgtcccctcactttgtatatatagccttgtttgtcatcaataaagtgatactgtttattccaaaaaaaaaaaaaa

SEQ ID NO: 33978 - DNA, 823 bp, Triticum aestivum
  Clone ID: PAT_TA_33978
tccccccggggcgccgcttcctccgctctctccggcggcagccccggcccgccgccccggtacctccgctgctttgcccccaggttccgacgcgactagcgcaatgccatccgcctgcgcggcgtacaatgaaacgtcgcctctcccctcgcctcgaccaccccccgctcaggtgcagctggatgaacgtttcggctggagttctgctcgcacccctcgtgtgcgggtgtgtgtttcggtcggccccgttggccttagcccgtcttttatggcgctggtgccgatcttggtcgcgcgcggcggcagtgaggggacgacgggcccgaacctggatgaggagctcaaggcgatcttgggctcatcatggcagcaattacaaaccgggcatgtgtgttcctgctacagcgtgatgattcaagaggaggacaggtccgtgcagtcgagcagggaggtggcttcctccgacgtctccgccgccgcccccgccgggagcccgggcacctccgtcgccatggccgtggccgccaacgacaataaagccattgccaccacctcggcggacaataagaggagaaggctgcattttcctcagcgccagtaggcaatgggaggagctggatggatgttttggctagagttcagctcgcactccagctgctgctgatttctgtcacccccctagccttagactttttttcattagcttgagcagtgattttggtggtggtggtggctaaatagggggcaggatttgattcttgtgattgtgcaattattacagctgattggtaagttaggatcggaaagattttggttttcaaaa

SEQ ID NO: 33979 - DNA, 2228 bp, Triticum aestivum
  Clone ID: PAT_TA_33979
ccacgcggccccgggcccgcccccgaaccccaccgccaccacttgctccggcccgccgccggccaccgcggaagcctcggatggcaccaacggggggtgccgctcgcgcgggctcgcccgtccggacgccgttgggcagcctgatcgggctggtgaaccgggaccagcaggcgtgcgccgtgctcggcgaccacggcggcggcgccgggggctcgcgctcggaggcgcgcccctccgtcgccggcgtcggaggccagagctccgggaagtcgtcggggctcgacagcattgtcgggcgggacttccggccccgtggatctgggatcgtgacgaggaggcctctggtgctgcagctgcacaagacggagggcggccaggagtacgccgagttcctccacgccccgcggaagcgcttctccgactttgctgctgttaggaaagagattgctgatgaaactgaccgcatgactggaaaatcgaaagcaatatcaaatgttcctatccatttgagtatatattctccacatgttgttaacttgacacttattgatcttcctggcctgacaaaggttgctgtagaggggcagccagagtctattgtgcaagatattgaaaacatggtccggacttacgttgacaagccaaactctattatattggctatctctccagcaaaccaagatatagcaacatcagatgctatcaagcttgctaaggaagtggatcctacaggtgaaaggacctttggagttgtaacaaaacttgatttgatggacaagggtaccaatgctattgatgtactcgaagggaggtcatatcgcttgcagcacccctgggtgggcattgtcaaccgttcacaggctgatatcaacaaaaatgttgacatgctcgcagcacgtcgcaaagaacaagagtactttcaaagtagtcctgattatggtcatttggcacataaaatgggtgccgagtatcttgctaagcttctgtcacagcatttagaggctgtgatcaaagccaaaattccaagtattatatcaatgatgaacgagacagttgatgaaattgaagctgagttggatcgacttggtaggccaattggaggtgacgctggggcacaattgtatacgatattggacatgtgtcgcgcatttgaccgtgtttttaaagagcacttagatggcggtcgaccaggtggagatcgcatttatggtgtctttgaccaccagttacctgcagcactgaaaaagcttcctttcgataaacatctttcattgcaaaatgttcgaaaagtcatttctgaggctgatggttaccagccccatttgattgctcctgagcaaggttacagaaggcttatagatagttcactcagctactttaggggcccagctgaagcttcagttgatgcggtccatttggtattgaaggagctagtccggagatcgattgcagcaacagaggaattaaagcgtttcccaacgcttcaatcagatatagctgcagcagcaaatgaaagcctagaaagattccgtgaggatggacgaaagacagttattcgtctagttgacatggaggccagttacctaacagtagagttcttcaggaaacttcctactgaaccagacaaaggagctaacaacaacactccagccaacgacagatatcaggacaaccatcttagaagaatcggatcgaatgtatcatcttacatcaacatggtttgcgatacattgaggaacacaattccgaaagccgttgtgcattgtcaagtgaaggaggcaaaaagaaacttgctcaaccgtttctatgcgcatgtaggaagcaaagagaagaaacagctgagcgcgatgctggacgaggatcccgcgttgatggagaagagggattccctcgtgaagaagctggagctgtacaagtccgcgaggaacgagatcgactcggttgcatggaaatgatctgatctgatccgatagagcgtttgcggctggaacagatagaacatgtgtagtagagatgctccattcgttttgcatatgctttgtacacgggctttgttgccgagtgttgttttgtggctaccaccgagacatggacagacaccgttgcttctttggccatcctttggcctcctgtatgattcgtatcgatattaatacagatgatgtattctttgttcaaaagatgcctccccatgatcctccagtgagacaaatttgtgtgtttgttct

SEQ ID NO: 33980 - DNA, 739 bp, Triticum aestivum
  Clone ID: PAT_TA_33980
ggctgatccttgtcgtctgattcttggtggtgaacgtaaactacccgttccttgggcaaagttacagcgggttttctggtttgctgattttgattctgatgaatcaatgaatgagagagttctcctgcagaaattctttgagcatattgccatcaagaccttgtcagagacattgcccaatttgcaggttgtcttgatcatgaacaacacaaaatttgttcacttacaggctgaaagattggcgagggaatgcttctattttctgcgtgaatcatttatgttcgatgaagggactctgggatggttttcggacgccccaagttatccaaatgggatgcaagtatcagcaccagtcgcttacgttttcaacatgcatcctcctactggcattcagtttggtgactatcaaacagagctacgcaaagccttacggagagcctagttaggccagtagaggtttctcagatgtgaatagctaggtcgaatcattttacgagctgtaatttttttgctatggtcagatcagactacgagtgccatctcaagtgaacccacgctcgctaggaattcttattggtggagacagagtaggccctgctgcagtgactaatgttggtttcagctaactgctttaactttattctcgttaggttgagaactgaagtgttgatgggtaaaccttgatatcccttttttggggtaaaccttgatatcttgagaaggtcagatgttggtttgg

SEQ ID NO: 33981 - DNA, 987 bp, Triticum aestivum
  Clone ID: PAT_TA_33981
ctcaagaagacatacctacggcagtatgctgtgcgaagttgctgcctgcaggtggagatgggcatgttcttatcatgaatgacaaaaatctgcagttctcctataaaatctgccactattatgaccccactaagatagttacatgtacacctggtctgcattcaatggagtctgattcagtgacaaacggcatcatgatactccagaatgtggctgatccttgtcgtctgattcttggtggtgaacgtaaactaccagttgcttgggcaaagttagagcgggttttctggtttgctgattttgattctgatgaatccccacgcgtccgcccacgcgtccgcggacgcgtggggcatattgccatcaagaccttgtcagagacattgcctaatttgcaggttgtcttgatcatgaataacacaaaatttgttcacttgcaggctgaaagattggcgagggaatgcttctattttctgcgtgaatcatttatgttcgatgaagggactctgggatggttttcagacgccccaagttaccccaatgggatgcaagtatctgcaccagtcgcttacattttcaacatgcatcctcctgctggcattcagtttggcgactatcaaacagagctgcgcaaagccttacgcagagcctagttaggccgctaggtttctcagatgtgaatagctaggtcgaatcattatgcgtgctgtaatattttggtaaggtcagataagactacgagtgccatctcaagtgaacccacgctcgctaggaattcttattggtggggacggagtaggccctgctacagtgactactgttggtttcagctaactgctttaactttatttcgttaggttgagaactgaagcgtatcttttttgggggtgttaaacattaatatcttgagaaggtcagatgttggtttggaattgttttctgcattatgaaatttgaagtaatctactactacgatgcatggaaaag

SEQ ID NO: 33982 - DNA, 1014 bp, Triticum aestivum
  Clone ID: PAT_TA_33982
attccctgtcgacccagcgtccgctctgaatgtatcagtcgaatttttagatcaattttatattttatttgtactagcaagtgaattatcaaccgaattatatggtgatcagactgatccagatactaatgaaattcaaatggtggctgcaggataaaaggagcaaggatcaatgatcccatacaggttaatgatgatgaagaccaacactttgtatcactgattatttagagagccgcaaacgtgccagtgaaacccaaaggtccaactaggaatgcaaaaaatatatagactaagaggaccgttacacaagggtcatgcatacatacagtacagggaacacttggaactccaatgcaagtatccaagtgaatttgacatctctcccggtgagatctgtcttcttaagcgactggttcattcgccggtacctgccagtaaggtctatgtctgtaagatgaacaacacatgtagtacaggataaagaatgtacttctctgctccatacactaggatctttctcaagcttaacccaatcgttgagaacatgtgaatcataaccccatgtggatgtttacaggaacaactttgtttaatataaggttaagataaaagagtggctatcaacacaaactggacgcaattcgtcaaagcagccagaatcaagaaaaagggatgtattcgtctgtctttgaagagactcgggtcgtcagctgtcactcaccgtccataacctttcataaggtgagctcgctgattgccaagcgacggtgacggtgatttttcaacaggtcatatgacattgcgtcgatcactcaggaaaaagatcccatccagcacacatcaaggcatgccccatacgtcttatattgttgtgtacatagtttgttcctatgctttacataaaaagcattgtaaataagttatcatgtaatgcgatcttgcgttccttttggtatgctatcatgaaccaatgcatttttggcttccatcatgtaaacctatcaagcaaaa

SEQ ID NO: 33983 - DNA, 1013 bp, Triticum aestivum
  Clone ID: PAT_TA_33983
ctgacctgctgttttgggtgcggtatacacctgatcttctctcttatagctacagtaatgacttggaattctggggatcagcgagtacgatggggcattatacttacattcttggtctttgtcggtggtggaatttttcataaaatacaaagacaagcccttggctggatgggagtagcactaagtgtgctgtctcattctttccgtattggatcaacggtgtactacgccaagattaatcggtatctgtttgttgcctccatggtggggtcagtaaatggattcttgtggcttatccatcctcagctatgcatttcaaaggaatacaagaattatgtcaccatctccttgatggtaaccggtgaccccccaacttcgtggcgtattaagatgaattcgttggtgattaaagtggtgatttagattgaaacacacttatcaccaaatcttgtttcactggatcaatgtgcaagaaagagatatattcaagtgtaactagctcggtgctcgtggttgctacggaatcacaaataagctgagttagacacgtggcatggaagatcaatggaaaagcataagtgtagtatgaccgcttcatgggtacaatgaaaaaaaagagacaaggaggcagttccaggcagtgactaaaacaatcatgggtagggtttgaagatttaaatctacatgaaactaaaattttgagatgctgaaggataggcacatggaagaaatacgacgcaaggaaaacgattgggaaagaaggaaggtaggcccaacaagaatgaagagtgaggagtgaaatcacccccagttccagtctttataagtaggaaagacaattattgctaagaactcatttttatttttgtatatgatgatgtaatcattaaattagcttgaccttatgaatctgcttcatgtttacttacgtgttataataatcaggaatcaggaatttggagcaacaaacacaacgctatcttcccatgttgaggggaggtgcatatatgcat

SEQ ID NO: 33984 - DNA, 573 bp, Triticum aestivum
  unsure (1)..(573): unsure at all n locations
  Clone ID: PAT_TA_33984
cctggctcattgaacagagttgcggacgctgtcaagactggagtcaccaccgtcactgagagtctggaaagtgccgacaaaatgaccacgcttctggagaaggttgtggctgctccgacaagagtgcaggacctaaggaaaagctatgaagaaaacaaagcaattgtctctgcaatgaggaaaagctacgaggataacacggaagttggctcctccttcaagagtgttgttgcgggtgtcgtgaccagcagcctgttgcttgcaaggcaagctttgaaggatttggtacggggaggtggaggagatggtgatgccgagtgatacttgcgcaagttgtctggatccaccgatgtttcaaatgacggtgattgtccgctgtgagtggatacgaagttttgttgtatgttgctgttgcttttgaaacagatgtgcccttccagaattgtttcattgatcttacgatagttgcttgacgaattgatgtgtattccttgtttcacgctctaaaatgtatatacatgctcttttacttgataaccatttgggtganggnatccnaanattgtttaattt

SEQ ID NO: 33985 - DNA, 1241 bp, Triticum aestivum
  Clone ID: PAT_TA_33985
gtgtctttcggcaacacacacagagctgccacacgccatggaggagaccgaggctaagaaacccacccccgcatcccccctcttctccttctccaaccccagcgcctccttcgggttcgggttcggcgccgcgcccggccctccccatccgcctccgccgccagctgttgaggtcctcctctccgaggaatcacccgtcgcggccggcaacttggagcctgtggtggtcgacgactccctctcgatttacaaggggagagttaacacctctgatgttttcggggtaaaaaactctgatttggttccaggaaaatatgaaggtgggttgaagctgtgggaaggatcattggacttggtgaaaaccctaaattcagacatcaaagatgatcgattgcttatggaaggcaaacacgtactagagttaggatgtgggcatggcctccctggcatctatgcaggtttgaagggtgctggtctagttcacttccaagatttcaatgctgaggtccttagggtgccttaccatcccaaatgtaaaagctaatctgttgaaggaatcatctcaaggaacattcacatctaggagtgttggtttttatgctggtgattggagtgaaatcgacaagttacttctttgcggagatgctgtccaggataaaacaaccaatcttcgcacaggaaatgaagggtatagaggctatgatatcatcctgatggctgagactgtttatgcattggattcacttcctagtctctacaggctcgtcaagaagtgcttacactaccctagtggtgtagtttatatggcagggaaaaagcattactttggtgtaggtggcggcacaaggcaatttctacgcttggttagagaagatggtgcgatgcagtcggacctgcttgctgaagttactgacggatcatccaatgttagggaggtttggaaattctcattcaagtagactagcatggcctctgtggttgttgtatcagatacaagcgtgtactgggctccatagtggtagagtgtgagccttggtttagcggtatcatggtgttttaatgcactgttagtttcaagttgattgtccatgagctcttgagaagtcatacaagtacttgagtcctatctctgaattacgactcttaaaaccggtgtaccctttcctctgagatgtgaattctccatgatgcccgcttgtaccatctcacaactttgacaaaagcagcactttctattgccc

SEQ ID NO: 33986 - DNA, 1610 bp, Triticum aestivum
  unsure (1)..(1610): unsure at all n locations
  Clone ID: PAT_TA_33986
cattggtgtcataggaatctctttttgataatggaggaattggtaatggaatagcagaggtaaccattttatcaaagtggttaactctcacactagactttactttggacagttatattactgctctcaaatattcagctgttagtatgattgcgatttacgtactctgtttttctttgccaaatatgccagcaaacgtcgacgttttcccaaaagccttccgtagtcctctgtccgaggaaaaaattttcttgtgttacaacgaatgtcaagcaaaactccgtatcttataagtaaaaaatgatttcttcgaatgttaacaaaaacgtggttatttagattttttcttttctcggttcagtaccttcggttgaacaggtctcatcgtaataacggtttcttttcatatcaatgctatttatggaattatcaatggattgggaattgctagattttcgataggacacgatattaaatatctagggcgaggtcatttcgcgtcttattggttcttttttttattttatttatctgtgtatttatccttttttctttcttaagttaaggaatttacaacaagtctcttgcaaaaataactatcctatccctttctacaatctctctatatccttgttacataaggtaagtattgtataatagttcggttttccgcgattttttccattcctctgtgtaaatagcctaatatgggttcacaatcaataacatcctcaccatcgggagtaacgatcagtccaagaacaccatgcattgatgggtgttgagggcccatattgactatcatgagatcttttcttgtaagcggtagactcatatcctttcttccttaattcattattccatgaaaatggattattccatgaattcctcaaagcgaggctcatcaaaatgaaaaatctaagactactataagactactaaaaaaataataaaacaagaaaaaaatttgaacgattaaattactgctcccgaatattcaactgaccgattaatttcttataacgtactctatttttctttgccaaataagccagcaaacgtcgacgttttcccaaaagtcttcgtagacctctttccgatgaaaaatcttttttgtgtaattccaaatgtgaagcaagtctccgtatcttattggtgaaactgaatacttgaaattcaacagaacccctgttttcttctttttcttctttaaccataaatccaaaaatttttctacctcccttctttttcatgtatttttctgatcaggaaaaatacaaaattatgtcagttattttgaagttattctaatctcgtacacacacaaatttgcaattattcatctactactggaatttggatttattttatcgatgcaaattggatttggatagaagggtacatccttctaatatttaagatagaagaaacattccttctacctaaaatattagaaagaatttgctgattatttatgctatatgcaatttatggaattgatacaccatttaattgttatcattgagcaagatggatcaccgcggacgcggcccccgtctggcccnnagggtcnatagccgccaangcgcgtttaagtcgacggaancnng

SEQ ID NO: 33987 - DNA, 935 bp, Triticum aestivum
  unsure (1)..(935): unsure at all n locations
  Clone ID: PAT_TA_33987
ncacctctagtagtctaacgccagcgaacattttcctgctgccggttgcttcaatgaacgagcaatgaccaagcggtacgacccggagcaggtcacccatcccctcgatgtagcacaatcagccgcctctgttggtgtcgcaactgctgtcccgggacttgccataggctccttctacggaaccctcaaaacgacgactcccgtcctcttctccatcgcctcaggcgcacaatgcttcgccataggcaccaccttctggacagccaggaccgccattctcaaccaagacggcctgcaaaactggtggaacttcacccgtggcgtcccattgatccctcgtaatgaccagagcccctctctttccgataaggtccgcgcctcaaccattgccggcgcattcaccggcatcagtctaggtctacttctccggggtccgcgcaacgtcgtccctggcaccatcatgttcacccttttcggttggggcgggcaaaaaggctataatttcctcgacaaacgcaattcgcaggaactccgggagcaagcgcagctcaaagctttgggcgaggataggccgaaggagacgcttgtgcagaagtttgcgaaaagcaagtggagccccatgagtattttgacggatgagcaatatgaagagatgctgcaggaaaagttgctgaaggttgaggcggacattgcgatcattgacgagaggattgaggcggtaaagaagatggcgatcgaagaggaggggcagcgggcgttgagggagcaagagccccccccccaggagaaaaggtaattgtcattgatacctgtgaagttcttttactcatctgccggacacgtctctcaccttgttgatccaaatctcatgtcttcgggctaagtgcttctcattttataacattgaggttatcaacgaaaacaccaaacccagc

SEQ ID NO: 33988 - DNA, 621 bp, Triticum aestivum
  Clone ID: PAT_TA_33988
agccttggttgccaccacgccataatttgcaaactgagcaggatccacccccgccaagtctagtattgctggctgaattggcgtcctcgaggtcctgacctggagctagtatcactgccattgccacgtcgagcgaggatatttggctcatcatggcatgccaccaccatgatagtagacctgtttggtctcaatgggaagcacgggccatggcctgtagctagagtgctcaaaggtgggcaggggcggtctggtgcctgacccaatcctcgcgccgcaactgctcgtgggtgcatacaccgcaggagatgttggcctacatcctgcagagggggtagatgaaaagttccacgaacaaccctcacaagaaaagagagagccatggacaagctagcagaagactcagcaaggcaaaggtgttttggttccgggcactccttgacacatgttcatttttgccatcaaacttgattttgatttcatcctcgtttgatacgttgaatctctctttattggtactatatacacgttggatcttttgttaatttttatttccttccttgcattttctttttgttcatgagaatgagatggctaagatctggttggtgaatttctcac

SEQ ID NO: 33989 - DNA, 946 bp, Triticum aestivum
  Clone ID: PAT_TA_33989
ctgcctgactgagccaccttttgcatactcagtaataatgcaccacacaattgacttcctgcaagcccctataaatcttactatatttgggtgccttagggtagataacatcataacttcttggacaaactgctgttccaacgattgtgctctctcgatatcattttcaggcttctccagcagcttaatggcaacatcttctccaatgtaggtaccccggtacagcttcccaaaggctccctgtgcaaagggaacccccatatccaacctccccagatcaatggcccactgctggtacttgctaagtatctctgttggatgatttgggtccatcagaaccctggccaatgcatcttcatttagggtgtgcgcagccacacggttgggacgaaagacactgttgccaaccgaatagcttgcagttggggcatcacggaggcccgggtgcttaagtatgacggtgcgggactcgttcgagcccacactgctgttgtccacagacatggtaacggagccaccggcgaggttgtagttgtcagtgctgtcgacagacatgtgggagccctccggacgcgtgggcggacgcgtgggcggacgcgtgggccaattttctgatagtagggcatgctgaagaagccattgaactcgttctcttgcatccccttgccgccaccgccaaccatgccatgaaaccttgccccttcagccatgtcagaagaaccaaatgctacaattcgagctgctgcagattaactgtacatcctcaactaagaaatgccctcttccgtacacccaccagaccccggcaggaagcaggccgatcgggcaggcggcgaggggcgggatcgcggggctggaggggaggagaaggattccgaattggcgtgtggggcttgctgctcggcgctggctttgcttttctccggagaccggagcagagcggacg

SEQ ID NO: 33990 - DNA, 1452 bp, Triticum aestivum
  Clone ID: PAT_TA_33990
gtttgcaacagcgtcatctatcccacaaggctgccgcgtctgtcctcaaggaggatgcgttggctcgggttttgatggacccaactcatccaacggagatactcactaactacgaggcgtggaccattgatctggggaagctggacatgggggctccttttgctcagggggcctttgggaagctgtatcggggaacgtataatggggaagatgttgccattaagctgctggagaagcctgagaatgatctagagagagcacagttgatggaacagcagtttgtgcaagaagttatgatgctttccacgttgaggcacccaaatatagtaaggttcatcggggcatgcaggaagtcgattgtttggtgtatcattactgaatatgcaaaaggtggctctgtcaggcagttccttgcccgaaggcagaccaagtctgtgcccctgagattggcagtgaaacaggcgcttgatgttgccaggggaatggcatatgtgcatgctctgggatttatccacagggatctgaagtcggataatcttctaattgcagcagacagatccattaagattgctgactttggagttgctcgaattgaagtgaaaacagaggggatgacaccagagacaggaacctaccgctggatggcaccggaaatgatccagcacaggccttatgatcataaggtcgacgtgtatagctttgggattgtgctgtgggagctcatgaccggcatgctccccttcacaaacatgacagcagttcaggccgcttttgccgtggtaaacaagaacgcccgccctgcaatcccgcaagattgcctgcctgctctgagccacatcatgacgcgctgctgggatgcaaaccctgaagtccgcccgtcattcaacgaggtcgtcaccatgctcgaggctgccgagacggacgtcgttagcaacgtccgtaaggcacggttccgctgctgcatctccgagcccatgaccaccgactgagactagtgccaggatacagagtaccagaaaatgaaaaaatgggaagaagaacgaggatgggaaaggaggcgacacaatctcgatgtacagaccacactgatacacctgggcgttgcgtgtgcctgcctatccgaaggtctgatggctgccctgggctaagctaggttcttcattgctgctttctactatcttgtcttagttgcatgggttggagtgattgtttgccaagtatgaatgatggtaccttgtatgttttctgttttcttggaaggatgctatctggtatgttaacaaggagctatggtatgtattctccgcaagcaaagagctatcttgtcttgtgttgatagcagctgcatattctgagttgccttctagcttttgtgtaaatctgtgtccattgcctgaagcgtcggcctactgttggtctagatgttttgttgatttgagatttgagaattgt

SEQ ID NO: 33991 - DNA, 1829 bp, Triticum aestivum
  unsure (1)..(1829): unsure at all n locations
  Clone ID: PAT_TA_33991
gcggttcttctctctttctaccctccactcccgagtcccggttctaccatttcgagtcgtcggctcgcaggcaggcacagcacgccaatccgcccccggattccccgcgccgcgcagccgccgccaccccggccccacgtcccccggccgacgccccgcccccggccgtgggccggtgttattgcaggacaaccattaagttcgtcaagtcgtcgtgtctggctgtgttgcatccctgaaggatgtcttagccggcatgctcccccacaatgttaggccagcggtgctgccggcatctgccgtggcgaagaaaatcggttggcaagagcgccaccgattctaccaagcccctcattgccataatgtcggcggatgcttcgctccaggccctgaagtccccccgtcatccaacgaagctatgaactagctcgggggcgcggacacttaatctgtggacaatggccgtgaggcatccttccgctccggcatcttcgggcccacggaaaccggccgagactaatggcgaagatgatgccattaagctgctggagaagcctgagaatgatatagagagagcacagtcgatggaacagcggtttgtgcaagacgttatgatgctttccacgttgaggcacccaaatatagtaaggttcatcggggcatgcaggaagtcgattgtttggtgtatcattactgattatgcaaaaggtggctctctcgggttgtttctcgtgtgagagaagtccgagtctttgcccctggtatggtttgtgaaacacgcgcttgaagtcgcccgggtagggtcacatgggcatgccctaggattcaatcacaggaatctggagccagataaccttctaatttcagcagacaaatccatcaggattgcagactttggagttgctcgaatcgaggtaataagcatgcaaaaggtggcagagtcaggcagttcctggcaaaaaggcagaacaagtcggtacctttgaggctggctgtcaaacaagcattggatgtagcgaggggaatggcgtatgtgcatgctttgggatttatccacagggacctgaagtcggataatcttctaattgcagcagacagatccattaagattgctgactttggtgttgctcgaattgaagtgaaaacagaggggatgacaccagagacaggaacctaccgctggatggcaccggaaatgatccagcacaggccttatgatcataaagttgatgtctatagcttcgggatcgttttgtgggagcttataactggcatgcttcctttcacaaacatgacagctgttcaggcggcttttgctgttgtaaataagggtgctcgtccagcaatcccacatgactgcctgccttccctaacccacatcatgacgcgctgttgggatgcaaaccctgaagttcgcccaccattcaccgagatcgtctgcatgcttgagaacgccgagatggaggtcgtgagccatgtccgtaaagcacgcttccgctgctgcgttgctgaacccatgaccaccgactgaaactaaagcaggttagactatcgcagcgggcattagggaagaaaacaggtaaggatgaagaaaagaggcaatgccaatgtgttcatcgttgtcagtgcgtggggtctgtgtgcctttaccagtgcgcattctgtcttgtgtaagttgcacacctcaagtaaaagtaatttcgtatagatgttgccttgtatgctaacaaagacctaatggagcttttccgtgttaataatatccgcttgctcttgtactcgtgcaagtttgtgcttcaaaaaaggcccctannnnnnnnnnnnnnnnn

SEQ ID NO: 33992 - DNA, 1174 bp, Triticum aestivum
  Clone ID: PAT_TA_33992
ccgcgcgtccgcggccgcgtggcggcgagcaggctcccccaggtagaggtgttcaagaagacgactaggatgctccaggtacaactggacattttagataagaagctaggagatgagcttggcaaagcaaaaagggacatcacaaagcaatttgatgacaagggcacggacttagtggccaagtcacttgctgtgctgggcgacgtgggctttgtcgccaagtcacttgctgatctgagtctcacgcggttgatctctaagaaaggggtcaatgaggattctgactcggttgaagcgtaggcggggtttggatggctcccgcagtgagatagccgtggacgatgtgagagtatttgccaaagagatagtggagatggagatagcaaggcatgcagcaggtcgggctgggggtcaaagtggattaagcattctgggagctttccaagaaaggctaagagcatgctgcctcgtcgtagtgaaaggtcacaaaatgctgggggaccaagttttgggcagccacgagaatgttttgcactggaaggaagtgttggatttgtggaaatcaggctcaggaccggaattgttcctgaggcagtcactctagagcatgtcgacaagagtgtggcctacgaccgctccagcgctcccaaggatttccaggtcagcgggtggtaccaaggagcagacgacgattcagacaagcaaccacgcacgccgacaagcctaggagagttcacttacgacctcgagaagagcaacgcccagaccttccagctagacagaaccaccgccgacgcgtcggtggtcaacattgtccggctcgacttctcctcgaaccacgggcagcctgagctgacgtgcatctaccgcttcagggtgcacggcagcgagcctggctctctcggcaccgcggcatcgtgaggcctgatctagttagtacctgtgtgcctgggaccatacggtcttccctctttagctttgattgaagacttgaagcccctgcgagacagtaggttcaagttgattctaatctgtagcataatgctgccccttcgtgtacccgccgactggcgcttcttgttcctcgcgcggcgggctttgcgctttgctcgctaccgtggctgctctcggtacgctaaattattaattaggctgtgaaaaaaaaaaaaaaaaa

SEQ ID NO: 33993 - DNA, 705 bp, Triticum aestivum
  Clone ID: PAT_TA_33993
gccggccgtccgtgccggcgcacgaggtcatgcacgtattctacgtcgccctgctgtgcaccgaggagcacagcgtgcagcgcccgacgatgcgggaggtcgtgcagatcctgagcgagctcccaaagccagctgccaaccaagatggagaagaagagcttcctctctcctgcgaaggacctgaatccaaccctcctgccccaaccagttacaccgaggcaccagccggcgacgcgaaagatcagcagccgcagcagcggcacacaagctcggagtcgtcgcctcctcctgatctcatcagcatctgatcatccaagtacccggaagcatcgccgtccgtggcaaatatgttggggcttcgcttgcttatgcctgaatctaggggtctttgggtgtcagactttgtgggtgttgtgctgtacatatccaagctgctttgggggtggggcgtccaagagcttccagtttggtgtgtgtgtgtgtgtgtgtgtctgcgattggtcctttgctttgctgctcctagccgtagggattatgtggtagtggagcctttcatgatctttccttgtgcaatgtagtagcagtagtagcatcagtagtagccatctatctaaatgtcaagctcctctcctgtccccctccggtccggtccagcatgagaatctaaatctttgttgtggaaccaaaaaaaaaaaaaaaaaaaaa

SEQ ID NO: 33994 - DNA, 792 bp, Triticum aestivum
  Clone ID: PAT_TA_33994
ttttatagggggaaaaaggcctccaaggtccatgcataggtcagttttacttgtattgcttacaatcacattaaaagacgcggttacaacattcgatatacgagcagcctctagcaactcactgagacgctgacaaggtgaagatattaagggacaccaaacgtaaggtaaaaccctgagtatgagatggcagaatgcggggaaaagtacccccagaaggaaaatgccgtgttcaccaattttcattttggacaactgaagctgatgatgttcaagtgtgcaggcttggtaatcggcacaaacagtgctgataagaaatcattaatggacacgaaattgtaaacaagccctacccaaatggagtcatcgagtagagtcttgagagctgagagagcctgtgggttccaaattggctcacttctggtctgtgtagacagcatcaacatcatccaattcaagcaacttcaatacaaggtccttgttaagttccatggcctcgtcatccacctcaatcggattgagaggcagcagttcataaccattatccgtttcaaatttcagtccttcctcttgtagctttgatagcacaacaggatagttttcagatgtagtaactatcttgtaaaacctctctagaacctcttcagagtcatcttcatcatcaaaatttggttcaataacatcatcggcgccagcatccaaagcaacagagagtagttggtccttatcggcatctgtaacttttatgttaaccactcgagcttgtctgaatctgaatgtaacagatccagg

SEQ ID NO: 33995 - DNA, 3077 bp, Triticum aestivum
  Clone ID: PAT_TA_33995
gggccacgggtcccccataaaagccacgccttcgtgctcctcctctctcttcctcctcgccccccacccgctctcgtccctctcccccgtccttcgccgccgacgccgacgccgactgccgcacgggggccctccagcgcaatctccacgaaatggaggacccctgtctttctacgcagcttcaagatggagatggtgttttcaatgtttctggattggagagtttcatgaaggaagttaaattggccgaatgtgggctctcaaacgctgttgttggatcaatgggcccacagagaaagggaaaaagtacacttttgatgagccttttccgcaccaattttatggagatggatgctttcagaggaaggtcacagacaaccaaaggtatatggatggcgaaggcccagaatattgaaccatgcacccttgtaatggatttggaaggcactgatggaagagagaggggagaggatgacacggcctttgagaagcagagtgcattatttgctttggctgtttcggatattgtgttgatcaatatgtggtgccatgatattggcagagaacaggctgcgaacaagcctcttttgaagactgttttccaggtcatgatgagattatttagtcctcgcaaaacaacaatgctatttgttattcgtgacaaatcaaagacacctttggaaaatcttgaaccgattttaagagaagatattcagaagatatgggatggtgttcctaaaccccatgcccataaagatactccactcagtgaatttttcaatgtgcaagtggtggcccttaacagttatgaggaaaaggaagagttatttagagagcaggtttccaacttgagagataggtttcaacagtctattgctcctggtggacttgctggagatcggcgtggtgttgttccagcatcaggtttttcatttagctcacagcaattttggaaggtcatcaaggagaacaaagaccttgacctacctgctcataaagttatggtggctactgtgcgttgtgaagaaattggttatgagaaagttgccacttttacagctgatgaggaatggcaacaatttgaggaggctgttcaaagtgactatgtaccaggtttcgggaagaaaatcagcagcctgcttgatagatgtttatcagaatacgacatggaggctatttattttgatgaaggtgtcagaacatcaaaaagacatcaacttgagtctaaactcttgcagcttgtcaatcctgcgtaccaatctcttcttggtcatttacggactagaactttagaagcattcaaagagtcctttgataaggccgttgaaaaggagggatttgctgttgctgctcgcgattctacccagattttcttggagaagtttgataaaggatctgaagatgctaccattcaacaagtgaactgggatccctcgaaagttaaggataagcttaagcgtgacattgaggctcatgtggtgtcagttcgtgctacaaagctttctgaactttgtgccacatatgagggcaaacttaccaaagctcttgcagaacctgttgaagctcttctagattcagccagtgaagacacctggccagctattagaaagcttcttcagcgtgagacaaaagccgccgtttcaggtcttgaatctgctatttcaacttttgagcttgatgaagctactgagaaagaattgctcttgaggctggagaatcacggaaggagcgttgttgaatcaaaggcaagagaagaagctgcaaggatcttgatccgcatgaaggacaggttctcgacgttattcagtcgtgatgccgactcgatgccaagagtatggacaggaaaggaagacatcaaagcaattactaaaactgctcgttcagcttccatgaagttgctttctacgatggctgcaattcggttggaagaagatggtgacaacattgataccactctttcccttgctctagtagatgctgcgaggccagggactacagatagaagtattcaatcgcttgatccactcgcctccagttcatgggaaagggttccagaggagagaactttaatctcccctgtccagtgcaagtctctgtggaggcaatttaaagctgaaactgagtataccgtcactcaagccatagctgctcaggaagcaaacaagaggaacaacaactggctgcctcctccatgggcgctcgctgcgatggctgtccttggtttcaatgagttcatgacattactgaggaacccattttacctggccgtcatgtttgtagttttcctagtcgggaaagccatgtgggtacaactagacattgccaatgaattccgaaatggatttcttccagctctcctttcgctgtcgacaaaatttgttccgacaattatgaacattctgaagagactagctgatgagggggcagcgcccgcagccccagagaggcagagagagacggagctccaaccaaggaataatagttcaaacagcaacgtgacatcagcaggttcctccagcttaacctcttcagagaatggacctgaatattcaagcccggtagcacaatgatgagtggatccctagcttttagctgaaagctctactagctgtagctgcaacggtttgagcctaggagattgaagtgccttgcggtttttgtacgctcgcttgcccttcccaacctgatgtatgaaaattatgtggaagagtccacagctgttatataaggaattttggggctgggaatcgtttgtaagaaacattgtagaacaacttccgtttcacttttatttttgtaatatcttatatgatggttgtatagaagatttgtgattatttttgttatatccacccaacccatgaggacaggaaaaacaaagtggcccatttctacacactatggtatatggttgtttgcatagattgcaatttgtgcgcatccatttgtagatgtttttgaactctggatattcgcgtttctgtgatattttatgttaataccgatcagtagctacagcttgaatgtacattttgcatgattaatatatgtgcttcacgtgaaaaaaaaaaaaaaaa

SEQ ID NO: 33996 - DNA, 666 bp, Triticum aestivum
  Clone ID: PAT_TA_33996
ttttttttttttgccccctttttgcctcacaaataaatcattaataatccaagataagaggctttacaaatgaatagccctaaaaagagaacctaagtgggtagcttttttcatctctccaaaattccccacctttcttcaccaaagcgaaaaaggcaggctacatcttccttccttccttcctgtacaattaattccttacttttttttgtttttgcacaaatgcttcttgccatctgtatgggacctaacctggcataataatcgatcaaaacggaatcaactactcatcaagctacaacaatctatcaagatccacagagacgacaactttcagttgtgctgaaggactctatacacttcatcccccagggccgccaacgtgacgggcttctggagcagaccgtttatccctgaccgctggcaccggtcccggacgttgtcgtccgagctcgccgcgagggccacgatcagtggcggccagctgttgctcctgaacttgcggatcgcgagggccacctcgaacccgtccatcgtgtgcatcgtcaggtccagaagcaccagctggaaggacgactcgccgcctgcaaaggaggtcatgcactggatgcccgagctgaccgaaaagactcggcacccgagcttctccaggagcttgtgggtgac

SEQ ID NO: 33997 - DNA, 551 bp, Triticum aestivum
  Clone ID: PAT_TA_33997
atcgcggggtcgacagcagtcattaatgccgaagggcaggtctgtgagctggctgctagtgtgggctccgggaaggagagctccccgccggaattggagctgtctgcggggaaactcaatccgcaagcaccatggttggcaatgaggattcgcattggatcagcgagtccatttagaggcagcgtggtcaagttagccggactgtgggcgcccgcaataataaaagagattgggagaccatgcagacctgctcactgcaagaaccacggtgtacagggtcactcgagattttttttgtacaagccgggtgaaatgagactgggttcaggggcttgagtcggcgttcatgccaaatggttagacagttgggttcgaattccctccagttgtgcatcacaaagagtttttagttatgtcaacgtgcgtgtgttatttctgctgtaatgatcctctatttcctttttggacaaagaattggctcaatgggactgatttggtacgtgaattttagactgaacgacaattgatgtgcaaaaaaaaaaaaaaaaaaa

SEQ ID NO: 33998 - DNA, 429 bp, Triticum aestivum
  Clone ID: PAT_TA_33998
ccacctcatttcacacactataggcttcttttccagcagcactgtctcatagaaatcttgctgttcctttgtgtggaacctgtaatcaacaacagttcttcttcttgtagcatatgggtctatctctctccatttccttagtccagagtccctcctgatctgcatgttctcagccacaggatgagcatcattgtggtctggaatcttgggtttgagcttcctcaggacttgtccttcatcatcttcatcagtagcaacttcaggcactggggcattgttcttctcagcagctggtatactcctggtattcctcttaggtgcactcttgggcttggaggctgctttgggtgcttctttgggctttgatgaagcagcccctgtcctgatagcatcacccataagcttctatgccttgggtgctggtgcaac

SEQ ID NO: 33999 - DNA, 998 bp, Triticum aestivum
  Clone ID: PAT_TA_33999
ctcgtgccgaattcggcacctcttcgtctcgcagtaagctcctagcgcgcgaccatggcggcggcaggtaccctagtcgtgtacagggcggtgttcgccgcgcttggctgcctcatggtgggcaccctggtgtacacctgcatcaccgacggctcgccgtttcgcaccgagctgctgaccccgtggatggtgacaacactggttgatctttatgtaaatatagcagcgatttcgacttgggttgtctacaaggaaggaaattggattacttctatcttctgggtagtattgttgatttgtttcggcagtgccactacatgtgcttatattgttagcaagttatttgagataacatcttcagggctttcccaaaatccgcttgatcttttgttgctcaggcaaaataatctacctgaaaggaagtgttcttttgtcgtcatcggtagaactattttcagcattctgggcatactcatggctgcacttgtcacgtatactgtcattacagatggactgcctttcaggaaggatttgttgacaccgtggatggctgcaaccttaattgacttctatataaatgtttttgcaatatcggtatgggttgttcacagggagtcgacttggatctcagcagtcatttggatatgcttgttgatatgcttcggaagcatcacaacatgtggctacattgtggttcaacttctccaagtgtcataccaagacccagtctaccatctgctactgaactcccatagcaagtatggaatcgcacccttgcagtaatcgccgatcctcttctactatcctggttagcttacagttggtgtaaattctgctcgacatgcaatcattcatgtggcatttacctgattgaaatgtaggaagacctgaaaactcattgaagggatatgttcttggtacacaataatgtcccctctgttcataaaggtgccacaataaagggtataccagagtagcaattagagaagttttttctt

SEQ ID NO: 34000 - DNA, 1139 bp, Triticum aestivum
  Clone ID: PAT_TA_34000
gcgagtctggatctggcaagcgcagaagccaaccgatctggcaagcgcagaagccaaccatctcacgattctgggcgatgtcgtgggctcgagtcgtgatcatgaagaaccgggtcttagcgctgatggccgaggaggatctacgccggcagctgaaagttttcatccacggcggctctctcggatctgtgtctttcggtggcggcggctgttgtaaaggctcatccagtgccgccgcagccgcccacctaccaaacggtgacaccgcgctgcaggatttcaagtccgctgtcttgcggctggctgaggcgaatcagcgccggctgctgccgaggtcaatccatggcggccgaccttttcctgtccgatctatgtattccgatagcgctgcatggtacggtggcgccgctgctgccagcccaccaaacggcagcaccaccttgcagcaaacgtgcgccaaacctgcgccagcggtcgactctgagagagaatgggcctatcgtcaaataacggagatcgagaccacgaaacaccacctcttttacctgctcgcagaaatggacaagagatacccgggccgtagatacacgtcaaataacaaggagctgatccaccatcttttcaaacacgtcgaggctaaccccagcgatcccctctggcgccacactctcggaagagaaagactcaataattgtgtgatatatggaatgccaacgctgatggccacttggttgtatttggactgggagggttggaaaaatatgttcgctttcttacttggaattgggcactagttttctagctcaatctcttgagtctagatgatgctttcgacgggacgggagtaaagttacgtggccaacttcttgttttcaaaaggtttccaaataaaagttcagtgtcatgacgttgggaagaaaaaaaaaagtttgctcttatgaatgctatgacaatagtattgtaatttgtaagcagaatgtttcactgtatggtgaagtttgtttgatgttgtaagctcggttcttttctactctatcacaagtttctcaggtgttcagttattaaaaaaacaagtttgtttaatttgtaaaaaaaaaaaaaaaaaaaaactcgaggggggggcccggtacccaattcgc

SEQ ID NO: 34001 - DNA, 954 bp, Triticum aestivum
  Clone ID: PAT_TA_34001
gctcatacttgggaagcacaatttgtctgcacccatgacttcttattcccgaccagaggttatggtgaaatcccagtcatacttttttactcattcggtgaaggcaatggcagttacacaaacagccaagggtatcacttccaagcagcttctcattggcacgattggtgatcaggttttggcacttgacaagcgctttcttgacccacgccgttcattgaatcctacacaacaagagaaagaagagggtattataccgttaacagattctttgcctattattccacagtcctatgtgacgcactctcttcaagtggaagcactgcgaggaattgtttctattccggcaaagttggagtccactactcttgttttcacttatggtgtggatctcttctacactcggcttgcaccatcaagaacctatgattcactcacggatgaattcagttatgctcttcttctaattactattgtcgcattggttgctgctctcttcgttacttggattttgtctgagaagaaggaattaagagacaagtggaggtaattgaggcctctatgttgtgatgcaaatgaaatttttggccctagtcgacatccttatcttcgactttgttagtgccagggttcgtttcacttttgactaggctattatttatgtaacatttgaaagtgaaacctgtttcctgggatgacactgcataaggtacttgtgcaattagaaatcctggacatgacatcaaagaactggcagatcacgcatgactcataatacgttgtaaaatcgccccccagcgaccaaactttccatcagaatgttagcagtgctttgtaactttttctgagtagaaataacatttctctcctccaatcttgacattatttctgtcgttgatatgtgattctcacgattatggtttgttttggggaaaaaaaaaaaaaaagacagcc

SEQ ID NO: 34002 - DNA, 1622 bp, Triticum aestivum
  unsure (1)..(1622): unsure at all n locations
  Clone ID: PAT_TA_34002
ccgctctgttgctcctggtgtcctctgtgttcttgattcttattccggagaggaactcaactctctgagctttgaccattctgttgcccaaattatcccattgacactgaaggattcatctgaacagcgtcttcatcttattgttgattccaactccaacgctctccttgatccgagttctccggttgcccttaattcatttattactgaaatgtcaaatcagtatttctattctgtagatattcagaaaaatgctatcagagggtattcatttacagaaatcatgtgacttcaattcggatgacacatactgctttagcacaaagttgttatggtctatcattttcccttccgatgcagaaaggatttctgtctcagaagcacgaaagatgaatgaggttgttcatactcaagcaaagatcatagcagatcaagatgtgatgtataagtatttatcaaagaacttaatttttgttgctacggtgtctcctaaagctgctggtgaaattggatccgcggcacctgaagaagcttcactaatggcatatctcattgatgctgtcagcgtacgcctactacaacgtgtggcccaactcggtgcacaagtccctgaccatgctgttgctagcgagaattgcacttttgtatcattatttcttcctgtgagctctcagatttgaaattgcagcgtttgatgacaatgcgtaatgtacgtgggctattagaaatgctgcaaatgacatcattggactggcagatcacgctggactcctaatttgttattccctggattagtttcactttagattccactataatttttgtaacattttagagtcgaaacctggttcttaggatgacactgcataatgtacttgtgaaacaacaaatccttggcatgaacggcgaagaactggtggcacttgacaagcgctttcttgacccacgccgttcattgaatcctacccaacaagagaaagaagagggtattataccgttaacagattctttgcctattattccacagtcctatgtgacacactctcttcaagtggaagcactgcgaggaattgtttctattccggcaaagttggagtccactactcttgttttcacttatggtgtggatctcttctacactcggcttgcaccatcaagaacctatgattcactcacggatgaattcagttatgctcttcttctaattactattgtcgcgttggttgctgctcttttcgttacttggatttggtctgagaagaaggaattaagagacaagtggaggtaactgaggcctcaatgttgtgatgcaaatgaaattcggccctagtcgacacccttatcttcgactttgttagtgctagggttcgtttcacttttgactatgctactatttatgtaacatttgaaagtgaaacctgtttcttgggatgacactgcataaggtacttgtgcaattagaaatcctggacatgacatcacagaactggcagatcacgcatgactcctaatacgttgtaaaatgtaccacagcgaccaaactttccagcagaatgttagcagtgcttggtaacttattgaagttctcatgttcaacttgcaccctttcnagtagaaataac

SEQ ID NO: 34003 - DNA, 1104 bp, Triticum aestivum
  Clone ID: PAT_TA_34003
ccaacttagcattacaaacacacgccacttgacttgactccacataagaaatgacacggcagatagttgcattagtaactactagcacaatctaataagtactggacgacgagccagccaacagcaattaaaagtagctaggaattgtcacacaggacacaacaaacaggttcgtacaacacattattttagtagacacatcgactagtagcagcagcaaagtagtgtatgtatgctagctgaatggcatggacggacggacggacggatcgatcgacgccataatccgtcgaccgattggatcgagtccaaccagcagccggtggtcacttcttgggcggtccgtacttggggcaggcggggctgaagtgcttggagagcaccctggagttgagcagctcgatgatggggccgaaggagacgcaccgtggcgccttgtactggttgatggaggcgccccgggagatggcgtagtccatcacctcctcgaaggtgccaccccgcaccaccctgatctccagcggcccgatggcgtcgccgttccgcccctgccggtataccgagttgagcgcctcctccatctccaggcagcaccgctcgaacaccgccgcctccggccacagcccctcgcggcagtccttgagcatcagctcccagtacaccacgtagtgccccgggatggtcgtcgcgtccgcctcgctcgtgtactccacgatgctggccccgtagggcgccagcagcctcgccgcgcgctccaccgccgcctgcagctccgcctcgtccgtcttgtccgagtcgatgctgaggagcacgttcttgcgccgcacgaacctgaactgcggcgccgcgttgtccgtcccggccggctccaggctgtcccccacgcgcttccgccgcacccccccgtacggcggcgccgcctgctcgtaccccgtcccctcctccgcgtcccccacgccctcccggcgcggccccgcgtccgccgtggtcaccgccgcgcgcgccttccccacctccgcgtcggccaggtccacgagccgcggcggcgggtcgtccctggacaccgcccggacgcgtgggtcgaccggaaaatccggaccggta

SEQ ID NO: 34004 - DNA, 373 bp, Triticum aestivum
  Clone ID: PAT_TA_34004
gggtcgaaaaatgggggacatactataccgctggtgtgcggaaggagaaaaagaccagctcggaaagccaggcgcgagaggttcaagaactcaaggcacaggtggcgcggattccggagattgtccaagagtaagtggaacaacgactcggagcgacgatcaccgcccttgtgcctaccttgatctcggggttgagtgcgtggattgcgggcggccaacaggggccgcccccgattcctagcttcacggctagcaactcgcataatgcgatggcggggccattggtgcctccggcggaggcggcattggtgtctccgacgccggcacgggagcttaatgcacccgggtgtacgccggccggcacctcttcagc

SEQ ID NO: 34005 - DNA, 1044 bp, Triticum aestivum
  Clone ID: PAT_TA_34005
aaaacacaatgcattgttcacggcttaacgtccatgggcataaaagcaagtaacaatgtcagaaaacatcatacatttaatttgaggaatgaaataccaagttctaggggcatcaatttttcaaaccaattaactaaacaaatcataataaccctgttgaaggaagtgtgttgaaataaatcatcaaatgccccctgaccgtctccatcaaaaggtatattacatttggacaccgctcatgcttactcggaatcaaatgggcacaatgctccaaactttatttgccgatctttttatcaacactcatgatgatcacttgacaattaggggggaccttctcagtagtctttttgactgcagccattgctgccgcagcacccacattatgctgcgaaaattcgatgatcatatgcttcaggcctgacaggtgctcaacgccagacacaccactcgactcctttgaaaggccttcttcaaactttagctcaagcacttcaaccttcgataaagcgtcggtcacaaaggtcacagatggcaagctgcaccttatcgaaagcttcttaagactctgaaatccatcactcggaaatgcgacttgtttcttgtcctcagacgcccgaggaacattacaaaataattccagttcccgcaagcttgccatattactgagctcttgaatgatatccgcatcagcactcttcccgatattgctgcatgaaagtgtcagcagtgacttcatcttggttatcccactcggcaacttggcgttcccggcgagcaaatgcattaacttttccagcctgagaatgctcggaggtagctctttcacctttgtggatctcacgtccagtgtctccaggcatcttagctctccgatctgtgcagggaggttgctgacatctgttcccttgaggttcaagtacctcagaagcagcaatttgtagagaccatcaaggcacagtggaccttgacagccttcaaggtcaagaacccgcagtacactgagttcattcagacgaggcgtgcgaccgcctcgtgccgaat

SEQ ID NO: 34006 - DNA, 1735 bp, Triticum aestivum
  Clone ID: PAT_TA_34006
ggttgggtgattgagttggagggtttggttgaccagcttgaggagttgatgttgctaatccccagcagggattgcccaaagtcaggtgagttggctgatgaacttcaggaagaaggtgcagctgttggagttccaattggaggaagccgaccagtcactcattttgaaaggcaagtctttggattcagtgatggaagaattagatgaaacaagcactttgcttaaagacaaagaatctgaagctgctgtacttcatgacaacgtcggatccttggaggatgaggtgaccaggctcaaggaagaaattgacgtgacaagtgaacgtcttgatgctgcagagaaagatgcagccgacctaattgcagagatcgaagagctaaggttgaagctacaggcagtagaagatgagaaagcagaggcgctgaacaatgaccagcttgcaagttcagaaatcgcggccctgactgaacaaaagaacgagctagccaaggagctagaagctagcaaagatgaagtcgagaaggttaagaaggcaatggagggtctggcctctgccttgcacgagatgtcagctgaatccgctgaggccctggcggaggaccgcctctcccaggagctgatcgagcacgctcgggcacaagtagaggaactcaacaatagtctgcacgaatgccaaggagagctagtgaggtgatgctcgatgaagtaaactacgagaaagtttgcctcaagaagtccgttgagagaatgggggcagaagctaagaacgtgtctgaggaatggcagtcgaaagagctaagttttgtcaactccattaggaagtcggaagaagagatcgtcactatcaaagctcaaatggacaagtacttggccgtggtgaatgaaaaagaagctgaaaataccgagctgttggagaagatgaatcatctcgaggctcagctagttgaagccaacaaggctagcgaggaagccaaggccgagacccgtcaactgaaggacaaactattagacaaagagaacgaattacagaacatacaagaggagaatgaggacttgcaggcaaaggaatcagctgcttcggagaagataaaagagctctcttatctagtgccgaatggaacgacaaatggtggcaacaaggaagaagataacgagaatggtggcggtgtggatgacgaaccggtcgtggtggttgccaagatgtgggagaacagcaaggtcaccgactacgactcgtccaaggagaaggagaacgacggcgagtccgaagtcgatctggagtccaacaagggagactccgccctcgacagcaacgggttgcagtccgcaaagatgaacaacggcatcacgtcgccaaccaaacagcagcagcaaaagaagaagaaatttaaatttagcggcttactgaagaaaaagagctcaaattagcacaagaccaccgtcttatgttgttcctttgttgtatgctatgtgacatctcctttctttgactagccacccacccatgcctctagttttctgagtctgtcatcatggtaaagcaagtgttgggtgtttcagagaatacaaaagagccggccgattgtatttacagccatgcgtttgttccttgcatttgtgtaagttcagtgatgacgattcatgctgtagtcatagtgattgtatttattcatacatatccccggggtgttgtcgtggtccgtggtccagggatttcctttttaaaaaaaaaaaa

SEQ ID NO: 34007 - DNA, 651 bp, Triticum aestivum
  Clone ID: PAT_TA_34007
acttgcatcgccaaaggatgccacctcggttcgtccagagcgaaaacctcggtccaagtcactgaatgagaatctagccgtcgacgacgggggatttgatgacctcagctccccgaagaccaaggagattatatgctcagaaataaggccaccacatgaaagaaaattttcggccgacgggggaggtgacgattcagaatcgtgttattctcacccaacaccggtggctccacccgccaagccttccgttgtgagcggaagctgcaagaaagaagccgccgccaaggccgtatcactagccgttgtcccaagcaagcagaaggggaaccccaacttgctcaagaggatcctgacaggaaggaggagggatgccataatcaaaccaaaggtggtcctgagtgcttagctgacagagaccaagggtaactctatccatgataaattccatttccatgtgtaaattaagcgtgtatcagttacctgttgagctgtgtttcttgtcaggtttaggaagaaccatggagtgtggatgccgtgtatgtattacaagtattagtgtgctttgtagcgttgtggccagcattaccctgttccttaggtgtatgaacttgtgtttgctcttggatgtggctaatttgtgagtagcatgct

SEQ ID NO: 34008 - DNA, 576 bp, Triticum aestivum
  Clone ID: PAT_TA_34008
ttgttctgtatgagtaaatatgttaacctagtatccatgattcaacccattatgattaaacatgtttgcaatgacgattagagattatagtttctcatgccatgcataagtagctaggagtgaataatgatttatcttagatatcaacattgcgttaaaatgattgtgatgtagtatgatgatatgctatcctcctctgaatgtttgagtggcttgacttggcacatgttcacgcatgtagttgaatcaaaaccaacatagcctctatgatatttatgttcatggtgttcatatcctacttatgctagtacccaatgttagttatgcataatgcatgttcatgaccattttccctctctagctggccgcttctcagtctaattgctagccttggcttgtacaaagtgggatttctgcttgtgcatcaaaaccctgaaacccaagttattccagatgagtccaccatacctacctatatgcggtattaccccgccgtcctaagtaaatttgcatgtgccacctctaaaaacttcaaataaatatcctttttgtgcgcctagattgttcatagagcga

SEQ ID NO: 34009 - DNA, 701 bp, Triticum aestivum
  Clone ID: PAT_TA_34009
caaactgacatatgattgatagtttgtttggatatatatagtacatataaatgcaacaacataaatataatacatcattcacaggaatgagaacccagatactatatagcgagttagccacctactagtactactacatacctaatcctccttcattctctttctttctacaaccaagaataataataatcgcgctacgaccgcatccaaatgaatgaatagctacaatggaggaaataaagcaacacgagccatctactcactccaccctaccctacttgaagaagatgcccttcttccttcctttgctcttctcgacggccttcattctgaagagccgcagtatgagcacgatgctatcccgtgacggggagttctctccaggcttgagattatactcggcaccatccgcagactggatcgagaactcggttggatgtccatacgggatattgatcgccgtagcttgctggaatttctctgtgataacaacgccccgctgtccattacacttgatgctgtaaccttccctctttattgccaataccgcaggttcccacatatctataaatctaacaggtctgtcgttcttcttctggcacccgtccagcggtatgaattctctccacgacctccgtctctgctgctcctctcgtaatcgttttctgctctgtagcgtaaaccttcacgatctccccctt

SEQ ID NO: 34010 - DNA, 923 bp, Triticum aestivum
  Clone ID: PAT_TA_34010
cgggtcgaccgcttggtaaacccgagcaaagatatgaccgtgcctgagttgtgcatcgtggaggagatcaatgctgaattcaaggagtctgttcttgctcgggttggtctgaagggtacaatcattttgcggacgttaccaccaaagaaggcagcagggagggagacagagttctcattccggcttgagggtgcttctggaatgaagagggccgccttgcagagtaccgtgttgagcagcctcgagaacggcctgttccatgtgaagacaccatcgaaggaggagcctatccccatcatgaaatacagcttcctgcccaagcactcacctctccccctgaggttgcgccttgtaaagcgccacagtggcacattgctctcactgatgatacactatgcgtcgaacccgatgttgccacagccactgagcaatgttacattcattgttaagcttcctgtggatccaactctgcttaatgtttcgcccaaggctgtgttgaaccgggcagagagggagctcaggtggcacatctcagacattcctctgaaaggtcctgctggccggttgagagcacggatgcctgtagatcaagactccaaagatggtgaactagaggttgttggaatggtcaagtttgcttaccaagggccattcactttgtctggcatcaaactctgcccagccatcaatagcactgcccaatttaatgaagttggccacactttctccagcgggagctaccgttgcatctgagttggtaccttctttgtactgtagctgtttactttaccccttattcagtttgcttctacaacagggtgtgaatttcatatttgtacgtatatgttttgtgaggctggaattaaaaccatgtttttgggttgtgacttccaacgtacccagctctgctaccgaaaaaaaaa

SEQ ID NO: 34011 - DNA, 209 bp, Triticum aestivum
  Clone ID: PAT_TA_34011
gtcttgcactcctgcagtcagaacgctcaatctgaagatgagcctgaccgttcttggactatttgttgctgcctaggcactaagttgtttttgtatgatacgcatggtggcgcgattgttctccttcagtgctttcacgtatgatacgcatgtacatttgctgcctaggcactaagttgtttttgtaaacggctcttcatttttctttt

SEQ ID NO: 34012 - DNA, 813 bp, Triticum aestivum
  unsure (1)..(813): unsure at all n locations
  Clone ID: PAT_TA_34012
gcaggatggtcccatcttcctacctctttgtttcagttcaaccttctgaccacaggcattcctaccccacagtagtaggcactcgtgatatcttcttgctgcattccctattctactgcagagattgacgctatactttgtatgatgagataaacctttcaagagttttatggttaatatagtcgctttgtgatcatctctattctgcaatctggatgttctaccaataacatggtttgctcctttgttcttgcatttgcaggtatacaattcattataggcattcttttatattttacccaaatcaacataatctcacacaacactgacgtccgaacgacctctccccacgcgtccgcccacgcgtccgcgtacacgttgcattccgggcattcttttatattatccccataccaatatgagctcacacaacattgatggctgacagccttctctgcccttggattaggatcccacatatgactgatgggtgaagattttctttttgctaatcttgaatcgagctaatttttatcattgcagaatttcagtcacttataggaagacacttcaacttatccaccagagttaatcagaagtacttgcgttgcacaatacaacaaatcatttcgtgtcattccagaataaattgtatgtaatacatattttgctcgccccttttatcgtgtgtaattctgcacatgtttgtatctcgagcacatgatttttgttatacaaatatgtcactgcattttggggggggggcccngtacccaattcgccctaatagtggancccttattacccgcgcca

SEQ ID NO: 34013 - DNA, 1423 bp, Triticum aestivum
  unsure (1)..(1423): unsure at all n locations
  Clone ID: PAT_TA_34013
tcgacccacgcgtccgcgaagaaaatctccaagcgaatggcccccgcgccgtccgctcgggcggctcgggcggcgactagggttcctccgcgccgccacccccacccctccccctacctccctcgtcgccacccgaggaggtcgccgggcaagcccgcgtggccgccggtgacggtggcggcggggatctcgccgctccgtttttctcgcggagggctgcggtcgtcggggcggcggccccaggtggcgaggcgtcggcgttcggctggcggcctccgttggtgctggtggccaggttcctcggccgtccgggcggtgaggccctggtggttggtggtcgcggcgggaggccttcttctcgtcagatctgaaggtatgactcctccacctctctggctcactcctcctccccacccatggtgtccggcggccttggctgcctgcacgctggctggtgaggggctggtggctcaggtctgggtccgggggaaaccctaggccggctggtccggcctcggcggcggcgacgcccaagggcgccgctttccttcctggaggcgccgttgaggaccctccttgcccaccccctaccttgctcccaagcgaaagctcaaaatcctctccggattgngcggcggcggcgccgggcgcgtcgtgctctccatggagacgccgcctgnggatgctgcaggtttgggtgagtgttgccttggtgtggaggcgtctggcagctggtttgtcctctctacagcggctagcgattgcagatccggcgtcccctctggtggtttctctccggcggggctggcagccgtgttgttgagtacccggttcttctctgcggcgactgattttgctctcgagatcgctgctgtggcttggctcggggctgtttcatcctcttcgattgccccaagtggctttccctctttgctgggtgtccgcgggcggcggcgtggtagctggcgtggtgtgcttttggcttcgtgcaggtcaggcgacgtgttctccacgagtggccgtgaagccggctcctactctagctctcgggtgagcgtctctcctgccaacggtgcggcgtcctcgagccaggacgagagggcaggggccctcttcggcatctgaggaggtaggagctgtcccttctccgccagatgttacagacactatcttggtcctgcccttagcagccggctgatccttggctatctactctgtctagctgtcctggcccttagtgtagtgggcagcgacattagcaagctctgctccattttctgattatttgtgcttgttagtgtgtgttgcgttgtaagctgctccatcagtcccttgtatctttttcttctttgttagcctctttggttctctgtaatgcctggccggttgatggctttgttaattcaaagctggactcttcttg

SEQ ID NO: 34014 - DNA, 470 bp, Triticum aestivum
  Clone ID: PAT_TA_34014
acgcctgcccgtaccggttcgagagcccgggtccacgagttggttgatttatacaatgctagttgcacttcacgtaaatcttttgagtacgggtttatgcaatgcttcatgtgcgtcacttatgtcatttgacgtttggattgcctgtttctcttcactgtattcagccgccatgttgtagtaatactctttttcgtcactgaaacgtgtgatatattgggcacatcatttgtagattgacataaactcacatgcatgacatgtatcgatttagacagattacaggaagtggtcactcacatggctagtcattagatccaacacattactggtaatcgctcatgatcagatgtccgactcaatgcaataattttgcgatatgtaagcggtgaaattatcctcatgcaagacgagtaattgtgacatgtttacctacctgtgttgacgtttgtgattcccgtaacatgcac

SEQ ID NO: 34015 - DNA, 1110 bp, Triticum aestivum
  Clone ID: PAT_TA_34015
ggcgcgcatcgtggacaacccgtcgatccaggtccggctccacgaggagatcacgcagcaagtcggccccgcccgggcaatcgacgacaaggacatcgagagcatgccctacctccaggccttcgtcaaggagctcctccggaagcacccgcccacctacttttcgctcacccacgccgccgtcaagcctgggagcaagctcgccggctacggcgtgtccacggacgcgaagctggacatcttcctcccgaccatctcggaggaccccaagctgtgggaccggccgacggagttcgacccggataggttcctaaccggcggcgagaccgcggacatgacagggtccgcgggcatccggatgataccgttcggggcggggcggcggatctgcccgggcttggccatggggacgacgcacatcgcgctcatggtggcgcggatgctgcaggagttcgagtggcgcgcgcacccgtcgcagccggcggtcgacttcaaggataaggtggagttcacggtggtgatgaaccagcctctgctggccaccgtcaagccccggaagatgtcgctctgatgcatgtgcatgcatgtggatcggggtgcccggcagtcgtacgtccaatgcatgcatcgcaaccaccccggccgttagatcagcacgtaacccacccatgtgccaccaccgtacctactgttaccgattccagcattatgagaaagtatcctagtgtgctatacatagcttctctagtcgtttatctatgtccacgggatacacacctgtattatgtgtgcgaagtagcacagtcacatatgcatcaagcgagtttgtatcaggtggaaggcagtcatacgtactcgatcgtacctacgtcgaatgcatgcatcgcaaccactccgctcgttaggtcagcacgtaagccgcatgtgccagtaccatacctactgttaccgattccagcattatgagaaggaaagtaccctagtgtgctatagatagcttctctagtcgtttatctatgtgcacggtatacacacttgtaatatgtgtgcgaagtagcacagacacatatgcatcaagcgagtttgtatgattttgaattgaagaactta

SEQ ID NO: 34016 - DNA, 589 bp, Triticum aestivum
  Clone ID: PAT_TA_34016
gagccacaaatagtgtccaatattaagatttttttactgacttacaataaaagtccatgacaaggaggatcttcagcaacactcttcaattcatatactctaagaataaagaaccatcctctccatggaatctatcaattaatctacatatggatattttctcaatcacctagccagtacagaacaaaaaaataaaaacgtagataagatcagtacaattcccctctttgatttggtgccctaggacaaaaaccaccgtttcccaacctgatctgatgcgtcctcctacacgtacatgagttgctggtcaacctccgccaacggctcagtgtactcacacaggggacaggagcccgagaaagtctggcacgccactgtgaattgagatcgaaggaccctaggccgtccatgaggctaaccagatgataccatggcgaggtgaatcgtgggcggcgggggacaggggcgggccagggaggaaggagggaagtacctggggcccccggcgccagaccggcgaggacctgcccgcggcggtggccatggggggtcggtcgcgagctggcggtagcccgcaggagaggagaat

SEQ ID NO: 34017 - DNA, 619 bp, Triticum aestivum
  Clone ID: PAT_TA_34017
gagggaaaggaaggcggagagagagagagagagagagagaggggtgtagggacatcgtgactgaccaccggagagagagaagaagaggctgccaaggtcgacgacggagaagaagaagaggcgatggcgtccgggtggggcatcaacgggaacaaggggcggtgctacgacttctggctggacttcagctcgtgcatgagccgctgccgccagccctccgattgcggcctcctccgcgaggactacctcgagtgcctccaccactccaaggagttccagcgcaggaacaggatctacaaggaggagcaacgtcagataagagctgctgctcgcaaggccaaggaggaagccgaaggagctcctgctgttgcagctcaccactagcatccgtttttatttgctgcaagtgcttccatgttcggctatgagcaaggcaataatttcctaaacattctaccctcccactccatgacttgttctaaaatcatgagttcgataaacaaccttggtcaacaagtttgtgcatgtttgagatattaagcgataataaacgcttgattcaaccatgaaacatgatgtttgtgcatgtttgcataccttgtagcaatttcatggcatt

SEQ ID NO: 34018 - DNA, 741 bp, Triticum aestivum
  Clone ID: PAT_TA_34018
gaaggcggagagagagagagagagagagagagagagagggagagcagtgtagggaaatcctgagtgaccaccggagagagagaagaagaagaggctgccaaggtcgacggcggagaagaagaggcgatggcgtccgggtggggcatcaacgggaacaaggggcggtgctacggacttctggctggacttcagctcgtgcatgagccgctgccgccagccctccgactgcggcctcctccgcgaggactacctcgagtgcctccaccactccaaggagttccaacgcaggaacaggatctacaaggaggagcaacgtcagataagagctgctgctcgcaagggcaaaggaggaagccgcaaggagctcctgctgttgcagctcaccactagcatcccttttcaatttttttcttactgcttttgtttgttcaaatgctttcacttgttcggctatgagcaaggcaataattcacctaaacattctaccctcccagcctccaattaacttgttctaaaagcactgaatttgattaacttgttcctgaggaacataagtttcgataaattaccttggttaatcaagtataatacaatgtttattcaattaagcgataataaacgcttgtattcaatcataaaacataacaatttcatggcattattctgcgtgagaaaaaacaaaaaaagggttcaagacaccagtaccttcaagacccctccctcgggtacacagcccccccg

SEQ ID NO: 34019 - DNA, 841 bp, Triticum aestivum
  Clone ID: PAT_TA_34019
caagcacctgtccagccctgtgcgagctacacttcaatttgtattctcagatagtagcggctgcctgcagaggagaggtcgaggacgggtccctattcatgtaggagacaccaacatagatgagctatttcttccacttttcctcatctttccatggttgcttggtcggatttgttgcatgaggtaggagaagaataagaaaatttgtcagatttttcgtgtgcaagttcggcagcgggcaatggtcgagatagagtcgggtgcacatcatatatatacaagtacctctaatttaactctatatggaagatttaaaagcctttgtgaaagattccggttttgtagaagccgatgatcagacacaccatgaccttacttctggatacaatattgatgaggtcgattcctcgggtggattggattctcacccgctccaagtgaaacttgagcgacggcatgcaagggactaccaaagaagagatgatgcgggttcagaatctgacattatctgtgttagtgctggcagatccaaaggcggaaagaaacggacagtttcacacactagcaaccgtaggatcatcagcaaaaaggtaagttagcacaaagagaaaaagtattactactatcttttttactacttatttctctttctaaaccatatttggtcagcacctaaatatccacgaaagaggatcactaagctgacggggaatacattatccgtggtattatcttctaagataatacttgtgggctacagattgactgtgtttgcttgtctattgcagttcttttattataataaatcctatataatgcatatacatgagatagtcctaat

SEQ ID NO: 34020 - DNA, 368 bp, Triticum aestivum
  Clone ID: PAT_TA_34020
gttatatgaggagagcctggcatgttattcatttgtgcgcaaagcaaactgcttgtggtgagacattttcaaagcacccacgctacctttttatataaaatatttatgtgtaatatcgtgcctgcatgtttggcaaactgaaacacccaaggtttgataatgtaatagtatgagaccttttttgactgcctgatgttccttttactgtgaagaactccctctgtaaacttctataagaagttttgggttactacttcagtgatcgaaaatgtcttatataagtttggattattatcattttgctttcaaaatataatgatcaatgtgttgctaatgtttattatctgcatgaataagaggatgaggat

SEQ ID NO: 34021 - DNA, 803 bp, Triticum aestivum
  Clone ID: PAT_TA_34021
gttgggacagagctgcgaatgggccgttgtctctttaaccttgctgcaagtactttcgatgtcgtcccatgcccttcgtggtttgcaagatggagtagcagaaaccgctgtcgtgcatttgttgttgagcttgagggagtgttatgtgctgttctggcagatccagttgcagacaaattagatgtatggaagctagagcatggccgatgggacagagcatacacaattcacctagaagcatctcctggctattccctcaagacatgtgttgtggtgccattagctgttgatcccgatcgtgggaagatcctgctcaacactgttaggaaaataggtctatatgatccagtggagcaaacaattgaaaatctctattcacttgatcaggtgccggttgccagtagtgcacaccttaagtttcttgacatgccttcaacttcatcaggggatagtttgacatgctccaaagaagagtcagtggcggagatgaatagaatggactctaaattgattacttctgttcctatgttatatgaggagagcctggcatgttattcatttgtgcgcaaagcacaactgcttgtggtgagacattttcaaagcacccacgctacctttttatataaaatacctatgtgtaatatcttgcctgcatgtttggcgaactgaaacacccaagctttgataacgtaatagtatgaagcatttttattgcgagtatatcatatttcacttttcaatatgtaatgatgtgttcctacatgttatctgtgcaaataagagggtaatgccctgttgatatc

SEQ ID NO: 34022 - DNA, 1435 bp, Triticum aestivum
  unsure (1)..(1435): unsure at all n locations
  Clone ID: PAT_TA_34022
gctgacttctcanacgtttgcctggnaacataggttcaaagattgatatcttatgtggcttggcatggattggcaaaggattgcttatgagaggagatgagaaagtgaaggaaatttcaatgtttcttcttaaatgcctctcatcagaggcttctctagcatcagctgcagctgatgcattccatgtgatgatgggtgattcagaagtctgcctaaataaaaagttccatgcaagaataaagtttttgtataagcagcgttttttctcaatactgatgccaatttttctctctaaaattaaggagacctcagagctgacaacaaaattggtgatatatcgagcattcggacatattatttccaatgctccagtgtcagcagttataacagaagcccatcagattttgctcgtgatggttgatatcttagccaaattgagcgtggataatcaggataaagatctagtgtatagtttgttgcttgttttatctggaatgctgatggatgaaaaaggcaaagaatgcattgtggaaaatatccgcatcattatcagtgtacttgcacaacttgtttcctatcctcacatgatggttgttcgggagactgccttgcaatgttttgttgccatgtctagttttccccactcaaaagtttatcgcatgcggccacaggtcctacaagcagcaatcaaggctcttgatgataagaaaagggctgttcgcctagaggctgttcgatgtcgacaaacatggcaatcatcatttgcttaaggtagtctttctcccgccaccgcatcgtagtttggaattagtcactgaacagatcatgttagagcttgataagtattgagatgcgtgataggctgtggtagcccgtagggtggtagaggacaatgcggcttattccgcctttgaaatgcttcgcgatggtgtatgtcggtgcattggattcaatctggccgactgctcttccgtccctttttccttgtatttgtcatgaatggcctaggatcatagttgcatttataggaccagctcgcgaatgtatctccggttctcctcactatgcattgcatttgtctttcaagtcgggagaatgcaagtcagatatggcccgagtgctgattatcatgtaaagttgccccaccccacgtattccccgcaccgcaccttttcccccttccccggcctcggcgagaccgcgcgcggcgcaccatgacgagctccgcctcctcctccccttcccgcaaggtgctgagcaagatcgcgtgcctccggctgcagaaggagctcggcgagtggcaggccagccctcccggcggcttcacctacaaggtgggtcatcgaggtgtcgggggcagaggggacgctctacgccggcgagacgtaccggctgcaggttgacttcccggagcagtaccccatggaggctccac

SEQ ID NO: 34023 - DNA, 995 bp, Triticum aestivum
  Clone ID: PAT_TA_34023
cacaattcggcaaaagcgttgattgagcggcgagtctttccagccggccacttgagctcctccgccatcggcatccccgtcgcgtcgcaccccgccgctacaccaacccaccccaccccacgtattccccgcacctttcccccctcccccggcctcggcgagaccgcgcgcggcgcgccatgacgagctccgcctcctcctccccttcccgcaaggtgctgagcaagatcgcgtgcctccggctgcagaaggagctcggggagtggcaggccagccctcccggcggcttcacctacaaggtctccgacaacctccagcggtgggtcatcgaggtgtcgggggcggaggggacgctctacgccggcgagacgtaccggctgcaggttgacttcccggagcagtaccccatggaggctccacaggttatatttatgcatccggcgccgatgcatccgcacatttacagcaatgggcacatctgtctagatatattgtatgactcgtggtcaccagcaatgacggtcagttccgtgtgcatcagcatcttgtccatgttgtcaagttcaccagctaaggaacgcccatccgataacgatcgctatgtcaggaactgccgcaacgggaggtctccgaaggagacgaggtggtggtttcatgatgacaaagtgtgatgggctccagctggtttcttcttccggcatcagcagctcttatacatcatcatcctgcctaccgtagtatggcgtgcgtcgttcatgaaaaggattatttaggcaagtatttcaagccatctatttggcggcaaattgacatgcccatgtatgtggttttgtacatgatgaacctgcacctgtatcaactcccgtgcttaccaactcttatccctttgatttgatgtaacggggacgtacaatcgcaatcgagtatgcccgtgctatggattcaggctcccagtccgcgctcccgccttgtttgcttgaaaaaaaaaaaaaaaa

SEQ ID NO: 34024 - DNA, 619 bp, Triticum aestivum
  Clone ID: PAT_TA_34024
tcctccttgaaggctcgccgcacccacgcctccagctccagcccgccctccccctccgtcggctgccgcccggtcaccgcctccagcagcagcaccccgaacgcgaacacgtcccctttctgcgtcgccgccgcggccgtgccccccggcgcgcgcagctccggggccacgtacgacagcgccgacagggcgccgctgcggagcgcgcacgccgcgctgccgagcttcctcgactgcgccgtcttgtgcgcgccggcgacgaggcgagcgaggccgaagccggagacgtgcggacggagctcgtcgtcgagcaggatcttggacgacttgatgcagccgtgcacgtaccggcgagggctgcactcgtgcaggtatgccagccccctcgccgcgccctgcacgatggacagcctcaccgaccacggtaatggcgttggcgaagccgtcgggccaccgtggagggcggagtggagggagccattgccgaggtagtgggggatgagcaggttgtagggtggggcgtaggatatgcgcggaggcgggcgtacttggtatggaacgcgcgggcaatggcgggggtctgtggctggaaggcacgggggccggggcacccgggctg

SEQ ID NO: 34025 - DNA, 868 bp, Triticum aestivum
  unsure (1)..(868): unsure at all n locations
  Clone ID: PAT_TA_34025
tttttttttaaggcgtcaaacaggattcactgatgcaggttcccttttgaatggataaaagcttatggttgccaagagcatgcccattttgtatgggtacataccatagttgctggaaaaggccacattttgtagagaaacaaggaaacctgggggtgtactgctgatacatacgtgcttgtaaatttgtccacaacagtaccatcccatgctactccacgcacaggaggcatcccctcatataagcttatgtttttacataatgcaagtatgttcttacataatgcagatatgacgatactgtgcacatattagacggaatgtatgcactagtaggatactaaagggccatggcctaaccacttcatagtgatcggtgcacagatgtaggcaatgaagagcaggcacaagaaaatcaacacatactgctccagttggcggcaatatggaaccaccaatcgttcatcacggccagcttccctgccccgtgcctggttccgcttcctttgccggcggttaatgggcttggatctcccctgctgcacctcgtaagatccgcccttgtccttgccgccagaaaggttgttagcatcacaagagctctccactttccagtcctctgtatctcttgcctgctcaaataccgtcctccctcctatctggaaacggttaatcaggttggatccccactgctgcaactcgtcagatctgttctttgaatagacgactggctgcttgcaccatgtaaggttgttagctttaggagagcactgtagtttcaagtcctttggatcaccaggctcctcacccagatcaaatattgntttccctcctttttgatgacaggcatncgcaagcgccctcaagg

SEQ ID NO: 34026 - DNA, 430 bp, Triticum aestivum
  Clone ID: PAT_TA_34026
aacgattaaaatagtgtcaggaaacattttcgtgatggctaagcaaggaacggcgcgatctcccgcgatttcatgaaccgtgctaattgcgaggcagattttattcagagatagcgcggctgttttgcctgcggttcaaaatcgtggcagttgatctgtttgctctacgctgatgggagtatttggcaatgttaaaagtaactgtcgttctgtactgtttaattagcagtacagcggtacttcctcacagaaaaaaggacgtgcataccaccagcaatgttcaactcctttggaccgtctttagcaaaaccaattactttcagattttcacagtgtaaaacgcacaaacgcaagaggggaggattgatttcattctgcaagactgcaaccacactgaaaggtgcacaggatctgctccttccacaccagg

SEQ ID NO: 34027 - DNA, 1163 bp, Triticum aestivum
  Clone ID: PAT_TA_34027
cttaattatttctatccatcgatctcttcttttcttcccgaattaatcagctgagctagaggtcgatcgacatcgacatggccggcgctgcacagggcaagcagagtagagaggcccatggtaacaacgatatcggcgtcgccaaggactacctcgaccctccggcggtgcggctgttcgacgccagcgagcttggccagtggtccctgtaccgcgccatcatcgccgagttcatggccagtctgctcttcgtctacgtctccgtcgccaccgtgatcggccacaagcggcagacggacgcggaagcgtgcagcggcgccggcgtgctgggcatcgcgtgggccttcggcggcatgatcgccgtcctcgtctactgcaccgccggcatctccggcggccacgtcaaccccgccgtgacgttcgggctgctgctggcgaggaagctgtcgctcccccgcgccttcctctacacgtcggcgcagtgcctcggcgccatctgtggcgcggcgatggtcagggccgtgcacggcgcgcggtactacgagctctacggcggcggcgccaacgaggtcgcgccggggtactccaaggcgggggggctgctggccgaggcggccggcaccttcgtcctcgtgtacaccgtgttctcggccaccgacccgaagcgcatggcgcgggacacccacgtgccggtgctggcgccgctgctcatcgggttcgcggtggtggtggcgcacctggccaccatccccgtcaccggcaccgggatcaacccggcgaggagcctgggtgccgccgtggtgtacaacaacagcaaggcgtggagcgagcagtggatcttctgggtcgggccgttctccggcgccgccgtggccatggcgtaccaccagtacatcctcaggggcggtgccgccgccaagccacacttcaacttcgacaatggattccgacgcctcggctgttgatggagccacacacaccaagaggtgatggtaatcaatctgagagagctctggcgatgtaagaaacgacaccagtactgcttttctggttgataatgtcttttttgacaagctgtaaaaatgtaaatttaataaatattatcacgaggatcataactccgcgccggcccgggtccctgttcgccccattgcgggccctat

SEQ ID NO: 34028 - DNA, 716 bp, Triticum aestivum
  Clone ID: PAT_TA_34028
attcggctcgagcacccttcctcccagtcccattccacagccatgtccgggcgcggcaagggaggcaagggtctcggcaagggcggcgccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctagggccgtccggccgacggtcgtcgctctttgtcgccgcctgcagattccaaaagcctgatgagaccctgacttgtttagttcgctatttcctctgtagctcgaactgaatcgtggaccaaagttattcgcatgtgttgttggaaatgaaacctgtctctgttgtgataccgtgtttctgattttgtctcgctggtcggtctctgttattgaagcggcaacgagttgatttgccataatttaccaggagccccggatgagtcgtagtactacttgtttgcagtctattttgtaatgccatagtgactgaacaattgtgtgtcccgattcagcaacatcatttgctcaccattgatgttacttct

SEQ ID NO: 34029 - DNA, 663 bp, Triticum aestivum
  unsure (1)..(663): unsure at all n locations
  Clone ID: PAT_TA_34029
ccctttttaaattaaacttactggttgtatacacgggcgctgaaccggggttagatcgatttgcgggtagttaaactctatactggtattcgggagcgatgtttccaggttgagatacccacccacacagccacattgtaccatttattacacatgaatagcagatgggggaaagaaactcaacgaccagcgtgctcaagcctcaagcagcaaggaaagaagtgtgcaaatgggatggcaaaaaaacagaggtagcaactcatcgttatcgtacatcttcagagggttcgtcgtgacagatttctcgggcaacggtgcacctgtttcagctgtgtatttccagtcaggtttcggccggtggcatcctcgagaatgacttctatgtacaacggtcaacggcattatctacttctgagtgacgacctcatccttagactctgcctcagctgcagtttttcttcgaacttttctagttggactcctcatagtgacaaattcctctgcagatgttgggtgaacgccaacagtgacatcaaaatcttgcttcgttaacccagctttaacaccaattgcaattccctggattatctcaggtgcacctcctccccaattccgcactcctacaanttngttngtngtngcncacacaatnanttnattagt

SEQ ID NO: 34030 - DNA, 890 bp, Triticum aestivum
  Clone ID: PAT_TA_34030
tcgagggccggcccgggcccgggaatttcccaaaaaaaggaaaaaaaaaaaaaaaatataacaccccccacaccgatagctgcaaacatcccccacgcgtccgctaaaatgaagctgcacgtagccttcttcctcctggtaaccatggccgcgacggcccgggccgtgacgttcgacgcgtcgaacacggcgtcgggcaccaccggcggcaagcgcttcgacaacgccgtcggcctcgcgtactcaaagcaggtcctctccgacgcctccaccttcatctggagcaccttcaaccagcgcgccgctgccgaccgcaagcccgtcgacgcggtcaccctcgtcgtggaggacatcgacggcgtcgccttcaccagcggcaacggcatccacctcagcgctagctacgtcggcggctacacctccggcgacgtcaagaaggaggtgaccggcgtgctgtaccacgaggcgacgcacgtgtggcagtggaacgggcagggcgcggcgaacggcggcctcatcgaggggatcgccgactacgtgcggctcaaggccgggctcgcgcctgggcactggaggccgcgggggagcggcagccggtgggatgaggggtacgacatcacggcgaggttcctcgactactgcgactcgctcaagcctgggttcgtcgcgcagctcaacgccaagatgaagagcgggtacagcgacgacttcttcgcgcagattctcggcaagaacgtgcagcagctgtggcaggactacaaagccaagttcggaggctgaatgggcttttgccttttagtcatctctcttgcacggtgtgatggcatagcaccctatacatattgaaataatcaacaagacatgtgctttacgttgtaatgaaatttaat

SEQ ID NO: 34031 - DNA, 900 bp, Triticum aestivum
  Clone ID: PAT_TA_34031
cccacgcgtccgcccacgcgtccgcccacgcgtccgacgagcgagatgaagatttccatcgccctcctcctcctgggcctggcagccacggcgggcgccgtcaaattcgacgtgacgaacgaggcgtcgagcacggccggcggccagcggttcgaccaggagtacggcgccgactacgccaagcaggtgctgtccgacgcgtcctccttcacctggggcatcttcaaccagccggacccctccgaccgtaggcccgccgacggcgacaccgtcaccctcgccgtccgcgacacggacggcatcgccgccaccagcggcagcaccgtggagctcagcgcccgctacgtcggcggcatcaccggcgacgacctcaaggagcaggtgacgggggtgctgtaccacgaggtggcgcacgtgtggcagtgggggctgcaggactacggcgcgcactcgggggtcttcgagggcatcgcggactacgtgcggctcaaggccgggtacgtgccggggcactgggtgaaggagggcggcggcgaccggtgggatcaggggtacgacgtgacggccaggttcctggactactgtgactcgctcaagcccggcttcgtggcggagatgaacggcaagctcaaggacggctacagcgacgactacttcgtgcagatcctggggaagagggtggaccagctgtggagcgactacaaggccaagtatcctggggtgtagttatgtttttttgggggtaaaaatagtgattcaaaaatagttacgttgtcgtgagctgaatcacgttgtacgtacataagcaggtgggcttattgcgggactgtggtattgtctaccgcggtacgtattatgtattgcctgacctaatggaataaaatttggtacttccctgcc

SEQ ID NO: 34032 - DNA, 882 bp, Triticum aestivum
  Clone ID: PAT_TA_34032
agcacttaagagaagtcactagctaggcacgcacgatgaagactgccattgcagcagccgctcccctcctcctattcctggccctggccgccatggcaggcgccgtgacgttcgacgcgacgaacacggttccggactccgccggcgggcagagattcgaccaggacgttggcgtcgactacgccaagcaggtgctctccgaggcctcgtccttcatctggaccaccttcaaccagcccaacccggaagaccggagggactacgactccgtcaccctcgctgtggttgacaacatcgagcctgtggcccagacctccgggaacgctatccaactccgagcccagtatgtcgccggcttcgacgagggcgacgtcaagaaggaggtgaagggcgtgctgtaccacgaggcgacgcacgtgtggcagtggaacgggcagggcagggcaaacggcgggctcatcgaggggatcgccgactacgtgcggctcaaggccgacctcgcgccgacgcactggcgcccgcaggggagcggcgaccgttgggacgaggggtacgacgtgacggccaagttcctggactactgcgactccctcaaggccgggttcgtggcggagatgaacagcaagctcaaggacggatacagcgacgactacttcgtgcagatcctggggaagagcgtggaccagctgtggaacgactacaaggccaagtacccccagccccagggctgatcgacgatgcatgcagtttgttgttgtatgtgtaccggtcttcgtctacatacagatacattatagtacttgtattactgtacaatttatgtactgcctggaatggaataaatcagcgttggcacggtgtgtgttaacgaattgacgagac

SEQ ID NO: 34033 - DNA, 1255 bp, Triticum aestivum
  Clone ID: PAT_TA_34033
acaacaaacatccgcgacacaggcctgcaagcctgcaacacccgctacaaaaggacgatgcagacagccccttgcacgccgtcgctcccgtcgtcctagtcctggccggcgccgccagggccggcgccgtggcgtacgacgcgacgggcaccgtcccgcagccggcggtttgggagggccttcggcctaccatactccaagaaggccctctccgccgcctccgccttctcctggagcccctgccctccgcgctggcaccggcgaccgcaaccctgtggcagccctcaacatgacccgtcgaggacaccacgccgcgtcgcctccgccggcgccaatcgccatccacctcaggcggcccagcacgtcggcggcatctgcggcgacgtcagagaacggggtgcacgacgtgctggacctcgaggcgaggcacgtgtggcagtggaacgggcagggcaggggcgaacgacgggctcatcgagggcattcgccgactacgtgcggctcaaggccggggtcgcgccggggcactgggtgaagccggggcagggcgaccggtgggatcaggggtacgacgtcacggcgaggttcctcgactactgcgactcgctcaagcccccgggttcgtcgcgcagctcaagcgccaagagtgaagagtgggtacaccgacgacttcttcgcgcagattctcgggaagaacgtgcagcagctgtggaaggattacaaagccaaagtttaagaggctgaacgcacgataagttgatgggtcattcacggtgtgatggcataacgcactacttcgaataagacatgtgtgatggcataacacactatatatactgaaatgatcaacagaacatgtaccttacgctctatagtgaaagataaataaacgatttcactaattcgaaataaaaattgagttaaaaggaatacgtcagcgtttggggggagtggggtgaggatgtgcggcgacaaaaaggacatcctggaggaagtagacgtcgtcgtcgacccgaagtgcctcgtcggctgcctccgcaagaagtaccacgacgttcacctcgtcaaggtggaggaggtgaaggacgacaagaagatggatgagaagaaggaggacccgccgccgtcatgttatggcccacaaactggatcaactctgactgtactagtgttggatacaaattcatcgaaaaaaaaaaaaaaaaaaactcgagacacctgcccgggcggccgctcgaaatcacttagtgaattc

SEQ ID NO: 34034 - DNA, 1143 bp, Triticum aestivum
  unsure (1)..(1143): unsure at all n locations
  Clone ID: PAT_TA_34034
gatggtatgccaaanttntgtgatgtgatgaaaattttgtgtatgngactgntcttntaatgggatnnggnttgcatgtngatgggntgnaaaccggcgggaccttagggtnntaaattatgnatggcctgngtgtcaatggtttaaccccatgtaatantntaatntattgctaaaatgttagccaaagtagtnggaagtaatagttggggagcaaatttcatgggagancgntggatgggagatcatgatggtggagatcatggtgtccatgccggtgacggaagatgatcagggagccccgaagatgaagatcaatggagctatatgatattggccatatcatgtcacaactctatataattgcatgtgatgtttattatgtttatgcatcttgtttacttagaacgacagtagtaaataagatgatcccttataaaaatttcaagaagtgttctcccctaactgtgcaccgttgctaaagttcgtcgtttcgaagcaccacgtgatgatcgggtgtgatagattcttacgttcacatacaacgggtgtaagacagttttacacatgcaaaaacacttagggttaacttgacgagcctagcatgtacagacatggcctcggaacacgagagaccgaaaggtcgaacatgagtcgtatggaagatacgatcaacatgaagatgttcaccgatgatgactagtccgtctcacgtgatgatcggacacggcctagttgactcggatcatgtaatcacttagatgactagagggatgtctatctgagtgggagttcataagatgaacttaattatcctggaacatagtcaaaaggcccttcgcaatttatgccgtaccccaccctattcctccgctgttttagattcccccctagagtttatttggttgtgagttgaccgttgcgctgctgcgccctgtacgaggcggccccccgctctgcaccgcttggcctgtggccccccacgtcctggcgcctgtcccacggcgtcgtccccgtctgccatctgcgtacactcagttcatggtcgtgaagggaccacagagtttggaacgccggacaatggagtgggcggaaatggattaggcntccatcaangaaaaccccngntttaccaacnaggaa

SEQ ID NO: 34035 - DNA, 2170 bp, Triticum aestivum
  unsure (1)..(2170): unsure at all n locations
  Clone ID: PAT_TA_34035
cccacccctccgcgcgccatcgcagcaaaacctcacccaccccaaaccctagccgctgctgcagttggcgccacctcaaccacccggaagctcgcagccatggcgggtaaccgggaggcgttccgcgtggcggtggggaacacgctcgagcggcgcctcttctacgtgccgtccttcaagatctacggaggcgtcgcggggctctatgactacgggccgcgagggtgcgccgtcaaggcaaacgtcctcgccttctggcgccagcattttgtgttggaggaagggatgcttgaggtagactgtccatgtgtgacaccacgaagttgtcttgaaggcctctggccatgtcgaaaagtttacggacttgatggttaaagataaaaagacaggcagctgttatcgtgctgatcacttactcaaggatttctgtaaggagaagcgcgttaatgatattacattgtcaccacagaaggtcgaagaattaaactttattcttgctgtcttggatggtctgtcagcagaacaattaggcgctaagattaaggagtatgggaattgctgctcctgacacaaagaatctattgtcaagatccatacccctttaatctcatgtttcaggacttccattgggaccgtcaggtttgagtgcagggtatatgaggccaagagacaggcacaaggtatctttgtgaacttcaaagacttgtattactacaatggcaacaaactacccttcgctgcagcccaaatcggccaggctttccgcaatgagatatctccccgtcaaggccttctaagagtccgtgaatttacgttggcggagattgagcactttgtggacccagaggacaagtctcatccaaagtttagtgatgtttctgatctagagttcctgatgtttccgagagaagatcaactgacaggaagatctgccactagacttaggctcggtgaagctgtttctgagggaactgtgaacaatgagacccttggcttctttattggaagggtctatctcttcttgacgcagcttgggattgacaaagaccgtctacggttccggcagcatctgccaaatgaaatggctcactatgctgctgattgttgggatgcagagatcgaatgctcttatggatggatcgagtgtgttggaattgctgataggtcagcgtatgacttgcgtgcccactcggataaaagtggtgttccactcgaagctcatgaaaaattcgcagagcccagagaagtggagaagttagttataaccccatcaaagaaggagcttggccgcgccttcggggcgagcctggtcccgggcctcggagcatggggagccgtgcgcgggtctgaacccctggggtcgagggcagcttgtgaggcttgaccgggtggggagtttaaggtctgtacccttgggaaggatgttaccataaagagaaatatggtttcaattaacatggagaaggcaggggaacatcaaagngaagttcactccttctgtcatagagccatcatttggcatagggagaattatttactgcttgttcgaacattgcttctatcaaaggactggcaagacagatgatgagcagttgaatgtgtttcgttttccccctcttgttgctccaattaagtgtactgtatttccactggtcaaggttgagaaatttgatgttgttgccaagaaaatttcaaaagctttgacaacagcagggatttctcacattatcgacatcacaggcacttcgattggtaagcggtatgcaaggacagacgaaatcggcgtccccctggcgatcacagtcgactcaactacaagtgtgactgtccgtgaccgggacagcaaggatcagatccgtgtggaggtcgaagaggtggcttcggttgtgaaggaagtgaccgatgggcagagcacctgggcagacatcatgtggagatacccagcacataccgccttggccaccgatgaggaagaagcttcagaaacctgaagggtacgttggcttcctgagtttcggatgtgtgtccttggaacagaaatactaatagagcgttgccctgtaatcctagtcctgttttcccttcacgtatggttttcatccgttccctgtcgatatttactgtatctacatgctcatctcgtgtgattaaatggaagagacgtgtgcat

SEQ ID NO: 34036 - DNA, 1302 bp, Triticum aestivum
  Clone ID: PAT_TA_34036
cacgaggtctggcgccgacccgccgccgcccctttccgcgacgccagtggcgctcccccacaaattggtcctagccgccggacaaggctgtacgcgtccggctatcctcgtggtactctgccccaccaccatccttgtgctgctcctccggctagagcggctccacctccaaccgtcgggccgtgctccacctccgacccgtctcctcctcctccaatccaggtcaccgtccgctcgccgctcccttccgtgcccgggccccccggctccgggcccatcgggacgagcccgctcgcgccctgtcgaccctccgggcgcgctggcgtgctcccggcgaccctgccaagcgagccgtcgcgcggcgtgcggatgtctctctccctccatgcggaaggcgccgctcctggttcctttcactgggccaggcgatgttggggcactcgttctcggattcagagtatggaggtttatcatctgcatcactggagataactgatagtgtttctggtggagatacttcatcaacaggtgtcttttctggcaacctctccttggatatgtccgagggatcaccatggaggatcaggcggagtggtttctgtggaatgcgatcaaagaagtttgatggttacatcgatcttgattcatatgatacaatagcaatgaagctcagaggggatggaagaacctacatatctactatatacacagagaactgggtaaattcacctggacaagaggaagataactcgtggcaggctttcgtgtgcgtgcctcatggtagctggcgaatcctgaagatccctctcgatagctacttacctacatggaaaggaaacgtgatcgaagcgaacatggaaatgaatccttctcgcgtcgtgggaatgtctctctcgttaaatgcagaaggcggcgttcctggtgctaagactgggccaggcgattttagattagacgttgattggatcaaggcgatgaggtccctgtgatttccgcagtttgtctttcggctttcacaagatagatgtttctgggcctaaaattccaagcattttccttccagtttgcttgccgagctccttcacaaaagagaatctcattctgtatgcagcttctttgtcctacggcgatagatgagtgtcatcaataacaaagagtccggtaaaaccgtcataccccagattgacaaatccagcatcccttgtagatgcatgaaatgtttcactttgtatcagagcagtaaccttggaaatagttatcttttcagggccctgaataaaaatttttttttccggccctggg

SEQ ID NO: 34037 - DNA, 778 bp, Triticum aestivum
  Clone ID: PAT_TA_34037
tttttttttttttggaataaacttaaaatatgattattatttttattttcttctaatcttctatttcatacaaatattacatgttcccggaataaaacactcctgcagataacttttgtaacaaacacttgcatgtgtatcttttgctgcacaaacacttacaaagcgcttgatgccaaaacctataggagcaagtatcttttcaaggtatcgcatatgaaccgaatatgtgatggccagtaatctttacatggcggcccatcttgaacaacaataaaagaatgagcagcatatttggcaaccttccccctttcgggtaaaaaccaaataatgctatctccttaacattctgaacgatggcagattctgaacgcttgaaacgcctccaattgtaagctcttgctctaactggcctagtgtggacttcagaacctcgttgaattccatataactagctctccttgcaagccactgagcatcgagcatctgaaaagctaggcagaaaaggttatcgaaagccatctcgtcatcttcaagtagttgagcaaagccaactcttgcttttgagctcctcctattttctgattgtaaatccagcatttgaactaacatataagatacatttacgccagctactgcaaaaggatattcccattcagctctctcaccatctgccttgtgtaatagccgatgaaaggaatctgggtaatttcttgcaaaatatattagattttccaaggacatgaatcccccagacctaaaatctgttgctgggtca

SEQ ID NO: 34038 - DNA, 424 bp, Triticum aestivum
  Clone ID: PAT_TA_34038
ccgggtcgactgattttatactatgcgacagtcatttttttagtataaaaaataacggagggagtagaaaacaaggggtacgactatccttgtggcaatgctatgtctggctggctacatgcatgcatgcaatgtttcggcatgtcatgtatgggccatggatgggtcacacttacatcatcgttgaactttcgagtttgatggatatgagtacgcagatgagaaatgaaagatcacatacatttgtataagtctttattgattgtatggacataaaataatagaataaaaatgtatttgtacaattggtattgcccattataggaggaaaacaaggcaaacaactttacacaagttgcaccttttgtaacacacaagtaataaacatatactccctcggtccggaaatacttgtccgagaaat

SEQ ID NO: 34039 - DNA, 912 bp, Triticum aestivum
  Clone ID: PAT_TA_34039
gctctcagaccaacgtgtcagggaaggaattgaggcgagcgagagagaaccccacatcacatggcgaacggcgtgggctcggcgaaggcggagatctgcgccgggctgggcatgccgatggcggagctggagcaggtgttccggcgctacgacgccaacggcgacggcaagatctcggcggacgagctggcgtccgtgctgcgcgcgctgggcgcgcccccggggccaggggaggtgcagagcatgatggaggagatggacgccgacagggacggcttcgtcgacctccacgagttcgccgcctttcactgcggcccctgcaagggcagcgcggccgcagacgccaaggagcaggaggccgccacggaggccgagctcaaggaggccttccggatgtacgacgccgaccgcaacgggctcatctccgcgcgggagcttcaccgtgtgctccgccagctcggggagaagtgctccgttgctgactgctcgcgcatgatacgatccgtcgacgccgacggcgacggcagcgtcaacttcgaggaattcaagaagatgatgggcggcggagggaggagctaggttggtaagggccggccatcagcaaacaatgctgcatctacatgcctcgttgagggttttgttcctccatggtgcttaatttaattttaattaatctcaaagtgaaaggcttaggctccccgtaatgcgaatactaatgatgatgcgggtgaagtgattaattatgtaaatctaatcttctagtagtagtagtactactaatgatgatgggtgtactaagaaatttggtctggggttgtttgcaatgaattagaactcgtttgaaaccctttgtttttctgtttggcactctttgtttttctgtttgaaactcatgcaaaatcaataactata

SEQ ID NO: 34040 - DNA, 962 bp, Triticum aestivum
  Clone ID: PAT_TA_34040
gccggccgggctgccacggcgcaaagcaaccgaccgtggcgagggaaggaattgaggcgagcgagagagaaccccacatcacatggcgaacggcgtgggctcggcgaaggcggagatctgcgccgggctgggcatgccgatggcggagctggagcaggtgttccggcgctatgacgccaacggcgacggcaagatctcggcggacgagctggcgtccgtgctgcgcgcgctgggcgcgcccccggggccaggggaggtgcagagcatgatggaggagatggacgccgacagggacggcttcgtcgacctccacgagttcgccgccttccactgcggcccctgcaagggcggcgcggccgcagacgccaaggaccaggaggccgccacggaggcggagctcaaggaggccttccggatgcacgacgccgcccgcaaggggctcatctccgcgcgcgagcttcacggcgtgctccgccagcgcggacagaagtggtccgttgcggaccgcccgcgcagaattcgatccgacgatgcccaccgcggcgacagcgtaagttgctaggagtcggagatgaggatgggctgcggaagtagcagccatcgtggaaacaatgtggcatctacatgccatgcttcatctttttgttcttccaaggtgcttaatttaatttataacttaatccaaattgtaatgattatgctcgtgaaaaggttaatactgatgatgttgcggttgaagtgatgaagtatgtaaagctaatatgctagtagtaagacttttggtcttgggtgtactacgaagtatgatttgtggtttgatgctctgtgtttgtcctcgtttgaaactctttgtttttctgtttgaaactcatgcagaaacgataactatattgtacaggttgtgaaaatcgggtccgcaagttcttggggatgtcgttcaatctgtatatcatttgttgtac

SEQ ID NO: 34041 - DNA, 672 bp, Triticum aestivum
  Clone ID: PAT_TA_34041
tagaggaagaggctggcagtttggttggagagaagaaagaagctgacactgttgctccggaagagaagaaagaggctgacactgttgctccggaggagaagaaagaggccgacactgttgctcaagaagagaagaaagaggctgacactgttgctcaagaagagaagaaagatgcccctgtcgttgatgccccagagaagactgaagaagtggaaggcgaggcagctgaatctgaggtggctccgctcgaggccggatgcctgaccctgtaaaaaaaaaaaaaaaaaaagaaaaaaataacaatgtttgctttgagaactgtaagcgtgtttaacctgacagcgcctgtaattgtaggccctttccgcatacttcacagcttgttgtcttatgaggtgctgcagggcagcaggctggcttgtgccgcctcggtcattattatcatttgtaacttgttagagtgcacattaatctcaggaggacatagacataatacttatgctgctgttgttgtaacctgacgacctttatgcctttgccttgtgttgttattcataaataagccatggaggcttgaacaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 34042 - DNA, 543 bp, Triticum aestivum
  Clone ID: PAT_TA_34042
aggcttcgggagaatccaagcaggcaacggctgctctccaaggatggccagggtaaccccggccccacgggagaacaatccacccgggaacgtcgacaacaatggacagattcatccaggtgttttttaccgtgcggtgcatctaaaggtaggttccgtggacgacgacaggcgaggcgaggcgaaacgacgacaggcgaggcgaaacggggaacaaacttggtctctgtgtgcttaggatggagtcccgcatttgctttgagaactgtaagcgtgtttaacctgacagcgcctgtaattgtaggccctttccgcatacttcacagcttgttgtcttatgaggtgctgcagggcagcaggctggtttatgccgcctcggtcattattatcatttgtaacttgttagagtgcacattaatctcaggaggacatagacataatacttatgctgctgttgttgtaaaaaaaacaaaaaaaacaattaaaaacaaaaaaaaaaaacataaaaaaaaaaatcaaaattataacaaaaaaattaataac

SEQ ID NO: 34043 - DNA, 1982 bp, Triticum aestivum
  Clone ID: PAT_TA_34043
gcgacccacgcgtccggggaggaactcaaatccagagccctctcctccccaaccctccctcccctagcggatccacacttgcggcggcggcgagagcgggaagcgaaaactcgaagcagccccgagcatggccagcgaaggcgagcacgcggcggcggcggcggcggcgggcgagcagacgccgctcaagaaggcgggcgaggcggagcagggcgaggagctccaggccccctccggctggaccaagaagcttaatcccactcggggtgggaagtttgaggttgtttttgttgcaccaactggcgaggaggtcaagaccaagagagctttaaccacatacctaaaagcacaccctggaaggccctgctctttcagagttcgtctgggcaactggcaatactcccagacgatcctcacgtctaagtgcaaagcctaaggctactgagagcccagaagatgagaaaccctcacgccgaagtggaaagtctaaggctaccgagagcccggaagatgagaaacctgccaaacggggaaagccctcaagctctaagaaaggcaaaaaggggaaacaggaggatgcagaggacgcagaagctgaaagtggagatcatgctgatgctgaagaagccaaaggcactgaagtggagatgaaagatgctgaaggagccaaagtcactgacctggacctgcagatgaaagaagctgacaatgctcaggaagaaaagaaggaggaaggagcaaacagactgacagtagagcacagggaggcgaacaaagcggctgacgcagagactcaggaagatgagactgcggctgacactgttgctaaggaagagaccaaagcggctgacacggttgcgcagaaagaggagaaagcggctgaccctgttgctcagagaagagaagaaagcggcgtgacactgttgctcaagaagagaagatagatgcccctgtcgctgatgctccagagaaaactgaagaagtggaaggtaaggcaactgaatctgaagtagctcccgtggaggctgagatgtctgaccctgtaacagagaacaaggaaaacgagaagccagctgaatttgaagaagttcccgtggagtttgagatgtctgaccttgtatcagagaacaaggaaaacgagaagccagctgaatctgaagaagtccccgtggagtttgagatgtctgcccctgtattagaagagcacaaggaagatgagaaggcagctgaatatgaagtagctcccgtggagggtgagaaaagtgaaaacggtatggcagtcgaatccacagtgccacctccagcatcttcagaggaaaagaaagtagaggcagatagcaccatcaatccggcgacccctcctccagtggaggtgaaggcagatgctccagcggcagaggcagcaaaagccacggagaatccagcagacaacaccgtccccgaagaacaatccgccgtgaacgtcgacaacaatggacagattcatccaggtgtttctcccgtgaggtgcatctgaaggtaggttccgtggacgacaggcgaggcgaggcgaaacggggaacaaacctggtctctgtttgctttgagaactgtaagcgtgtttaacctgacagcgcctgtaattgtaggccctttccgcatacttcacagcttgttgtcttatgaggtgctgcagggcagcaggctggcttgtgccgcctcggtcattattatcatttgtaacttgttagagtgcacattaatctcaggaggacatagacataatacttatgctgctgttgttgtaacctgacgattgttacttgttgcagtgcatattaattctcaaaaaaacatagacataatacatatgctgctgttgttgtaacgaattgaaatctggtgtgctcttatgtgattaaaacttgaatattatagaatagaaaagttatataaggctgtaaaacaacttcatacctcttcgatactgtcacctatcttca

SEQ ID NO: 34044 - DNA, 784 bp, Triticum aestivum
  Clone ID: PAT_TA_34044
ctattttggtagtaagaagtctggtgtgtcaactgaatctgcaccgaaaaatggtgctcctgattctggccatggtagtggccataatcatccaaaacaccataaccaatcctctcagccgccaaaaccacataatccagtgactcctcgtcctcacaatggacctggtaattttcacacatcaaatttacatagaagtagttcatgtccaccacaagctccacaagctgggcatactggtgttcccactgcaccactgcagtcctggccaagtgctcctcctcccccctatcatgtcccgccagttaattatcctgatatgagtcggctgaatatttctggataccccataggggctcatgacaaccaaggttcaaacgttagctaccatccaaactattctggtgctgttcagcctccttacaataattatagttacagacatccaactccacctaatatatccagcaacatgcagaatgctggacaatggggtgcaaacactggatgtccgcagccatcttctgactctcaaattcttataagaaatatcttaagtgctttggaagtactgaagactgagaagcttgcaccaaccgaacagcatatatcagattgcgtacgttatggaggtgctaatctaccacaatttgatgttaagaaggctcttgaagttgctattcagcatcaagctatcgtaacgaaaaagttagacttgtgtcattctttctgggaaaagatgaaaatctctggaaatgcgtgaatatatggataacatgctagg

SEQ ID NO: 34045 - DNA, 946 bp, Triticum aestivum
  Clone ID: PAT_TA_34045
cccatgcgtccgggtattctccccttccaatttcaacgcgtccacgtgccctggttcccacgggtcaggccctggccctgcgatctgctcggcgccaataaagtatcagtttgcgaattactcgtcaggttataacaagtcagggcaaggggctctcaggttccagttgatcaaccagcgccaggatttctcctccgggttcttcaccggtggactctcaaatccagcgctcgtggcggtgtcgaacaggatcgtcttcgcgaacccgaaagccccggtttacccacgtctagcgctcgggaaaacatggaacgagatgactgtcacatggacaagtgggtatggcatcagtgaggcgcacccctttgttgaatggggcatgaaagggagccatcctgtgcacgcgacagctgacactgtcacctttggtcgcgagagcctctgtggagaacctgctcgtagtgttggttggagggatccaggcttcatacacacagctttcctgaagaatctatcaccagagaaagaatactactacaaaatcgcacacacgctccatggtggaaaagttatatggggcaagcccaaatctttcagagcacctccttatcccgggcaaaagtcactgcagcgggttgttattttcggtgacatgggaaaggacgagagggacggaagcaacgagtaccagaattaccagcctgcgtcactcaacaccaccgacgcgctgatcagggacctcgacaacaccgacatcgtgttccacatcggcgacatctcctacgctaacgggtatctctcacagtgggatcagttcacgcagcaggtcgaaccgatcacctccaaggtgccctacatgatcgcaagcgggaaccacgagcgagatttccccaacagtgggtcgctgtacaacggcacggactccggcggcgagtgcggggtgccg

SEQ ID NO: 34046 - DNA, 1968 bp, Triticum aestivum
  Clone ID: PAT_TA_34046
cgcggagccctccctccctcctgccccaccggcgcgaaccccctctcgctctctccgctctactctgcgccgccgcctcgtcttctcgcccccgcacacgcctcggcggcgaaccctagccgcctcgggagagagagagacagatcggcggcggcggctgctgctctgagcatcgacgtggtccagtcaacttcgaagaaccagcggatcgccacccacacccacatcgaggacctcggcctcgacgccaatgggacggcggtagggatgtcggccgagttcgtcgggtagacgggggcgagggaggccggcggcctggtgatcgacatgatccgccagaacaacatggctcgacgcgcgctgctccttgcgggcccgccagctatgggcaagaccgcgctcgctctcgggagctcccaggagctgggcagcatggtccctttctgtcctatgggacgagcacgaaggctactcctcagacgtcaagaagactgaagtgctgctggactattctcgtagaggtatagggtcgcgtataaagcaaaacgtcctatgctatgaaggagacgttaccaggctttccccagaagaacctgagagtccattgcacaagtattcgcagctgtcggctcaggtgactggactgtcttcccctaccttgacttggcaagcaggcgccttgacttcgagagcacagttgggggcattgtttgtgtagcaggtgcactctggactggacttccattggttcaacagcggtgcagtgtaaagggttggcagttgtgatgcttttgctacagaatacgatcttgaagcagaggagtatgtgccaattcccaaaggggaaagtccaccaagaaaaaacaaatagtgcaggacgttacactgcatgaccttgacgccgcaaatgcccagccgcaaggaggccaagatattttgtcccttatgggccagatgaaactggtcacggaagactgaaatcactgagaagctgcgccaagagatcaataaggtggttaacagatatattgacgaaggtattgcagagcttgtacctggtgtgctgttcattgatgaggttcacatgctggacattgagtgcttctcttatcttaatcgtgctcttgagagcccattatcgccaattgtaatacttgctacaaacagaggaatatgtactgtaaggggaactgacatgacaagtccccatggtatcccagtcgaccttctagataggttggttatcgtacggacacagatatatggccctatcgagatgatccagatattagctattagagcacaagtggaggagattgaaattgatgaggacagtcttgcatttctaggagaggttgggcagcagacatctttgagacatgctattcagttgctgtcacctgctagcgtagttgccaaggctaatgggagagagaagatctgcaaggctgatcttgaagaagttcgtgttctgtatttggacgcaaagtcctctgctcagttgcttcataagcagcagggaagttacatcacctaaattacccttgcacaagaattctcagctgccggctcaggtgactggactgtcttcccctaccttgacttggtaagcaggcgctgacttcaagagcacagttgggggcattgtttttgtagcaggtgcactctggactggacttccattggttccagaggacaatttgattctggtctctggcttctgtttgctgattagatttagattatgtgtagggattattgtgcatcttcgttgcccttgctaattaatggttagatctcgtttccccccttcgactaccagtcagccttggatgtatcaggtcgtgattcctttatggtagaactggaatttcttggattatgtcttgtgttaagaccgtctcaacttattgagcatgccattgcacgttgcctttgagaccgactcaacttgttgagcatgtcatt

SEQ ID NO: 34047 - DNA, 722 bp, Triticum aestivum
  Clone ID: PAT_TA_34047
tggtgatcgtttattagcaccttcaaatttctggaaaatatataagaacaatccaactcggctgagagaaaatatgtttgttacactagtaagtactgacctagctaggatataaaactgaggttgttaactttggaaatgaattgtgagcaatgtgtgttgatgctacaatagaaaaatatgatcagttgatatgaccactcaaaaatgtcacaagtattgatcatgtagctagattatttatctcatgaccttcaaccttgtatatgttgcttctcttctaaattttgttgctctattaacctgttttatcttctttctctaatgatacgttactcatgtcagctttttttattgccatagatggcccagataattgaatggtccatggctaagttgttaattgcaaggtggagaatgagggtctaagttgttgatgcaaggtggagaatgagggtcaagttgttgattgcaaggtggagaatgggggctaagttgttgattgcaaggtggagaatgaggccaagttgttgattgcaaagtggtgaatgggggccaagttgtctactaccaaatagttttacattcacattgtagaacatgaatttcatggtcaatgtatatgaatcattggattgtgctccatgtaatgcatccggcatgatttaataaagagactttcccgtttactaaaaatttaaaacaaaaaaaaaaaaaaaaaa

SEQ ID NO: 34048 - DNA, 1230 bp, Triticum aestivum
  Clone ID: PAT_TA_34048
gttgttctcgcgtctttgagcagcccacggtatagttctgattgcaattcatgatattaatccagaaaaggacaaagttcctctaaagaaggtcatagatgcttgtactgcttgctttgagcagcgcacggtatttactcagcaagttctagaaaaggcactaaataaattggtcgacaatgtaccgaatcctcttctttttatgagaacagttattcaagcactcgatgctttcccagctttggttgattttgtcatggggatactttccaggcttgtcaataagcagatctggaaaatgccaaagctgtgggttgggttcttaaaattggcataccagactcaaccacgctctttcgatgttttattacagttacctccaccacagcttgaagttgcattgaataagtacccgaatcttcgaccacatctttcttcctttgttaatcggcagaacttgcacaacaagttgcccagacatactttgaatattttgggcttcgttaacgaaccacagcaggcaccaatgccatttgcgcccgctgcattacaaacagcagacacgacttcctctcttcctggtgcaaacataatgtgaaatctgatgatggaagtcgtagcaccgatcaggtgcaataatgccttgttcatcacaggtggacattcagagatatatgggcgtggaatgacacaaatgaggacggcggtgccctttgatgcgtttgcagttaatgcctctcagcaactcaacaatctatcgtggttactgattaaagggtggtctggatcaaatgtggttgattagagggtggtctattgtgtttgtgctggagctattgcttctccgaacaccggtcactcccaagttgtatagtagctgtatccttgtggtaaaaagtagtaccacttgcaggctgaggcttatgtggcgaccaaacggcagagctagtgatttacaaatggccaagcgatactatttgatcggcatgtcttactccaatgaggacactgggttacttgcagcagcattctttttgcaaggagcccgcaattgactgactgacgctaaccattgctgcagtcctaacagtttgtctgtgtgttgtaatattgtatattaaattaattatttagttagcaagaatatttactctgtcaattaatcaaggcttttgtcagagtgaacgtgttttaaaaaaaaaaaaaaaaaaaaagtcgacgcggccgcga

SEQ ID NO: 34049 - DNA, 1294 bp, Triticum aestivum
  Clone ID: PAT_TA_34049
gcttcgctttgaaaatgatttgaacttaggtgtcgatactgttggggcaattgctagcaaatttgaaccaaggtcatcatttgagaagcagatggctggtgtgtttaacaacacggaaattatggaagcacacaagaatgatggtgctaaaatcttggaacttaacaagatggaggtggaggatgtgagagagcgtcaaaatcgtcttgctaaaatgcgcagccttctgtttcgtcatgaaatgaaagcaaaacgtgtgaagaagattaagtccaggacttaccaccggttgatgaagaaggacaagctgaaggcagcagacttggaggcagatcctgaagctgcaaaagactctgctaagaaactagaatttaagcgtgcggaggaaaggatgacactgaagcacaagaataattcgaaatgggcaaagcgaatcttgaagcgtggcttgtctgttcaagacgatggcactcgagatgctattacagcacaactccaacagcatgctcttcttactagaaaaatgaattccataaaagatggatctagtagtagtgatgaaagttctgatgacgacgatgatgatgaagaagatgaaagcaaattagaagcaaagcttctgaacagagggaaagaaaagattcgtaaagtgattgaagaagataatgagattccaaagtctggagttttttcattgcctttcatggagcgtgctatgaaaaagcgtgcagatgcaacttatgaggaaacacggctagattatgaagaattggaggaatccttaaggaaattggaggatgacaacaccgaggagaatgtagattcaatgaaggtgacaggtaaaagaacttttgggcctgtgaaaagggcacatgaagaggcaaacaagaggccaaaattaggtgatgctgacaagaacagtgacagtgagtatgactctgactctggtcaacatttcgacagcagtgaagtaaataagaaggcagaatatgcgaataacaaggcagatgatgtccaacttgggactgcactgctcgacgatgaacaacagaatgatctatacgttagctttgatggtactagaaaaagcccaggcccaaagacagacattgaagttcgaatgttagcggataattcgtggaagaaggtcaaaaatagcaaaacaaatggtggtaacaatattaaagagagtggcaataactccaaagtgcagatcccttctgtggattcaaaccctaagcctcacaattctgattcagattctgaggaagagatggttgacggtttcttgact

SEQ ID NO: 34050 - DNA, 653 bp, Triticum aestivum
  Clone ID: PAT_TA_34050
ctgtgcggcgctcaggcggcgggccccgcaatcgctggagagctcgcgaatctgctcctcgtcgccgtccctgcccgccccgatccgtccgccgtccctccccgtccggctcccgatggcgcggttccggttgcactggctggaggccatgctgccgctgggcatcatcggcggcttcctctgcatcatgggcaacggccagtactacatccacagggccgcgcacggcaggccgaagcacatcgggaacgacatgtgggacgtcgccatggagcgccgtgacaagaagctcgtcgacaagcccgccgccaactaggatattgatcagcaattgatctttcttggatgttgacgaagctctttcagaagctcagaaatactgctgtgtagtttccttgtatcaatgggaaactggggcttctgtttttgtttttggtttcccaaccttggatgaataatgtgtacctaaagttaatcaaacaaaatatggttcccttgcaaattatttaccctttccctccttgattgttcatgaacaatgtgtgatgtttgttgtatctattatggatttttatatggatatacttaatctacctgttcatgagatccaaaaaaaaaaaaaaaaaagaaaaaaaaaaaaaaaaaggccccta

SEQ ID NO: 34051 - DNA, 1839 bp, Triticum aestivum
  Clone ID: PAT_TA_34051
ggcacaagaatactgatactattatttaaataaatggacagatattatatttagtaaatgtcatgcattacagtctggacagtaatgataaagtggggttttctcatttctagcaagtgacaaaatgtgacagctaaaggtagacggatcaaatctacattttctatcttctttgttagctactataatctgcctctccacaggaggcactgtacgacaagcccgccctctacaatattgctgtaaaaattacaaaatctccttcccctgcgcgccgttaggaagaagtcccgcggcctgacaaaatgatgtgtattcggaaaaacccatctgtctcatgaaattccacacctgtgctccaaaaatttcaagagacaagtttaatctcttcaacgtgcccgattttgtatgcatcattcttcgtcgtctgctagcagagcaaatgagaatggtttgaatttgtagccatccccatgatagaacttgttcatgaactcaacccagtgtagacgcaatgcatgaagaaaggcgctcagtgattccatcccgagcgggactccggttccccacccgcaaccgctagatagctcgcgaatctgctcctcgtcgccgtccccgatccgtccgtcgtctccccgtacggcccccgatggctccgttccggtttcactggctggaggctccgcttgcgctgggtatcgtcggcggcgccgtctgcaatatgggcaacggccagtactccacccacacggccgcgcacgacaggccgcagcacatcgcgaacgacatgcgggacctcgccatggagcaccgtgacaacaagcccggtcagacacgtccgccgcaaatcagcatatggatgcaaccattgagctttattggtgttgacaaagctctttcacgaagctcagaaatactgctgtgaatttccttgtatcaatggttaaactgggtcttctggtatcgcttttggattcccagcgtcgtgttgttgtatctgtaccaaaatttgatcaaacaaattgtgtttcccttgcaaatcatgtatcaataatgagtacctatagttaatcaaacaaaatatggttccctggctaattatatacactttccctccttgattgttcatgaacaatgtgtgatgtttgatgtatctattatggatttttatatggatatacttaatctacctccgcaaaaattcaggcagtagcaaaagcaaaaactatgagccccactaccttaaagatgaggctgtcatacccccatgcaaatagcagcaacttctcgtagaagactgttgatagctcagaatgtgccaagctcaaggcccaaagtcgaaggtatgatgcagtatttgagacagccccgagaacaaactcgatggagtgtatcatttgatgcacaaaaacttcaccaaaattgaaatcatcatgacgtgaacgggcagagtccggttcagaatctggatccatttcagatgtcccaaggaagcgatagctgtgaccttgaaatctctccttatgaagtttctttagaatgaaaggctttgggaagagcatccatggaacagctactagggccagaagcaacaaaagtatctggagttccttctgtccccaaaaaagttgattctctccaagatctccagcagggtcaaggaacatatatatcatcacgtgatacagatcggctttagatcccgtgcaccacttaatgagaatcaggagtgataagtaaccaaagaggctattcagaaaaatcagctgcggtatgaattggtacctgatgtctaggcctcgtgccgggaactttgcatcaaaataactcaataaaatt

SEQ ID NO: 34052 - DNA, 1957 bp, Triticum aestivum
  Clone ID: PAT_TA_34052
ttctgttctttggtttctgtcgcgccggcaggtgcgtccccctctctcccttcctgttccctcttccgggctgtccatcccggtccccaccgagcagctgcacccatctctggctcaggtgccgctgccgccctcccccccctgggctcctccttggctccttcgctggcgggttcatccctccgacgctggcctcccccccaggattcacaaggactttattcacagaagcccaaatccacctataacttagtccagttaacataacatgtcttacaagcattcatgattaagctgaaaggggcttttcgcagacaagagtgaaaaccccagccatgaaaatcagggggttttctctgtactgtcggcacatctatccgctaaccgcaaagcaaaagagttactactgagtcaacttactagacaaattcaaaagttctctcaagtctagcatatgatgggtaatattagcgatggatcatctactgcggttacaacaagacacagtctttattaaaacatgcatccttgtcgaggtaccctaacgatgagcgctacgaggcttatgtaagacctgaactaaggattccttcttatttgcactttgggcagttgttgcttatttcccagatggagttcactggggagggaaccagccactgctgtagagcttatctgatggctttggcattggcattggcagcctgacacggtcgacttggccatggttcttccgagcaccgtcataagtggaagacgaacaattgggcggcacggtccctttgttcaagtcctgtggtggaaggaagtaatttgcaacagctacgttgttgtcaaggacagggatatcacctgtaagagtcctgaatgcaaactccaggcatgggtctgaccagatacttcgaaacagcgacgacagggaatatccgggcatagcatcagctgttccgacaagtccgttctgttgcggcggagcatgcgcattctggcatccaacgtctgttaacgagcatgcagcagatgctcctagtatttgttcaggagccgaaggatacttgtcttcagcatttccagaagtacttggggcatgtgctccatctttattctgaattactggagaggaaattgcctttgacttaggatttttaacttgctctgttggttgtacctgatcagcgatatctgtctgtgcgtccacaagtgggtctctaggtacattattggcttcctcgttccttttcagcgcagttaaacgaggtgacgatcgaacaggtgcagcaatctgtttcacgggttcagttttttgcttctttcccttgggtttcggctctacatttgcttcttctcttgcagcagattcatggttcagacgctgatcgttctttcttgccacctgaagctccaagtctgcaagcctccctttggagacaccctcgggctctgatgatggccgtccagcatgttgagatttgttccctgaaacctgcaggtcctcaattttcttcttctttggtgtcacaacactatcactggtatcttgagattcgagatagtggtgaacttctttgagagaacgaaattcgtagctatttgtaggatcaatgtagaacttgtccctcctgaacctagatccaggccgaggctttctaggcctgtactctttcagccaaccatcaggtaacccctctccggcaggctcgcgtttcgtctcaaccatgatcccgtttgggcagtgcaggccacaggatcctgtcaggctaaaacatccttgttaccggccaaggctacggtgcggtggccatggagctccgggtggttggggagaggaggagacccgggagggagggagggagaccggagaatgacagcaggaggtgcgcgaggaagaccagcaaggagcacgacgcactgggggtcaggagtagtaggagtcggaggaggacagcagaggcttccc

SEQ ID NO: 34053 - DNA, 1209 bp, Triticum aestivum
  unsure (1)..(1209): unsure at all n locations
  Clone ID: PAT_TA_34053
ttttttttttttagttgcagcaacggnattttgtatccattcaacccccttttttctttccgggttttacaatcctctgttttactcttgaagtacaaaattacattggcaaactacacctagcaacaaccgccgaaaagggtgatgatagtagcacctatcacactgcgagtgaaccatgctgaatacacgcacaactttattcatatctactatataaatcttgcggccggcacagcaccacactatacgccggcttgcagaggaaattcggaagaactggtgcgagaaacaacataccgtcaacctcaaagaaacaacatacagtaacgctacgctactggcactggcaggcaatgaaccgttgggagacagactcgggaggctaaggaatggactggggatcgttcatcccagcgagaaacgcgacgaagatccacaccatcaggaggccgaccaccgcagcccttatcgcgttctcgcagttgtaaggggatggaagctcctccagttcctcgtccaagtccatgtccgagactggtgatctggagccggcgctggtaaggctcctgctcctgctcccctcccctgcctggattagtgaactgtcgcgaggcttcttgcatcgtgagcagttgcatttgccaccaagaaaagctggcacaatctgtaagaactcggctaacgtcttcttgtacgattctccctcgaaacgcagcttctgctttgtggatggtttcaggagttgaataaaagtctgtgcaataactctgacaactggaggaagacggacaacaattaatactccaagacgatttgggtagttttcttgaaccaagttgacaagcgacctcatcatttgcatcggaaatttgaatggagaaatcccgtggcaatccagcaaaacagtaattcttggatcttcttcgttggtcaaatgtataataccatggtcaatctgagaaactactgcttgcccaaaacaaggtctatcacgaggggctatgctagagcacgcgagtccaagacggattactaagcaaggccgaagtgtagtgtcaaacccatgccaaaagaccaaatgggaccatttctcaagttcttgcaatgtaagtatgtgaaaagtttccctccaacggattgtcttcttaactgaagagaccaagattgaaaggtcaccatttgctgccatgtggaatctgcgtagtt

SEQ ID NO: 34054 - DNA, 444 bp, Triticum aestivum
  unsure (1)..(444): unsure at all n locations
  Clone ID: PAT_TA_34054
acacaactcgcatgtttatttgcacttatgcacgatacagtatatactacttgatacacatttacacaaccgcatgttcgccgttccacactgaaagatagtcagagctagctgcccatgcatgtatgtgttatagagattacacatgacatgtgtcatgcatgtttgtttgaccaaacatgcagacactccgtatacgtacttaccttgaaaaggcgctagctccatgcacgcgggcatgcatgaggatgcacccagtgttacagtggtatctggtatgtaccgaggtgctaatcgatggaggccggcgatnatgaanggcactgggaacgaggacgnactgcttgcgcactggttgacaanacnagatgggaacgggaacacaacttgacttcaacncttggcttnatggngggcaaaggcaaacccggttcaaggccggca

SEQ ID NO: 34055 - DNA, 785 bp, Triticum aestivum
  unsure (1)..(785): unsure at all n locations
  Clone ID: PAT_TA_34055
tttntaaacaaccatattggttcaaacttaattcataccaaaccataccagataactgtttcacacatcatggggactcgatggtccatcaaaccagattcggtagacttaatacgaacaagacacatgactaacagcagcaggtccaacgtcagggcaattactgaccaccacggaggcggagcaccaggtggagggtggactccttctggatgttgtagtcggcaagggtgcggccatcctccagctgcttgccagcaaagatcaggcgctgctggtcaggggggatgccttccttgtcctggatcttggccttgacgttgtcaatggtgtcagagctctcaacctccagagtgatggtcttgccggtaagggtcttcacaaagatctgcataccaccacggagacgcaggacaaggtgaagggtggactccttctggatgttgtagtcagcaagggtgcggccatcctccagctgcttgccagcaaagatgaggcgctgctggtccgggggaatgccctccttgtcctggatcttggccttgacgttgtcgttggtgtcggaggattccacctcaagtgttatggtcttgccagtgagggtcttcacgaggatctgcatgcctcctctaaggcggaggacaaggtgaagggtggactccttctggatgttgtagtcagcaagggtcctgccatcctcgagctgcttgccagcaaagatgaggcgctgctggtccggagggatgccctccttgtcctggatcttggccttgacgttgtcaatg

SEQ ID NO: 34056 - DNA, 1119 bp, Triticum aestivum
  unsure (1)..(1119): unsure at all n locations
  Clone ID: PAT_TA_34056
ttttttttttcattcaataccagatagttgtttcaaaaactacaggcacttaatggcccaaaacgagcaactagttccacgtaacacgaaacacacaacatcagggactcaacgtccatcaaacccagataaagaagacttaacacgaaacaagacacaggactaatagcagcaggtctaacgtcagggcaacttatcaacaactacggagaccagacccacccacttctaggggagcagtcgttctggaaaccctaatccgcaagagtgagcccaaccacgggctgggcgaacgcaaagatgggccaactgctggtcattaagaatcccctccgtgtcggggatcctggggttgagggtgtccatggtgtcggtggttgtcgccacaagtgtgacggtcttcccgctgcgggtcttcacgaagaactggatgctgctcctaaggcgggggtcccgttgcagggtggactccttctggatgttgtagtcagcaagggtgcggccattccccagctgctggccggcaaatatgagtcgctgctgggacggaggaatgccctccttgtcctggatcttggccatgacgtgatcgatggtgtcagacgactccacctaaagggtgatggtcttgccagtcaacgtctgcacgaagatgtgcatgcctccacgaaggcggaggacaaggtgacgggtgtactccttctggatgttgtagtcagcaagggacctgccatcctcaagctgcttgccagctaaaatgagacggtgcttgacgggagggatgccctccttgtcctggaccttggccttgacattgtcgattgtgtcagacgactcgacctcaagggtgatggtcttgccagtcactgtcttcacgaagatctgcatcttgaggcggcgggggaggaggattcgacgagcctagggttgatcggcgacgagattggttggggatttttcgttcgttccgtactgcagcctcaagggtgatggtcttgccagtcaatgtctttacaaatatctgcatttccccgaaggcggaggacaaggtgaaaggggggactccttttggatgttggaatcagcaaggggtcctgccattctcaanntngnttgcca

SEQ ID NO: 34057 - DNA, 1045 bp, Triticum aestivum
  unsure (1)..(1045): unsure at all n locations
  Clone ID: PAT_TA_34057
tagcgtggtcgcggccgaggtacacgcatggaacatttgttattctttcgatggaccggtctcctcaccgtatgtgtgctacaaaaagcttgagacagcccaatgcagtgctgatatggaacagtgccatatctgcttaactgaatatgaggatggagatcagataagaagtctcccatgcaaacatgagtttcacctgcagtgtgtcgacaagtggctcaaagaaatacacagggtgtgcccgttgtgtcgtggggacgtctgtgaaggtgttgttgcctcatgaagaccttggcaccggcttaccccctcaaggcgcctcttgaagacggtagcgccgccacatctcttgcagccatggacgaagctgttgagggttggtctggacccgcgctgattccccattgctgaaacatgcgatttcaagcattgattcgacatgtcaagttcccagaatataacaaagacctgtcctgagacagcccaatgcagtgctgatatggaacagtgccatatctgcttaactgaatatgaggatggagatcagataagaagtctcccatgcaaacatgagtttcacctgcagtgtgtcgacaagtggcttaaagaaatacacagggtgtgcccgttgtgtcgtggggacgtctgcgaaggtgttgcctcttgaagaccttgggcaccggctcacccccctcaaggcgcctcttgaagatggtagggccggcacatctcttgcagccatggacgaagctgtttggttggtctggagagggctggttacccattgctgaagcatgcgatttcatgcattgattcgacatgtcaagttcccagaatataacaatgacctgtacatatcttttgtagccttatcccatgtatgacatcatgtacatatgtgcgaaaatttgatccgattccaccatattcgagatctatatgtatcccccatgtgacaatgatgaatccaagtcaatctctccatcnaggaggagacatatttttaatgtagtatgaattgtgccttcaaaaaaaaaaaaaaaaa

SEQ ID NO: 34058 - DNA, 584 bp, Triticum aestivum
  Clone ID: PAT_TA_34058
gtgcagcagcatttcaattcttgcggaaccgtcaaccgagtgactatcctgaccgacaagttgggcagcctaaaggttttgcttacgtcgaatttgttgaagcagaagctattcaggaagctgtcaagctgagtgagtcagagcttcatggtcggcaaatcaaggtagcgcctaagcggactaacgttcctgggttgaagcagccccgagggggccgaggattcaacccatatggcggccacccttacatgaggccatatcctccaccgttttacaatccttatggtggttatgggagagctcccaggttccgccgtccgcgcaggcccttctactaagttctggctctactggagttctgtcaacacatgacaacactagtcttcgatcgatctcaagccagtcagagaactcaaatccttacaccgtgtttcattattttcacagaaggatatgtgatggttgttgtgtacgtgttgtgttgaaagatgtttaagccactacatgcatcagcaattcagcattatgtactatttgactttagtaatcaagtcatacgacatactatgcttgaactgtattat

SEQ ID NO: 34059 - DNA, 976 bp, Triticum aestivum
  Clone ID: PAT_TA_34059
acgcccgcgaccgaaaaaaatcgccctcgcgttaggttaggccgaggcgagtagattgggtttctagctcacgcaacgcggcggccatggaggacgaagagcacgagggtgtacggccaggagatccccgtcgacggcgaggacgtcgacatgggcgccgggggcgacgacgccgccaagctgcacgagctcgacgagatgaagcgccgtctcaaggagatggaggaggaggccgccgccctccgcgagatgcaggccaaggtcgccaaggagatgcaaggcggagatcctaacgcgaccacatctgaagcaaaagaagagatggattctcgttctgtttttgttggaaatgttgactatgcatgcactccagaagaagtgcagcagcattttaattcgtgcggaaccgtcaaccgagtgactatcctgaccgacaagtttgggcagcctaaaggttttgcttatgttggaatttgttgaagcagaagctattcaggaagctgtcaagctgagtgagtcagagcttcatggtcggcaaatcaaggtagcgccgaagcgaactaacgttcctgggttgaagcagcccccgagggggccgaggattcaacccatatggcggccacccctacatgaggccatatcctccaccgttttacaatccttatggtggttatgggagagctcccaggttccgccgtccgcgcaggcctttctactaagttgtggctctactggagttctgtcaacacatgacaacacttagtcttcgatcgatctcaagccagtcaacacagaacctcaaatccttacaccgtgtttcattatttcacagaaggatatgtgatggttgttgtgtaatctactgtgttgtgttgaaaaatgtttaagccactacatgcgccttatgtactatttgactttagtaatcaagtcatacgacatacaaactacctgcctgaactgtattctcctgcgt

SEQ ID NO: 34060 - DNA, 490 bp, Triticum aestivum
  Clone ID: PAT_TA_34060
catcgattagcaagcttcctatttccttattcactcgagggtgaaaatgggcagtccatccatcatttccggcccaaagtacaccagggttaaagtccctattttcttacagagagttgatttggtcgcgtaaatacatcgattagcaagtctccctaaactgcggaacgatctatgaacatcccaattgcccgaaacacaaatggcgcatgctgcatgtcaccagcagcaaaacatctgcatcatcaggaaaaaagaggcaagaaacatcagcaaagcatctgactcaactctcaggtctcaagtctcaccagctagcacttccagtgtcactaaccttccttctccagctccggcgcgggcgtgggcgcttggcgcggcccgaggcgagcgcgaggacctccggccgcagcagcacgagcggggaccagaggccgctcctgtcgtagtcgaagccgaactcgctggcatccatgaacttgcccagcag

SEQ ID NO: 34061 - DNA, 506 bp, Triticum aestivum
  unsure (1)..(506): unsure at all n locations
  Clone ID: PAT_TA_34061
ggtccgagattaccgggtccacccctgggggctacacaacattgctcaaatccacatgattatatttacaaagtacctgctcattattgcataatgacccgacccttgggggctacactagttgaagttttgagtataagacaattacaagtcccaggttgctgcaagcatgacaacccggcacttgggagctacataatatggagtattcaggttttactaagtgactgggatgaacaacatgggtttcttcttaagtggcagtatttatgttgaagcaagtcttaagccatcactttgttctactcaagacttgggggctacaggtattataatattatcgaagaaatattttttcagactctgttttgagcaaaccagattgaaccggtgtctgcaacaatcatgccccggaattatcagtttttataacccgacaatggtggtaatcataaaccggcagttttacatcttcaagccggctggnnatcagttgaaaattccag

SEQ ID NO: 34062 - DNA, 675 bp, Triticum aestivum
  Clone ID: PAT_TA_34062
taggggccttttttttttttttttttgatcataagacgggtgaaacctgtttattactcttcgtcgcaactcacaaacatctcataattttacatcaacaaccagaaacaccacaacagaataaccggagtcaagtgggtttcttccaaagtgaaatcatgttatttgacaaccatacacccatgacagcatgtctgatagtcgaagtttttgtgccccagtttcatgaatcttttgggcggatcgtagtatcatgcagaagattatctgagtacaaactatatggagcaaccatggtccacctgtttattcttgccttctgctgcgagctatctcccgagccctttcacgaagttcttcgggcggtggtggtcgtgggccttctggagggtaaaccacataaggacggaggcccatgagcttcttgatggccttggagtcggtggcgacgaggtaggtgagggtcacggggacggcgacgtacaccccgaacttggcgatctcgaggatccccttggacgtccccaacgacgacatggccgtggcctccaccctctctcacttcccttccctctttccaatctcaggaatctctcgagcggtggcaatggcgacgacacgcacacagtagataggggcgttccttgctctcgctcgtgccgaattcggcacgag

SEQ ID NO: 34063 - DNA, 785 bp, Triticum aestivum
  Clone ID: PAT_TA_34063
gctcggccggcccatgtccggtgaaatggttgagaacaggaagcagatattgagcagggtcttcctcaaaagcctccagactgatgacactgtcttcaggaaggtgtctcgatctgtttactgcgcgttccgtgcagtcgccctgggtggcaacgggacgaagggcaggaaactcgccgaggcggccctggggcgcatcggagcgacaaagttgaccgaccgcgtagtgaaggcagcggaagtgctgatcagagtagcaacaatatcagagcaggttcatggcccgtggtacagtcatctcctgtaaatgacttgatttgttttgtgaatccgtggtgctgtgtaaacagggtgggtgatcgtagccgctggggcgcacatcgccgtgcatcccccggtggaaaattctgcaatagttttcttctacgatcactggaacagttcttctgccctggcccggaccacgccctcgctgctctccgcccgcgtcgtctccgccgccccggtgctggccagtgcaaagttgagtcacttattttgagatgatgggcgtactattcttaaaaagttgatccccactattagcatttctctttacatgcatgttctgccccgggtgggtgatcatagccgctgggtcacacatcgcgatgcatccccggtggaaaattctgcaatagtttttctctacgatcactggaacagtccttctgttttgtccgtgaccactcgctggcttttctgcacagttatctactcctactattcttaagaaaaaaaaaaaa

SEQ ID NO: 34064 - DNA, 1242 bp, Triticum aestivum
  unsure (1)..(1242): unsure at all n locations
  Clone ID: PAT_TA_34064
ttttttttttaaaggcacggctcaaacaagaccggcaaagttcatttctgtgagacaacaaatacctcaatttagggttccacacgtgagacactgaaagagtagatggcgcacaacctctgaagatgcagtcgtgtaaaacatgccagatgtgatacttgccacatgtttgataattcagtgaacatgaagcagttcacagtcacgcacaaaaaattcagatcatcatgcttacactcagtaagcccccgctgagctttcataaccattcaaaatgtttcaaacacgttaagaatagtgactttctctacgattgacttgatagttcacaagtatccatcagcgtgttctggatcaaggagttatggaagcgctagcctctcctgttttagatttgatatagcctaaacttctcagcttctctacaagtttcctctctgcagcagcctcaagcatggggctgtctttcggaatgttacatgctaaaattacatttagacctgtcttcagcactaagcggcgggccatgcttgatccagtgttatcagatgttcctccaagtacagatgtgacactcactccatcacccagcctagtggttgcagcagcatataaatggccaaactttgctgagttgttgcatcctatccatgcatagatctgtttagagaaccttatgatctggaaatggagcgtgacgtcgtgcaggtcctcactgaaacaagtgacctgcgccccaccttcagaagacagatcacctgaagaaccgatttggctggccatcggggcctgcgaagccaccgccaaatttgacaagcttgttgtgagctcctctgaagacatgatgccggggcggatctgcagccgctgaagcagatgacagagaggcggtagcagtagcgaagcagtagacgatgcggagacagtggcctcgtcgcgaagaggtggtggtccccgggctttcttgccggcggcggcaaggcggctagtaggaagtcctcaggatgaggggtggcggcggagcggacaggctctggcgacggaggtgtatgtgggggcgggagcggccggcgggggcggagggacgcggtaccgcgccggtgccagcagctggccggcggcgcaggggacaaccctaatcgccagaagaggaaacacgggtgcgccgcccgcccccaccccgcgcgggctccggccttggcgcccgtcgggcggcttgaantcgagcttngcggaattcaa

SEQ ID NO: 34065 - DNA, 1379 bp, Triticum aestivum
  Clone ID: PAT_TA_34065
agaagatgctcagcttctgctaggccgccgctcctccatcgtcaggtatggatttcgggaggtcaaatgagcagaggctgctgctggccaggagcaagatgcccttcacaccttcgcagtggatggagctggagcaccaggccctcatatacaagtacctcaacgcgaaggcccccataccctccggcctgctcatctccatcagcaagagcttcagaccctcctccgatagaatgccctggaggcctgtctaccaagggttcaccaatgcagattctgacccggagcctggaagatgccgtcgaacagacggcaagaaatggcggtgctcaaaggaggcgatggccgagcacaagtattgtgagcggcacatcaataggaaccgccatcgttcaagaaagcctgtggaaaaccaaacaaggaagaacgccaaggagacacctgatgctggctcgatatcggccgctgtctcacatggtggctgtaataagaaagcaaaagctggtgatgaactgaagccagggagcgtcagttattggacagataatttaaacagggcaatggtgagcaaagccaggggaaacaaccctgaagaaggcaacagtgctccactcctgaattctactaatcaacaacacacattgtccttgttctctcaactgaagcaacagagcaaaccagataagttcagcccggcagtcgatagtgaatcgatctcctcaaatactgtattgaagccttgggaaagaagcaaccagcagagcagtaaggacgtttcttccacgacgctccatgatcgcgggtgccttcaatcagtccttcaagatttcagcatgcataagaatgacaagatcgagtctcagaaaatcaatgcttcagtgccatctactttctattcatctacagaaggtcgacacatcagctgccttgcatctaacatgatgcaagtgcaggaggattgcatctcaagctcttgggagatacctcaaggtgggcctttaggtgaaatcctaacaaactccaagaacactgatgacttgaccaataagtgtgaatcaagatcatatggttggttactgagtcttgatgaacatgaaatgtgagctcgggagagctagacatggcaaaattcaccatggaagggaacaatgctgatggaagcaggatgaagtagcttagatgtgtgacccatccatgcttgttcttctctccatattttcaatcttctgttttgtaatatccagtagttgcaacttttagtgtttaggaatctggctctatcctaaaatattatggcttgccttgtatcaagcttattagctacatcttttaacaggtaaactataaggattcattcttcaaaaaaaaaaaaaaaaaaa

SEQ ID NO: 34066 - DNA, 1263 bp, Triticum aestivum
  unsure (1)..(1263): unsure at all n locations
  Clone ID: PAT_TA_34066
accggccgcactgcgagcgagtactgctgcgattcgcgatgctgaggaggacgctgccgaggctggcctcggtgaaggaccgggtggccggcgcggccaagagcgccgtgaagggcgacgagcacttccccgcgctcaagggccacccggccgcgcgcgtcgacgcacgagaggccgcggagaagcaggccggcctcgccgcgggcgaggaggagaagaagagcggcggcaaggccgcgacggtgaaggagttccagatataccggtggaacccggacgcgcatggccggccgttcctgcagtcctacttcgtcgacctcggcacgtgcggcccaatggtgctggacgtgctccagatgatcaagtcggagcacgactcgacgctggcgttccggcggtcgtgccgggagggcatctgcggctcctgctccatgaacatcgacggggtgaacacggtggcgtgcctgaagcccatcgacaccgacacgtcgacggcgacgatgattacgccgctgccgcacatgtacgtggtgaaggacctcgtcgtcgacctcaccaacttctaccagcagtacaagtcgattgagccgtggctgaagacgaagcgtggggcgccggaggggcgggagcacgcgcagtcaccgggcgagcggcggaagctggacgggctgtacgagtgcatcctctgcgcgtgctgcagcacggcttgcccgtcctactggtggaactccgaggatttccttggcccggccgcgctgctccacgcctaccgctgggtctccgacagccgcgacgactacggggaggagcggatccaggcgctgtcggaggggtgggacaagctgtacaggtgcaggatgatcaagagctgcacggcgacgtgccccaagagcctcgacccggccacggccatctccgccttgaagaccatgcaccagctccgcaaggcgtgacaccacggcacgaggagcccgcacagcgatgtcaatcggtggctccggcagctgaatcgcagcgatgtgactcgcaacctgtgtagcctgtgttgatctggaaactaaataatgcctaggtaattgttgttgtaatggcaggtgaatcacagcgatgttgattgcaggcgcaggtagtgggtttcctgttagcaaaactcaaaaaaaaaaaaaaaaaaaaaaaaaaaaaaaaaaaaaaaaaaaaaaaaaaaaaaaaaaaaaaaaatgaaaaaaaaaaaaaaaaaaaaaaaaattaaaaaaatanaatatt

SEQ ID NO: 34067 - DNA, 783 bp, Triticum aestivum
  Clone ID: PAT_TA_34067
gcacgaggagcatttccatttagcgatcgagcaacaagccaattcgtcacagtgatcaaggagtctgagattgcctagcagctgcaccgacgttcgtgcgacgatggacgcgccggccatgctcacgcgcaagcacgtccccgagaacatcgccgctgagggggagggcgggcagcaacagatgcaccgggacgagaagcagcacaagccggtgctcaagaaggtcaaggacaaggtgaagaagatcaagaacaccatcgccggccacggccacggcaacggcaacggccacgatcacgatcacgaccaggacaccggtggcagcaacagcaccgacgaggacgaggaggatgcggccatgagggaagccaaagtggagaagggcgggtaccagcaagacgtcgaggacaagcccatcttcgcagactccagccccgagctgcacggcgcacccatgtacgactcggagaggatcccggcggcggcgaaggaggtgaagcacaacgacgctccgggggtgcggttcggtgacattggcggcccggcagcggcgcatgaggtgaaccgcgaggacgccgcgggggtgcgggtcggcgacttcggcggcccggcagcggcgcatgaggtgaagcgcgacgacgccgcgggggagcggctcggcgacttcggcggccgggcgtcggcgaaagaggtgcagcgcgacgacaccagggggtgcggctcggcgatctcggcggccccgtcgtcgaggacccggccgcgcccgactcgaggacgcccatg

SEQ ID NO: 34068 - DNA, 971 bp, Triticum aestivum
  Clone ID: PAT_TA_34068
aatgaacttgtttacaaatccagggtcagtcaaatgcccaaactcgttctgctcgtgaagagaagaagcctgtagaacctaatgaggtgaagcaatctagacctcagaagatgatggacttccgcaatataaagataagccaggtcgaattgcttctcacgtatgagggattgccatttgctgttagtgatgtaaggctactcatggatacctttcatcgtgaagattttactgggacatggccaagactgttttcacgagtgaagaaacatattgtatggggagtactgaagtcagtaactggcatgcagggtaaaaagtttaaagctaaatccactagccaaaaagagccaactgcaggattaatcgctgccagtgatttaaatttgagtgacagcgatggtgatgaaagtgggaactctgatcaactaccagctttccttagaaaaccaagtgatggtgctggtgatggatttgccacctctgtgaagggattgttcagttcacaaaaaaagaaagcaatgcattttgtcctgaagactatgaaaggagatggtgatcaggattttcagggtgaacggagtgagaatgatatcgagttttctccatttgctcggcagttgactataacaaaaacaaagaagcttataaggaagcacacgaaaaagttacagtctaaagttccccaaaatgcaggtaatcagcaagaacacgggtcagagttgccaccgcgcggcccttctgggcaccatatggactcgtcgtcctcctcctcttcatcctcttctgacaacgatgagccatcgcaggtggaaatgagcccgaaagattaggcagcataggcgtaggcgtggacgattctttggtccagtaaaagctggatggatgcttctagtttgtggactaaaacagctgcgcctgaataaatgctttaatccaggagaaatattgttgacgcatatgaagcatct

SEQ ID NO: 34069 - DNA, 727 bp, Triticum aestivum
  Clone ID: PAT_TA_34069
ggttcacaagatctggcccagaagacaagaagcgctccagcttattactggagttcatgggtagctatcttgctgagctgagtcttctggactacagctgtctccggttcttgccatcagtggttgctgcttcatcactttttcttgctagtctgaccattggaccagacactaatccttggggcaaggaaatgcataaactgacaggctacaaggcatcagagctgaaggattgcattatagccatacatgatttgcagctcaatagaaagggtccatcattaccagcaattcgagacaagtataagcaacacaggttcaaatgtgtatcgatgttgcttcctcctgtcgagatccctgcatcgtacttccaagacttaacagaatagttgttcctggaccgctccactgtaaagctaataactctgagctcatcttgagctccttgtgataagggagaattacagtttcagagcaggttctcagacaagttagaatgctggaagctgtttagatgcttgaggtttaaaagcttaaccaggagcttttcaaattcatttaggagctaggtttatcacaagtaggaggccaggcattctcttcttttgtagaattgtacttctgtattatatcttagaacaatgtgccttggtctgtttggccacatatctgtaatgtttgatatatgttcatccattggctttgctgatttttcttcttctttcgt

SEQ ID NO: 34070 - DNA, 562 bp, Triticum aestivum
  Clone ID: PAT_TA_34070
tggacactcaagaagaagctgaaaaatcagtattggaacccagcgaggaaatctgaaagcatagccgtggtttaagaactggtccgctttatattgcagtttttaatcaaaaggattgtctcgaaacaaatgaagcttacgatagaggaaattgatgtcaggagcactcttctgcccccttgctgataaatcagtgttgtgaccagcggggaaatctgaaagcatagaccatgtttaagaactggctgtttttgttgtgctatttttaagaaaaaggatttgtttcgaaggaaatgaagcttaccaacaaggaaattatggtggtggggcacttttttccacccttggcaatacagagggacctcctaatgacacacgatggaaacggatccgtggattaattcagatggcattaattggggggaagggatctagctaggtttgcaatggcatgtgtactaccaaaaaataacatcctcaggttctctcctgcaaatctaaagaccatgttcgcaggggtaataaatgtatttgggttaaattaaaaaaaaaaaaaaaaaaa

SEQ ID NO: 34071 - DNA, 1075 bp, Triticum aestivum
  Clone ID: PAT_TA_34071
tcgcggccgcgtcgacacccgcgacctcgccacgcagacgctcaagttcacccaccagctcggcaagttctccgatctaaaaactggcctaattgttggtggaggtagtatggagagtcagtttgaagtattggctgataatcccgatataataattgcaacacctggtaggtttgagcacatcttgtcatcggctcgtggcttgtcactgcgatcagtagaatatgttgtatttgatgaagcggattccctctttagcttggggttcgctgagcagttacacaaaattctacacaagttgagtgatacaaggcaaacattgctcttcagtgctactatgccgaaagccctcgcagaattcgcaaaagctggcttacgtgatcctcaagtcataaggcttgatttggacaaaaagatcagccctgatctgaagcttgcctttttcacactgcgtcaggaagagaaactagctgctttgctgtatttggtccgggagcgtatcagctctgaggagcagacaatgatatttgtttcaacgaagtatcatgtagagttcttgaatattcttttccgagaagagggcctagaagcttccctttcctatggtgccatggatcaagaagcccgcactattcacatttcaagattcagggcaaggaagaccatgctacttatagtgacagatgttgctgcaaggggtctggatattccattgcttgataatgtagtgaactgggactttcctgctaaaccgaagttatttattcatagagttggccgagtagctcggcaaggtagaactggtacagcatttacatttgtcacttcagaggacatgccatttttactggacctacatctctttctttcaaaacctcttagacctgctccaacggaggaggaactgctgaaagacatggatggaatgaatttaaaaatcaaccaatctcttgctgatggggaaacgatatatgggcggtttcctcagacaatacttgatctttgctctgatggagaaaaaaagtcatcaatggagcacagatctgattgcattggaaaaaccatgcgctaatgc

SEQ ID NO: 34072 - DNA, 580 bp, Triticum aestivum
  Clone ID: PAT_TA_34072
ctttttctctatttgccatgacaagataggaggagtggaggaggaggaggagcagcagcggcggcagcggcattgcagaagcgcgctcagagagagctcgcgcgcgggggtatccgggaatggtggcgatctccactgattcctctcggatctagagcggcagctcggcctttccgcccccactctttctctcgccttcgtcaccgccgccggtgtggtgtgagggcggccggagagcggggagatggcgtccaaccgggggatggtcgcggggtcgcacaatcgcaatgagttcgtcatgatccgccacgacggcgacgcgcccgccccgggtaaggaggtaaaaggcgcgggtggtcagggctgccagatatgtggtgacactgttggtgtttcggccaccggtgatgtctttgtcgcctgcaatgagtgcgccttcccggtctgccgcccttgctatgagtatgaacgcaaggatggggtcaaatgctgtcctcagtgcaggaccagatacaagaagctgaaaggtagcccccgagttcccggagatgaggaggaagaagaatgttgatgacctgga

SEQ ID NO: 34073 - DNA, 840 bp, Triticum aestivum
  unsure (1)..(840): unsure at all n locations
  Clone ID: PAT_TA_34073
gacgacgaggtcgccgccgtcgaccttgctgtggagcgaagggaaggcgaggcgggagagggcgaggacgaggccgccgccgtccactccgccgcgtcccaggagatcttccgcggaagcaagctgtttcaggtgtacgtggtgatgggcaccacggtggggctgttcctgccgctggcgcacgtcctgggtgggttcgcgcgcggcgacgatgccgccgtgcgctccgcgacgccgcacctgttcctgctctcctgccagatcctcacggagaacatcgtgggctcgctcggcgtcttctcgccgccgctgagggcactggtgccgcttctctacaccgtgcgccgcgtcttcgtcatcgtcgactgggtctatgacgtgtggaccaacaagctcatcacccgcaccgcccccgttcaggataaggcctgggtgtggttcggcaggtacctcgcggtggcgaacttggtctacttctccatcaacctgttcgtcttcctgatacccaagttcctcccccgcgcgttcgagaagtacttccacacgcgcaacgaggtgtacgccaagacggcggaggacaagcgagcaagggatctgtcctcgctcgatgatgacagtgcggcaaaatcggaggtctccaagaaggccgactgagatcgatgatcgtgttcgttgcgcggctgcgctcgtagtgtgctctgtagcttcaacgttgcttacctgtatgtggaccggnggttgtacatttgggtcttcgcttctcatttctgaaagacccggtgaatgtagtactcccttcggtttcacataattgaaggtctagatttattttaagtaang

SEQ ID NO: 34074 - DNA, 920 bp, Triticum aestivum
  Clone ID: PAT_TA_34074
taacctcggtagcagaggcatcactcccagcttgcctgcaagccatcttctccacgattccgctcacggttcatcggttgccacccgattctggtgcgccgtcgcagagcggcgaagatggccaccaaggggcgcaaggtcgtcgaggtccgtgacgcgagcaggacggacgggaagggcgacgccgcggacgtccacgtcgtccgcgaggggaagagcgaccacgacaccgccggcggcgtcggccaccgcggcgcgagcaggacggacgggcatggcgacgcgggcggcaaggtcggggacttccgcggcatcgacgggaaggactccctgaagatcgtcgcgatgcaggcgccggtcaccgtggagcgccccgtccgcggcgacctcgaggagcacgtccccaagccctatttggcgagggctttggcggctccggacatgtaccacccggaggggacgacggatgatcaccagcaccacaacatgagcgtgctgcagcagcacgtcgccttcttcgaccgcgacaacaacggcatcatctatccctgggagacttacgatggatgccgtgcggttgggttcaacgtgttcatgtccgccttcatcgcgtttctggtgaacctggtcatgagctatcccaccctgcccggttggctgccgaaccctctcttccctatctacgtgcacaacatccacaagagcaagcacgggagtgactcggggacctatgacaaagaggggccggttcatgccggtgaatttcgagaacatcttcagcaagtacgcccgcacgtacccggacaggctgagctacagggagctgtggcggatgaccgaggggtccggggaggtggttcgatttcttcggctgggtggcgatgaagctggagggggtcggtccttgtacgtgctggctc

SEQ ID NO: 34075 - DNA, 1904 bp, Triticum aestivum
  Clone ID: PAT_TA_34075
cgggccggcggcatcggcaccagaggcatcactccacggcttgcctggtccggcggttcttctctgattccgtctccggttcatcggttgccacccggttcctgccctccctgttgatgcggagaagggctgcttcaaggaggtgcgatatcgtcgacaaggcccgtgacgggagcgcggtctgacccgaaggacggcgcggagcaggtgccgccgcctccgcgactgggggggcgactgcgacagcgccggcggcgcgagccaccgcggcgcgcgctcgacggagtggcatggcgacgcgggctggtaggtcggggagttccgggccatcggctggaaggactcccttaagatcgtcgccatgcaggccccggtcaccgtggagcgccccgtccgcggggcgccggaggaggcaccgtccccaccgcctattcggcgaaggctttcccggctcccgagcattttccggccggtggggtggacggcaccacggtcgggccgttcctgccggaggggcacgtcccgggcgggcgcgcgcgcgccgacgaggccgccgcgggctccgcgacgccacacgtgggcctgctctcgggccagctccccgcgggggacacggtcgggctcgcgcgccgctttaccgccgccgcggagggcgctggtgccgcggctctaacacgtgggccgggtgtggggcgtcggcgagcatggccaggaacgtccggcgcatcgacgggacggacgccgtgccgctcgtcgcgatgcaggcgccgcgcggcgcggcgcgccccgtccgcggcgaccccgaggagcccatccccaagccctacttggcgtcggctctggcggcgccggacctgtcccgcccggaggggacgacggatgatcaccagcaccacaacatgagcgtgctgcagcagcacgtcgccttcttcgaccgcgacaacaacggcatcatctatccctgggagacttacgatgggtgccgtgcggttgggttcaacgtgttcacgtccgccttcatcgcgtttctggtgaacctggtcatgagctatcccaccctgcccggctggctgccgaaccccctcttcccgatctacgtgcacaacatccacaagagcaagcacgggagtgactcggggacctacgacaaggagggccggttcatgccggtgaacttcgagaacatcttcagcaagtacgcccgcacgtacccggacaggctgagctacagggagctgtggcggatgacggaggggtcccgggaggtgttcgacttcgtcggctgggtggcgatgaagctggagtggtcgttcttgtacgtgctggctcgggacgacgaagggtacctgtcgagggaggccatccggcggatgtacgacggcagcctcttcgagtacatggagaggcagcgcatggagcacgtcaagatgtcctagatcgccgtgtgtccgtcgtcggtggatctcgcaggggcggagctgcacccacctgtgatgctttccgtgtccttgtgtgtatgtacagcaggccacagatccatgtggtgaaaacataaataacgcgatatgatatgccatgtactcttgaatgttcagacccgaacggtctcccgtccttccctggttcctctcttcccccggccggagcgtcgacggtcgactgcagatagatacagatattcccttcttcccccgggcggaacgtcgtcgattgcagatacgcagatagataaggctggcgccggagcctggagggcctccgcggtcgctgtggtgtactaggtcgtgcgttggaggatccggagcagtcggtgcgcggcaggtgaggaacctgcttccttcacaatggttcctccgatagatcacaggctcatcgccgacggtggatctcgcaaggtcggagct

SEQ ID NO: 34076 - DNA, 507 bp, Triticum aestivum
  Clone ID: PAT_TA_34076
gagcacgccgccgtcgaacccccatcccctccccctcccccgcctccgccgccgccataatcgagcagccatgttcggctccaccaatccgttcgggcagtcgtccgctagcgcttttgggcagacctccagcaaccccttcggggcccaatcggggttcggccagaccagcaccaccaccaacaatcccttcggcagcccgaccaccgccttcggggcgcagacggggaccacctcgccttttggcgccacctcctccaccgccggcgcgtttggccagccatccgctccggcgttcggggctacatccaccccggcgtttggggccgcgccaactggcggatttggccagccatccacgccggcgttcggcaccccgtcgtcctctccgttcgggagctccacgccagcctttggtgcgtcgccagcccccgcgtttggcgcgggcgccacatcctccggctttggcagcggatctttgtttggacaaaacccaagcctaggtgg

SEQ ID NO: 34077 - DNA, 606 bp, Triticum aestivum
  unsure (1)..(606): unsure at all n locations
  Clone ID: PAT_TA_34077
ggaggaggaagaaggtggcggaggccaaggcggacgaggagacgatccgagggaggaagaggagcggagggggaggagagaggaggaggaaggaggccgtggcgggagaggaggagacgacccgtgggaagaggaggaaggcgactggggaggctcctccaggtaccgcgcggccacgacgaacctgaagaaacgctaccaccgtggtcgcaagggcgccgtgttccagagcgcctgaacaagaactgttccaatcaccttgcacgctctatgctctaccctttccccgcgtaccgctgtacgactaatggtggcgatcctagttgtgtggctctgttcagtctactgtagtctgtgctcgtagttttgttgggtccgtcgttgccacaatgccactgtgtcttcgctgtagccggtgtatagaagagcagcttgtgcattatgcctacgtataaataaatgagctgttcatcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34078 - DNA, 1599 bp, Triticum aestivum
  unsure (1)..(1599): unsure at all n locations
  Clone ID: PAT_TA_34078
ctctcggctccttctccttccttccagtttcagccatgggtaaggagaagactcacatcaacatcgtggtcgttggccatgtcgactctggcaagacgaccaccactggccatctgatctacaagcttggaggtatcgacaagcgtgtgatcgagaggttcgagaaggaagccgctgagatgaacaagaggtccttcaagtacgcctgggtgcttgacaagctgaaggccgagcgcgagaggggtatcaccattgatattgccctgtggaagtttgagaccaccaagtactactgcaccgtcattgacgcccctggtcaccgtgacttcatcaagaacatgatcaccggtacctcccaggctgactgtgctgtgctcatcatcgactccaccactggtggttttgaggctggtatctcgaaggacggccagacccgtgagcacgccctccttgctttcactcttggagtgaagcagatgatctgctgctgcaacaagatggatgccaccactcccaagtactaggagggcggacgaggcaaggagggagcgggagggggggaagcgggaggaggaagagcagaggaaacgagaggaggaagagaggaagaggagggagcaagaagaggaagaagaaaggaggaggagggaggaggaagaaggtggcggaggccaaggcgggggaggaggtgatgatccaagggaggaggaagaacggcggagggaggaggaagaaggtggcggaggccaaggcggaggaggagacgatccgagggaggaagaggaagagcggcggaggagagagggggaagagggaggcggaggccaaggcggacgaggagacgatccgagggaagaagaggaacggaggagggaggaagaaggaggccgtggcgggagaggcggagatgacccgtggaaagaggaggaaggcgactggggagactcctccaagtaccgggtggccaggaagctgaagaagcgagaccgtggacacaagaggaccgagtccccgagcgcggggacaacccttgttctactcacgttgccgcctggcggatacaccactacctaccgcgcggccaagaacctgaagaagcgctaccgtggtcgcaagggcgccgtgttccagagcgcctgaacagccgccgttccagacttccagtcaccttgcacggtctctgctctacccattccccgcgtaccgctgtacgaatactggtggccatcctagttgtgtggctctgttcagtctactgtagtctctactcgtagttttgttgggtccgtcgttgccacaatgccactgtgtctttctgtagctggtgtatagaagaagagcttgtggattatgcctacgtacgtataaataaaggagctgttcatcgcaaaaaaaaaaaaaaaaaaaaaagtatgggaaaaaagaaaaaaaaaaaaaaaggaaaaaaaaaaaaaaaaaaaaaaaaagaaaaaaaaaaaaaaaaaaaaaaaaagaaaaaaaaaaaaaaaaaaanagaaaaaaaaaaaaaaggggggggggattttaaaaagacaaaggttacaaaacttggtggggtgggaaaaaatttttttttggggg

SEQ ID NO: 34079 - DNA, 856 bp, Triticum aestivum
  Clone ID: PAT_TA_34079
cgtgtgcctccgcggcgcgtgcgcgagccggcccgcgggaaagagagggggcaccgtgcgtgagtttggtgagcgtggcagcgagggaggagcggcatccatacttccatagcccatcctaggtgttgagaggggaggcagccgctctcatttcgtcttcctcttttgcgtcctcgcgagatgtgcgcgcattgctgctcaagctgactgccgcctcttgccctgctcgccgccgccgctgcttcgaaaccctaaatctcgcctccgtcgccgccgccgtcctcccgccgggctcgtgatgccgcttcttgatccgggaaagccgcttcttttgtccgccaaactgcaggcaccaacggtcctaacttgaagcgcagcacatcaccacccacccagatgcggttgctgcttgcaaagctccgcaagtcaatactctgctaggagggagcatttctggaggcggtgggagtgctggagaggatgggttcttcagggtgcccggagatagtcgagctggtcgatgagaccaaagacgcccgtccgggcggggtcacccacctgagggtgagggtgaagccggtggggcaggagcatggggggcggtcgtgctcggttgaggatgaccttgaccggctcctcagatcgttcaatgtgcgcacctcggcgcgggcttctggtcagacgagcacggacaagaggcttattgcgcttgggaaggggcccgatgtcgagctcggagatcgggggagtctgtgagcttgaagcaggccctcaggacagatgtgcatctcccaggcctcggagatggtcgccatgaaggttggttgcgtcgcccaacgctgtgcacagtaaggct

SEQ ID NO: 34080 - DNA, 632 bp, Triticum aestivum
  Clone ID: PAT_TA_34080
aaccttcttagctcagcctctgtacactctcactcccaatgcgatttcccatcatgataaacgttgtagccgtatgcctcgtcctctccaccctggccgccgccggcgtctggtcgccagcgcctccgccgccggcccagcagcacggtgagcatgtcctccgggagggccgccgcgtcgtcatcgtcgagtacgagcgcgagctcccgctcaccccgggccagggctccgccaaagagacgcacgtcttgccccctcacgctcttgacggcgtcgaggcgaaagaaacggtgtcggaggaggccaggggagccgtctccaacgcggcggacaaggtggctggcgcggcggaggatggcaaggagaagttgtccaatgccaaggagagcgccacgggcaaggtgttcggcgcggtgaagcgctgcaaggacaggctctgcggcgcggccaaggggttggaggagggcgcgagagtcggggtctcccgcgtcaaagatggcgccgaggacacggtgacagctgccggggagacgctctctggtgccaaggacaaagcggagggcaaggtgttccacgctgcatcagaggcgaagggcgctgcgatgagtgccaaggacaaggtctccgaagca

SEQ ID NO: 34081 - DNA, 1341 bp, Triticum aestivum
  Clone ID: PAT_TA_34081
catgcaaacctatgcaactcttcctgcaagtatctcacaaaggatgtttcctccgcaaatgattgcatgcagttcctatcaatcaaatcaacagatattttatttccggaaaatgcataacgctaataatttagcgcggcactgaaaccacctccacggtcttgatgctcactttgacaactgaaaagcgcatcattatcctagaccgcaatcccgtttaaacggtgtgcccgaatctaaaccgtgttttctaccatgcaaatgaaggcaaaacgtaagatgggtatgagctatgcttgcaacacaacgcactgacggcatcatctccagcagtttctccaaattcaccgagtcccagttcagcagcatggatccctccagtgatgaatgcagatgtcattccggctccacttgcgcctttgatgtcgtggtgcagcgaatcacctacggtggtacattcatgtgcttcaacacctgctaaggacattgctgatgtataaataaccttatcaggtttccccatccattttacgttcaccaccaagacactcgtattttgctgccagcgtgccaggcatgacacgcaggtttcgagcttcaacagtgacataatctggattagctaccaccattggaagtcgcttttgtataccaagcactagaatctgctcaagctcctcaagacttttcgaaagtggatcaccgagaaggtaaacccagggcttcagtaccatgggctagtataaactctgcatcgtcaacattgttcacaacttgcaaaccaagtccctccagagaaattgcacctcgattgccccatgtcagatggatacacttccttcccagagatgcaaaccatgggtcatccctcttgtcaaggtactgatgggtgagttccccgctggtgatcgccccgaggaaacaagacgtgtcaaacccaaggctctgcagcttctccatggttacagacgaccgccttgaggaattgctgattatcaccatcttggcgccattcccagcgagcttctccaatgccaaaatggcgcccgggtagggtttcttcccgtcatgaagaacaccgaactggtccaggaaccatgccttgaagcggccggactcggcgaggggccggatcccggccagcctctcgaataccggtgccggcggcgatgacatcctccccgccgccgccgcgcgacaagggcccttgctgctgcggtaggtggaggtgggctccgtgatgggccggcggagagtggacacgagcaggcagaggcgatggaggagcttgttcggaagggtaaggcaacgaggacgccaagcaaccaggcagtggctggg

SEQ ID NO: 34082 - DNA, 665 bp, Triticum aestivum
  Clone ID: PAT_TA_34082
cctccgcccaccgcccacgttgcgaagggcctcttggagggcaggaacggacggctgcgggaactcaatcgcatcaaccgcgtctatgtagcctcgggggcagtgcggcacacgcggctctgaggcaagtcggcgaggggtacgtctacgtcgtgatggggtggagatctgcggccggccgtctgctggcgatcctgctcgttctgcacctcctcgtcgcctcctcccacggcggcccgcttcacgaggaagctacaggatgatcggcggtggaggctccgtcgttacgcggtgctggaggcgattcagcagagagcaacaggagggagagcgacgcgatcgtggaggagatgttcgggaggatggctctgcagacgaccgactacccgggttcaggccctaacgatcgtcacacccccaaggcgcccgggacatgatcgtgccatgtcaaagtacagaccctcagctcgcccagacgcacgtcatatatagtatatgatgtacagaagatttattagcccatcgacaaattagaacttagaacccatcaaaatgggggattattcaagtgtaaattcgtatacgtgtggaggttactgtaagattgtgtgctgtgccatttctattaagagaagtctgcttttaaacaaaaagtaaggagtagc

SEQ ID NO: 34083 - DNA, 1316 bp, Triticum aestivum
  Clone ID: PAT_TA_34083
ccctttgctccgctcgctccagtcgtccggcgccgacacgccctcgccgtgccgcctccacctccacctcgactgcgtgcgctagcccgcccgcactttccacgacccggcttgccttcggagcgaggagagggaaacgatggtggccatcaccgcgctcgcggacggcaagaggtgggcggggatttctcagacggggaagcccggggcgaaggctcctaaacccatcaacttgccgaaccagaggttggacagccatggcctccgcagtgacgagattgttccaaagcacctacatcacaggggaaagggttcagcctaagtatggatgatttcccagtacttggctccagaaactctgcgtcaaacagtcaacaagggcaaatttcaggaaggtggccaactattgcttctggtattgtggcaacacaagataaagaaggaaagaacccgataactggaactggtgaggtaattttgtcttgcagttatgagcatgaaattatctcaagaatggactatgtttgcaaaggagacgatcctattcctgctgcaaagttgataaggggagctgagcaggctcaactgcatgatccccaagttcctaatatatgtatacctcctccattgttggattactggcatcgtcctcctgatcagccacctgatgaaaatggaaaattgcatagtggagaggtgccatatggtccgtacaagcatgctgacccgcccgcctttgctgttgaatctcttgctcatcgtgatcagttcgcgctcaacgaggaggcactagcaaagcaggatactggacatggtgggtattatccagacaagagggatatatctcatgctcacatgcctgctgattgttgtgtcataaatcaatcttgccatgttcttgggaaggtcaagaatggccatgcagatgtacttgagatcgagaagcaacctatcatcaagaaggatgtggctctatgagagaaaatcaagtgtctaaacaacaaagctagaaatttccgtgcccttaacttgtccaatctaccttcatctctactcaaggactccaaggttaaacacccaaaaatcatccgtgtcgaggaagatcgtgtgacaaaatatgttcccttcagtgcttccaccagtgagactggtcctgcctttgacaggcttaattctgtttctcaagcagcagttctgtgtcaactaatccatcaaatgggcctgataagggtggaacctgttgttggtctgtcagaaaaacaaggtactgaattcagccaagctggaaaaagttggcaaatctgctgatcgccatg

SEQ ID NO: 34084 - DNA, 1139 bp, Triticum aestivum
  Clone ID: PAT_TA_34084
agtgttcggctatggaggactattaagggaacgtctgaaggatggagatcactctcatggttgactgcttgctttttccctggctgtcatgtttacggtccttaccatcttaaactttgtgttgtggggaagcaagagcactggagctttacctatatcattatttttcacccttctggctctgtggttctgtatctctgtgccgttaacgcttgtcggtggcttccttggtacaagagcagagcaaattgagtttcctgttcgcaccaaccaagattcctaagagagatccctgcacggaaatatccatcaaggcttctggtccttggagcaggcacgctgccatttggaaccctgtttattgagctgttcttcaatctgtcgagcatctggcttggaaggttctactatgtgtttgggcttcctgctgattgtcctggctgatgcttgtcattggttgcgccgaggtatctgttgtccttacatacatgaatctctgtgttgaggactggaggtggtggtggaaggccttctttgcatcgggctctgttgctctctacgtgttcctctactccatcaactacttggtctttgatctcagaagcctgagcggtcctgtctctgcaatgctctacatcggctactcattcctcatggcgttcgcgatcatgctcgccactggaaccattggcttcttgacgtcaatatcctttgtgcactacctcttcgcgtccgtgaagatcgattgatggatggttgccatatcaatggccttctgtatctgtattgctaaaagtacgtgcgtgagtttcgcccatgagaagcgcagtttaatgaggtgattttgatcaactgcagatgtttttagtagatgttgatgcagtttttccctagtaaatgtagttccgctgttcaactgcagatgtttccttagtagattttggtcagctgctacacttattcagatagatactgcaagtctgcaacccatatctacaaagtgttaaggggtaatgactatgatattctaatctgcgagtggcaaggcatggtagccacctattctgtaaaagatcttaatgtgtgaacattatttgctacgtgtttcttggcctaatttcaaaaaaaaaaaaaaaaaa

SEQ ID NO: 34085 - DNA, 1755 bp, Triticum aestivum
  Clone ID: PAT_TA_34085
ccacgcgtccgggtaatccagcatttctgcaccgagctgtccaagggattgaattttctgacccagttgcagtgaggcatgccttgtcaataatctcagaaatcgccgttagagatccatactctgttgcaatggcactcggcaaaaacgcacaacctggtggcgctcttcaggacatccttcatctgcatgatgttctcgcaagagtttaccttgcaaagttgtgtcattcaatatctagggcacgtgtattggatgagaggcccgacataaaatcacagtacagttctctcctttatcaactccttttggatccaagtgacagggtctgtttcgaggcaatactctgtgttctgggaaaagttgacaacacagaaagcactgaggacagagctggcggatggatccggttaactagagaaattctcaaattgcctgaggccccatctgtagcatcaaaggtcttctgtcaaaagctagtgagaaatcttctaaagcaaggcgtcctcaacccctcatcaaacttgtaatgagaaggctggagagctctttccgtagcttttctcgccctgttcttcatgccgctgcaagagtagtccaggaaatgggtaaaagcagagcagctgcttactctttgggtgcttatgatgagggagccaatcttcaagcttattcagataatgtcgaatctcttgattctgatgagaactcacaacctgaagccacccggaaagctaagccactgtcgaatggacatggtggaatggacacagtagcagggttattggcatcactaatggaagtagtgcggacaactgtagcatgcgagtgcgtatatgttcgagcaatggtcatcaaagctttgatatggatgcaaaatccacatgagtccctcgatgaactaaaatctataattgcgtgtgagctgtctgacccagcctggccttcttctctactgaatgatgtcctgctaaccctacatgctaggttcaaggcaacccctgatatggctgtgactctgcttgagattgctagaatttttgctactaaagttcctggaaagattgatgctgacgttctacaactgttatggaagacatgccttgtgggagcaggaccagatgggaaacatacagcattggaagctgtgacaattgtccttgatctgccaccacctcagcctggttcaatgtctgtcctcacgtctgttgatatgatatccgcctctgatccaaaatctgcaatggcactgcaaagattagtccaagctgctgtttggtttctgggagaaaatgcaaactatgctgcatctgagtatgcatgggaatctgcgacgccgcctggtactgctctaatgatgcttgatgctgataaaatggttgctgcagctagctcccgtaaccctacacttgctagcgctctgacgcggctccaaaggtgtgcatttagtggcagctgggagatccgtatcgctgctgtccaggccctaactaccattgcaataaggtctggtgaaccttatagactacagatatacgagtttcttcatgctttgagtctggggggtgtgcagtcaaacttttcggaattgcagctaagtaatggggaaaaccaaggtgctagtggtactggtcttggatctttgattagcccaatgctcaaggtcttggatgagatgtataaagctcaagacgaccttgctagggacatccgtcagcatgataatagcaaacaagaatggagtgatgatgaact

SEQ ID NO: 34086 - DNA, 2183 bp, Triticum aestivum
  Clone ID: PAT_TA_34086
cctaatttaatcccagtgaacaacacccaagaacacactcaccggagcaagcagtccgtgaagcgatggcgcatttccagggccagcagcacggccacccggccacccgcgtcgacgagtacggcaaccctgtgccggccggccacggcgtcaccgggaccgaaggcttggggcacttcccgggccaggcccagcagcacggccacaacaccacccgcctcgacgagtacggcaacccggtgacggccggccacggcgttgggctgggatccaccggcactggagtgcacggcgggtacgggtctgccggcaccggcacccacgacactggcggccacggccgccaggtgggatacggtgccactggcacgggcacccacgacgctgggggctatggaggctctggaattgcccctcggcacggcgccaccgacgctgggcttcacgacgccggtgggttgggcacgcggcatgccgcgaccggtacccacggcacagggcacaccgccggcctcggcggcaccggcacagggatgaccgggaccgatggagaagaccagggagaagctccctcgggggcacaaggacacccaggcgcacaccaccgcgacaggcggctacgcgcatggcaccactgccaccggcggcggctctggtacagggacacccccacatcgtgggctacccgagcagggatgaccgggacccatggcacgggccaccccgccgggctcggcggcaccggcacagggatcaccgggacccatggcacaggccacaccgccgggtatgacgccaccggtactgatggcacagggcacacggccgggtacggggcgaccggcactgggatcactggaacccacggcgccgctggcacacaccctcatggcggggtagccgagcaaaagactcgtggcatcctccaccgctctggcagctccagctccagctcgtcatcctccgaggacgacgggatgggcgggtaggaggaagaaaggcatgaagcagaagatcaaagagaagctccccggcggtaacaaggagcagaccacggccgccggcggctacgggccagggtacacggggacgactggcactggtgggccagggtacacggggaccaccggcactggcggggcctacggagccactgaggggacgcatgagaagaagggcgtcatggagaagatcaagcagaagctccctggcgggcacaaggacacccagccgcacaccacggctaccggcggctacggacctggcaccactggtaccactggcaccggcggctatggtactggcaccaccggcaccgcggggacgcacggcgccactgagggcacccacgagaagaaaggcatgatggagaagatcaaggagaagctccccggcggccaccactgagctgagcctagcttgcctcggcctcgggtacagagtagtgaagaataaagactcgaggaatcgccgtgtgcacaatcaagggatagtatttaagttttttttatgttatcctttttatcttcttttttttttacaaaatgttatcctttttatccgtgtgatagatgttgcagtactgtgaaatggcctagtttgtaagtacgtttgtctggttggttcgcactcccccgccggtgcgaggggcggcccacagcctccggcggctccgggccgcggcacccgcggccctccggcacaggtgggccagggccccggggcccctccggcaccggcgggacctacggaaccactgaggggacacacgagaagaagggcgtcatggagaagatcaaggagaagctccctggcgggcacaaggacaccctgccgcacgccgccgcgacaggcggctacgggcatggcaccactggcaccggcggcggctatggtacaggcaccaccggcaccgcggggacgcacggcgccactgagggcacccacgagaagaaaggcatgatggagaagatcaaggagaagctccccggcggccaccactgaactgagcctaacttgcctcggcctcgggttcagtccagtgaagaataaagactcgaggaaccgccgtgtgcacaatctaagggcatagtgttaagtttttcatgtcatcttttttctccgtgtgatagttgttgcagtactgtgacatggcctggtttctaagtacgttttgcctggtt

SEQ ID NO: 34087 - DNA, 446 bp, Triticum aestivum
  Clone ID: PAT_TA_34087
cgggtccacgacagcgtgaatgatgcacctacacccctgccctggtcgaggtggtccggccggatttgtgaccagccatgagcagagagagagagtgtgtggccgcctatgtcttgcttagatctagagagcatgagagagtgaaagagaggaaccctagtaaagcaagcgctaaggctcctgcttatatatatggtggagtgattttgttgtaccagcttcaaaaaaatgcgctcctacgtgtacccgcgagtgggtgtgagagaactagtgcgtgcgtgcaccgcttctcttcgtgagagtacaatatacgatgcccaaagaatgttcaccacaatagtagtactataagtgtgtgacgtgtgagctaacataaaaggtgcgcgacgtcgtttgttttttagaagttctgagggtacggtgtgaagacacatatgtgtgtgacg

SEQ ID NO: 34088 - DNA, 1131 bp, Triticum aestivum
  Clone ID: PAT_TA_34088
tggagatgttgtttcattcaagcagcgtttgacagatgacaggatggttcagctggatgccctaaccagtgacagggagatgtctactcatatggatctggacataattaatgaagaaacggaaagggctatcatggactggagaaatcttgaactggcaaccatgaaattgtcccaagaactggctgagcaattgcgccttgtcatggaaccaactcttgcaagtaagcttcaaggagattacagaactggaaagagaataaacatgaggaagggcattccatatattgcgagccagtttcgcagggacaagatatgggtgcgacgaactaaacccaataaaccgaattaccaggtgggtattgctgtcgatgactcacgaaacatgtccgagggcaagtgtggaaaaaatgcaattgaagcattagttacagtttgccgggccatgtcgcagcttgaggttggacagttcgcagttgcaagtttcgggaaaagagggaatgttaaagtcttgcatgattttgatcagatcttcaatgccgaagctggagtcaagatgatctctagtctgtcctttgagcaagacaacaaaattgaggatcaaccagttgcggatctcttgatgcatctgaatataatgcttgatgctgctgtggcaaggtcgcgcacgccatcaggacaaaatccacttcagcaactcatacttgtaatatctgatggaaagttccatgaaaaggaaaatttgaggcgatgtatcaggaatgttctaaacagaaggagaatgattgcatatgtactcctagatagtcatgaggaatccattatgaactcactggaagcgtgctatgaaggagacaagctaatcttgggaaaatatatggactcatttccgttcccttactatgttatgctgaagaacatcgaagcgcttcctcgcacactggccgatttgcttagacagtggtttgagctgatgcagagcgctaatgaatgatctttggggacgttgccagcttgtcaaattgctcagggaacaattagtggtccaaagtccgagttttgtacaaaatataccacacctgttgtagcttgttttacacttcggaactaatcgttgtgtaaagtttccat

SEQ ID NO: 34089 - DNA, 1180 bp, Triticum aestivum
  Clone ID: PAT_TA_34089
atggaagacacactataggagtggaaatttgggtactgaagcatggcggcagattcttactgatagataagacctcactagaagaaaatcataaaatatatccatgtgtgtcgagagaaatcatctataaagataatatagtagcgatgtcctccttttgaggcaaagggacctggaccccaaacattgaagtgaacaagatcaaaaggacgatgagacacaatctcgctatgaggataatgtaagttaacctgtttgctaagccgacaaactaacagtctaaagacacaccgccagagacagatcaaagaagaccttgtcgaactaaggatgagagactagagccacacaagtgaccaagacgatgattccaaaagagcaggtaaacaaagtaaccaaggcagagagactggcggcggtggcaggaaagggaaggttaagctagataagcacccagaggacctgggaattacaacttcgagggccaacaccaagtagagcatccgtgtaaggattctaatcagaacatgaacatgagaatctggaggtcgaatggctgacaaactggaagaagttatatgaaaatacatccagtaccaaggatccatgggagatgtacctggttgtgtaaaaagtggtcactcggtacaagaaaattagtagcaaaacctgttaatgttgaaccaaaagaagctgctagtagatcgcctaaccttcggtgtagtcaggttctcaactgaagaggttgacaaagaagtactgggccatgaaactagaagtaggaagtaaatgttttgttaaagttcgaaaacccaaatgtatttctcattcttcttgtttggcttcatttggtttttgatctctttcttttgtgttctttatggttcatttccttcttattgtttcttttgtttatttgtttgcttttacaagaaaacacaaaatatttctttctcccttttttcttttgaagttctttgagaaaacaaaaaaaatatttcttcgttctttttgctttttctttggaagtttatctgattgcctctttgttgaaactttcgaaatcttgtatctttgcttgtcactttgcattattgtttgccttctttgagaaaaccaaaaattccaaaaatacttcagtggtgtttctcttagttctttgccttttatatttcaaaaa

SEQ ID NO: 34090 - DNA, 977 bp, Triticum aestivum
  unsure (1)..(977): unsure at all n locations
  Clone ID: PAT_TA_34090
ggtctccccacgtgcccctccctcccctgcacaccgcagggtttcgaccgccgccgtcccgtccgccgcgccccccgccccccccgtccgctctccgcccccccccctccgtcgccccgtcgccctcgccgctctcgccccaaccaagactggcggcaatcaccgtttcatgcatttttggtggacaatcttcagttgaacctgagtgctgactcgctctcccgttgccaacaatgtccggcttgctgaattcaaatcttaacagttccacatcgaaccttccagactcatccggacggccattcacaacatccttttctggtcaatctggctcagttcaaggtttccatcactctggtctgcacaacattcatggaaattatagtcttccaaatatgcctggatcacttgcacaaaggaatgctgccatgagtggccttccatcctccggggttcaacaacctggagggagcatttctgggagatttgcttcaaacaaccttcctgttgccatgtctcagattcctcatgcacattcaggtgtcagtggtagaggactgaatgttggtggaggtcaagcattcagcagtggaatgaacatgggcgcaaccattttaggtttatcctcataattgggcgccaatggtagtcgaaattctactggtgttcctggcaatccagcctgcggggtccgccggccgcggcgttcgggctgcggcggatgctgtgtggctgcccggagctgcgccaggcaggattgccgctggtcgtccgtcggtgccgcccctcttcccacccctcgctcttcttggcaccggtggcacgggggatccgagccggcctggttcctgcctggtcgctggagcgtttcttcctaaggattttgtggttgacagatgttctctcnctggtggattggtaaaaagacttaactcttaatcaggggngcgcnattttgntgaaggttgtnaaacatt

SEQ ID NO: 34091 - DNA, 902 bp, Triticum aestivum
  Clone ID: PAT_TA_34091
aagacctgccaacgcgcgagaagcgatgtcctccagtgatcagaacccagcgcccacgcccgcctcgggcaccggcgggacggcgccgccgccgggcaggccgaccacggtctcctcgcaggcgatcgacatgggcgctcaggtgctgcagccgttgaagccggtgcgccagatgaagcagcacgcgtgcagcttcgcgctgtacgcgcatgacatgcaccggcagctcgaggtccaccacttcgtctcccgcctcaaccaggacgtcctccagtgcgccgtctatgactccgacaagccctcggcccgcctcatcggtgtggagtacatcgtgtcggacaaaatcttcaaggacctgccgccggaggagcagaggctgtggcactcgcacgcctacgaggtcaaggccgggctgtggaccgacgtgggcgtgccggagatgctgcagacctcggagatggccaggatggccaagacgtacggcaagttctggtgcacgtggcaggtggaccgcggcgaccggctgccactcggcgcgccggcgctcatgatgtcgccgcaggccgtggagcccggccgggtgcgcgccgagctggtgcgcgcacgcgacgagaggtgcaaggtggacagctcggctcgcgggctcaaggctcagagggtggagatggatgagccggagtggatcaacccaaacgccgactactggcggctgcacggcaaggggttcgccgtggacgtcacggccacggagatgaagcagcacgcgcccttcccttgagaggtcgaatggttgcccagtgaaatgcgcatcttctttcaacttctgttggttggtcttgtttttaaggtagagtcgtcggtgtacggaatggtcgggagatgcgagtgaaggtgcaagttgc

SEQ ID NO: 34092 - DNA, 1108 bp, Triticum aestivum
  Clone ID: PAT_TA_34092
ttcttccgcaaagagcacgcagtagctagctttcagttcttcatccatcatgccgggcctcaccatcggcgacaccgtccccaacctggagctggactccacccatggcaagatccgcatccacgactacgtcggcaacggctacgtcatcctcttctcccaccccggtgatttcaccccggtgtgcacgacggagctggcggccatggccaactacgccaaggagttcgagaagcggggcgtgaagctgctcggcatctcctgcgacgacgtgcagtcccacaaggagtggaccaaggacatcgaggcctacaaggttcgcccataatccgtgttcgattagccatgcatggttggttaatttctctgttgtcgcgcgtgcagcctgggagcagggtgacgtacccgatcatggcggacccggaccgctccgccatcaagcagctcaacatggtcgacccggacgagaaggacggccaggggcagctgccgtcccgcaccctgcacatggtggggccggacaaggtggtgaagctgagcttcctgtacccgtcgtgcacggggcggaacatggacgaggtggtgcgcgccgtggactcgctgctgacggcggccaagcacaaggtggccaccccggccaactggaagcccggggagtgcgtggtgatcgcgcccggcgtctccgacgacgaggccaagaagatgtttccccaggggtttgagaccgccgacctgccctccaagaagggctacctccgcttcaccaaggtctaggcgtgcgtccgtgctagctcggttacttgtggcggtctgtgtcgtcgtggtgcgtgcgtgcttttgtggtggtatgtgtcgtgtttcttctgtaaatctaccagcgtcgctgggctatgtatgtgtactgtgactttgccactttcatgtgttcgatcgccggtattacaacagactcagcaaacaatatccattgggccggcgctctttacgatcatgtgtgcgcactcttgagggcccaagcttagttccgccttaatgctgcgtaaatttcgttgtatggaggaacctattactacttacgtgtcctgcaatgtacaacgtctacattggt

SEQ ID NO: 34093 - DNA, 1122 bp, Triticum aestivum
  Clone ID: PAT_TA_34093
cggctttgggccggcgctcgaccccgcggcagcaacgttcgcagcagcaaagagcacgcagcagctagctttgagttgtttcatccatcatgccgggcctcaccatcggcgacaccgtccccaacctggagctggactccacccatggcaagatccggatccacgactacgtcggcaacggctacgtcatcctcttctcacaccccggtgatttcaccccggtgtgcacgacggagttggcggcgatggccaactacgccaaggagttcgagaagcggggcgtgaagctgctgggcatctcctgcgacgacgtgcagtcccacaaggaatggaccaaggacatcgaggcctacaagcctgggagcaaggtgacgtacccgatcatggcggacccggaccggtcggccatcaagcaactgaacatggtcgaccccgacgagaaggacgcggaggggcagctgccgtcccgcaccttgcacatcgtggggccggacaagaaggtgaagctgagcttcctgtacccgtcgtgcacggggcggaacatggacgaggtggtgcgcgccgtggactcgctgctgacggcggccaagcacaaggtggccaccccggccaactggaagcccggggagtgcgtggtgatcgcgcccggcgtctccgacgacgaggccaagaagatgttcccgcaggggttcgagactgccgacctgccctccaagaaggggtacctccgcttcaccaaggtctaggcgtgcgtccgtgctagctcgtcggcgcctgctcggttactcgtggcggtctgtgtcgttgtggtccgtgcgtacttttgtggtggtacgtgtcgtttcttctgtaaatctaccagcgtctccgagctatgtatgtgtacttgtgctttgtgactttgtctctttcatgtgttcgatcgccggtctcatgtgttccatcgccggtatatccatgtgttggtcctgtagtggtgtatctcggtgcactatgttgcttctcgcttttttgctcgatgttgcgcctcctgctggcttggtgcgcacgtggcgttggaggtagcgcctcctgcggggggttctgtctgctgcctttccgcaccttgcgcgacgtcctctg

SEQ ID NO: 34094 - DNA, 824 bp, Triticum aestivum
  Clone ID: PAT_TA_34094
gggaagcccataagcttgacccttcagcagtcctctttgtcaacgactacaacgtcgaagatggatgcgattcgaaatccaccccagaaaagtttgtggagcagattgtcgatctccaagagcggggcgccccagttggtgggatcggcgtgcaaggtcatatcagccatccagtgggagatatcatctgtgattctctagataagctagcgatactgggtctccctatttggatcactgaactggatgtctcggcggagaacgaacacatccgagcggatgatctcgaggtgtgcctccgtgaatgcttcgcccatgccgctgtggagggggtggtcctctgggggttctgggagacgttcatgtttcggaatcatgctcacctggtcgatgctgatggaacaatcaacgagaccggcaaaaggtaccttgctctgaagcaggagtggttgaccaaaactgatggtgacatcgatcaccatggggagttcaaattcagaggctaccatgggtcatacaccgtagaggtagtgacgccctcggggaaggtgactcgatcatttgttgttgacaaggagaaccctgtgcaggtggttaccttgaacatttagcttgtatcatatgaagtactttctacactccagcagtgtgcactgtactgagatttttcggtttcatgccatatgttcacagtttaccttatatatgttgtaacgggagaaaaaaaagttccttctgccttgcctcgggcttatggacccgtgcgctcccacggcggggggggaaaaaaacgcttaattttttaaaaaaaaaaaaaaaaaaaa

SEQ ID NO: 34095 - DNA, 944 bp, Triticum aestivum
  unsure (1)..(944): unsure at all n locations
  Clone ID: PAT_TA_34095
ccggcacgccccctaatgacatgtttagcccgctatttcctctgcctcactcctttccatcttcccaaattccccaaattgcgtcgtccccagagtcccgcccaccacatcccccccaagcgatcccagcgccgccgatctcccgtgccgccaccacctccgccgcctcctggacaagaggccaccaccattgagcaccacttcggtgcgcctggttgccaccacgactctggccttggaaggtcgtcctactgtcctggatcgggggaggaggcacgatttggatctgggcggcgacggctaagcaagggcacctatgctatcgagagtgtacattgcttccagtgtaacaagaacagaaaataagatagttaaagcatcgtggggaccaggaggccaagcagtctgtggtgtctccgtcgttgttgcaaagaaacatgcccaaacttccccacggggaactttctctatcggttcaggttggacgagcaagacaacatactgcagactgggaacaagagtatgttcgtcatcattgatatgtgttaatactctccttgagattgattcctttgctttcgcaaaaaagcgtcagatacatggcgagcttcaaaatatcaggttgcaaatacccatcgttgctttggaccttgccatggatggatggacactaaatgaccacaaatgcctctagattattaataagcgtggttctacgttcagtgctttgggcatctgttttgtctcgggctggttctacgtacctgattttgcttggaacagccacaggggcgaggatgttatattgatgcagcttggtttgctaactagcaatgttttgtttcttagacggacaaacttgtatctcagaaccttgatgaattgtttcatttgatcagcttatgtgggaactnctaaaaaaaaaaaaaaaaaaaaaaaaaaaa

SEQ ID NO: 34096 - DNA, 678 bp, Triticum aestivum
  Clone ID: PAT_TA_34096
aaatcttcaaagaccaattaccatggaagcaggctcagttgttctgatggatcttctgtggtcggatccaactgagaatgatagtgttgagggactcaggccgaatgctcggggccctggtcttgttacctttgggcctgaccgtgttactggagttctgcaacaacaatgacctgcaattgattgtgcgagcacacgagtgtgtgatggatggctttgagcgtttcgcccaaggtcacttgatcaccctcttctcggcaacaaactactgtggtacggcaaacaacgcaggtgcaatcttagttctgggaagggaccttgtggttgtcccaaaactcattcatcctttgccacctgccattacatctcctgagacatccccggagcatcatattgaggacacatggatgcaggaactaaatgccaacaggccaccaactcagaagaggggcctcacccaagcagctgacaatgaccgagcaggcccatatgcgtgggcatatcggcttcgcggcatgctgaaacaatctgttcgataacttacaccatgggtccttggaatatttacgaattctgcccacaggcggatgatcttatgcccaggtgacatgctatcccacagcaatggcaacaggaaatcttttgcggggatcatctaagcttaacgatctgagggca

SEQ ID NO: 34097 - DNA, 474 bp, Triticum aestivum
  Clone ID: PAT_TA_34097
ccacgcgtccgaaaggaggttccttgctcacgaggtttgaccgatgcacccagggaaggtgctctttgccatgcagtatctggtgtggatgggaagttctcatttagatcaatgccctgtggtacctatgatctgttgccatactacagaggggaaaacactgtttttgatgtttcaccttcttcattacatgtttctcttgagcatagtcacatgacaatcccccaaaaattccaggttactgggttttctgttggtggacatgttgttgatggctatggtgctggcattgaaggtgccaaggttatactcgatggtcagttgagagctgtaacagataatcttgggtattacagacttgatcaggttacatccaagaagtatgatatagttgctgagaaggatcattataagttcaaccgtttggagaacttcatgattttgccaaacatggaaagcattggtgatatcaaa

SEQ ID NO: 34098 - DNA, 703 bp, Triticum aestivum
  unsure (1)..(703): unsure at all n locations
  Clone ID: PAT_TA_34098
ccctcctcccgcacgcctcgcacctaatcgcctccatgaaccctagcccccaatggatgggacgccacaccctcactcctccccagcagcctccaaaccccccgcctccaccggatccaaggcgtgcggccacggaggcgagcctctccggcgacggtggcaacctgcaggcagagaagatgggagagagggagagaaggaatgagaggagggaggtccgacggcggacaggagagggtcagcggcctgtgccggcgaggtcaggtgtgacctggcagacctggcaattgatggcggccactcctggatccttcttccacttccccactgcctaccaccaagcacgggtcagggagcatgggattgacgacggcggtcgaaagccaggatggttggctgaggaagagggttgctatggagactgttctttgcaagggtaaagcatcatcagcactggtggtggttggatcattagatgattcccagtaactaggtatgtcttcttaaccaggtggacatttccccagattggctcctccacatgtttcagactgacaaatcatgacaatcctcttcttanagtacaaaatgatgtagctatctccacatgctttgatgatatctttttcgtatggttggatggttccttatcaccgtgattcatataaaaacttgtgaattgtagtgtcatgatgatttcata

SEQ ID NO: 34099 - DNA, 680 bp, Triticum aestivum
  Clone ID: PAT_TA_34099
ctgtgacgcggcaacgcagttgttgggcatttcgccggcggctgctggcgcaagcttttggcggcggctgcgatgtctcaggcacggaggccaggcgacgcgcgcgtgcgtgagcgcggcagtggcggctgttagcttcattccgcgcgccatcccgaaggatggcggcgtcccggccatggcgtgcgcgcacggcagcggccgtgcggaccccgaaggccggcgtcatcaggggattattggatcgagttgaccatcagatggagcagcggcaatcaagtgggatgtcgaagctagacagtagcggtgtgaccgtcctcgacagcttgaggtgagtgtgaggaaagccgtgtgcacattacaccttatcgcttcaaggagaatatcattccacttccgttcttggagatgcaagatgattatgtgatgccagaagcagaagatgatgatgagatccattattgcatctggccatatccatagaacacatttatgtaatatcctgagatcctggtccaggtttgttgtgcccttgcagtacttatgctatgctatctagtaggttccgtataactgggcatttggactggtaacggtagcatctttgctataagctatgtacacatgataaatgtcgtgaactattgatagtctattctatagaaatgtgcacttgattc

SEQ ID NO: 34100 - DNA, 754 bp, Triticum aestivum
  Clone ID: PAT_TA_34100
aaattggggcagaggaatccgcaccgtttcctttcccccacctccgccgctcccgtcccctcccctccgcgaccgaaacaatggccgtcatcccttccatctgacgctccaatccatgagaacccccgcgccacaatccgatcttgccgccccaggatgtccctgcccgacgtcgtgtacagctgtggatcctgtggatatgctctaaatctttcatcttctaacagaagcacatctgacgtaggatcctcgtaccaaaaatctctgaagaagggtctgatttcattcacttctattgatctcagccgttttactcaggttgacgagatatcttgttttcctttccttacctggcgtagctaccggccgaaaactaagcttctgtgccgaaaatgtggatcatctattggctatggatacggcgagccacctgtattgtgtagctttgatccagcaagttcttcctctggtacatcccaaaactatttaataaagatccaggctctccgactttcagacggtactcaataattggtcaagtgtagtcagaatatggaaaaggagatgatggataacagcatagaaggctgtatcagttgcctttctgatgattgcttgctttctatatttaacaagcttgaaagtgaatcggacaggaatgcttttgggttaacttgtaagaattggtccagggttcgaaacattgctcgaaaatcgctaatatttcatttctcatttgatactaaagtataca

SEQ ID NO: 34101 - DNA, 347 bp, Triticum aestivum
  Clone ID: PAT_TA_34101
ggcggccttttcccccaattcttttcccctcccctcccttctcgtacgcggccgattgcgaccccgccctccccacccgcacccgcacccgcacgcgcatcgcatttcctgctccgccgccgccgtccgcgcgcatcgggggcgccccggtcggcgatgtggcggtgctatgctgggcgggctcctcaggttcctctcggcgtgcggcgggtcctggcagacctcgcccgcgccgccccacgccgcgcccccgccgccctccgacccctcctcggacgccgaagcctccgcctttgagggccgcgacgggctgctctggtggcgcgacctctcgcgctgcgccgcgg

SEQ ID NO: 34102 - DNA, 678 bp, Triticum aestivum
  unsure (1)..(678): unsure at all n locations
  Clone ID: PAT_TA_34102
agcttctgaagttggtttttctcagcacatcatcaggatcagaagtacaggcttcattagctacaaccctccagctgtattcacagagcgaaattgtggctgccttttcctttcttagtgagaagaagttcacggttagtggacatggaacaaagccatacaccctttctagaaaattcttcttcaaggcttctcattcacccttcccatttggttctggaaaaaaggcttctgaattttccaactggcttatagggcagcaaaggaacactgcagacaatagaatttatttgtatccagatgtagaatgtggagaaattgtttatctcttttcgctggtttcgtctggagggttgttcatttcaccttccttgccaagcgaaggagttggtgatgctgatgggtctaatagttccagccctttggttgaagataccagtggactaaatgatggtactcacaaacgcaaggctgatacggtggaacaggaaagcagtgcggctaagaaaaacaaactttgctaccgccgtgagaaaggtttccctggtatccaagttgctctgaatcaggacagaattcaaacaaaccatctcacgcaggagttacatgataaagaagtgccttatttttagttagcccaaggaaatgagcatgagggatgttgantcacaaggttgg

SEQ ID NO: 34103 - DNA, 435 bp, Triticum aestivum
  Clone ID: PAT_TA_34103
agatccctttgcttcaacgaagcgcaacgctgggcctcagcgaagtattgtagtaggtgggccgacgacccagtttaccacaggccttcatttcggccattttggccactggagcggcatcccatagaacaacacatgttcatcaatatgggcgtccgagtgggtttgtcggcaccgcacatgtttactgtccgagtaggcgggcacccggtttaaatgcatttacatagtggtccgtcccacctagtcacatcgttccggcattgaacaagtgcgtagaccaaggcgcagggcgataacgctcttggcatgtgtgcctgttcaatcttggatagttgacgagtagattgattttttttcatttttgattaaaaagttagaattaccgatccaaagaaggagcaatgtttttggccatgacacccgccctgtttg

SEQ ID NO: 34104 - DNA, 643 bp, Triticum aestivum
  unsure (1)..(643): unsure at all n locations
  Clone ID: PAT_TA_34104
gnngngnnttgnannccntnnnntttgattccgctnagctcgaaattaaccctcactaaagggaacaaaagctggagctccaccgcggtggcggccgctctagaactagtggatcccccgggctgcaggcgctccgcgcccccgcaccgagcccctcccggcccctcggctcccgatctcgccggctcgccgcctacctcgccggacgccatcgcccgtcgctacctgcctcgacgtcgctagacgccaaggaggcgccccttaccggagctcggcgcttccgcgcccccttggcgcccctgcaatccggcgcctgctgcccagtccgctgtccgccgattccggcactcggcctgcagcaagacagcaaccctgcccagtggccagcctttagcccgattcgaggacttgaggttgacctgccgttctgtctgagattgtggtggtgtactgctggttgtagtggtgttcttctcccaggttgaaggttctctctgccaacaaagaaccgctccgccgctatacttgcttggaccccttgtttctggggcttcctcgcgccttcgcccaccgagtggtccaccagccaaagaccatgtggcgccgagccggaccgatctgcctccatctctccggaattgcc

SEQ ID NO: 34105 - DNA, 900 bp, Triticum aestivum
  Clone ID: PAT_TA_34105
ctctcctgacctagctagccgtgccgtgccccccaccccccccgcctctcctgcgcgcgtcgccgccgtcgccattacccttctcccttttcgcggcatcgcgtgcctccaccccgtccgcaacctccgcccgttggttgggtttggaggtaacttggagcctccagcctccgcgggccgccgaagatgggcttcatgggggcgaagctgttcccgtcgtgcgagagcatgtgcgtctgctgcccggcgctgcgcccaagctcgcgccgccccgtcaagcggtacaagaagctgctcgctgagatattccccaagacgcctgagggtcccccaaacgagaggaaaatcatgaagttatgcgagtatgctgccaagaatcccctgcgcattccaaagattgccaagtttctggaacagaggagtcgcaaggaactgcgtgctgctcatttgaactatgtcaagataatcactgaagcatacagcaagctactcttcatttgtaaggagcagatggcatattttgccatcagcctggtgaacgtccttaccgaccttctggaaagcaagcaggagaacattcatatccttggatgtcaaactttagcaaggtttatttacagccaggtagacaacacatatgcacgaaatattgagagcttggtccacaaagtgtgcacactttcacggcaacagggagtggagcatagtcttctgcgggcagcaagcctacagtgtctctcagcaatgatctggtttatgaaggaacattcgtacatatttgctgattttgatgagatggtgcagtcggtcttggaaaattacaggatggatggaactgctggtggtgatgatgacaggcatgcatcacagcataactgggttgatgaaatagtcaggcgt

SEQ ID NO: 34106 - DNA, 1294 bp, Triticum aestivum
  Clone ID: PAT_TA_34106
attcggccactggaaaaaatacctgtcggcaaggacgccgatgacgatgctgatgggcaggctggccggcgtagcgctggagctcgctctcgccgcactgctcgtgctcttcctcccgccctactacgtctacaggctcaccgcctctttcctcggctccgtcttccccgacagcgtctccggcaaggtcgtcctcatcacaggcgcctcctccggcataggcgagcacctggcgtatgagtacgcgaagagaggagccaacctggcgctggtggccagaagggaggcgagcctccgggaggtcgccgaccacgcgtccgcgctcggctcgcccagcgtccttgtcttgccggctgacgtctccaagcccgatgactgccgaaagttcatcgacgacacggttgcctactttggaagattggaccacttggtgaacaacgcgtcgatttggcaggtctgcaagttccaagaggtggaggacgtgaactacttcagaacacttatggacatcaacttctggggacatgtgtacccaactcgctatgccattcctcacctgaagaaaacccatggccggatcgtcggtgtcacctccaactcctcctacatattcatcggaaggaacaccttctacaatgcgagcaaagcagcagcgctaaatttttacgacacgcttcggatggagctcggtggggaagtccgcattacagagatcgtcccaggggtggtcgagtcagagatcacaaaggggaagatgctcaccaaggaaggcgagatgaaagttgaccaagacgaaagagatgcgatccttgggccgacaccggcggagcctgtcgccgctttcgcaaagacggcggtgaaggacgtgtgccggggagagaggtacgtgtttgagccgaggtggtacatggcggtgtacctgtttagggtctgcttcccggagatcctggcctggagctcccggctcctgaccgtgaagacgctggggcgccctgcaacgaccgacactgtgggaagacagatcctcgacatgcccggggtgcgctggctcacccaaacggcctcgctgcggtcgccggagattcaggccaggtgaaagtagctggatcggcccgttgtgatgtaagaagcccactacgaggtctggtagtagtaagatgaagctttgtcgaactaaaacatgcttgtgtactagtatgtcccatggtccgtaataattgagagtggaaaagaacattacagtacttttttttctcgtctgaaatccagtgacaccgtagaagacatcactact

SEQ ID NO: 34107 - DNA, 856 bp, Triticum aestivum
  Clone ID: PAT_TA_34107
catctatagcaagaatgaagatagttcccgcaaaaaaaaaaaaacaagaatgaagatagttcatcagaaaatcaagcgaggactttgagaaaatgggattccttctccctttctccctctctatcactactgatgatcacatgtttccctcgatttttagtttattttggttatccgtgtcatcgtgtgctttcagttatattgtttcctaaatgaaaaacaaaagttagtaggagctatgtctgatcatatctgtttcatgtgtttgttgttcacactgctggaattttctaatgttgtttgtctcaggttgttcatctcagcttgtgaattttataatgttgtttgataacagataagttttcccagacaacttccatgggcagattgtcattgactcacttggtatctgggacttactagcatacttttactacttaagtgctaagaacattttgaattaactgaaggtagcttgcttctgttttatggtacattcatactaattatagctgatagaaaatgtgatttgtcagcatgaaggtaaaagaggggaaggtataatgctcatgggcctcagtgctactatcatatagagataactgctgcaaagttcatataatggtccctgtttcttttattggaatattgacattgttttcaaagattcaatttagttggattgagtttctgttttaactttctaacatgtgcatgcagatgaactaagaattaaaggtagtacttatttaaagtttctttttccattgaaatgtgcagttttacacatttctatgccccttttcctatttgtgtgcatcaaacagtagaaatcaatgttaatattctttatctg

SEQ ID NO: 34108 - DNA, 1083 bp, Triticum aestivum
  Clone ID: PAT_TA_34108
gaagctattttcgacactgcaaggatttgtgtctgtcaatgggattgagagaagtgcttgcaacaaaatgcttcggtttacaatatggactgtgttctttgcaaatgttcttactggctcagtcttaaatcaacttaacatattccttgatccaaaagaaatacctgaacggcttgcggttgttgtacctgcacaggcatctttctttattgcatatgtggtgacttcatggacaagtataacatcagaactcactcaaacttctgctcttctgtatcacttgtgggggagctgcgcaaagtgttgcaagagggaagactcagaagctccatcgatgcactatcatagtgaaattcctcggattctcttgtttggacttctcgggctcacgtactccattgtagctccacttatcctcccatttgtgttgacttacttctgccttggctacttcatatttcgtaatcagctttgtaatgtgtatgcacccaagtatgacaccggtggaagattttggcccattgtgcacaatgcaaccatattttctcttgtgctgatgcatttgatttcgatcgggatatttggagtaaaggaatttccatttggttcaagtctgctggtgcctctaccaattctcacacttctgttctatgcatactgtggaaaccgattttaccccatcttcgaagcatactctactgagtcattgataataaagatatacaagaacaaagcaaaccagagatggcagagttcttcagcagtcttgaaactgcgtactgtgacccggcactgaagcctatccaacggtctttgaactctgatgaacgtactgcaccactcttgtcttctgtttagatccagacaagtcataggtggcatcctggctcccatggtgtgagatttttgtttggttttgggcttttgatgatcaggtacataacagtacaggtgtgcttcttgttgtgtttttacacggtaaagcagaacttaggacatgaatccttgtattattatgttgtacattttctttaggacataaattcttgtattattgtgtggttgtaaaaaaaaaaaaaaaaa

SEQ ID NO: 34109 - DNA, 601 bp, Triticum aestivum
  Clone ID: PAT_TA_34109
agcagtacgtggaggagctggaggggaaggtcaaagccatgcaggccaccatcgccgatctgtccaccaggatctcctgtgtcaccgccgagaacgctgctctcaagcagcaactggctggcgcaggtggtgcaggggtcccgccgccgcttcctatgtacccaggattgtaccctttgccaccgccatggatgcacccggcttatgcgatgggagcgcgcggctcccaagtgccgctcatgccgatacctcggctgaaaaccaagcagcctgcgtcggctgccgcagagccaccggccaagaagtccaggaagaccaagaaggttgcgagtgtcagcctccttggattgctgttactgatgatgctctgcgggtgtttggttcctgcggtaaatcggatgtatggagcatttgatacccaagagggagttcgtactggtcgccctatatcacgtcatgccacgctcatggccgtcgttggacctcgagacgggaaatcgggattaccagattataagctgccacataattcaagtgaaaagcctccggcgggtgttgtatattcccaggaatgggaagcatgtctagatcaatggaaatc

SEQ ID NO: 34110 - DNA, 760 bp, Triticum aestivum
  unsure (1)..(760): unsure at all n locations
  Clone ID: PAT_TA_34110
cggatccaagccccgcgtgcgtgcgtgcgtgcgttcattcattagcccgcacaaacacggaaaaggaaggcaggcgagagggggagggagaagaccgacagaccgtccacccattcggccggcggcggcgcgcggagcagcagcagcagcagcggagggggatcagcgagcggcgccgacccgaagcccctccccgcccaggcatttaggatggtggataacaagaatgacgggtctgaaggggttaagttcaacacatcacacctgatgcaatcaaccgaagaggttgcgagagcatttattgccgctgcttcagctgccaccgtgcaaccaacacggccatccgtcgtctattcgtctggggaagagagtggcagcccaatgcagaagctgcagcagcaattctccaagatcatgaaagggttttcaaattcacccgaagtgtctggaccatacaacccagaagtcctcacgacacacaagcggcagtggtcgaggttccagcagaagtcattgggtaataggtgcatcaaagaaccatcacatctttttgagagcatagtgattgttgggcttcctcctcaggcagatatccatgagctagaaaacattgctctagggagaaatgatgatgatgcaaagaaatcaagacatatatttggcaacaaccaccaccaagntcatgccgtatcaaatatggaacctcaggtcctttttgcatacccccctggagaggtctctttcgcttaagtacaaggga

SEQ ID NO: 34111 - DNA, 628 bp, Triticum aestivum
  Clone ID: PAT_TA_34111
aaaatgccggaagaggcaggtcctgaacataagtccagtgagtcaagaaggtctagaaagagccctgccccgagttaaaaggtctctagcgtttcatttctttgcacaagatatctgctgtgctcaccttgctgcatccgccagacgataactacagctgattattcgccagtggagatggacatgccaaccatttgttggcgcataccccttgtcagatgatcgctcgaacagggaattcatgtctggagccgagtagagaaactgaaatggtgaggatggtctactacatgtatagccatgccgttcataaagtccactagctgtcggtgagcgtgggaaagcattccctctagtaaagatccaagcgcgccagggatggtgaggtcctttctcggatcgaattggcgagtagatatttcaccttcctgtctccaggaaggcctctggttcatcctgtacatctagcatggctgttcattgtattttagttctttctagtgagctcttatcagtgcagagaaatgatgctcttataagtggaaaataatgcaacattcaggccctgtttggaaactctggaatccagcgtttaattaatgccaaatgtatgatatgcaaaagaaaa

SEQ ID NO: 34112 - DNA, 684 bp, Triticum aestivum
  Clone ID: PAT_TA_34112
aagccatcgctctgctcgccggcaatctccagtcaagcaatcctcgcacatctctccactccccgaatcctctctccaccaccagcgcagcagctcgccatggacgcctcagccaccgtagccgccgggaaggcgaagaagggcgcggccgggcgcaaggccggaggccccaggaagaagtccgtggcgcggtccgtcaaggccgggctccagttccccgtcggccgcatcgggcgcttcctcaagaagggccgctacgcgcagcgcgtcggctccggcgctcccgtctacctcgcggccgtcctcgagtacctcgccgccgagctgctggagctcgcgggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtgctcctccccaagaagaccgccgagaagtcccccaaggagcccaagtcgcccaagaagaccgccaagtcccccaagaaggcgtaggtggccactgcctagttatctcggggtagctgggatggatatatgggtgtgcttcagctcgaagcagagtgttattgttgtgccgttgtatcttctcatctgtaattcaatgaacaa

SEQ ID NO: 34113 - DNA, 630 bp, Triticum aestivum
  Clone ID: PAT_TA_34113
ctgtccgccgccaccccatcacaaattgatgcaccgccgccacctcatggatagccccgacgcgccgtcggtagccaaggcctccttccgctaccccgactgggtgatgctagatccacacacccgcctgaactaccccgtacccaccatcgattccgattaccctatggaagactttcacgcgaccaaggcgcacgcggagacatccatgggcgatcccatagacgtcttcttccgcgccgtgccaccgccaggtgcttctcgcctctatgttaactggacgcctcgccggtttacaaagggttcgtcgtcgtcgtcggggggcaggggagaggagaagatcgctgggatggattttacggacgggaaccccttgtcctggccgccaatggcaattcgatttcttctgaggctcactctcagcaacaccccggggtagacttcttcgtctacacggtccactccactgggccgccctcgctcttgcgtctaccccgattgcaaactcagattctcaaacagttgtctccgctctggtgggttagatcatatggtcacccttggtaacattggttttttatgtgatgctgaaagcgaagaatttgtggtggcagacctaatgattttgcc

SEQ ID NO: 34114 - DNA, 674 bp, Triticum aestivum
  Clone ID: PAT_TA_34114
ccgccggtggcggcggcgtggagccggcccggtcgctggagatcgctgccaagctcctcgccgcgcgcgacctggtcggctgcaagcgctttgcggagcatgcggtggacgccgaccccctcctccccggcgccgacgagctcctcgccgtcgccgacgtccacctcgccgcccagcgcctcctcccctccggccgccccgatcccctcgccatcctccagctccagcccaaccccgacagcgccgacgtcaagcgggccttccgccgcctcgccaacctcctcgcccctcgccgcaatccccaccccggcgccgacaccgccctccgcgccgttgaagaagccttcgcccacctctccgagagcacctccaccggcgccgctcccgctcctgctgttcccgggggggcctccgccgcagaagatacgttctggacggtctgcccccactgctgtcatgtgcaccactacgagcgcctgctggtggggcgctcgctcatgtgcgcgagcgccgggtgccggcgagcgttcgtgcccaccgagctcccggcggttccgcctattgtgcccggcaccgactcttactactgcgcctggggttttattccaaagggggttgctaagcccgctgatctgagcactgactggaagcccgttttttccatggcccgggat

SEQ ID NO: 34115 - DNA, 428 bp, Triticum aestivum
  unsure (1)..(428): unsure at all n locations
  Clone ID: PAT_TA_34115
gcacctgctgccctgacggtggcactggaggctggggtacacctgctgctgctgctgctgccactactgacggtggcgccggaggctggggagcagccactacacctggtgctgctggtgacgactcaggatggggcagcgccaagaaggccgtcccagctcaggactccggaggtgggtgggggtctggcggtgggggctggtgaaggatctttgctttgcagcataaaccataaactagctaccgtagaactatcaagtggaaacttgtttttatgtttgaaccctgttatgcttctgcctagtgctgtcgatgggtgaaaggtggcacttgtttgccacttggtaaatttgctatgtggttcttgttggcttggtacctttttgaacggcctaatgtttcattgcttgaccagtttttagccnna

SEQ ID NO: 34116 - DNA, 666 bp, Triticum aestivum
  unsure (1)..(666): unsure at all n locations
  Clone ID: PAT_TA_34116
ctcatctaacacagcctgaatcctgatgcgatggccttagccaccgccgccgccccgccggcgataacagcggccacctcgacgtcgttcccgtctctcctccaacaccactcacccggcagccgccgaacggtcacagccctggccttcgcgcggcgcttccgcagcaaaaaccctagccccttccgctccggcagcaaggccgccgccccggccccggccctcgcccccgcccccgaagacgacttcggcggcctcgagggggagctctggcgcctccgccgccgcgcggagctgcgcttccagcgcctcgccgcggaggccgacgaggcctacagcgacctccgctcctgcgtccgcgtcgtcggcgggggaccgcttggtcctgacttcggcgctcgtcgctgcgcttcgccgcattcgcccttctctggtccctcgctctctccgccgagctgggcgtcgctgggggctggccttgcgggcttggcgccagcatggggcgggctctggaacacacgaccggatgtgcagctgtggtaacgaagatggaccagaaatgtggtgctgatcncccgtgngctcgtnacagtaaggagcgcaggaaggagngagacanagaaggtccnatgtgctanaaaccnatgggacggcaagaagnatggg

SEQ ID NO: 34117 - DNA, 645 bp, Triticum aestivum
  Clone ID: PAT_TA_34117
cccgaccccgagctccttctcccgtgcggttcctccccggcctccctgccgccgcccaacctccaccagccgcgcctcccaccacatcccgccggcagcccagaaacgtcgcgccgcctgccgcccctacctagcagcacgaccccgactacttccaccacccgtgttgttgcgctcctcccgcgtatggccaccagcgttagatccaaccaccgcagagccctgcatcgccaaccaccgcctacagcgctggatccggtcgtccccgaccatctaccaccttcttctaccttgagccgtaggagagaccccccctctctttgtagttcggcgctggaagccaggctcatggaccatgccgccgtgaccggatgggccgttctcctcctcccttcttcctcacatgcgagcatgcgcaactcacatgtcgctcacttctctgttgaggaggtgagcagctgctccaccgccttcctccggctatcaccttcacgacacccacccacacggtggaccgcagtgaataactcggccatctcacggtgaaaatcccagctggcgggtgaaaaacccagccggcgcggacttggcatttgttccgtgtgtgtgcaatactccaagtgcagtgcatcggccacactgctt

SEQ ID NO: 34118 - DNA, 504 bp, Triticum aestivum
  Clone ID: PAT_TA_34118
agaatggtggttgtgatgaagatctaattgatgaagttgcctcagctgagagagtttcacaagaaactgcagatggcatggacgctaattgcatgcacggacggctcaattgtggtgctgattgtgtttggcaagcttccctggttgttagttttggtgtctggtgtatccgtcgggtgctaggcctgtcccttgcggaaagtaggccagaactttggggcaagtatacttatgttctcaaccgtcttcaggtgatccttttgtcttgttattttgcacccttaccgctgaaaaaaggattacaacatgcaccttaccgctgaaaaaggcaacctgagaagattaaaatgaagttccagtttccagtaaactatgctagagtccatttaatttgaggataagatttgagaatatatcaactaattaaccatggagggtgggaactgctacatgacaactgaacttaccatggtgattggaaccgactaatgagcatatatcaat

SEQ ID NO: 34119 - DNA, 631 bp, Triticum aestivum
  Clone ID: PAT_TA_34119
gtccgaaactcgcgggtcgacatcaagggtcgcacattttattttttggattctttctatgatgagaatagctcatatcatatgaacataaaaaagaagattatctcaagctttatatgcacttggtacgaagctcggctccagccaatggatttcaatgcattccctgttgtttaccctaaagtccctcaacaagataacgatattgattgtggcattttcactatgaaactaatggatggtgcccaaagaatccaacccctatagttttttcaccaaaagatgccccagatgcaaggatccgatatgctgttgatctcatgttcagccactacaacactttggatgacgagaagaagcgtgtgaaggagttccgcctatagacatgaaaaagtgctgacagctactaaaagataccactcatagatgataagaggagctgtatcaagagtcatatcagcaaaatcaaaggaaagaggagctacatcaaacacatagttagcaattgttaaacattttcgagatgtttttctattttttgtatgaacagagaatgtagacccttcttgttgctgtagacatatatatgccccctctatttttttgtttggttgggaaacatgtgctcccg

SEQ ID NO: 34120 - DNA, 760 bp, Triticum aestivum
  unsure (1)..(760): unsure at all n locations
  Clone ID: PAT_TA_34120
ccacgcgtccgagcgcatctacaaagttgaatcctcgatgttgatgcgctttacacatctctgggttgcaatgcccgagccagaaagcgacgcaagtcctgaggttatcgatgacattaggtcggagagtttggtgaagcttgctccttcaagcgtggatgttccgcttaccgaaagcaatgagaaggcacaaaatgcagaggaccaggtggttgctagtggaactgtggaaaatgttggtgttcaggagcctactgaccgtgagggtgaggctgttgatgatgagatagttttagctgcagctgatgagaaagatgggagtggtaatgagggtgatgaggacgatgatgaggtgagctttgacaggagtcctgcacgtgttgcaatcatagagaactctgaagctgcaaagcagatcatgaaggagcttggtgaaggatcctcaagtggtagtcctgtgtctggcttgagcagctcaagggagtacactaatagcatggatggacaaattgttcttgatgattctgaggacgatgatgatgacgacgataatgaggatgatgatgagaagggttttgactctcctgctttagctgccctactaaaagcggctaccggtgcatcccctggatgggaaacatcnacagtttncttcgcaaagaacggttccaagaaatcttttccantgggtagacccgctggtctgggctcctcagccccatctttgcggccaactgccccccgccaacctgcccggtca

SEQ ID NO: 34121 - DNA, 867 bp, Triticum aestivum
  unsure (1)..(867): unsure at all n locations
  Clone ID: PAT_TA_34121
tgattgaagaggccatggagagcagcagcaccaccataagagcagcagcacggccaaggaaagacatggggactccattgctgcactccttgcatgaggaacggagctgctgctgctgctgcttctgcatggtttcctaatcaaagctttagcatgagaaccagatgattaaacctgacctggtcaggaaagagggtgaggaggaaggagatggaggattggactctcacattgaccacagaagagagcaggtttgggtcaaggatcaggggccgtgcgggcgcacatccacactggtgctcttcacacttgcctcgggcagcagcttcctggctctcacccacgccatcacgtttcggttgaggccgccctgcaataagccaataatctatgaaaagaccagaccctcttgcgcaaaaacaattggtgcttttggtagccaccctttgattctcggattattgaatcggtaatggtacaatgatgcattttgtttaactacatgatctgatggatacgatatgatatgccccatcggagaagtattatttttaccaacttgactatgcaacaagtctctactaatcgcagcaggtggtcactggtcagtggtgttcgttcttggtctctctctttttggngnttttatttacttggccgntacttagtttgttacttctactttattcactcatgtaatgtggtccttgtgaatctaattaggacattangtgctggttggctgtcaggtgtcaactttgcacagtcgagtcttcagtttcagattagaacgtagacttggcatgcatggagatgcaagagacgtcacgtaagcaaagaaattgcctgccacctaagccttgggga

SEQ ID NO: 34122 - DNA, 730 bp, Triticum aestivum
  Clone ID: PAT_TA_34122
gcacgagaggccaacgagctgactcccgatccatcgatggcgtctagcgacgagaagcctgtcccgacgccggcatcaaccggaggcgacggcgggccgccagggaagccgacgacgacgtcgacgatgctgctggacaagggcgcggcggcgctgcagtcgctgcgcccggtgaagcagatgaagcagcacgtgtgcacgttcgccctgtacgcgcacgacccgcaccggcaggtggagacccaccactacgtctcccgcctcaaccaggacgtcctccagtgccccgtctacgactccgacgacaagcacgcccgcctcatcggcgtggagtacatcgtgtcgaggaagatcttcgagtcgctgccggcggaggagcagaagctgtggcactcgcacgcgcacgagatcaagacggggctgtgggcgaacccgtgggtgcccagcatgctggggaaggcggagctggaccacatggccggcacgtttggcaagttctggtgcacctggcaggtggaccgcggcgaccgcctgccgctcggcgcgcccgcgctcatggtgtcgccgcagggggagcgcgacggcgccgtgcgcccggacctggtgcggaagcgcgaccagaagtacagcttctccacggaggagctcagggccgccaggccgacgtggaggtgccggccgagccgcgccccggccaggccgactactgggtccgccaccacaagggctt

SEQ ID NO: 34123 - DNA, 1077 bp, Triticum aestivum
  Clone ID: PAT_TA_34123
aaactaaatcagtggactggtgtgctggttgattaggatctttcagagagaccaggattgcttgattaatcagcgagaaactagatcagtacttgggagttgggactggtgtgctacggttgatttggggatgtgcactagcaggtccctgcaggggtgtgtcatattggatactttacaaacattctgtaaattggtatcagttgcacactttttgtttatctccatatctatgatgactacctactccaaagcatccccacgttaatttgaaataaaaggagaagaccagaaccatgatttttattcaatggtggttgattagtagtgttcctctccaaccattgaggctcagtttccaagttctgacctagcatcaatccatcatgtaaattcccagtacatgactttatctcactgtggttaatttatcaaaggagttgtacgccgttgtttgaagcggatcaggtgcccgcctctgtctgcgaggcttccacaagtaatatagttgcggcctggcgctgcaacaatttgctaccgcggcgccattcaacttcctcaccagtcgctcctatgcccactcacaggaatctcaagacttaggaatggcgccccaacaattgtgagcggcacaaaggaagggtcgccatcaccaaggatgtgcgctgacaattgtggactccaaagaggaagaagttctatatttagtgcatggagttgctatttaaaattctgagaggtgttgaattttgttaatttttaagatattgacttggaagaattagtattttgcttgatgtaaactcagattaatttgtcatgtcatttgaaccgagcaacctttttgtgacaccacttcaaaaaaatctgctatagatcaaatactcataaaaatttaaatctcaagtaatcacagtccaaatcaattgatgtatttggtttgtcccttctatcatgctagatttttgtggcaggtcattgggatgtgtaagcaaatttagaagggtggaagtcataagaaataaataacatttgagaaccttgtctaacaaccttgtgcaagtccgagatgaacat

SEQ ID NO: 34124 - DNA, 358 bp, Triticum aestivum
  Clone ID: PAT_TA_34124
ctctcctcccctctccctcgtgttctctcccacgccgctggccctctctctcgcctcagccgcctcctctcctcccctgcgccgtcggctccctcatcctgcttcttcctcctttccgtcggcggcagtggtaactggtgagcatgggagcagcggctgcggctggacgccgtgagctcgggagcagcttgttgagatggtccaagcgcagttgggaacgaccaaggcaaggaggatcaagatctggatggcacgcctcaccctcgggtacctctttcacctccccggcgactggcacttatcacggaggaggaagggatggagagatatggcggctgcgactggagctggcggatgc

SEQ ID NO: 34125 - DNA, 776 bp, Triticum aestivum
  Clone ID: PAT_TA_34125
ccggcgccggtcccggaaggagcagaccccgaagcggccgcgacacccgccggcggcggccttccgttagtggccgtcacctggcgttccacggggccagtcgcactgttacgaaatgtgtagaagtacagaacaggaaagggtgcggaaagatgacgttgccaggctgtagacattaattgagggggactgcgggagtgatagcaaccagctagcgtggtgattcgagatatgatgattggtaactgggtggtgcggtcgatgaaggcatgagatggatttggccggggcagtgggtttgctcgcggggcggtgggaaggacgaagatagtggaagaatcgtgagatgatggtgctattattgactcaatcctttattagctctatttcgtgtggatcttccaggtgcttaaatgatgttgtcgctcgggtgtcttcttctactgaagttttaacaccatctggtggcgcttgagagcagggatggcatactttcatcagcagcggccaaacccccagcgccgctggtgctgtacacccctgtacccctcgacatccagtgcctcgcgtctgcccagcatgaacacctcctcaatatgtacatctctgaattttgccattgctagagaaagtagagcattgttttgctgtagctataatttgagtttagaagatacactcctctctttttgacgtcaattttttcaagttgtcctctccgtccagtctcatgtctttctctttagcagggatcaatgagtactaaacgagcaaaa

SEQ ID NO: 34126 - DNA, 964 bp, Triticum aestivum
  Clone ID: PAT_TA_34126
ccacgcgtccgtggatattctagaaagacattagcagacgaggatttaagatccatgattgaagccaatttgacctgtcgggtagatcaccatgaaaattgtgaagaaaagttgaatgaattcctcaaaaggacatactatgtcgatgcaggacatgataacaaagatgggatggcgaaactaaattcgaaaatggcacagatagagggcacttgtgcagcaaaccggatattctaccttgctgttccccaagaggcacttcttgatgtggcattgccattatctgacagtgcccaaactaagcatggctggaataggataattattgagaaaccatttggcttcactagtttgtcctcacaacgggtaacacagtctttgctgtcaagatttgaagagaagcaaatctaccgaattgatcatcttttgggtaaggatctaattgaaaatctcactgtcttgagattttctaatttggtgtttgaacctttatggagtaggaagtacatacgcaatgtgcaggtcgttttttctgaagaaacatcagcagaaacacaagggaggtactttggaaactacgggataatccgtgacatagtgcacagccacattcttcaaacgatagcactatttgctatggaaccacctgtaagtcttgatggggaggatatccgcgatgagaaggtgaaggtgctcagatcaatgcgaaaagtggacattgaggatgtcgtccttggtcaactcaaagatcctctggtgacgttgaccgatatacaaaatcaatgacacctacctactttgctgccgccatgtacattgacaatgcacgttgggatggggtaccttttttgatcaagactggaatgggacttatggagaatagagctgagattcgtattcaatttcatcatgtccctggcaatatctaccgtgaacgttttggtcatgacatagatctcgacac

SEQ ID NO: 34127 - DNA, 739 bp, Triticum aestivum
  Clone ID: PAT_TA_34127
cttcgagaccatcccaaataagctggaagcacaggcttacgctgagctgctggaggagaacgacatcagtattcccgcctggttctccttcacctccaaggacggagctaacgcggcgagcggtgaccccatcaccgagtgcgccgccatcgccgactcctgcaggagggtggccgccgtcgggataaattgcacggctcccaggctaatccatggactcgtcatctccattagcaaggtggcgagcaagccgatcgtggtgtaccccaacaccggggagacgtacgtggccgagaccaaggagtgggtggactcggctgctgctggcggtggtgcggcggggacggacttcgtgtcgtgcgtcggcaagtggaggcaggcgggcgcctccctcgtgggagggtgctgcaggacgggcccggcgacggtgagggccatcgcgcgggcgctgcgagaggcggatgctgcctccgacgccgatgccgacgacgactaccctgcggtggccgtcctgtagggcctataggtcaccctttctacatcgaccgcgatgctggcgtagaggtttatgtaaatcttcgttctcatggccctgttgtgatgtaaatcgttctcgtggctctttctgttatgacgaagcttggttctttgatctttctagttttagtcgtatctctgcggtgttgcggtctaacttgttttggctgcgtattttggccgggctttgagtctgcgaggt

SEQ ID NO: 34128 - DNA, 1378 bp, Triticum aestivum
  Clone ID: PAT_TA_34128
ctactcctcaaacttgtccccttctcgatatcctgcgttctcgtatacgtgctcggcgtgcgtgctagctagggtgctgaacgacatcggccggctgccatggggcgcggcgacggacacgacgacgcgctgcggcggtggctgcgggaagcgggcgggtggctggtggtcgacggggccctgggcacggagctggaggcgcacggcgcggacctgcaggacgagctctggagcgcccggtgcctcgtctccgctccccacctcatccgcaaggtccatctcgactacctcgacgcgggcgccaacatcataaccacggcctcctaccaggccacgctgcaggggttccagtcacgaggcgtgtcgagggagcagggcgaggcgctgctccggcggagcgtgcagatcgcgcaggaggcgcgcgccatcttcgtcggaaggccggtcgaaaggcccctacgccgcgcgcgatgagtacggacggcgtggcgtccagagcgcgccggcccgtgctcgtggcggcctccgtcgggagctacggggcgtacctcgcggacggctccgagtacaccggggactaaggcagatccgtcaccaaggaagcgctcaagaacttccacaggaggcggctccaggtgctggcggacgcagggcctcgatctcatcgccttcgagacagttccaaaaccagctggaagcacaggcgttcgctgagctgttggagggagaacgacatcaggattcccgcccggttctccttcacctccacggacggggccgacgccgcgaccgcgggccccccgccctcgccgaccgccgccgccggctggtggccgtcgggataagctgcacggctcccaggctcatccacggcctgatcctctccctccgcccggtcacgaccaagccgatcgtggtgtaccccaacaccggggagacgcaccggggagacgtacgtggccgagaggacggagtgggtggactcggctgctgctggtggtggtgttgcggggacggacttcgtgtcgtgcgtcgggcgggggagtcgctcaggagcttccctcgtgggacggtgctgcaggacgggcccgccatcgcgcgggcgctgcgagaggcggatgctgctgctgcggccgaagtaccgacgatgactaccctgcggtggccgtcctgtagagcctataggtcaccctttctacatcgaccgcgatgctggcgtagaggtgtatgtaaatcgtcgttcccatggccctgttgtgatgtaaatcgttctcatggctctttctgttatgacgaagcttggttctttgatctttcttggttctgtcgtattctctgctgtgttgcggtctagcttgtttggctgcgtatttgggtg

SEQ ID NO: 34129 - DNA, 1491 bp, Triticum aestivum
  Clone ID: PAT_TA_34129
gaattcggcacgagcggaaacaccctttccaaatagaatttctatttcattgttatgaaggttgattttacctatttgacttaaatggtgacctccatgcactcccatattttgcttagattctcatttaaatggtgagcgctcagattctaaatatcggctctttagtactgttttattattttaagaaaaaataggagcaatgtgattttgttctctagagactggaattgaatagtatgtccttttggtactgtcctattgccatttgtagctcccagatgcatcagttcgactaggcattatcatatatttatcatgttatttacagtagtatgatttctgcatagactaaataccttcttttgctaaaggttacttttcttcataaaatttaattcatgatgtagttttaccagttgtagtaccttcagcatagaagcagtagtggtctgctcccccaaatatctatagctcgtggatgtggcggtatggggaatagggagtagatggtctacttgctggcgacctcaccatcaccaacccatctgcaggtatgctagctcctcttctattaatgcaaaaaggagatgctcaaatggattgagtggtaccctcctgaaagtattgtagggatggacatatggattgattggtagccccctaaaagctacacagatctgaaccaataactttaataagaatgtgtatcccagctccttttataatcttgagtccttctcggtcctactaaactgtaactcatgtttcttttgggaaacaatattttggacatatactaattaaggtaatggactggggacctggtgagcatcgaggatttcaggcttggggtggcacagtagtaggatagcaggatgagttggatgtgttcttcagagaccaggtgatgtcgttgccgaaaggtacctgaagcacacacttctgaatttggtcatttatttttcctcatagctattttcccttaatacttttcttagagacatgataaaacattgtaaagttttacgactgttgcaatgatggcagtataataagcatacacataagatctgttgatgacaatctcaggagtgtagacttaataaggcctcaggatggtgtgcttaggtttatcagttcttgtactgcaccccacgcatagtacaacaaatggtccgtcagagtccgttgtaagctaagagctaagatgagtacaagaattttctgtagagattgttgcaaggagacatctctgtccagtgttagctaaattttattggtctcggcattggactatctatgcattggtctcacatcttattttcggaacatttgagtactcttcaaatatgcatacactgcatattttcagtgatagtctgaaaatatgcatatacactgtacagcagcatattggaaacattcaggttttagtataactgaatttttggccccttaaaaaaaaaaaaaaaaaaaaaaaaaaaaaaa

SEQ ID NO: 34130 - DNA, 1072 bp, Triticum aestivum
  Clone ID: PAT_TA_34130
gtcgaagccgtttgtatgtttcttttgggccgcctataaatgcttggcctcctggtcctctcgtcgcccaccccctatctctctattgtttgcgatctctccgaagaaatcgccacagccgtacctcctagctttgcagccagggaacccgccatcaagaggatggcgtggacggagagcaccactccccgtgtcacgtcgcccgccgctaatctccttgtctccgtccgctgaggagccgacggacggcttggcggcagtcccacggcggctgggctccccatcactcgacgaggttgagagagagcggcggctccccaacaatctcccagcagcaccagccgcctgccggtcctggaactcgacgtctcgacctgcaaccggctgtcggccagccccaatgatgtgggttccgtctattcttcctctacctggttgcgtccatccacttccacctcggctgtctcgcccacgaggagcagaattggagaacgaacgaagtggatgcggagaggccagcaaggagcgcgccaggagagacatagggcaggttttttcatcctcaaaccatactttatgcatgtgagcacgtcttattttgttacgtgtttgttacgcattagaggtttgaaaatctggatgtctcagttatccctgcactcgacactcgtgcacctaatgcataaggattagggcattcggccattgttctagactgttggatcgccttggagttatccatacatggtcttgcttgaagcgagaaattttccccaatgcttatcaggccactgttctggacagttgattttttaccttggagtgagaaaaatatactttcagttagacaaatttcccagcagtagattttgttcagttctatatgaggccattgtatatcagttatcaatcacactcaatatttgccttggaactctaaattttcctaacgattctccatttgagcctgtaattgtgccatattgctatgaacgtcagtgagccttgaagcaactggtgctccactgcgcactccctttggtaactacttttctttctaccctgctttttt

SEQ ID NO: 34131 - DNA, 1471 bp, Triticum aestivum
  Clone ID: PAT_TA_34131
attgcgcctgcgcagacgcctacgccattcgagcacaagcaccgatcccccgcttgcatcaccacaagaaagcatgactccccacatcaagctcgcaatccgggggaacgcgatggcccgcaccgcttccaggggtcacgcgacccaggtcaggtcgaaattgctgtatgaccacatccgtctcatcatgatgaacgtcaagggctcttgtttctgtgagtgtgcagacatactcaccctgctagagtcctagcgaaaggccatgaggctgctgctgagcgactgattttcctgcctttgtaagaaaactctactgcattcgtaatcaacttaatgacacgctggctttgtctttagcctaggctatggaaatgaaagcagtacttaataagccggatttgttttgtgttgcctgaattaaagcgcaattgaagatgagagacttgaacatccttacgcacctctgagttattggaattgatcggatgaatgctatactggatactatgttttgagctagcatagcagtggttatgcgctttctctggtattagatgtgacatgacctgttcaatcagctctttgtttggcgtggccgtcagcaaaccaacgcaatttttttttgcatatatgtaggaccatatgaactgctcttctgagcgcctagctcaaaagtaaggccctatactggcgcccagctgctgagcgcggctaggcgagcgcctagtagcgccttcttgaacagtggaaatattgacattctcaaaccaaatatgaggtgccctttattcagtccatgggagtatatgtaagttgactgcttcaaacccaatccatgcttgctgtttagtgaataaatatgctggtagaaaattgcaaactttgaaatatgaataaatatttgatggtaagttgcgatgaagattaaaattgtatcgcccacaaaaaagaagattaacattttattacatacactaatctatctagcaccaatgtcacgcagtcaatttcctttatccttagcatttttatgacataccttcttctatttagaatctttggttgcaatcagttcttttttctgcaaaaaatgaaatcagtttcttttacttttagcatatgtacttaacaactgaggtgccagtgaaaaagtaaatttatttttatttagtatttggtggatcctctgtttttataggtttcgacattgctgcctccatatagctttttgctgatatacgttgatggtttgatgtgtcgctcctagtccgaatgttagttttttttactggaccttcctttttgatcggatattgtttatatacgtgactgattcataatccagctgaactttcttttcatgtacatgatggagtttgcatccatatattattgtacgtgtcgaatgatagacttgtacatttaattatggtgcatgtcttcgaatatactcccattatgcatgtttttt

SEQ ID NO: 34132 - DNA, 707 bp, Triticum aestivum
  unsure (1)..(707): unsure at all n locations
  Clone ID: PAT_TA_34132
gctctcagagaacttgttcctgcagtagtaggatggggaggtaaactggatcagatattgagagtgttactgtcacatatcctggcatctgctcagcgttgtccatccgtttcaggggtggaaggtacaatagactcccatctccgtgttttaggagaacaagaacgatggaccattgaagtgctccttcggatgctgactgagttgttaccatttattcatcagaaagctatagagacttgtccatcaatagacccctcaagaaaactacatttaagaatccagccctaaaactgtatgcaacaggtgagacagaatggtcagcatttgagtggatgcacactgagtgcctgcccgatttgatcaagcttgctgctttttgcctgcaaaagaggatagcttaagaacaatngatcacaaagtacctgttggccttatctggaccctatggaaaatttacccaacgcacattatgttacttgtatttcttatgggaaatgataatggattacagcggccctgtaacctatttttctggttcaatcaagtccgtgcgtaaaccacatttgtctcatcatgcggatttggtccaaacccgctatcatttggtgttctttcattgctattggtctggggattttgggttcttctttcagntcgncacaggttagaagaatattttaaggaaattacttattccaaaacac

SEQ ID NO: 34133 - DNA, 673 bp, Triticum aestivum
  Clone ID: PAT_TA_34133
acacttgagatggtgacaaaagagaatgagcaacatgaaagggaaattgtttcactcgtgagtgatatgataacttgttcggtgaatgtcatgatctatgaggaacatctacttgagctgatgatggaatgcgaggctcttgagatcagaatgatcactgaaaagggaatgctaatggaagaaatctcctcaaggatgcttatgttgatgagctgcacagaaggattgccgtgatgggagcagaaactgcagaactgaaggcagagatgagcagatatctgccacttttagcatctctgtcggatcagataagcatgctggagggaggcacccatttactttcagataaagaaggcaatttggagcttgtacaagatgacagacgtggttcagagttcctagacataccatcaggagttttggagttggacagcttaattgcaagagttaaagcactccgggttgtgatattagatgtgaaggaccgccaagataaggagtttactgaattcactgctaaattggagtcggcgaatctagaaattcaagatcttaaatcaagaaaaggttcatgcattaggcacaaggaacaatacatggaggatgataggcaaaaatatgatgccgataactccaaagggaagcaagcacagatcatgaaagatatcgaact

SEQ ID NO: 34134 - DNA, 828 bp, Triticum aestivum
  Clone ID: PAT_TA_34134
gtcgacccacgcgtccgaaaccgcttccacgcacgggtttggctgcattctgagccacatcagctccattcagccacacggagcgaaagtgccatcggaaagacgatttcattttgccctccccccggaaccccctccccccatctcctccacctgttgtcgctcgcttgtcccggcctagggtttcgcctccacccgtcccccgcccccgcctccggtctcgacgccggcgacccccgatcctccttagtcgtccgccgccgaccccgccgagttccgattcgccactcacctcacgccacaccaccgcgtcctccagcctctggacgcgctcgcgggggacagatctagggtttggggccttgcttggtgcatgagaagggcaccagggtcttgacggcatggaggtggaagcggcgaggagggatgcgtcggcgcttgacccggagctgctgcagctgccagagctcgcgccgggcgcgctccgggagaactcaagcatagccgaggcactctacttgcagtggctcgtgctgcctgagtcgtccaagctggtgaaatctttgattgaagatgcaaaagccggtgccacactgaatgttgctgggagctctgctagcacaaatgccgcttcaagtagttctttgccgtcgatgttccctgctggtagtgcccccccactttctcccaggagcactgctggctctccccgtgttatgagacgaggatctagtgctggaccatcatccttgggatctcctctaaaattagtcagtgaacctgtgagagaagttataccccagttttacttcaaacatgggcgccctc

SEQ ID NO: 34135 - DNA, 730 bp, Triticum aestivum
  unsure (1)..(730): unsure at all n locations
  Clone ID: PAT_TA_34135
cagagatatgccaacttggcaggcaaacatgtcgttgttgaatatgacacaaaagatttgaagccacccatcttaactgtagaacaggcagtacagaacaatagttatttcgaagttcctcctgggaagtatccaaaacaagtcggtgatttctcgaagggcatggcacaagctgatcacaagatcctctcaacagaagtgaaacttgcctctcagtactacttctacatggaaacacaaacagcactggcgattccagatgaagataacactattgtggtctacagttcatcacaataccctgagcttgcacagaatgtcatagcgaggtgccttggcattccattcagcaatgtgcgtgtcattacaagaagggttggaggaggctttggtgggaaggcattcagatcattcactgtagcaacggcagctgcactttgtgccttcaagttacgtcgtccagtgcggatgtatctcaaccgcagtactgacatgatcatgatcgggggtcggcaccccataaaagcatattacactgttggtttcaagtctaatgggagaatcacagccttgcaccttgacattctcatcaacgctgggatttctccagatgcgagccccctaatgcctgacactatgatgtcaggcctgaagaatacaactggggtgctctctcgtttgacatcaaggtctgtaagacaaacaccacatncaagtcagtaatgcgtgc

SEQ ID NO: 34136 - DNA, 928 bp, Triticum aestivum
  Clone ID: PAT_TA_34136
acgcaacgcacatcaaaaatctcgcgacgacgaaacgtcgccctcctctcccccgatccgcacgccggcaccgttttctttccttctctatccactggcaacttcggcgaccgattcatgcccaactcctcccaccattgccatgcccacccgcccgcacactttcccatttcagtcgcggctccgtggcagggccgtgcttcaaatgccggtctccgctcgcttcattattcgcctgagcatgcagtaattcctccgggtcggcaccgggttcctgaaatttcgctccacttctagaattatattggcccgacgccgcctcaaggttggatttttagagtcaaacatcggaatcttggccgacacggactgggtttctttgagcaaaatcgcttgcctgctacccacccgctgagctagagattggattcgcgggggcgtttcggtggggggccgagcatgacgatcgatttgtccaccatgcccgggagctcctcctcccgtctcctggacgccgccgcggcgaggaaggacatgaacttcttcaaaaaccgctacgtgcttgggctcaccggcgtcgccggaatcggcgggttcctctttggatacgacacaggtgttatatctggagcgcttctgtatatccgggacgaatttcctgctgtcaaagacaatctattcttgcaggagacaattgttagcatggctttacttggagccatccttggagcagctgggggcggttggataaatgatgcctacggtcgtaagaagtctactcttcttgctgacctgatgttcgcacttggttcactggttatgtgcgctgctggcggtccttatgttctgattcttggaaggctctttgttggattgggtgtgggaatagcatcagtcactgcccccgtttacatcgctgaagctgctc

SEQ ID NO: 34137 - DNA, 759 bp, Triticum aestivum
  Clone ID: PAT_TA_34137
agaaagctccggagtcactcagatgttcaacgaggccaccttctgcgatgcttcgaccctcaccggccgctcatctcagagtaggaggggcagcggcggggatgtagggcgcgttgggggagaggtcgatgccgagctgcgcctactgaagcacggcggagagcgaggcttccagccaacgccgacgtcctccatggggccggctcagcccagcttatgacagatgcgcagctgcagcagcaccggcagttcgccatggtttatcagcaaactgcagttcatctttcaaaccccttgcgccgtcccggctgcaaaccccctcgtgctacctgaacgcattggggggagtcgccactggtgagtccccctaccctgcaaatgtatagggccccagcggctgccgcctgtttctttttgaggtagtttccgctttgacgtgcagttctgaagcgaatccgtacatgctgacttatatatacttgttgttttactgtttttgtgtgtgctttggttggccccattgggtttgttcatcagctggtcgaactggccgtggttgttctggacgtaggactctggaggcgtcgcttcttcgtcggtcttatatgctgcgggttctatgcatcggcctcgtggatcttctgctgacggttccaacttctatgcgtaggcctgctatcttgttttgtgtggactcctggtcgctctactgctggttcgttggccgatgtatctgttgcttctgtttctttattgagt

SEQ ID NO: 34138 - DNA, 1499 bp, Triticum aestivum
  unsure (1)..(1499): unsure at all n locations
  Clone ID: PAT_TA_34138
ncgtatgatcaagtaacagagctaacaggtgccgagggggtacaaaatgcactaagacggaacaatggacttggttgggtcacttccgcagcaagtgcctttgatgccgtcaaggatatcatggaagctcttaggagcaagcataccaatctagccaacgaacttgagcttttactgtctgaaattgggtcaagatttgttactcttcctgaggaaagacttcttgctgtggttaatgcactgcttcatcgctgctacaagtatccaactgcaaccacaggcgaggttccgcaatctctcaagaaggagctttctggtgtgtgcagggcttgcttttcacaagatgctgttaacaaacacgttgattttgttaaggagtacaagcaagattttgagcgtgaccttgacccagatagtgctactacatttccatcaacccttgctgaacttactgagagattgaagcactggaagaatattctgcagagtaatgttgaggacagatttcctgctgtattaaagctagaggaagaaagtaaagtacttagggattttcatgttgttgacgtagaactcccggggcagtattttacagatcaggaggttgcacctgaccacactgtcaagttggacagagttggacctgatataccaattgtccggagacatggtagtagctttcggcgcctgacacttattggttctgatggttcacagcgccattttattgttcagacatcattgactccgaatgctcggagtgatgaaagaatgctgcagcttttccgtgtgctaaacaaaatgtttgacaaacacaaggagtctagacgtcgccatcttgctatccataccccgataattattcctgtttggtctcaggttcggatggtagaggatgatttgatgtacagcactttccttgaggtttatgaaatcaactgtgcacggcataacagagaagctgattcacctataacaatttttaaagagcagctaaatcaagccatctcagggcaggtttctcctgaacaagtggtggaactgcgtttgcaagcatacaatgaaattactaaaagtattgtaaatgataatatcttctcccagtacatgcacaagattctgccaactggcaaccacctttggactttcaagaaacagtttgcaatccaagtggctctgtcctgcttcatgtcatacatgttgcagattggtggcagggctcctaataaaattctgtttgcgaaaaataccgggaagatcttccagactgacttccatccagcttatgatccaaatggattgatcgagttcagtgagctagttccatttaggctgacacgcaacatgcaagctttcttctcaaattttggcgttgaaggtctcatcgcttctgccatgtgttctgctgcccagtctgtggtttcacctaaacaaacccaacacatatggcatcatttggctatgtttttccgcgacgagctgttatcttggtcatggaa

SEQ ID NO: 34139 - DNA, 1010 bp, Triticum aestivum
  Clone ID: PAT_TA_34139
cctttgggcaggccgccgccgccgccgccgccggcggcgacaaccactccccgccgccggcccttgcctcctccgtccaggggtatgtccttgggctcacgggattccttccttgtgtaatcgtgctagaaaggaagtggctcgatttccgtctggattcagatcccaagcggactccaaaaggaactctatttatttattagtagcaaagtttgtttgtgacccgagatattgttagtaatcattaggatgtgatcgagtcctcctattcgtgtgctgcccttgttagcggactagccgcagcagatttcgacttctttgatccatctataataaggccaattggagattttgcggagatggaaaacaataataaagccgaagcccaacttgacagtcttagctagctgccggatcaccttctactcaacatattggagagggttgaaacgctagatgccttgagaacctgcatcctgtctaggggaatgctcgagcttcgccccatgctgtcgctgcttgatattgagactatccctcttgcgcgttacctcaagcccgatgtcgacacctttaatcgtattttttcagtacaacattgctgtggctgctaccacggacaagatacttggtgcgaggaatcccgagatccccatccgcgagctgagggtcaggttctgtttgaggcatgatgagtgtctctccatcagccaagctgttgcccgcaccatggcaacccacaagctcgatgtcgctgagtttgtcgtcctcacggagaagactagttggagatgcactcaacatgatctcctctcctttgccaagcggttcaatacttggtttggtgattgtccagttgtgtttgctggtctcacgcacctgtggctgcggaatttgaggtttggtgaactggacatccacaacattctcaacacctgcaagcgcttggaatctctgcgtctcacccattgtgaaccaggggtccgctccgtgcttcaagtacagcatgc

SEQ ID NO: 34140 - DNA, 538 bp, Triticum aestivum
  Clone ID: PAT_TA_34140
cttcagagttcagtcccctccagctctcgagttcgacagatcttggctcacttcaccgccggcggacgcagcgaagcgagggaggagcaatggcggaccgcgggggctacgtgcaggtgcagcacgggcagtacggcggcgggcaccacggcgggcagcagcagcacgggcgccagatgggcgagcagatgaagggcatgttccaggagaaggcgccgtcggcgtcgcaggcgctgacggtggcgacgctgttcccgctgggcgggctgctgctggtgctgtccgggctggcgctggcgggcaccgtggtggggctggccgtggccacgcccgtgttcctgctcttcagccccatgctggtcccggccgcgctcaccatcggcctggccgtcaccgggttcctcacctccggcgcgctggggctgggcggcctctcctcgctcaccgtcctcgccaacacggcgcgccaggcgttccagcgcaccccggactacgtggaggaggcgcgccagcgcatggccgatgccgccgcgctcgt

SEQ ID NO: 34141 - DNA, 1302 bp, Triticum aestivum
  Clone ID: PAT_TA_34141
gcggcacgaggcttcacttcagagttcagtcccctccagctctcgagttcgacagatcttggctcacttcaccgccggcggacgcagcgaagcgagggaggagcaatggcggaccgcgggggctacgtgcactcgcatcacgccagctcttgagttcgacagatcttggttcacttcaccgccggcggacgcagcgaagcgagggaggagcaatggcggaccgcgggggctacgtgcaggtgcagcacgggcagtacggcggcgggcaccacggcgggcagcagcagcacgggcgccagatgggggagcagatgaagggcatgctccaggagaaggcgccgtcggcgtcgcaggcgctgacggtggcgacgctgttcccgctgggcgggctgctgctggtgctgtcggggctggcgctggcgggcaccgtggtggggctggccgtggccacgcccgtgttcctgctcttcagccccgtgctggtcccggccgcgctcaccatcggcctggccgtcaccgggttcctcacctccggcgcgctggggctgggcggcctctcctcgctcaccgtgttggctaacacggcccgccaggcgttccagcgcaccccggactacgtggaggaggcgcgccagcgcatggccgacgccgccgcggccgcggggcacaagacgcagcaggccggccacgccatccagagccgcgcggaggaggcgcgcgccggaggaggcggccacaccggcgccaccggcggagcgggcgccggcaccggcaccagggcgtcgtcgtaagctggagctagcaggccgatgccagtcggccgcgccgcgcagcagggcgcgcgcgcgtcgtctgctacctgctctatgtatgctagtgccttcgtacgtgtctacacgagcgagtgtgtgtgttcgtgcgtgtcagtgtgtgtgtgtgatgtttctactgttttagtactgctcgtgttcgtccgatcgatcggtttagtaccgagttgtgaataagaaaaggcccgggccgcttcgtctgtccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggggggggggaaaaaaaaataaaaaaaaaaaagggggaggggttttagggtttcaaagattccaatctgctggccggcgactttaaaacttttttaatttttgtaccggaaacaaaaaaaaaagcccccggggccaaactttaaaaacggggaaaaacggaaaaccccc

SEQ ID NO: 34142 - DNA, 637 bp, Triticum aestivum
  Clone ID: PAT_TA_34142
gcacgaggtcgccctactcccgccgcctctccgacttctccaccgccgacttcagcctgtccgtcatacatgacccggccgcccaccggatgggcatgggcatgggaatggagaagctcgcgttccgtgcgcaggccagctccttctggcggctggccaagatgaactcgcccgagtggggctacgcgctcgccggctccgtggggtccatggtgtgcggctccttcagcgctatcttcgcttacatcctcagcgcggtgctcagcatctactacacgccggacccgaggcacatggaccgggagatcgccaagtactgctacctcctcatcggcatgtcctctgccgcgctgctcttcaacaccgtgcagcacctcttctgggacacggtgggcgagaacctcaccaagcgcgtgcgcgagaagatgctcacggcggtgctccgcaacgagatggcctggttcgacatggaggccaatgccagcgcgcacatcgctgccaggctggcgctggacgcccagaacgtgcgctccgccatcggggaccgcatctccatcatcgtgcagaactcggcgcttatgctcgtcgcatgcacggccgggttcgtctgcagatggggcctctcgctcgtgctcct

SEQ ID NO: 34143 - DNA, 696 bp, Triticum aestivum
  Clone ID: PAT_TA_34143
ccacgcgtccggtctctctctcccagcaccgctgcacagagcccagaaccctcctccagcccagaaccctcctcctccggcggcggcggcgggcggcgaggggagatgagcacgtggaactacgtcgtcacggcgcacaagcccaccagcgtcagccactcctgcgtcggcaacttcaccggcccccaccagctcaacctcatcgtcgcgaaatgcacccgcatcgagatccacctgctcacgccgcagggccttcagcctatgcttgacgtgcccatatatgggaggatcgcgacgatcgagctcttccggcctcacaatgaggcccaggacttcctcttcgtcgccacggagaggtacaagttctgcgtcctgcagtgggacgcagaaaaatcagagcttctcaccagatccatgggagatgtttctgatcgcattggccgccctacggacaatggacagattgggatcatcgaccctgactgtagacttattggccttcacctctatgatggattgtttaaggttataccattcgacaacaaaggacagctgaaggaagctttcaatatcagactagaagagcttcaagtgttggacatcaagttcctgtatggctgtctcagacctacgatagttgtgctctaccaggataacaaagatgccaggcatgttaagacatatgaagttgcactg

SEQ ID NO: 34144 - DNA, 1225 bp, Triticum aestivum
  unsure (1)..(1225): unsure at all n locations
  Clone ID: PAT_TA_34144
ctgtcgaatttgtcagctgctcagaggaggtgaggctgttattcttttttgtttgatgggagttattcccaacttattgtttggtcgatttttttcctgctaccatggacagccagccaccatggcctctgaacttttgtctgttcgtgagcttggagagctgacacttcgcttttttgtgcctatatttggccacattgtttcttagcaaatattcatcatctaacattatacatatgattctctgttttgccactgcagtggaagtgagtagaatacgtagggaaaaagaagaaggaaacaacagtcttgcaagctaataaagaaacagtagcttgctcacaaaatttccatgagtggtaacgcttctcttcatacatataatctgattttcgccactaataattagaaactacaggattgtagacacactgatttatttgagaggaacacaagtgaattttaccttagttatgccagttctattttctttcagaaaatcctttttatggattgatggtgggacttgggattaaacatatacatgtgtggaagcttctctttgcataattntgttactgatgcatctatatttttcctcttaacttggggctcttttaaaaaggaagcacctcatgtgtgagaattggttggatttactattttctatacaacctgaatgtactagaagggccaacattcatgaaactataaccagccatagtaatcttgctattgatatatacacactgaaagtctaaagacatgctagtaaaagctactttctttgaaagcagcaataccatttatattcaatgggactgccattgccgcacctttgattgctttttaatcttgctatacatatatacacactggaagtctgaaaatatgctgggaaaagctacttgctttgaaagaggcaataaggtttatattcagcgggactgcaattgtgacaccttatagctacaactcctcttgaaaatgaattgtgaaaggatgtgtcatattggaagtgaaactgtgtgcatgtaagctctaatcaagctcttctggtgaaattcaactttttttacgacatagtaacacaattatgtttgatgggcatgaaagcatcaacacaaacacgtgtttttaattcactcatttattgtatgggtttgaatcatgttagacacatcctagttttggaattgaactggctaaacatacagacacctat

SEQ ID NO: 34145 - DNA, 576 bp, Triticum aestivum
  Clone ID: PAT_TA_34145
ggccttatcccgatccctttcctcctctcagcggacacgtggggaagcacgggagcacaccggagcgtcgatgtggaggcggcggatcagaggagccggcgaagaggtcggccaggacgggaatagcagcgccaccgtctcttcctcccaaattttcagtgcggagctggagtaatgccgtcggcgtcgtggtcgatccgtcaagggtgcgggatgtgggatgtccacccatccgcaactactggaagaacacgctggcagcgagtgtccccaagagcaagggaggagatgatgttgcagctcaagggggcctcactacctgaaggtgagcatggatggcgcccattttcccccatcaaatttgtacaaattcgttgcagagcaatggacatttgtgtttgaatcagtgggtgaatattttgcaatcaatagataggcagttatgtgaattatggggagaaagcagtcccttggatttctagaagagttgcctcgtattgtaatgcagttgcttgattttgttagaacagatgtttggttttgccaggccaaaaaaaaaaaaaaaaaaaaaaaaaa

SEQ ID NO: 34146 - DNA, 1850 bp, Triticum aestivum
  Clone ID: PAT_TA_34146
gtcggcacgtgcctccctccctgcctccgcccctcccgtcccctctgcgccaccttagccaagctctcctccttccttccccgcccgcgcgcgctctctcctcgccggcgccgccccgcgccatgtcgtacaacaagaccgcctccatcaccgccgagaccataaaccccaaggtgaagatcttcgactacgagccctgcggggagatcgccaggcacgcagagcggttggcgcaggagatggagaagagcccaggttctcgccctttcccagagataacatactgcaaccttgggaacccccaggctctcggccagcgacccataaccttcttccgtgaggttctttccctgtgcgacaatccagctctcctgcgcagggatgaaactcgtatgttattcagcccatgtgccataaatagagcgcggaagattattgagtccatgcctggcagaaactctggtgcatatactaacagtcagggaatcagaagtttgcgcgaagcagtcgcaagtggaatcgctgcaagagatggttttccatcaagaccagaagacatctttctgacagatggagcgagttcagccattaatttgagtatgcagatactcattaggtcccaagaagatggtgttttatgccctttacctgaatatccgttatactcggcgtccattatacttcatggtgggactatggtaccatacaatcttagtgaggacggtgattgggggcttgagatcttcgaagtaaagaggtgcttggaggaggcacgcatcgcaggtttgactgttcgggctatggtgatcataaaccccggaaatccgacgggacaggtactgtctgtcaccaaccaggaggagatagtagaattttgtcggaaagaaggtttggttatgcttgctgatgaggtataccaagataacgtctatgtggaagataggaaattccattctttcaagaaagtagccagatcacttgggtatgacgagaatgacatctccatagtgtcatttcactcggtctcgatggggttctctggagaatgtggcagaaggggaggctacatggagatatgtggttttggagatgatgttatgggtgagatttgcaaagtggcttccgtgactctttgccccaacataggtggtcaaattcttactagccttgctatggatccaccgaagctgggagatggttgttttgagaattttatggctgaaaaggaagacatccgtttatctctcgccaagcgcgccaagaccttggcgggcgcattcagcagcctggagggaatgacctgtaacagagtagaaggtgcgatctacgccttcccacggatccacctccctgcagcggcgatcaaagccgccaaggccgagggcatgtctccagacttgttctacgcgtgccgccttctcgacgccactgggattgccgtcgtccctggctctggattccaccaggtgtctgggcgaaacaaggccaccgggacatggcatatccggtgcacgatcctccccggcgaggacaagatcaaggtaatgatcccgcgcctcaaggagttccacgagtccttcatgaacgagttccgtgaccgaagctgatgcgcatcttcagctacacaagccacaggccggtcagagccccgaaggcggtgtgatcttcactaccctaccctgtaaattaagcctgtgttgtactgccaataaataaactttcactaccctgtaaattaagcctgtgttgtactaccaataaataaactttggcagcggtgtgttcgtccttccctgtaaattaagcctgtgttgatgtaatacactttggctctgcaaaaaaaaaaaaaa

SEQ ID NO: 34147 - DNA, 824 bp, Triticum aestivum
  unsure (1)..(824): unsure at all n locations
  Clone ID: PAT_TA_34147
tccgggctccgcacctcaccgccagtaagccacagcactccccacccggtcttcctccttcttcatgcgctgatcgaccgcccgaaaccgcgcgcgcgcgagccaactccgaccaagaaagccccagcggcggccgtccaaggaggggagccaccatgcactcccagaaccactggggcggggcgttcgacatcgacggcgcggaggacgaccagagccgcaacatggacatcgaccgccggcgcgctgcagcaccagcaccagctgggacgagaccgcagcagagctgggctgctcggcccgccgggaggccaagaaagaacggaccgctacgtcgacctcggctgcgtcgtcggcaaagcgcaagttcctctgggctgggatgctctcctcggcgccggcgccttcgtcctcatcggcctccctatcatcatcgccaagaacatccccaagaagaagccccacgccccgccccccgacaagtacaccgacgccctccacaaggccctcctcttcttcaacgcccagaaatccggcaagcttcctaagaacaagggcatcccgtggcgcgggactccgggcatgaaggacggcgcggacctgccggacgtgaagggcggcctcgtcggcgggtactacgacgccggcgacaactcaagttccactttccgatggccttttccatgacgctgctggagctggtcggtggtgggggtcccccgacaggtacaaggcgatcggggagtacgaccacgtgagggagcccctccagggggggacccgcctcccgcctgctcancttcaactcctccgcctccaacatt

SEQ ID NO: 34148 - DNA, 818 bp, Triticum aestivum
  Clone ID: PAT_TA_34148
caaagttcttctctggtgtggaacgagaagctcaaacctgcttaggcatctgcataaaggtttcctgcctgctgtttgtcatctgcctgtgcccggatacatgtttggtcgagccatagtctgttcggacgcggcggctgaagccgctcgttatggctatacggcggtggaccgtccagaaggatacctggtcttggcagtggcctctctggggaaagagatcaaagagataacaggcacaccaggagcagaggatgtgaaatccctggaggagaagaagcttggcgtgaagggggtggggaggaagacgacggacgagtcggagcacctcacctggagggacggcgtcaaggtgccctgcggcaagctggtgccgtcggggaacgagcacgggccgctcgagtacaacgagttcgccgtgtatgacccaaagcaggtgagcatccagttcctggtcggggtgaggtacgaggagcagaacatggaggtggtgccggacgagtgaagggtccgctcctcgggcctccggtcatgaggtcgacggttccctgtattttggaacgctgtagtggtagtaaccgtttgactcctgcgatcggtgcggcgatgcgttcgacgatgcgttcgactatgttcggtcgcccgtgtcccattttgggctgccttctggtttcatcgccgttgccgccggttagtaggcgttgctgggtaacttgggtaggagaaacccttgtagttgtagtagctgaagtgctgaacatgctgtgcccgtacagatgtctgtagcagaatgtatatgtatgtatctgccagctggg

SEQ ID NO: 34149 - DNA, 676 bp, Triticum aestivum
  Clone ID: PAT_TA_34149
cggtccggaattctccggtcgacccacgcgtccgcgacggtgcagtcgagtccgagatctaggatcgtggcagtggcggggggactggatgctgccgggacgaccggcggcgagcatcatcgggcggcgccgagcatcgtcggccatggcgccgagctacacgacccccttgtttttgcggcggcggacgacagctacatgtcagacgaagaagtaatggagtctggtactgcattcagccaacgttttgcagcaaaacgcttgcgcggagttgcgaagacaaaactcaatcccaccaagaggcactacattaatgaaactggctttggtgatctgatgaccatttcacatttcaaagcgccacctgatctgatggagtggttaactatgaacattgacactgaaaagcgtgagctcaggctgagtcggactaaggtgattgtgtttactagagacatggtgaagaaggttttcaatatcccatcaggcaacagaccagttgagcttttcaagagacacgagcagtgtgagctacgcaacatttatcataagaatggcagggctccaattgcgcatacagtgactgtgcttcaccgagcaaggaatgatgatggcgatactacgaagagatcatgggtgctcttggcgcttgcaaccgttttaactccaagcactg

SEQ ID NO: 34150 - DNA, 994 bp, Triticum aestivum
  unsure (1)..(994): unsure at all n locations
  Clone ID: PAT_TA_34150
gcacgagggtccatcagcgtgtcctcccatctccacttttttcccctctaaaaccccaacgccctcctccaatccccctatcctcacagcaaatggtggtggtggtggtggtgggtacacgcggaggagagacctcgtccctgtgatgccctgccatggctgcccgcgcgctggtcgcaccccctttgcctccaactccccctctgggtaccatgcgggcaaccccgcgcgtcgccgccggtctcagctcagcgctgaccggccaccggggaaggcacactttgtgttcagtgcaattgacagaatcccccagtggcaatcttcaggtggaagcaaactcgtctcattccccaactcaactgatgtctacaggacatgatgactcagccataacatgtaaaggattctgtacgatatcatggagcgttaaagcagatgttatggatggttacattatcttcataacaggtgatccagttaccctgggttgttgggaacctgatatggctggtcagttgaatccttctgttaaaagtagcaataaatggacggctgtaatcaaggtaccatatggtgggcatttcaagtataattattttggtcgagaggaaaaaaattcctctaatgacatcatatggaggcctggacctgagtgctccttatcgatacctttctgttagccagaanaatcatgtcatccttgtaaaagatcagtggatggaaaccagtgtggcagggtattttcctctccttcctgggggatcatgggctgatgngaagctgatttctggttgaagctcaaattgctgagagagggaaagcgtgagagcattgtgaaagcccactctgttatagatatggtgggacggagcttcatctgtagttgattggcaggtgagcatattataatgagactttggaatggcacacctttagaatcaagtcagtccatccttcagtgtgcatgatgaattttgctggcactgataaacca

SEQ ID NO: 34151 - DNA, 1390 bp, Triticum aestivum
  Clone ID: PAT_TA_34151
gaaaaaaatccatggcgtccgacgacctcttcgaaggcctgcctccgccagcggcgcccgccggcgaagaccgcgcggcctcccccgcgccgcctcctcctccgccggaggctccggcgccgaggcggtccgcgctgaagagctccctcaagcgcgacaagccctccccttcctcggccgccacctcctcctgctcacccgccaccgccgccgccagcgtcgctccccccgatgtcgccgccgaaggccgcgttcctgagaagcgtcttcgcttcagaactactgttgatgcatcagaaatgcaaatcattgaggctatgcagaagataacttcacatatagggaatccttcaaaattcagcaaggcatcaaagcttgctctacagcttattgaggctggaagtgtcaagccagagacaatcggtcacttctttgctgtactagaggctgcaatgtcttcaccgggagcctgcaatgaaccttctgtacgtgcagattaccaggcactgtttaatgctgctgagggtgtaacagagtgtttcaaccaagagcagaaaaatcagtttgatgtatggatgcttcacgcagtggtggctaatgatctctgtactgatgacagttttgtgttttcaaaggctgtagggaagattaaagatgccatttcagccctgccggtagcgacagtggacgatgataacgatgaagcagcagcacttgcagcacttgctgagatccaatctggcgccacagagaataaggcagccgatagcaacacacctgctgcagcgtccaactctggagaagaatcctcagatcctttcggtctagataatctcctggagcacaagccaaagaaatccgagaagtctcaggataagggggctggagccctgagcagaaaggcagacgaggagtccaggagacttttgaggtcacggcgcgaagccctcctgaaatgcctcgagacagccgctcggcgcttcaggataccatggacgcagacgagcatcgacatcctggggcggcacgcgttcgagagcgtggggcggttcacggcccggcagcgggaggcggtggagaagctgtggaactcgatcaaggagcagcagatccggcgcaagcacggcaagtcggcgagcgggaagctggacgtgaacgccttcgagcggctccaggagaagtactcccacgagaagatcagcatccggcgcgccgtcggcggcgcgggcgaccgccgcgccacgcagtggctcggctaaaggcaaagtcggcacgcccggccgcccccgcatgtaaaaccggtgcgctgtctgatgaccgcgacgttacaccgatcaggatggatgacgaaaaacgacgttatagttttcaaaaaaaaaaaaaaaaaaaa

SEQ ID NO: 34152 - DNA, 1496 bp, Triticum aestivum
  unsure (1)..(1496): unsure at all n locations
  Clone ID: PAT_TA_34152
ggctccgcctcggagcgcccgcggcgaggcacggtgacagctgccggggagacgctcggtgcgcggagggcgacgctgcatcagaggcgaagggcgctgcgatgagtgccaaggacaaggtctccgaagcagccggtggaggccaaccgacgcccgcacagacctctgtcggcccggggggaaggcagcacacatcaaggatggagcggctgcgaaccgtgaggagtgcccaaggacaaggtcgctccgaagcagccggtggagccaaggagaaggcagcagacgtgaaggacaaagcagctgaaacagtgacgaatgccaagggcaaggtttcagaagcagccggtgaagccaaggagaaagcatcgcacgtgaaggaccgagcagctgagacagtgaccagtgccaagggcaaggtctctgaagctgcagggaacgccaaagacaaggtctctgacatcgcagagcgagcagaggattacgccggggatgccgcagagagcgcggccgagaaggtggcgcgggccgaggaggtcgccaaggcgaaggccggcgaggtgaccaagaacctgacggacatcgcgaggcgggcccaggaggtggcagtccgatgcagcgggatacctgctcggcgcgcccatggaggccgcgcgcaccgcgacggcggtgatgcacctgctggggttcgccacggcctacggcgcgtgcgtgtgggtgacgttcgtgtcgagccacgtcctcgctgcgtcgctgccccggcagcagctcggcgtggtgcagagcaagctgtacccggtgtacttccgcgccatggcgtactgcgtcggcctggccctggcggcgcacctgctcggccgcgagaggagctccttcgcggcgcgcgcccagagcttcaacttgctcagcgcgctgggactggtcctcgccaacatgctgcttctcgagccaaaagccaccaaggtgatgttcgagaggatgaaagtggagaaggaagaaggcagaggaagggacatgtccgacatcgtcgacccgccggccgtcaccgtggccacggccgccacgaccaccacagccacccccacggcagcaggagcccgcagcccggtggacggcacgacgggaaccgtcagggcggcgaagaccacgacgacgacgacctcggtgacggcgcccgacgcggagatggccaagagcaaggtggtgaggctgaacaagcggctgaagcagctcaacagctactcgtccctgtgcaacgtgctgtccctgatggtcctgacgtggcacctcgttcacctggctcgtcgcctgcagatgagcaccgcctgctaggctcgtcgtctccgtgcggatgggatgtagtcttccatgtagctttgcttttcgtgttttaacgtagtgtggtctgacacgtgcgtggttgctcagtgtgttttgagaaaccactttgtagatttaggcatcgtgttccccctcnnnnnnnnnnnnnnnnnnnnnnn

SEQ ID NO: 34153 - DNA, 667 bp, Triticum aestivum
  Clone ID: PAT_TA_34153
gtctgctctctctctctccctcaacctcccacggcatgtatcgaccccttctgaaactcctcatccgagtggccacctgatgccgccgtgtagaacacgctcactcctgccttcgcccgcctgtaccaggatttgctcctgtggttcaagttgaataccggggagatggagatggtgacatggctggcttctgtggtggtggccgttgggcctatctgaagagcaacaatgtaacgcttttgagcttaggtacaagaagtcgtatttgaaaggggacgagatgatgttcatcaaaatgaaactgaaaaggagtgggaaacaataccggaggaatcgtgatctatggcaagggtgatgatgtctatggcgatgattgtcatgatctatatggcgatgagcgttatgatccatatggtgatgaagatgagtctaatgatctttcttcaggacatgcaacaaagtgaacttctgaagttttggtcaattttagcttaggcataatgcttggaccattatatattagttactattttgttttgcatttcaaacttcctagatagatcatgatgaacaatgtaatttggatgcacgtcatttggcttatggtattttgggaagttgcgctaaatataatatatgttacttgggtcaaaaaaaaaaaaaaaaa

SEQ ID NO: 34154 - DNA, 747 bp, Triticum aestivum
  unsure (1)..(747): unsure at all n locations
  Clone ID: PAT_TA_34154
cgattcccacctccttgctcgcggataagcctccgtccctccgcgcgccgccgcctttgacaaccccgatggcctcccagggagcggccacggcggcgtggaccaacgaagaggacaaggcgttcgagaacgcggtcgcggccggtgcgccgccgccgctggacggcccgccggaggagtgctggttcgcggcgctcgcggcgagcgtgcccggcgcggtcgacggaggaggtgcggcgacactacgaggccctggtggaggacgtcggcgcgatcgacgccggccgcgtccctctcccgcgctacgccggggaggactcttccgccgcggcggccgcagcggcgcctagcaaggaccggcgcgaggaccggaagagcttcgactccgactccgggaagggctgctccaaggcggagcaggagcggcgcaagggcatcccctggactgaggaggagcacaggctgttcttgctggggctggacaagttcggcaagggcgactggcggagcatctcgcgcaacttcgtcatctccccggacgcccacgcaggtgggccagccacgcgcaagaagttacttcatccgcctcaaactccatgaanccgggaaccgccgccggctccagcnatccactgacattcaaccagtcattcaacaacgcccgcccaaggcccgtgnccgcccatctccggccaggcccccgccgcgctgggggggccgcccgggggcatgatgaagcatcccggg

SEQ ID NO: 34155 - DNA, 1327 bp, Triticum aestivum
  Clone ID: PAT_TA_34155
cgggtcaacgaccacagaacggggtaacagtgactcttgcatgacttcattgacagacatgcctatcagctcttattgtggttcataagtgatgaagcaacacgaatcatctggtgctcctcctttgctagtcaaggatgagttggctgtatcaaattttgttaaacaagcaagtttcctagagaagaccgaggattgttgtctttcccaaaacaatggaatgcacaaatctcagttacgcctttggatcgagagtggacataacatgaagtgtgaaagcgtgtcagcctcaaacagcaaaggtcatgatacaccaaacaaggcaaatcgaaagagatctcgaccaggagagagttctaagccccggccaaaagaccgtcagcttattcaggatcgtataaaggagctccgggaacttgtacctaatggtgcaaagtgtagcattgatgctttactggaaaagaccatcaagcacatggttttcttgcagagtgtgacaaagcatgctgacaatctcaaagattctaatgaatctaagatacttagcggtgacaatggtcctctttggaaagactactttgagggtggtgcaacatgggccttcaacgtcggcagccaatctatgacatgcccaatcatagttgaggatctcgaccggcctcgtcagatgcttgtggagatgatttgtgatgacagaggtatcttcctggaaatagccgactttatcaaaggtcttggactaaccatcttgaggggtgtgatggaagcacgcaaaaataaaatctgggcacgattcactgttgaggccaacagggacgtgactagaatggagattttcctctcactcgtgcgcttgttggaacccagttgtgatgggagtggatcaggagagaaccaagaaaatggaaaaatgcctcttgggattgcgcagcaccagattatcccagcgacaggccaccttagatgagtgatcgagcatgggcagcatcaaggcacctttcaagagctaagagcaggggttcagctcgcttctgcaatgactagcgttgtcagctcacgactagctggtttcttgtgacgtaccacggatctttctcacaaccgggcgtgcagaaatcctaacacagtagaaccatgaaggcatcgacaattggtttaacaaaatgatcactaggaagtgtttggattgtaaaatctttgttcctgttttgttactgatgtttcttctattagcgagttttgttctgttgatctactgaatgacaattctaggttgatctgtctagcatgagttttactattggcaaatcacgaggctttgttttca

SEQ ID NO: 34156 - DNA, 662 bp, Triticum aestivum
  unsure (1)..(662): unsure at all n locations
  Clone ID: PAT_TA_34156
cgtccgcctctccccatcaaaaccgcaccgggaggagcgaaagcagactgccatccatggacgcctacgagggcaccaaggttgtgttcgcgcgggtgcaggcgctgcacccggacctcgcctccaagatcatgggcatgctcctcatccaggacaagagcgaggaggacatgatccgcctcgccttcggccccgagcacctgctccacgccgtcgtcgccagggcacgcgcctactcacctcgccgccgcccaccacaagcaagccctcctctccgcccaccgcgtcctggggcgcagggatgtcaagcggaggacgcgcctttccccggcgtcgatnaggcgaggtacgaaggcggnggggaaaggttttacccgccggaggagttcgggtgctggtccccggcgaacggcgggacaacaacgncggagcttttcgcttaacgacgcccaagcggcggccggcggggtggaaggccgtncatgttactaacgcgcgccgggnttctgcaaaaaacgggtncctcctggccgggtttgtcaacgtccctgcctgaacaacgttaaccgancaaggaanacgggaantctggacggggggcaatgcggttcngnggctcaaattnncccgcctttccctttttcgcggtngcccaaaaggcc

SEQ ID NO: 34157 - DNA, 536 bp, Triticum aestivum
  unsure (1)..(536): unsure at all n locations
  Clone ID: PAT_TA_34157
gtccacgtcggcggccagtgtttcgtccgtcgacagcttctccgcgaacaccggcatgcagctccactgggttccctgagtcactggttggggatatttgggtaggtgtatgtatggcctgatctagcagttggcttcctaaattatatatatactcctagctgatgatggaataattacctcatgtacgtttcctagggtatactactgtgctagtatttacatgagttacgtgtaaatatatattgtaggaattatatatgttgttatgagtatatgtatcatngcttggtccgtgttgcccggaaagaaaaaaatcgaagggggggggggccccggtacccaaattcgcccctaatangtgaagtccgtattaccgccccgctcaacctggncggtcggtttttacaaacgtcnttgaactgggggaaannccccngggcngnttacccaaactttaatccgcccttgncagcaacatcccctcttttcgcccancttgggnggtaaataacccgaaanaanggccccgcacc

SEQ ID NO: 34158 - DNA, 963 bp, Triticum aestivum
  Clone ID: PAT_TA_34158
gaattcggcacgagtggatgttaagttgtcaggcacaggatcttaccaatcaaacagccaaaattgatgatgtggacattatacccaaactgacacttttcggacacagtgctagaatttgggattgttgcatatctgattctatagttataactgctggtgaggattgtacttgctgcatttggggcatggatggaaagctaatcaaaacattcaaagaacacattggccgaggattatggcgatgtttatatgatccaagctcactagttttgatcaccgctgggtttgattctgcaatcaaagtgcaccacctatgtaactcctcttttcatgacatattggaagaaaacgtggccccggatggtctgaaatatgattctgaggtgtttgaaatatcttctcctatagtatcaggacagcatggtgccttggatagcaaaagcgaatatgtccgatgcttacattttgtgcaagaaaatgttctctatgttgccacaaacaatggatatctacatcatgctgagctctctgatacaaaagatccaagatggactgaggttattcaggtcactgagaaagcgccaattatatgtatggatgtaatgacagtgtgctcagacatttctttggataaggaggatataattgcccttggagacggtcgtggaaatgttactatcgtccgtttaagcagtcccagtgttgaacctaaaatagacttatcttttacctggccagctgaaaaagataggcaactgctaggactatactggtgcaagtcacttgaatcccattttcacagctgatcctagaggcactcttaagttatggaacataaggaatgcccttctctcaaatggccatgggattactacaactcaggaagcttcacttattgcaatgcttgaatctccctttgggggtcgaatcatgtgtttagatggatcacttcaggatgag

SEQ ID NO: 34159 - DNA, 765 bp, Triticum aestivum
  unsure (1)..(765): unsure at all n locations
  Clone ID: PAT_TA_34159
gtcgagnatacggatctccganacggggtggccctccgcgggcgacgcgaacgagaaggccgcgacgccggagagcgcggctcggtacaacagcaacgtgatgcggctggtggcggagtggaagggcacgccgctcaagcccaacgtgccgctgcgcgtctacgtgttcgcgctgttcaacgagaacatgaagcccgggccggcgtccgagcgcaactacggcctgttcaagcccgacagcacgccggtgtacccgctcacgtacaagcctgcgcacggcgacttcacctcgggcggcaacagcaccggcggagacaacgactactacgacatctcggccgcgtcgcgggagcccacgggtcggcggtggacgtgggcgcaagctgctgtggcaggaggtgctgctgccgccctcatggttgcagcctgaggtactgagatcatcatggggcgcgccactctcgtcttgatggctgagattcaggggtaggtagataggaagggaatggaactgcctgctctggagcaatggtgttgatgatgatcctgatcctctgcacggcgctcctttgccgttgtggttgctgaagacgtagactgagtccgagatgtggatctgggtaagctcatgaaacgattaatttgatggcatcgacgctatgtatttcatcttggtgccttaaaaaccgctgatcgttgggactaaaatagacccaaatcagtcggttttaattgccctttaatagaaatgttctcttgagtagt

SEQ ID NO: 34160 - DNA, 554 bp, Triticum aestivum
  unsure (1)..(554): unsure at all n locations
  Clone ID: PAT_TA_34160
ctctataannttccatttggagccaaaacntgtagtgtttatgaaggtcggaagatacttgagctttgaaattttcgcaagaagantngccccaagagccgagtaaacgtaagcttttctttaggaaacagaaaaatctgcagcaaatatttgatgtttctcgatgcttgaagacaacaagtgaagttgttgctaccatcttacaagcccaaagtcatgaaaaagtcaggtgataaaatgttgggagattacaaaattcatgctctattcacacatggtggaggcaacccaacaagttgttatgggagccagcagagaaaggagtcgaggaacccgcatcatgggagagtcatccaggggcatctggataaagttaggcactacattgtatatatatggtcagaatatatgaccatattctacatacaatgcacgcagagtattctttgttgcacattattaaatctttcatgctaaatcttcatcctaactatatacattgctcgtgtaggttggntatgagctgaaaatgtagattctattgccctttttgg

SEQ ID NO: 34161 - DNA, 854 bp, Triticum aestivum
  Clone ID: PAT_TA_34161
cgccatcaagcttacgccgcagaatttgctgcccccatgccacctccggggcctggcttgcatactcatgaccagcagtcgaggaagacaaggcggtgctggtcgccggagcttcaccggcactttgttgccgccttgcaccaactcggtggccctcaaggtacttaagccatagtctagcggccggggaggacaaggcggtgctggtcgccggagcttcaccggcactttgttgccgccttgcaccaactcggtggccctcaagttgccactccaaagcaaatcagggaggtgatgaaagttgatggcctcaccaacgatgaagtgaaaagccacctccagaaataccgcctgcacaaccagaggtgccctagctcttcttcagccagccatccggttatgctggtgggcgatctctgggctcatcaggagcaaagcagctcgcagtcccggtcccctgaaggcccccttcagctctctgtttcaggggtggccgtctcggcactcaccggcagcgacagttccgaggaagacggcaggtcggtaggctatagccggaggtgatctgaaggcttcgggactaccgtcgaagattttcatgagagaggtagagatagctttgcggcatggatgacaataacggcatgcactctcgatccagagggtgtggtgcaggccatggatccagggatattgggcgttgatccgacgcccaaaaaatgaactgatcatggccttgttcttgtgatgtacatgaggctttgtttcgcgagcgtttcgggcagaccaccaattttcgccccgagaaaatacttacatacatatataaatgagattcgaatattaaagaaaaa

SEQ ID NO: 34162 - DNA, 762 bp, Triticum aestivum
  Clone ID: PAT_TA_34162
gcggcactgttgctggtggtactagccgcagccgctcgcctgctgccgttggcgcaatgcgacgggcccaacccggagatccgcaacaccggcgggctgagccggcagggcttcccggcggggttcgtcttcgggacggccgcgtcggcgtaccaggtggagggcatggcgaggcagggcgggcgcgggcccagcatctgggacgccttcgcggccataccggggacgatcgccggcaatggctccgccgacgtgacggtcgacgagtaccataggtacaaggaggatgtgggcataatgaaggacatgggattcgacgcgtaccggttctcgatctcctggtccaggattttcccagatggaactgggaaggtgaaccaggaaggagtggactactacaacaggctcatagactacatgctccagcaaggcatcaccccgtatgcaaacctctaccactatgacctcccgctggcgctccaccagcagtacctaggctggctaagcccaaagattgtgggcgcgtttgcggactatgccgagttctgcttcaaggtgtttggagacagggtgaagaactggtttacctttaacgagccgagggtcgtcgccgctctggggtatgacaatggcttgcatgcgccggggaggtgttccaagtgccctgcaggaggcgactccaggactgagccatacattgtcacacacaatataatcctttcgcacgccgcggcagtgcagcgataccgcgagaagtatcag

SEQ ID NO: 34163 - DNA, 630 bp, Triticum aestivum
  Clone ID: PAT_TA_34163
cacgactcggggacgaacgtggtccggtgctcttcgtctccaagtttcttgcacattggagccaaagatggcaaggtccgccatgtccgggctagtgctcctgctgctctgtgcaacctgcaggttggcgctaggaatcaccgatgggctgctggccaacggcaacttcgagcgcgggccgcagccgtcgcagctgcgcgggacgcaggtggtgggcgcgtcgtcgatcccgtcgtggcggacgtcggggttcgtggagtacatcccgtcggggcggaagcagggggacatggtgctggtcgtccccgagggcgcctacgccgtgcgcctgggcaacgaggcgtccatcgcgcagcgcctccgcggggccgtccccggcgcgcgctacagcctcaccttcagcgcggcgaggacgtgcgcgcaggcggagcgcctcaacgtgtccgcgtccggccagtccggcgtgctggtcatgcagaccatgtacagcagcaacggctgggactcctactcctgggcctgggacgccaccgccgacgaggtcgaggtcgtcgtccacaaccccggcgtcaccgaggaccccgcctgcggacccctcatcaactctgtcgccaccaagacccttacccc

SEQ ID NO: 34164 - DNA, 665 bp, Triticum aestivum
  Clone ID: PAT_TA_34164
caggaacccgccactgcaaacatgtcctcctctcggctctagtcctgctctccatcctcgccgccgcggtagccaccatcgcctgcaggccaggggtgggcatcccgcccaagccactcccaagctgccgcgcgtacgtggtccagaagacctgcaaagacacccaacagaccactccgggaaaagtggcctccaaggatccgtgctgtcgggagctggaagccgtctcggaagaatgccgatgcaccgcgatggaggacttcatgcaagggatgctccgcttggagggcgttcctgaggggtgcactagaaaggacctgtgggagttcaccttgtctctcgtcaagccggagctgtgtaacctgaagaccatcaccggcgggccgtactgcggcctccctcctagcaacgatgctcgtcttgccgacagtgtacaagatgtgtaattaagcatgtgactgatggtgcatgatgaataagcatgtaaattgcgcatgaatatataatagaatcctcgcgggttcataaaaaaaaaaaaaaaaaaaaaaaaaaaaaaaacttcgagggggggccccggtacccaattcgccctatagtgagtcgtattacaattcactggccgtcgctttacaacgtggcgactgggaaaaccctccccgttaccc

SEQ ID NO: 34165 - DNA, 609 bp, Triticum aestivum
  unsure (1)..(609): unsure at all n locations
  Clone ID: PAT_TA_34165
cacgcgtccgcaaaatttctctcagaaccctagcccccgccgccccgcggttccgcatggccggcgccgccgcgctccggcgggccgcccgcagcgccgtccgcaagctggccaacgccccctcccccgcccgtacgttcgtgctccccgagcgcctcctgtcctcccaggcgtcgccggagcaccgcccccgctccggcgtgtcggcgtcggagctggggcagtacccgccggagcggatccggaaattctccatcatcgcgcacgtcgaccacggcaagtccacgctcgccgaccggctgctggagctcaccggcaccatccagaagggccatggcgctcagtacctcgacaagctgcaggtagagaaagaaaggggcatcaccgtcaaagcccaaaccgcgactatgttctacaagcatacagtggaaaattccgagtcccatgggacagacacttcaagctatttgcttaacctgattgatactccaggccatgtggatttcagctatgaggtctncaggttcctaacagtttgncagggtgctcttttagttattgatgcattctaaggtgttcaggttcgtacagttgcggatgggtaccttg

SEQ ID NO: 34166 - DNA, 1284 bp, Triticum aestivum
  Clone ID: PAT_TA_34166
cgcacaccaccgtcgttgccagctgatccaagattccaagctttcaagattccgccgcattgacggatcgagtagtgctgatagggtacgcccatgtccaggttgatggccgccatgcttctcggaggcgcgcgggtcgccagcgccacggcgctcaccggcaacactgccgtgaaggccattcccaggccctgcttcctcgctccccggccgcatgccgcgagctggagccccatctgcatgcagaccgccccgagatcgtcgcaggcgtataacaacgcgccggacgaccggagggagatcaaggacaagtacaggggcgcggcggagcaggccaaggatgccaccggccatgccaaggagagcgcgaaggaccaggcgtcgcgcatggccgacgagaccaaggacagggccggggacgccgccgagaaggcctcccgcatgacggagaaggcgaagcacgagaccaaggagacggcaagccaggccgcggacaaggcgggggagatgaaggagagggccaaggagacggcggaggaagccgcagagagggcctcccgcatgacggagaaggccaagcacgagaccgaaggagacggcaagccaggccgcggacaaggcgggggagatgaaggagagggctaaggagacgacggggcaggcgatcgacaaggccaaggagacggcgggcgcggccaaggagaagaacggcggaggtggcggagggcgccatggacaaggccggcgaggccaaggacagggccgcggagggcaccaggagcgccggggagaaggtggcggagatgaccaaggagggcgcgagcaaggtggcggagaccgcgcaggcgctcggcgagaaggcgaagcaggcggcgcagggcgcctgggaagccacaaaggaggccgcgcaaggggtgaaggagaaggtcggttcagagagcacggcggaggagcactcgacgtgggacgacgtcgaggcggcgaccaaggagagggacaggatcgcgcaggaggagcggaagaggcaggccagggagaagggcgccggcttgccgtagacgaagatggctgtctggcttgacatctgcacgcgtctagtggcctctgtttcgagttgaattttagttttcagcctcttcggtttacatgttgaataatgctttggtaaacagatgcgccgatgcctcccctgagatgaaaatattggagcaatcgtgtagaaaaaacaagaaatttcttttgagctctgcaatatgtgctgtctctttttttttccgaccgcga

SEQ ID NO: 34167 - DNA, 1178 bp, Triticum aestivum
  Clone ID: PAT_TA_34167
ctgcctcgccgccggggccccgcttcagccgctacggaaggttggaaaccatgacgacggcctccatggcgccgagcaggaggcggtgcgagcaaagcaaagatgccctctgtacaggtgcaacggaaggttggaaaccaagacgacggcctccatggcgccgagcaggaggcggtgcgcgccacggggagaggcaagagcaaggcgtcggcgcggaaggtaacctacggcttccacctggtggagggcaagatgccgcacggcatggaggaccgccacgtggccgagttccggcgcctggacgacggcaacgaggtgggcctcttcggcgtcttcgacggccactcgggcgccgacgtcgccacctacctccggaaccacctcttcgacaacatcctcggcgagccagacttctgggaggacaccatgggggcgatacggcgcgcctaccaccgcaccgacaggaaggtgctcaagaagaagaaggtgaccgccgacggcgaggagatagtaaggccacgccgcggcgggtccacggcggtgacggtcatcctcctcaacggggagaccctggtggtggcaaacgtgggggactcccgcgccgtcgtgtgcgagagcggcagggcgaggcagctctccgtggaccacgagccgcttcgggagcgcgacgccatcgagagcaggggaggcttcgttaccgagatgcatggggacgtgcctcgcgtggacgcgtcgctggcgatgtcgcgggcgttcggtgaccggaaactcaaggagcacatcagctccgacccggacgtggccatcgagcacgtcggggacgatacggagttcgtcgtcgtcgccagcgacgggctctggaaggtgatgtccaaccaggaggtggtggacgaggtgaggagcacgcgcgacgcccggaaggcggcggtgaagctcgtggatgcggctgtggaccggggtagcaaggacgacatcgcttgcgttgtcgtgcgcatccattgacctgcaacgatgatatacgatcatgtgtttgttctgtggtgcgtagaaccagtttgtagaagggaggtgagctgaagtgtttgctgtgaacttacagaaaggaaatgcactggactgtttgatgtcaaaataaaaatgaaaacccgcgcccagtagccttcaccgcaccttcttct

SEQ ID NO: 34168 - DNA, 595 bp, Triticum aestivum
  Clone ID: PAT_TA_34168
gccgccgcctcgcctcccccgccgttgaccttgtcggctctccgccccctcgccccctccgccgctgacctcgtcgtcctctaccgccgacgaggcctcctatcgccggatacccatcccctaggcaccggccccttcgcatccctgaaacccccctcctcgccccggcgagccgtgttacaccccgactccgccgatcctccgaaccctagatcccctgggcacccgatcgcgcgccccttccggaggggcgccgtcccgatcgccccggaggaaatgctccgccgcgtcccgtgagatccggccgccaagactcgaccttttttgcctccgaggcggcgtgacgcggcgcgatggcgatccgcatgaccgtctcctactccggctacgtggcgcagagcctggccacctccttcgccctgcgctgcaccaccgccgccgccgcgggctccggggccgcgcccggcgccggctgccgcgtcctccaggacgcgctctcccgccccttctgcctcttcgcctcctcccgacgcgtcgagcagcacaatgacgccgaggaccacaaccaccccaagcccaagcccaggcccaagcc

SEQ ID NO: 34169 - DNA, 908 bp, Triticum aestivum
  Clone ID: PAT_TA_34169
atcgaccacttggagcctccctgttcttaaaaatcaccaacttgccagcgaacgagcgaccaccgacggctcctcgtcgccgccggtgatcgaggtgggccccgcaggccggatctcgggaggaggaggaggagcaatgtcgcgggcgtcgctgtccccgtcgtcgtcgggcgacgaggaggaggaggacgacgagggggtcgacgggtaccgcaagggcggataccacgccgtgcgccctggggaccagttcgccgccggacgctacgtcacccagcgcaagctcgggtggggcaacttctccaccgtctggctcgccttcgacgtcgagtcccagaaatttgttgctcttaagattcagaagagtgcaccagagtttgctcaagctgctcttcatgaaattgagttcctctcggagatcactaagagagatccttcaaactgtaaatgcaccatccagttgatagatcacttcaagcatgcagggccaaatgggcagcatatctgccttgtctttgaattccttggagacagcttacttaagctagtacagtacaaccgctacaaaggcattggactgggtagggtgaaggaaatatgcaggtccattttggtaggtcttgattacttgcatggagagcttggaatcatccactcagatttgaaacttgaaaaatgtactacttgtttcaacaatcgatccctcaaaggatcccattcgctccggacttaaacctaatcttgagaagcctgaggggaatcctaatggagaagctggtcttaacccgattgataagaaactgaagatgagagcaaggagggtgctcgcaaagcttgctgagaaaagaaaatcagctgcagaatttgcacgctcagaaagaagcttggatggtattgacatgacatgc

SEQ ID NO: 34170 - DNA, 459 bp, Triticum aestivum
  unsure (1)..(459): unsure at all n locations
  Clone ID: PAT_TA_34170
gctcaccgggggtgttggtncattttggatgcatgccacattgcccggttgggaatacgctccaagaagcccaaggagtgcttctttncctagaaggttggggcgaggatagaaanccacactggactatgggcatgcccactcgatggctgcagttgcacagctccggtgagctgccgcgaggcaaattcggagcattgaccaacactagcgacggctacctgctgacagccacatttatctgtcaggccgctctctgagtggaatgtttacagaaacctcatatttgtttgtaaaagttttagaacaactataattttgtgtttgtatcaggcaatttatacactaggtgtagggcaaaaggtagggacaagaaaggttcggaaatttatttgttaaacagaaaaaaaaaatcctcttaatttatgaaaacaaaaataaaaaaaggggggggccgta

SEQ ID NO: 34171 - DNA, 450 bp, Triticum aestivum
  Clone ID: PAT_TA_34171
ggggccaggcacgtcgattcacattgaataaccttggttctgtccaaacatagctgtatgaaaatgatatagcatgaaagaatcatgtctactaagtaaaaagagaaagaactaaaacgtaaagcggatcatgtatagaaagtacgaagaaggtgaatggtaaaaaagagcaaggcaaaatgagagattatgtggtgaggtcatttacgctttcagttccttcatgtgcttgctgctggccctcgcattacaaaatcgcttgacaatatcatacagttggatttgttccttcgtggccctgacttcaggctcgtagtcttccgcggggggtgggtgaactaccctctgctgcctcacagaaccaggggtggcactcctaatggtatcctcagataccgtatctgcaggcacattgaaacttgattgcccctgacctcgtgaggacctcct

SEQ ID NO: 34172 - DNA, 1486 bp, Triticum aestivum
  unsure (1)..(1486): unsure at all n locations
  Clone ID: PAT_TA_34172
ccaaggtcggcaagttcaggtcggggaagaacgcggctcgcccgccgcgccccaagggccccaagaagccgcgcgtcgcggcgccgccggtggacgcggagatcaacgacacgatccccctcgttgggtcggaggcggagttcaggagaggcaagtacctctactacatgagaggcggtgaccactgcaagagcatgaaccagttcatctggagcttcctccgccgcctcggcgaggccaagttcctcaaccggacgttcgtgatggatctgaacatgtgcttgtccggggctcacacagaggacggcaaggatgtggatggcaaggattttaggtactattttgatttcgagcacctcaaggagtcggtgtctctggtggaggaaggggatttcttgaaggattggcggcgctgggacaagaagaagggtccgggccggatctcggtgcgcaaggtgcccacatacaaggtgaccccaatgcagctgaagagggacaagagcaacatcatttggaggcagtttgatgggcatgagcctgagaactactggtacagggtctgcgaggggcgagctgccaaggtcatccagaggccttggtatgctatttggaagtccaagaggctgatgaacattgtgactgagatcgcaggcaggatggattgggactatgatggtttgcatgtggtccgagggtggaaggcaatgaacaagaagatgtatccgaacttggacgcggacacatcacccgacgcgatcgtagataaggtgaccaagcttatcaagccgtggcggaacctctacatcgcaaccaatgagccattctacaactacttcgacaagctcaggtcacactaccatgtgcatttgcttgatgattataaggagctttggtcgaatacgagcgagtggtacaacgagacgacagcgatcaataatgggaaggacttgccgttcgatgcgtacatgaaggtgattgtggacactgaggtattctacagatcaaaggcaaaggttgaaacgtttaacaacctgacgagagattgcaaagatggaatcaacacgtgcaatttgtgacacatgagttcatggtgtgataattatcggtgtccatatactccctactgggctggcgcaatggaacttgggcggacttcatccagggtttgtcatattaggcataatatcttgatgccgcttgtcatagcatgctcagttgattgcattacatgtgcatctaaattatgtgccctccattctttttgtataatttaccactgtgctcaaacctgcaaaatccaaaatagtaacactcagtgagcattttgcagtgccaaaaaaaaaaaaaaaatacacggctgccctctctctggggccccattagttagcttggggtttctcttcatttattgtatgtttccatatgtgtgttgctaaatattctctagtcggaaatgaactttcagaaaattatacaanaaaaaaaa

SEQ ID NO: 34173 - DNA, 708 bp, Triticum aestivum
  Clone ID: PAT_TA_34173
gctcgtgctttccctgcgttgtgtcgccttgtgggttctgataaagtacaaggacatgttgttggtactggtgcatttctggttcaagtgtttggccttggtccaaagccttggtcgagtgcttcatcttccatttctactaaaatggctttgttatgttcataatcacatgattggagcagaatgaattatattcacctactcactttggtcctcatgtggagctttacatacttgactttaaatggcaggtaccctagggcgacagtgcatgtgttttttttctttctctgggaagtgtcttattttgaaacaaactgtcagtgatgattcgatgagtacatcggaacacaacttatcatttctcagtttcaactgtacatgttatgattccagttagcattttgcttggacactggcacataatttatattttgggaaatcgcttattaggaataaattgttattgttaattcaatttacatagcttcttcaatgcagggttacagctttgttcttcttgggaagttgcaaactgggaagtggaatatgtaccggtaggttatttatatgttagtataaactgcaattttcttatactgttgctcacgattgtttctataagcttgcagatctgcacaatcacctctgtatttgatcaacagatttgctgctatgctagatattggaatgatacttgatactttt

SEQ ID NO: 34174 - DNA, 474 bp, Triticum aestivum
  unsure (1)..(474): unsure at all n locations
  Clone ID: PAT_TA_34174
cagcaacggaaccaacaaatccccagctaatctcgtctccgatcgacccgaggctcgtcgaatcctccttccccaccgcctcaaggtccggcgattcctccccctcttctcctttctgtggtgctccgtgattgttgggcgtgtagtactgtggaatttggctccgatctgttgttaggtcggtgaagattagccgaattcgtagggatttcgccttcgggttcaggatgaatggtctcctattttatgtagcagttcgttagtccctgctcatggattcgcccaagtagcttgcgtgccatgtaaaaaaaaaatctatctagacgtgcgtacagcctgatctgccgctcgtgatgatcctaacaggcctagtactgtagattggttgaaacccgagggtatgtttcttttcttaaatgatgattggcccccgananaaanaaggtttccgttcctgaaaagcnaatgccccaa

SEQ ID NO: 34175 - DNA, 1677 bp, Triticum aestivum
  Clone ID: PAT_TA_34175
ccacgcgtccggtactgaagaaacaaatagcggtttaagcactcaaactcctgcacttcccatatccagagaaagtaatctttccatgggtgacaagcaaggtgttggagtttataccatacatggacaaacaaagatggttttggctgcagaactggcatctgcaaatgatgaacataagctgcatgaagtacatgataagactgctgatggtaatatactccaacacagtgctgcaaatgacacactccaggataaaactgatagcattgctggtttggacctagcctctcgtcatagaattggtgatttggaaatggagaagggtgattctaatacagtgatgttaccagactgccaaaccccttttgatgcctcagttaaggatattaaggatactcttgcccccacagaagctgatgtcagtgatctgcaaagtgaggctgctgctattgatgtgactagtcctaagcaagatactatggtagttgaagcactgcacactaattctggaggttctgctagtcatctgcctgctgctttacaatcaacggactcaaaccagcatgcagaacggaaaggaagttcagagaacagtggctctaaattttttgcatctgggaagaaaacagaggaaatggaaggaactttggataagaatacggatcacaatcttattcaggcaaatgccgatatagctttaggaagacattctccttcagaggacaaaagagaggacagttgtgcccatgtagttgatggtggcctgttgggaagcaaacaaactcttcctgaagtcgtttctgctgtaaacactgatggctctgaggaagcactcaatgcttcgtctacccattcgaataaagatgccaccttggtttgtgaagtaacaaaggatcctgagagccatgtatcagtgtctgtactggcctctgctgctatgaacgctggtgatgactgtgaggaagttcacaatgttccatccacccattctgatagagggggcagcatggtagaagttgatgcgtctagagatgatgctacctctatttgcgaagtacgcaaggatcctgagagtaatgtatctggtgagttgtcgatgccagtagggttagcggagctcgagttagaactgccaaaccaatccaaatcttctagccagtctagcgcagtaaaggctgatgaaacaaaggccagtatcaacattcagactacttcattggtagaatcaggagaacaaaaatcacccagaaatggtgcacatgaagagatggagttggctgggcctaagattgagtgcacaatacaaatgctgagtcctgatgataagagttctgaggctcatagtttggcacaacgcgagatggtttcgggtgcagaacaagcatctatgaaagatgatagagaaaacaagatggttgatgttatttttttgattggtggtttacaaaaatgaaaatgaagacttttaattgcagaccattaacgtatgcaagaagagaattttattggtaccaaatgagatatgatgggtgttattaggatagtgggtatgctctcagattctatgaggtgatttgattggggaggattgtgcagcactattattgtttatatataggattgtcaatgagagctatcggttgctagcgttccttgcagggagggtgtttgtgt

SEQ ID NO: 34176 - DNA, 687 bp, Triticum aestivum
  unsure (1)..(687): unsure at all n locations
  Clone ID: PAT_TA_34176
tccagatggaggccctttgggtcaggctcggatgcatgctccacctccacacttccacgggaccttccctgggaatccacctgctcatgaatcacctaacgggtttcgaccatttcctccagcaaatccatcaaacagaatgccgtttcatttcttgccaccacagcagaatccatttccagctgcaaacaggcaaggtggcccaaatccgatatacgatcctttcgcgccaacatccgtgtcaggggggagcaaagaaggcggcggctgaccctgtctactgaggatctcatggcatcagttggctcgaaaggacgagacgttgatgtcatctctgtcctggaatcaaagctgcgatgtgaagggagttgagccttgagcggtcaaggtgcttaacttgcaccatcgctctccctctttttgttttgacagaagaacaccgggtcgaaggagacatttcttgcttttgcagctatttgtacgttcaaatcctccattaaagaaagaaacaaagatgcctgtgctgttttgctcttcaagcaagcgaaactcatacccggatcacttgcgtttgtttacagcaatttatgtagtactgccttgcttccagtgcagccctaaaaaattaaagtgccagcattgacatgtaaccgaatctataagtgtctacacagtaggaaacaanag

SEQ ID NO: 34177 - DNA, 438 bp, Triticum aestivum
  Clone ID: PAT_TA_34177
catcacgcagcgcccacacgcaccagcagggagcggcggtgacggccatgggaggcctcagccagcacaggtccggacgaggtggtgctggcagccggcgaggtcccctcggtgcgcggcgtggttcgtagcggaccgcgccgcggcgagggcgacaaccagcgcaggccatgcatggcaccgcgaaagcaagcacgaggccatggaggggctcacgcagcgcgcggcagggcatgtctaggcggagctagcgttgcgacggcggcaggtgcgtgcgagcggtgaccctgagaggggacttgcggcgtgactgcggcatgcagcagtggggatctccccaacgttcctacccctcttctgatatggggaaccatggattaccggtttcttgctgaatctttagtcgcgtggaaatggcgtctcggcatggacgcgacg

SEQ ID NO: 34178 - DNA, 1468 bp, Triticum aestivum
  Clone ID: PAT_TA_34178
gcccgcgaggacgatggacggctgcggcggcgatggccgccggcctcgcgccgtctttatggccttcggcacccacggcgacgtcttcccaatcgctgcccttgctgcagcgtttgctaaggaccaacaacagtatactgtggtgttcatcactcattcagcacaccagagtttatccacacatcttgcagccagtaacgttaggtacatgcctgtggcaagcccacctgcccttgctgccgaacaacttgataatatttcatatgattctgttcaatcgaacgctggtcctgagtcattttcacggcggaaagagatcattcagacggagcacaggaaagcctgtttagcttctgtggaagaagtgtttggaaatgatccgagcattcatagcgacttcactgtgatcaatttctttgccctggaaggttggcatcttgcagaattgtttcaagttaagtgcatcattgctgctccttattttcttccatatagtgctccttcatcatttgaacgccaatttaagcaaagttttcctcttctatacaagtactttcaagaagctccccccaacacagtccaatttcaccccggtgctcctcatgggctgctggactgacattacccattggatgtgggcgcttttcatggaaagttggggattgtggagaaatgattgcctaaatcttagtcctattccttatacagatcctgtctcaaatcttcttttctggcatgtacgggatccggcaacatatctgcctttgtggcatgtacgtgcagagtcgccgttgctgttgtatggtctccaatatgctactgtttgaggctgagggtttttcccttcagctcctcatttttcttgtgataggtttctttctttattttcgcccggtttctatgacttcctcaagggctttctttgtgcatattttcctacaccttttgactgtcttctgagtggttgtaatgcgtccctcagagactttatagggttcagttccattggcacagtagccattcttacaaaacataaaacatttagcattatgacttctgttaacaatccttaaacatgttaaatagttatcccagtttccttgggatcccagcaggtctggtttctccttggctcttctcgagcccccccgatattggccctcaagtgctcatatttgtggcttttggtttcttcctatggcttggcagttttcttgtgataaatgcagggagttattctctggagatttcaattctccatttgagggtattctatgtgcaaatcatgctggcctggaagacttcctcatgggaagttcttgttcgtctttacctatatttataggattaagttccattggcagcatggggtttcttagaaatcctaaatcatttctaatggtgattaaagctgtcatagagtcaacagattacagatttatccttttctcatctggataccagccaa

SEQ ID NO: 34179 - DNA, 1372 bp, Triticum aestivum
  Clone ID: PAT_TA_34179
cttcgcctgcgtcacgctcgcctccatgaccacaatcgtcacgggctacaatctcgccttgatgagcggcgcggagctcattgtcagcgacgacgtgtgcctgactcacaagcaggtcacgctgctgcgccgagacgagtggcacgctcaagctccgtgacgttgacgtgatggacacggtgctgtccctacgacgctaggcacttggagagagccatcgtgatgcccaacctgaagccaccggatacaacaacgggccgtgcgagcaggtacagagatgatatcccagcgatgcccaccgggaggagctttgtgccgccgtctgcgcgccccccctcatggcgctctacctcacggacaggactagcccggaggaaattaagatcgcaagaaagagtggtgtggtttttgctgtcaagttgtatcctgctggagcaactactaactcccaagatggcgtaactgatattttggggaaatgcttgcctgtccttgaagagatggtcaagcaggaaatgcctttacttgttcatggagaagtcacagatcctcatgtcgacacctttgaccgtgagaaggtcttcattgagaaaatattagcaccacttgtacaaaaacttccacagctgaaaattgttatggaacatatcactacgatggatgcagtgaacttcgtagaatcatgcaaagaaggtcatgttgctgcaacagtgactccgcagcatctccttctaaacaggaatgcgttgtttcagggtggtttacagcctcacaattattgcttgccagtgctgaagagagaaacccacaggcaagctattgtttctgctgtaacaagtgggagcagacaatactttcttggcactgacagtgctccccatgataaacggctgaaggagtgttcctgtggatgtgcaggaatatatagtgctcctgttgctctttctctttatgcgaaggtatttgaagaggccggtgctcttgataagctagaggcgtttacaagcttcaatgggccagatttttatggtctcccaaggaacacatcaaagactgttctgagaaggagtccctggaaagtgcctgcaacttatgcgtacggttcaggagtgattgtgcctatgtccaccggcaacactctggaatggcttccgcccgatcagcccgaagaataagcaaattacagacggtccatttgggggagaaacaataagtggagccgttccatctcccccctttctgtagaaatgcgcctgacaaacaaaggttttggttgtagacttaaccccgtgtgggattcctaaaatcaactttgtaagaacaacttattccaagcaagagcgaaaagtcttcgtctgaataaaagaaaaga

SEQ ID NO: 34180 - DNA, 1044 bp, Triticum aestivum
  Clone ID: PAT_TA_34180
ctcaaaggccgatatcctgtgagagggcaaagagaactgtatcttccactactcagaccaccattgagattgactcgttgtttgaggggggcagtgacaccatcactcgtgctcggtttgaggagatgaacacgtatctgttcaggaggatcatggattctgtggagaagtatctcagggacacaatgatggacaatagcaccccacacaatgttgcccttgttggtggttccattaggattcccggagtgcagaggttctccaggacttcttctaaggtctctttaaagaatcgtcaaatttattgttcgcatactactgcttggtggactacctcttccacggccataactcagcatcttcatcggttctggtgtctccctggtctccgccgaggaatacaccaagcaaacggcacaacaaggaaccatcagacccattataggattcaaggatttcaatgggaaggaatacgccaagcaagtggcacaacaaggaaccatctgacacatcataggccaggccgctacaggagagatgcatcaatgacctgtgactattcagactcacttgaaggacggcgtggtgaactcccattgttggtgatgaatgccagatttgattcatcagcttactgagcctgtcgtgttgttggattagtagagaaacgcttgttagaggattttgactttatccagtgcatgagtgaatgaaattgaacagtttcattcttgatttggagtgcatgaatggatcatcctgatttgcttgagttggcaaatgtgcgggcatcgcagaccaaataaaatcttctatggtcaagagttgtgtgtcaggctcttttcatctagggggtgccctggtggtcgcgtttgcggaaatcaagggccggatctcatcatgcggtttactcatactcacatgcaggaactcccaagggcctgcctgcctccaccttggtggtcacttgttgggttgaagtttattgttgtttgactacaatcaacggaatggtcaacgagacggctggtggaacatactact

SEQ ID NO: 34181 - DNA, 1319 bp, Triticum aestivum
  Clone ID: PAT_TA_34181
ggagcatttattggatatgctcgtccactataatcagacttctgacatcttgtattacgaagtattggatattccattgccggaattgcagttccttaaaacccttaaagttgcgttccaccatgctacaaaggaggaggttgtcattcacagcatcaggcttcctaagaacagcaccattgctgatgtgataattgacttgaaaactaaggttgatctatccagtcccactgccgagctacgcgtgctagaggtcttttaccacaagatctataagatctttccacttcacgagaagatagagaatataaatgatcagtactggacgctacgtgctgaagaggttccagaggaggagaaaaatcccagtcagcatgatcgcttaatccatgtttatcacttcacgaaagatcctcttcagaatcaacagattcagaattttggagatcctttttttcttgctatccttgaaggtgagactttagcagaagtaaagggccgcatacagagaaaactccaggtccctgatgaagaattctccaagtggaaatttgcattcatatctatgaatcggccagactacctacaagattctgatgttgtatctgctcgtttccaggtaaactgttgattttgccctacatgcttctatagttctgccgatacatttgttttcggtcttttggtttctacagaggagagatgtctatggagcttgggaacaatatcttgggctggagcacactgacactgcaccgaaaagggcctatacagccaatcagaaccgtcacacgcatgagaagccggtgaggatatacaattagtatgccttaaaactgtgttggtcccctgatgaaggcgttggtctgggagtggaagagtaggctgcaacaggtgaaagcagcagcatgtttggccatttgggtgctacggcatatctatcgcttgctacagtttttgctcttgatgcatggccatgacgattttttcaaggttcatcatcttgcctttcaggcaagggtgcatgatatcaagtttctgtaaattgggtgtaaaggccaccctcctaagggtagatgttggatgttggttcatttttagagcaaagtcgagtacatatgattttggtagtgggcttgtatacaagggtatagttttgcgacttgatatggcatttgttgtaatctggtaataacggaagattaatggatcttttcttggtttaagtagctgcactagtaaaaatgtgactaacaattcttattgcagccagagttacatgatactgaaaaaaaaaaaaaaaaaaaaaaaaaaaaaaa

SEQ ID NO: 34182 - DNA, 859 bp, Triticum aestivum
  unsure (1)..(859): unsure at all n locations
  Clone ID: PAT_TA_34182
gaattcggcacgagagacattgaggtccctctttgtcagtggatcccataacaaaaacataggtctatgtaatgttatttggccagagaagaaaaagaaaggtgaaactgaaaccaagcaaaaagagacagagagggaagaagcctatcgagggctgcaaacggcaggactggactttgaggtattctgggatctgcaggacttcttgaacgtctgcaagcttacatctaacgacatacatgctatgttgaggacatacggggtggaggctgctgagggccaccatcattaacgaggtgaaggccgtatttgagccctttggcatcaaggtagacccgaggcacctgagcctagcggctgattacatgacctcgggaggctcctaccgaccgatgaacagcctcgggatggcccggttctgcacgtcgccgtttggcaagatgagcttcgagcaggccacgaggttcatcacggaggcggcctaccatggggaggtggacaacctcacgggcccttcggcgaccgtgtccctggggaaaccggccaagaccgggaccggtgccttcgggctgatgcagaatatcaccctggaggagcgggcggtgatgtaagagtgccctactcggaccttgctttggcatagatcacaagaatcggttgctgcgtgtccagccatcactcgtgtgttttgaaggaactagtcatgtgaataacatttttgtgcttgctaagagcaaagccatgtcattctcacctgttgtatctacaattctatctaaaaaaaangacacnanctccaggggggcccggtaccaantcgcctanagnnagcctnttcgccnnctaacggcgtcgttta

SEQ ID NO: 34183 - DNA, 869 bp, Triticum aestivum
  Clone ID: PAT_TA_34183
gcgaccctcgcgtcccccgccgctcctcccccggcgccgtctccccccccccccccgcccccccgtcctcgggccccccccccgccgcgcggccctcacccaccgccggcatcgattgccgcaccgcccccctgcctcgccgcttccgccgtgctcctcccaccgccgctccccaacccccgcccctcccgccgcgccgcccccctgccgctcctcccgccgcgccgtctccctgccgctcctccccaccccgccgtccaccgtaccgccccagccgcgcggcccttccccaccgacggcatcgattgtgctacgacggtgccccagcggcggcggcgacgacgcggtcgggcgctgctggtgaccacgacgccttcgaggccccgcggaatctcgacaaggattcccgtttcaagtaagaaactgccagtcttctagcagtcggtacatctgaccttcaatggcgcagcctccagctaaaaagacgctgtcggtgtacctgtacatccctaacatcattggatatttcaggatcatcataaacttcattgcatttgctgtgtgctataccaacagaacactctttgctatcctgtacttcttcagcttcttctgtgatggcttggatggttggtttgcgaggaggttcaatcaagcatcaacatttggagctgtgttggacatggtaacagatagggttagcactgcttgtttgttggcgcttctctcacagttttacagacctggcttggttttcatactgttacttgggttggacatcacaagccactggtttcaaatgtacctcggccgcgaccacgctaagactagccacaaggatgtgaagcacacaggcaatgggctttttg

SEQ ID NO: 34184 - DNA, 705 bp, Triticum aestivum
  unsure (1)..(705): unsure at all n locations
  Clone ID: PAT_TA_34184
cgcgagaccgtgatcgtccccttaaggtcgaagaaggtgaactggggaacttaaaggcagaaaatatgaagcatgcatttacaaagtttattgcgaagttcacagacaaaggcgggcttcctcatgctgaagcagtcgagaagctagtccagttcatgcaagttgatcgaactgaacggaagatagaccttggtggtcgagtagcacttgcacatattatttcagctacagaaagtcctgtttgcctcgggagatttgtgcagctaaggggccttcctattttgaatgagtggcttcaggaaactcacaaggggaagtctggtgaagggggtagtcctaaagaaactgataagcgtgttgaagaatttctcatggccctgctccgtgctctctcaagattgcctatcaatttgaatgccttgcagagttgcagtattgggaaatctgtcaatcatctgcgtagccataaaagtgctgagatacagaagagggcgaagtgtcttgttgaaaactggaaaaagcgtgttgatgctgaaatgaagtcaaatgaagccaaacctttagtatctggtcaagctgtttcctggtcagggaaagggggcgctgcagaagtttctaatggtggaaacagacgaagcgcctcaagtgaggccagtccgaanaacccagtatctcggacagctaaacctggtgcatccgatgctg

SEQ ID NO: 34185 - DNA, 466 bp, Triticum aestivum
  Clone ID: PAT_TA_34185
gtgccctggcggctgcggcgtcgcgtgggcaggacgagatcaacaagatgaaggaagaccctatcgctggttggaacttcttctcattcgatcccatgcccgccatggaccggttgatgaacatatcaggctcgtcgggctttagtgcatacaagatcgccgacttcgggtggggaaagccgacacggacagagccgattaggatgaacacagacggtcaggtggcattgatgggcagcagggacgaccggggtgtgcaggtctcagtggcactgctccaagcggcacaaatggacgagttcaaatctaactttctggcgctacttgagtgacaatttttgttctcaaagagacctagttaggtcaattcaaaacagtacacccagatgttttataaagattaatacattataattgaattgtttatttaactaagacatccttctcttggaaaaaaaaaaaaaaa

SEQ ID NO: 34186 - DNA, 1182 bp, Triticum aestivum
  Clone ID: PAT_TA_34186
gacgcccgccgccccggaaactctactcggccgctgcgctatcaagcctcccggtgcgccccggccccgcctgcccatctaattccggcgcacaaaaaaccgctgccttttcgcgaattccgcgggcacgagaaaaccctgaaactctactcgcaccgctgcgctatctcgcccatcggagcgcgacgacatggcctccgcctcctccctcttcctggcctcccccacccgtccacggcgccaagccgcccgcactccctcctcccccggtgccccgctcggccgatccctgcgtccaccggcggccccccctcacagtggggggctccgaccatccgcagcgacagcagaggagtatcgctgctcataccggtagtgcttctcccgttccgggtggtcgagggtttcgactaccctagcctatagaggagctgtccggtcttcaagggctgcagcaccagcggttacgacaccggctccgtcgtatactccaacggggacgtgcttctgacactgcgtggtggacgcgatcctcggcgccctggggctgccggacatcgggcagatcttcccggacaccgacccccggtggaagggcgcagactcctgcgtgttcatgagggaggctgtaaagctaatgcatcaagcaggctatgagctggggaaccttgatgctacactgatcttgcaaaaaccaaaaattagcccgttcaaggagactatccgatctaacttgtgtgaactacttggggcggatccatctgttgtcaatatcaaggccaagacgcatgagaaagtcgacagtctaggagaaaacaggagtatagctgctcataccgtagttctcctgatgcggaagtagagtattagaggtatactacataatacaggaattgtattgtattgtagtgttgctgtacaagaggtgttactacactatccctgtggtatagtcaatacggaagcttcagggaaagtagtaaagctgagtacaatgaagagaaatgtgtatccagcttgtgtctcctgttattgttccaaaattgtattcttgtcttgcagggtactagatatcaatcattttggaagttcttgttattttcttaccgaccttaagaaccattcacaaattatacagcaatatactagtatgaggattttacactttaacaactctaactt

SEQ ID NO: 34187 - DNA, 1083 bp, Triticum aestivum
  unsure (1)..(1083): unsure at all n locations
  Clone ID: PAT_TA_34187
caccaagtcacagcttctgaaagagctcgagacgctagtctcctgcggcatgttcgagcgggttgacctagaagggaaggccaaacctgacggcacccttggcctcaccgtctccttcacagagagcgtctggagtgcagccaagcagttcaagtgcatcaatgttgggcttatggcgcagtccggccaggctgacttcgatcaggacatgactgagagggagaagatggactaccttcggaagcaggaacgggattaccagcagcgtgtccgcggcgccatgccgtgcattttgccagagtctgtccgaggggaggttttggcaatgatgaaaaaacaggagaaggtgagtgccaggatgctgcagaagatcagggaccatgttcagaaatggtaccacaatgagggctttgtatgtgcacaagtggtgaattttggaaatcttaacaccagtgaggttgtgtgtgaggtcgtcgagggggacataaccaaagtggagtaccagttccaggataagctagggaattttgtggaagggaatacccaaattcctatcatcgaccgggagctgccccagcagcttcgtcctggtcatatctttaatattggagcaggaaaacaagctctgaagaatataaattcgctcgctttattctccaatatagaagtgaatccacgtcctgatgagacaaaagaaggtggtattgttgttgaaattaagcttaaggaactagaaccaaagtctgctgaagtaagcacagagtggagtatcgtacccgggacgtcaaaggcaggcccaccctgggcatccattccaacctgggaggaactggtgtccattttgagcaccgcaacatctatgggccttaacagttccattgctgggttcccggtcgtcgtcccacccgcccggccctcaccctccaagatgattcttttcnattccaagcttngaatacgtccatccctttatttttggaccgtggtgggattgacccgttnattaagaccgaacctttnnaaaactagctggctttcnaacaaccaagaattgagccctgnccttttggntggctngcccca

SEQ ID NO: 34188 - DNA, 592 bp, Triticum aestivum
  Clone ID: PAT_TA_34188
ccctccgagtcccagctccaaggcactccgccgccgccgccgccgccgccatccatccatctccgccgctgccaccgcctacctattccacccacgaaccgtagccagcgctcgcggaggacacacggcatggaggagccgatgtccaggctcgaccacgacctaatggcggagatcctctctcgagtgccctacaaatcactctgcatctgcaagtgtgtgtgccctgcctggcgcgacctcatcgccgatccggcgaatcggaagaagattgtgcagtccctggccggtttcttctaccacatcccggccgactctgccgagtcccgcggcttggccgtcaactacgccgacctgtctgccttcccttggtcaagcgtgccttctacctacccgcgcttgccactaccgccagacagcgcagactgtttcctcactgtcaaggattcctgcgatgggctgtttcttacccggattgggaggggcacgccggagccacaatttggctacatggtctccaatccagctaccagtgagtatactctgctgccccactctggctacgccggcgagtgctgtggctcttacttgg

SEQ ID NO: 34189 - DNA, 273 bp, Triticum aestivum
  Clone ID: PAT_TA_34189
gggtccagcacgctgtgaagcttttgtttccaggataggaaactgatgtcatgtcccgtgtacatacatgggctgttgcatgatgaacacttattgaaagacgtcgtcttatatgttaggttgttgctgtggatattgttgggtgtttacgtttttctttttgctattatcgtgtgtagacaatctgctgccctggtgtgtaaaaatctcagaagtctgactgcttgatgccttttaaccctgttagcaaattatcccggtactgttactatc

SEQ ID NO: 34190 - DNA, 734 bp, Triticum aestivum
  unsure (1)..(734): unsure at all n locations
  Clone ID: PAT_TA_34190
cgtgtgatgtgccactccggcttcgccccgttggggttgccgtttgccgtcgcctccttggctctggcttggcgtttcgcgaaccacctggttctcggcggtgaggttccttttgttccgacccccgctcgcatgtggccactctcccacacttccatcagggtcgccctcatcgtccaccccttgagcgtgcaagtcagcagctgactgagacgccgaacctgtgcaccatttacaccgcctacatccctccttgcctcaagcccggcctgctcgtgcctttcacgctcttagccggcgttcgccaacgcccctcctccggtggcccgtcagctgctggatgtgtcgccgatctccagctcctttggcccccctttcctccccgacctccctctggcccgtgtggctccaggatggggaactcttggcaggcgccctgtacatacatgggttgttgcatgctgaccacttattgaaagacgtcgtcttatatgttaggttgttgctgtggatattgttgggtgtttacgtttttctttttgctattattgtgtgtagacaatctgctgccctggtgtgtaaaaatctcagaagtctgactgcttgatgccttttaaccctgttagcaaattaacccggacccgtggccgcggccgcgcgttnacgttttcctttttgcaatancgngtgnaanatctgctgccctggggggntaaaatccaanaatcngacgg

SEQ ID NO: 34191 - DNA, 826 bp, Triticum aestivum
  unsure (1)..(826): unsure at all n locations
  Clone ID: PAT_TA_34191
aatggccaaaaagaaagaaggcaaattttcataactgatgggcagcaacgtgcagtcgtcacgctttggggacaacatgctcgatcgtttgatgccgtgggcttgcgcaattcatcggttaaaggaccgataattatactattcgtgggtgtcaccgttggccattatttaggcctccttgcattcatgtcttcttctaatacgtgatggtatgtcaatgcttccgtgcctgaaacagatgtcgtgcgtgagagcacgaaaaatatatctcacttaattgagatggctggaccgaaaaaagaacaagtttctgcaattgacgacactgttgctaatgttgcttctcgtgatcctgaagagattctgaaagaacgatatcgatttactattcaaattaccgaactggtttcaactgaagattggtggtaccaaagttgcaaagattgttggaaaaagatcaaatcggatggagacgtttataaatgttcacgttgttccaataccaagccaattccaaggtgtaacatgcctatttgtttgtttaacctatttttaatttttttatttgtgaaatatttggatttcttgcataattaatacgtaatctggctttcttgcataattaatatataatctggtgatgtgtcagggtgtgctgtcgggggttgggggtgtcgaaccaggatgtcgggggggttgagggtncggggtcggngttttttttttaatgcattatttgtgatattttatgttcttttcatgatcatcatttgtaataatttatattttattacataatgtttacgtgatgtacaattttcttaat

SEQ ID NO: 34192 - DNA, 687 bp, Triticum aestivum
  Clone ID: PAT_TA_34192
ccgccgcgtcgcccgcggagagacagaaacgacacacccgcaccagtcactcagctcatccgtagcgaggcatatcagcaagagccatggcgacgagcaaggaagacatcaagcacggcacggcccaggcgaggttgaccgtggacgacgagctcaggaccggctacttcaacggcacgccgctcgagggcggcaagatcgccgactccgaccccgtcgacctcttcgcccaggcgcgacacgtcgccgacgcctcgcagcagcagccgcggcgtgatctaggggaggaggaagggaggaaggctgggtcggaggagccgcgggcgcaggcgcggcaggggatgggcgccggtggacgtcagcttgggcgccagtagctggctagctagccgtagtaccacgtcgatgtagagctgcctagaaataaagttgccgaggccgccggccggccggacggccgatgttgtatgtcgtatgtagtgtatcaccgaggtcaaccgtgtgagaagcaccacctagctctgcttttgtcataagtttcaccctgcatgcgcggtgctttagaaaataaatgaaccagtgttggtgcatcaaaaaaaaaaagctagactcatcatctttatttccttataaaaagaacaagaaaataaacctgatcgctatagcatgcttacaaaacacttccgt

SEQ ID NO: 34193 - DNA, 493 bp, Triticum aestivum
  Clone ID: PAT_TA_34193
cggctccacgggccagacggtgccgggcgaggcgcagaggagttcgaacgagcggtcgtggcttgggcagctgcgggagatggccaaggcgagcttcagcagggacggggaggacccgtccagcagcaccgcggtcaaggggaaaaggagcgggagctcgtcggtggcgtcgcagtctgcggactccaaggccaagggggagtggaggcccaagtccaaggcgctgtacaaggatttggaggccatcttctccaacaggtagcaggctcgctcgtccatgattggcaagtgacatgagaataagatagaatcaactgatattcaaaaaaaaaaagatagaatcaactggataagcagggaacaagtggaaacactgcacatactagcaataggaatatgccgtttaatttgacacaaaatcatcagtaggtgtatgtgtggtagcattattgtcacaagatcattcatgaccgtaatagaatgagttcttcat

SEQ ID NO: 34194 - DNA, 656 bp, Triticum aestivum
  Clone ID: PAT_TA_34194
agtgtgcagaggccgctgttgttggtgttgagcatgaggtcaaaggtcagggaatatatgcttttgtaactttggtggatggcgttccttacagtgaagaactacgaaagagcctcatagcaaaagtccgcactcagatcggggcgtttgcagctccagacaggatccactgggcgccggggctccccaagacccgcagcggcaagatcatgcgcaggatcctgcgcaaaattgccgcgaagcagctggacgagctcggcgacataagcactctcgctgaccccggcgtcgtcgaccagctgatcgcgctcaaagattgctaggatgtaaagcagttatgcgactgttttttcccctatgcggttatgtggttggtagaaggttgattttagtgctcgctagtccttttaatcagtgcgattttctcctgaggctagtgagctgctgcgtggtgtaatgtaatgttctctccttgtgtttcacttttgtaaacttgtgtatcacatatccgtagagttccgtgaatgtattgattggccgaagaaaaatacgtcaataaaggaaatgtcaactgtgttaaaaattttttgtagaaacaagtggtgttttctcaagtctggtttaaaaaaagggagcgtgtactgattaagcagctg

SEQ ID NO: 34195 - DNA, 1310 bp, Triticum aestivum
  unsure (1)..(1310): unsure at all n locations
  Clone ID: PAT_TA_34195
ccacgcgtccgatatggtgtatactgcaacaacatttaagtatgcttttgattacaagccaacagacatatactggtgcactgcggactgtggctggattactggacatagctatgtgacatatggcccactcctgaatggagctgcagttcttgtttttgaagggactccgaactaccctgatgctggtcggtgctgggacattgtggacaagtacaaggtgtcgatattttatactgcgccaacactcgtccgttcactcatgcgtgatggtgatgagtatgttacacgctactctcgaaaatctctccgagtcctgggaagcgttggtgagccaattaatcctagtgcatggagatggttctacaatgttgttggggattcaaagtgccccatatcagacacttggtggcagactgaaactggtggcttcatgatgactcctttacctggtgcctggcctcagaaaccgggttctgcaacatttcctttctttggtgtgcagccggtcattgttgatgagaaaggacaggagattgaaggagaatgtagcggatatctttgcattaaaaaatcatggcctggggctttccggaccctctatggagatcatgacagatatgagaccacatacttcaagccatttgctggctactattttactggtgatggttgcagcagggacaattatgggttaccactggcttactggtaagagtagatgatgttatcaacgttagtgggcatcgaattggcacagcagaggttgagtctgctttggtttcgcatccacagtgtgcagaggccgctgttgttggtgttgagcatgaggtcaaaggtcagggaatatatgcttttgtaactttggtggatggcgttccttacagtgaagaactacgaaagagcctcatatcaaaagtccgcactcagatcggggcatttgcagctccagacaggatccactgggcgccggggctccccaagacccgcagcggcaagatcatgcgcaggatcctgcgcaagatcgccgcaaagcagctggatgagctcggcgacataagcactctcgctgaccccggcgtcgtcgaccagctgatcgcgctcaaagattgctaggatgtaaagcagttatgcgactgttttttcccctatgtggttatgtggttggtagaaggttgattttagtgctcactggtctccttttaatcagtgcaattttctcctgaggctagtgaactgcagcgtgagcaatgtaatggtctctccttttgtaaacttgngtatcacatatncgtagagttccgtgagtg

SEQ ID NO: 34196 - DNA, 949 bp, Triticum aestivum
  unsure (1)..(949): unsure at all n locations
  Clone ID: PAT_TA_34196
gctgatcggacctacactatagaagctatgatgggtgacaagaangccttacaagctggaactagtcacaaccttggccagaacttctcccgtgccttcgaaacacagtttatggatgaaaatggtcaacttgagcacgtatggcagacttcttgggctattagcactcggttcgttggtgggatcatcatgacccatggtgatgatgctggtttaatgcttccaccaaggattgctcccattcaggtggtaatagtgcctatttggaaaaagggtgacgaaaagggtgttgttatggaagctgtagcttcagttcaagaacacgctcaaagaagcaggcattagagtcaaagtggatgactcagagctgaggacacctggatggaagtttaacttttacgaaatgaaaggagttcccataaggattgaacttggtccccgcgatgtaaaaaacaggagtgttgtgctttctaggcgagatgtccctggaaagcaaggaaaggagtttggaatatctatggaaccatcaatattggtggatcatataaaaggccgtctagaggaaattcaggcatctcttctacagaaggccatcacatttcgtgatagtaatatagttgatgtcaactcatatggagaactgaaggaggtcatttccgagggtaaatgggcaagaggtccatggtcagctagcgatgcggatgagctgaaggtgaaagaagagaccagtgccaccatcaggtgctttccctttgatcagccggagggtgcgaaaaaatgtttcatgactggcaatccagccgatgaagttgctatttttgcaaagtcatattaggccatctttgtgcaaccagagatcagaatatttttattacagattcttttctctttcccacagtttctctgtggtctttactgaccatgaacgaagaatttaaaggttttttcc

SEQ ID NO: 34197 - DNA, 636 bp, Triticum aestivum
  Clone ID: PAT_TA_34197
tgctcactgtaggcaccgtcatggcggtgctcgacttaagggaggaggtcggcaaccaccacttcttgaaccgaagtttgcagaagctatggaagaaatggtaacttgcttacttgggaaaactgcattggatagcgatgatggtgacagtgatgaatctaaatagtgtgacggtctgagtactcgtgggcgtgacgaggtgattgcggatccaccagaacatgcgagtggcaatgcttcaggacaagcaggagttcaggctgaatggccagttaacaagaatcgggtggatctgcgtgtggtggatgatcgtttacaaggaaggttgaatgtatggttcctggagatgatcagatggtgccacgtatttgacctgcgatttgtgcctccaatagttccaatgaatgctccatagagaatgtaaggaagtaggaatcagcaggcgtctctgagttgtttcagttaccatatttgcttgcaaggtgtgagggtgaagccaactctaaaagtgggggtctgttcaagtagaaggaacatgccaagatgaaagatgacggagcaaaaaaacctatagaggcatgaacgcaacactatctaaaacgtctcacacttctgtctaggaatataatgggatct

SEQ ID NO: 34198 - DNA, 849 bp, Triticum aestivum
  Clone ID: PAT_TA_34198
gcggcaggcaacttccacttcgggatggccccttcaggcatgtcgatgccgccgatgcccgccgcccgtcatcctccatcaatgatgcagggctacccggggctcatgatgcaggaagggcagatgaaggcggagccaggacagcagtccgggtttgcggcgtcatcggcttaccaacagatgatgggcaggcccccctttggtccccagatgtaaataataggatgcaaagaaaggaaagatagatgtgctccggcttgcctgtatacatggtagaattgcaacagcaatgcatagcttcgttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttaaaagaacaaaattttaaccgcggggactgcgaaggttaaattttttttttggggcaccaaaattaaatttttgggcccggggtttaaaagcggggaggggggaaaaccccggggttcccaaaattaaacccctttgaaaaaaaaccccttttccccatggggggaaaaaaaaaaaaggcccccccggatcgcctttccaaaaggtgcccccccctattggcaaaggggaacccccctttacttggcctttaaaccggggggggggggggggttcccccaaggtgacccttaaatttttaaaggccctaaacccccaattttttggttttttccctttcttttcccgcaactttcggggttttccccgggaaagtttaaaaggggggg

SEQ ID NO: 34199 - DNA, 1224 bp, Triticum aestivum
  unsure (1)..(1224): unsure at all n locations
  Clone ID: PAT_TA_34199
cccccgcggtcgatcggagcaccaggtaccgcgggctgtgggagagccgctttcgccggcaaatacggctccttcgacgaccagacaactcttgggcccatgcgctttacattcggacccatcccgagctacgccagacctcattggaccatccagatcttcggcatccgggtggccaacctggaagacggtctccagcggccgctgcatgtccacggctttgtcgccgcgagggacacctcggatcacaatcgcaacttcctcttcaaccgcaccagtgataactgccaggtcctcacccaacaggatccatacctactgctgacaggcccgtcgcgcgcgatcgtgatcattgacccgatcacgattgagttccagctgaaggtgaagagcaagacggaccccgaagaggtcgagatgctggccttcgggatcttcaactacccccagacctaccttgccacacatgtgatccgctctggtatcctctgcgaccggtgcacgatccagcttgcctacgcgccgctggacccctcggtcgaggcgaccgtcatccatgtccggatcatcgacggtgtgtggccagagggtctccgtgggcgcgtcgtcgccgaggtcacaaccgtgcgggaaggagaggtgctgctgctcgactcccgggacgggaagatgccgatcagcccttcaaccggcgcggtcgagctctcgaggcacgtcgtgtcggtggacctcgagggggggaagctggttgtctccgtggtggcatcccctcagaccgctggcaaagaagacggtgatgatggtggtggcgctgccgtcgttgttgcgcgaggcgaggccgtgttcacgccagagagggccggcacgagcaatggcacctgcgatcttggcttctgcaaggtggaggttgctgttgcatggtcccttgtttcgagcttgtggaatgagtggcgcgccctcgcgaaactcgcgaaggagagggcatgaatgagtgttctttgtgttcctgtgtagtgatcagctcaggcgagcactggaaccgaggttcttccatgtctgtccgcctctttttttcacttgtctttgttcagttataagtaagttttgtgttgatctactttggtctgttacctgttggcttgcaagatagtctgccagcaaaaagataacacttgctaacatgaagaattctgccagtnagttaacctacagcaatttaatcta

SEQ ID NO: 34200 - DNA, 680 bp, Triticum aestivum
  Clone ID: PAT_TA_34200
cggacgcgtgggggcggccacgcagctggccgcgaaaggggcgcgggtgctggtcctcgagaagtacatcatcccggggggcagctccgggtactaccgccgcgacgggttcaccttcgacgtcggctcctccgtcatgttcgggttctccgacaagggaaacttaaatttgataacgcaagcactagaagctgttgggtgtaagatggaagtcataccagacccttctacggttcatttccatctacctggtgctctctctgttcttgtgcatagggagtataatgacttcatcgaagagctggttagcaaattcccgcatgaaaaagaaggaatcctaaaattctatggcatatgttggaagatcttcaattcattaaattctttggaactaaagtccttggaagaacctctatacctattcgggcaattttttaagaagcctttggaatgcttgactctcgcatactatctgccacagaatgcgggggatattgctcgcaagttcataaaagatcagcagttgctatccttcatagatgctgagtgtgagatatttattgtgagcacagtcaatgccttgaaaacacccatgatcaacgcgagcatggtattgtgtgataggcactttggaggaattaactatccagttggtggtgttggtggtattgcggtgtctt

SEQ ID NO: 34201 - DNA, 1013 bp, Triticum aestivum
  Clone ID: PAT_TA_34201
cggacgcgtgggcaacggcgaacccgccaatctcccctgcctcaaccgggccattggagaccggggtttcgcttcgctcgtaaaccctaatctagtccacctctcgccaatccagtccagtacctcgacggtcagcctctccgatctcacccgatgccccgacctcgaccccgcgggcggggcaaaaccagatccggctcgcaaaggatggattccgaagagggcaccgcaccaccggctccggaacaggcggcgtgtgatccgtcgcaagaagagagtgcggcgccggtggacgaagagagggcagacactgacgcggtagcgggagaagaccaaggggcgagtgagaacgaggcggaacggacacgcgaagagctcgagcggacggtcacggagctcagcatccagaacgagtacctaaagtcccagatcgccggtgctcagcagctggcgaatagcgccgaggtgggaataggcagtgggagggaagacgaggatgactccgagctcgttaggagcttgaaggagcaggtcgaaaggcttagcaaggaggttcaagagcaaaaacagacgcagaaggttgcggaggcggccctcgagcacgtcaatatgtcctacgccgaggcggacggcaaggttcaggagctcacggcgaagctcaaccaagctcaactgaagattgaaaaagaactaaaggaacgagatgaaaaatatgttgagttggatactaagttccagaggcttcacaagcgtgcgaaaaaccgtatacaagatatacagaaggaaaaagatgatctggaagctcggtttaatgagattaatcagaaggctatggaaactgcttctctacagctagcggcacaacaggaactgggaacgtgctcgtcaccaggctagtgaggctttacgggcaatggatgctgaaagacagcaactgcggactgtgaacaacaagtttagatgtaattttgacgagacacggcttgctttggatgccatgactaatgcccttg

SEQ ID NO: 34202 - DNA, 1832 bp, Triticum aestivum
  Clone ID: PAT_TA_34202
ttcccgttggcttccaacccctacagcttgccggccaagctagcaacaagcctccaaggagcaagaagagaggaagccgagctcgatcaagcaaggtcgaaatggaggtggaggccagcgcccatggcgacacggcggcgagcaagttcacgctgcccgtggactccgagcacaaggccaagtccttcagactcttctccttcgccaacccccacatgcgccccttccacctctcctggatctccttcttcacctgcttcgtctccaccttcgcggcggcaccgttggtgcccatcatccgtgacaacctcaacctcgctaaggccgacatagggaatgccggtgtggcatctgtgtctgggtccatcttctccaggcttgccatgggtgccatctgcgaccttttagggccgcggtatggctgcgccttcctcgtcatgctctcagcacccactgtgttttgcatggctgctatcgacgatgcgtcaggctacatcgccgtacgcttcctcattggcttctccctcgccaccttcgtgtcatgccaatattggatgagcaccatgttcaacagtaagatcattggcacggtgaatggcctcgcggccggctggggcaacatgggcggtggtgccacacaactcatcatgccgcttgttttccatgccatccaaaagtgtggtgccacacccttcgtggcatggcgtattgcctatttcgtgccgggaatgatgcacatcgtcatggggttgcttgtgctcactatgggccaagatctccccgacggcaaccttgcgagtctccagaagaagggggacatggccaaggacaaattctcgaaggtcctttggggtgcggtcaccaactaccggacatggatattcgtcctcctctacggctactgcatgggtgtcgagctcaccaccgacatcgtcatcgccgagtactactacgaccactttcacctagaccttcgcgccgctggcaccatcgccgcttgcttcggcatggccaacatcgtcgcgcgtcctatgggtggctacctctctgaccttggtgcccgctacttcggcatgcgtgctcgcctttggaacatctggatcctccagaccgccggcggcgctttctgcatctggctcggtcgtgcatcggcccttcctgcctcagtcacggccatggttctcttttccatctgtgcacaagctgcctgtggcgctgtatttggcgtcgcaccattcgtttccaggcgttcccttggcatcatctctgggctgaccggcgctggtggcaatgttggcgcagggctcacgcagcttcttttcttcacttcgtcgcaatactccaccgggaggggtctcgagtacatgggcatcatgatcatggcatgcacattacccgtcgctctggtgcacttcccacaatggggctccatgttcttcccggctagcgctgatgccacggaagaggaatactatgcttctgagtggtcggaggaggagaagggcaagggtctccatattacaggccaaaagttcgcagagaactcccgctcagagcgcggcaggcgcaacgtcatccttgccacatccgccacgccacccaacaacacaccccagcacgtataaggcccttatttttatgtcacctaagaattttactgttcatcacgtatatatacaaaccgtatatctacgtctgcagccccagcgtaataagttgtatggggatttatgtttctactagtaaacttaaggaaacgctgcttttgcgttcctgctctgtacgcatgaaatgtaatatcaatttgagtccgaaattactacaaaaaaaaa

SEQ ID NO: 34203 - DNA, 1189 bp, Triticum aestivum
  unsure (1)..(1189): unsure at all n locations
  Clone ID: PAT_TA_34203
ctcgcaaccccccactgcccctcgcaagctctcccgcactcgcgcccgctccctcaggcccgccgcagcgggggaagaaggggggcaagaactcgagacctgggaggcggatccggcccccacacacccagcccctcgcaagctctcgctccctcacccaccgcagagcgagggaagagggggccaagaactcggaagccgggaggccgaggcggaggagggctgtgccggggagtggcgggccccggtcccggacctgacgatccaccgccggggcccctgcggcgcagccgcctgctccgcacctgccagatcggcggccccgccgtcggggggccgccatttctgggtggccgcattggttcaagagtttattacctaaaggttcggcacatcgggcttcgtaagcccttccttgtgaagcttccaattgcgtactttccaacgggtaagatggggtctgttccctgataacttctacggacacacgttcctcgccctctggaacagtggcatctgcagaatttgaaaggcctatgttggcagttccgtttttgtcctccaagaatcgcaactagacgaggccggtcgagacccagatgggggattcagccttgagcagctcgctgatcggtgattaccctcgcaaggctggctgcgtggggagggctgttggatggaaacgtgtttttgtccagactgacactgggtttgtactgcctgttcaactggatcgtggtgacagtgtacacacagtcaaaagaaagctgcaggtggccctcaatgttcccactgaggagagttctctgacactcggtgatcatgtcctcaagaatgatctcagcagcatccgaaatgattccccactgctcctgaccaagaccttcatgcatcggagttcctccagcccatgcctgtctcctacaagcaaggatcttccagcgcataaaggtttaggggcaantccaattggaaatttaannttttccaaccccgttgatttaggccaaacaantttgttaagganttttctttgggncnttaaaaaaccggggnggntcccaaaatttgnnaaaangggcttggggggncccncttttttangaaccntnanggggnaaannnnncctttnaanccnannntngggncctttnnccccncnttnnaaagntttnnngggnaanccnn

SEQ ID NO: 34204 - DNA, 395 bp, Triticum aestivum
  Clone ID: PAT_TA_34204
cccgcggctaagcagccaagaacatacgagaaacctgcacagcgctgcacacacacacacacagagagcgcaacgaacagaaagagtgagaggcccgacactcccgctccccctcccatccatctcgccaaaaccatccattattagccagatgctgtcgtcgtcgtcgtccgtcccccgttgatctctccaatctcttttagccactctcgtgcagacaccgcgcgcggtccgcggaggaggagaagctagctagctcaacgttggttcgcatcgccgtcggagggagttcaggctcagccggccggccggcatggaggggaagcacatggtgatgtcggcggtggggatcgggataggcgtcggcgtggggcttgggctggcatccgcgccgt

SEQ ID NO: 34205 - DNA, 824 bp, Triticum aestivum
  Clone ID: PAT_TA_34205
ctcccaagtcccaacccaacccctccctagccgccccaatcttcttcttcttcttcttcttcctctccctcttctctccatgattgaaaaacaaaacacagctgggcaacggatggatggatggatggatggaggcctctccttgcttttgcctttcttcatcacaacaaggcaaaagcaggattcctggatggatggatggaggcctctcttctcttcaagacaggaaggcagaagcaggattgatggatggatgtaccaagaagatccggccacctcctctttggatctacagttttcggagcaaaagtcgttggatctgcaagttttttggtgcggtgttctactcaccatgcccgtcaggatccgccaaggtctcctcctgctgttagccatgccgagacgagttttttggcgccttgttctcctcaccatgcccgtcaggatccgccaaggtctcctcctcctggtagccatgccgagacgaactcagtttcctctttctttctttctttcccccaccagggcccagcccggcctcgcccccccaccgccccgccccccgtcccccgcccaccaccgccccgccccccgtcccgcgccctgcgcccctgcccccccccaccgacccccggctccccggcccccgctgcccgcccccgccgcgccgcccccccgacccggcccctggcgccgccccccctccccggccccgcccccctcccccgccccacccccccccacacccctcccgccgcctccccccccgccgcacctcctgccgctgccgccgcgacaccgccggccggactccgatggccagc

SEQ ID NO: 34206 - DNA, 628 bp, Triticum aestivum
  unsure (1)..(628): unsure at all n locations
  Clone ID: PAT_TA_34206
tcatgtcatgcagttgaacaatcatccatttgtaaagatcccacaaatgtacatgacataggttcaactattatcatttgcgacatgttcatatacagtcacgatgatgtatacatacatgcaatgttgtgaagatctatcagcatgtggtcattaattcattcattataagatggtccaccatggtcaaatgttttgtcttctcctttcgttttcttgctatctctgtttttaccatcataatagaagatttggttcaagcatcaaaagcatataatagaagttccatataatggaagttacttgttgtgttgtatctctctactattataaggacttcaagtatctcaaatactaaacatactttcatgtcatcctattatagatgcatctcgtggacttgaatggggcaagaggtatctaattattaaaggaatttgtgagggcttatattaccttaaacaagaaagtattattaacttagatctgaaacncagccaatatatcggtggacaacaatatgttgcccaaaattgccgactttggtctcccaagatgttatgatgaaaatcaaaattggatcaatgtaagccggttaagtctctcaaagctcatcaatggnggcttt

SEQ ID NO: 34207 - DNA, 1173 bp, Triticum aestivum
  unsure (1)..(1173): unsure at all n locations
  Clone ID: PAT_TA_34207
cggcacgaggggcaccgccccaggaagaaacggcgacgccgaggaggggagacgcggtgccgccgctgccggcgacgacgactgccgccctctctccgatgagctgagggtgaaagaagagaccagcgctgccacatggtgcttcctattcgaccagttgaggatggatcgattagttcatgggttgaaagggagggcgaaagaacagaatactccaggccacaacttctggaggacatctggtgtcatatacattccctactaccaatgcgagatgctgcccgagctgcttgcgtgtctcgtgcctttctaagtttatggagatgccatccaaatcttacattcagtatggaagcactgggcatgaatatgaatccgtgtggagaggatgaaataggaaatttcaccaaaaaagttgaccacatcttaaaaaaccgctcacgcattggtgtgaagacactcaggattgttttccgttattccaatgccatggtcagcaatgttgataggtggcttcagacagctgttacacctgagattgaagaactcactgttcagcttacacctgggattgaagaactcactgttcagcttacacctgggattgaagaactcactgttcagctatcttcagcatcgggaacatactacaacttcccatggtctcttttagctaatgggaatggaaactcgatgcagcatctacgcctttcccattgtgttttctctcccagcgttgaacttggcttaaaaaagatgacaaggattgatttgtgttatgtctgtatcacagaggagcagctggggtgccttcttcacaattgctttgttctccaatggatgcgactctcacaatgcagtccgctaacttgccttaagattccgttccatctgcaacagctcagatacctgaaggtgtttgaatgcaggtctctacaggtgatagggatagaagctccaaacctcgtcagttttaattttcatgattcccaccaggtacagatatcatttggagtagcattgcaattgaagaagctcggcatgtcccatcctggtgctgtatgttatgctcgtgctgatctcccattgagcttgccaaatgttgaagatctttccctgagntcatgnanngagatggcngataccccnntgctggctaggggatgcttaccc

SEQ ID NO: 34208 - DNA, 1138 bp, Triticum aestivum
  Clone ID: PAT_TA_34208
gtccagtcgtgtcttattgatttggacgggttcttactaatctttaagccaacttcaaattttagcctgctcggtcaatctggattatttagtgtcaattttgatgcatgtctttaataaaataagaaactgattttgggtgctaaaataaacactaaacactacttgttcatggcgactatgtgtagaaagacgatcatggtggagatcccgacggccgacgtgacgccgggatggaatacgggcacgaagatcaccttcctagaaggaacaatctgattttttcgtcttatttgcagcgtaaactatgtacagtaatcattagaccatctttgaagatctgacgaacaaaagcagaatggttctttctatactgttcgaccccccctcccccccccccttgcgttctctcgcagggagtggctagcgcgcaacactgccatgctcctctgctgctccgtcatcacagggtgggacggcgacctcgccttcctgttcattgttctgtcggtagcgacgttctttgtccaggatcatccggacagggaggtcctccaggccatgcgtctaggcatgtactgcaacgccgaccacatggctaagatggtcattgccatcaccgagttccgcgctctctgttcttcattaaatccagatgcggaaactaaaaggcgagtaccatgggatcatgaagtatataaagcaaaggaggagttgtaccatctcctctccggcaagattcttttttttgctggggaatgaacgaattgaatgcaagattgcattgttacaaggacagagagtggaccaccaccttcagtttctcagattccctgtttgcattcgccattctcaacaagcaccaggatgtggctttggttctgcacaaacaatatcttcagtggtttctagatcaagccctatgttctttatctgaacaatagacattgtaattgttccatccattacctctgaaagtcaagaatcgaaagaaaagttattggcatatctctgtcaccaaggaaggttcgttagacagaaaaatgatctctggttatgtatgagatgatgcaatgcacatctctgaatgaagcacaacaggaatttacatcctctaatgctaactgttgatcattct

SEQ ID NO: 34209 - DNA, 1593 bp, Triticum aestivum
  Clone ID: PAT_TA_34209
gtcgacccgcagccgcaggaagcccgcctcctgttttcctttgatgccggtgcaggccagcaaaaactctgcccttgtccggacctacgactacggtaaactccaggccgcctgtgatggcctcctcattgtctcccacggatccatgacggatgagttcatctgcaacccggtcacccgcaagtctgcccgcctagcaaagcctctggcccaacagggttattaccaccagattatcggcttctaccggcaccaaccatctggaggagaattccgagttctatggatctctagtccggcaatctacaatgcatacaacacaaattacagaactttctactacgtcatagcggtgggatccgataatacaagatacatgagacaaggatgcataccacaaccaatatcctcgtcgccttccttggagctggcattacgcaggggcctgcctgattcgtcccaatatccaccagtccaccaccgtggcggcctgcactggaaacttggaaaataccacggctgcgatgcggactacataatggtgttcaacacatcagctgaaacatttcgattgatgtgtcgtcctgcccgattgggcaactgcttacatgagtcattgctggagatggatgacactcttgctttgtgcagcatcagtagtgacaaacacaccatagacttttgggtgctacaggactacgatgctgaaacatggtctttcaagcatcggattaatttgattggggtggatccatcagcgcttgttgatccagaggtcataatagcccctagtatggctgttctcagtgggggtgagatgctgattcggtttactcataggggtgtgttgcattttgatgttgatggcaagtttttaggatatgtgaaaagccaagatggccaagaaatcaatttgtgggttaccgggcattacctccaggagagcattattcccggtccactgttccatgagatgagagaagatgatggtgcgaaccaggagcctccattttttgtaggactgtaggatgcagtgcttgatctggacgttctacactgctggtttgcagcgccattggagtatctattctaattctatatgagcctttactttggttcttagtatggccttcttagtgctgcttgtaaaactgaacaattcggatggtaggagagctcctctgctatcagcatttggtgtctattatcttggatttagcataatgatggactacttactctattttattcccctcatttacttcattttttggtaccaccaaaggcatggttgcaattagaaaccggtgattgctcgctaagatattaggctctggtaagacttcctgctactccagattcagtacaccaatgacttgccattccactttctttccgagaaaacagatgtttgtacacatgccatcgagaaaagatgagctagtcagtctttgtcgtgttgtttaagtgcatacttttgtttagggatccattctagcattagaagtaattgcgacattttgaatcgttggaatggttagtttggatccttcctccatgtttagtattttttttttaaatgagaccaaccca

SEQ ID NO: 34210 - DNA, 686 bp, Triticum aestivum
  Clone ID: PAT_TA_34210
cgagctctcgcctcctttctcgctcgccgccgccaccacccacgtcggccgcttctctggggacctccagcgccgtccagcatgcccccgagctccccacggtccacgcctccctcccctccggccagagtctccgctcccgtcctctaccgcccgctcgcaagcccatcccccatggctagggtttcgggtagggcttcgcagccgcgtctccggctgccccaggttttttaggggataaacaaggggaggtatagcagggcgttggacatttgcgggagtgggggagatcgatgtggacgaggactgtctggtgcactgctggtgcggggagggcatgggagagggatggctgctgcgctgctattagctggatatagcactgctcctttcctgttgtttgttgattgatgctactgctgctgctactttgatgcagttgctgctaatttgatgtggaggatgtgcagggacggacaacgagcgagcagaggatttatctgggacctaaatttggcaggtaaaaattggtctatttgccgctagctggcttcatgtgcgactatagtgttctatggagacttacagtggcaggtaaaaattggtctatttgccgctagctggctaattgatcttgggctatttggcttattatgatccaaactgagagtatatgcccccctatt

SEQ ID NO: 34211 - DNA, 1370 bp, Triticum aestivum
  unsure (1)..(1370): unsure at all n locations
  Clone ID: PAT_TA_34211
ccgcccaccaaatcgcacccgcgtctgccgcctccgcctgccgccggcgagatgatgatgctcgtcaactgctccggctgccgcacgccgctgcagttgcctcacggcgcgccctgcatccgctgctccatctgcggcgccgtcaccaacgtcgccgcgccacccgcgcctggccccgtcgtcgatcccgcccggggcgcgcaggccacggcgccggcgtggggcccgcctcccccggccgcgcacgggcggaagcgcgccgtgatctgcgggatctcgtaccgcttctcccgccacgagctcaagggctgcatcaacgacgccaagtgcatgcgccacctcctcaccacccgcttcaggttccccgacgactccatcatcatgctcaccgaagaacaggcgcgacccttacaaaatcccaacaaagcataacataaggatggccatgtattggcttttacaaggttgtcaacctggagactcattggtgttccattattctggccatggggcacaacaaagaagctacagtggagatgaagttgatgggatggatgaaaccctctgcccgttggattttgagacacagggaatgattgtggatgacgacataaatgctgcgcttgttacaccacttccccatggagctaaacttcatgcactcatacgatgcttgccacagtgggactgcacttgatttgccgtttctctgcagaatgagcagaactgggcaatacgtatgggaagatcgcagaccgcgatctggtgtctgggaaggaactagtgggcggggaagctatttcatttagcggctgtgatgataatcagacatcagcggatacttcagccttgtcaaagatcacttcgactggcgcaatgacattttgcttcatccaagctattgaacaaggccaggccaccacatatgggagtatcctgaactccatgcggttgacaatacggaacacgggaagtggtgcctcaatggctggaggtggtgcggttacatcactcatttcaatgcttctcacagggggaagcgctagtactggtggattgagacaggaaccacagctaactgcatgtggcacatttgatgtgtatgcgaaaccattttcgctatgatacatttgtggtattctccactgccttctgtgattctatcatgagtccgggtttaaactatcatgtacagctagttgaaatggctcctccatatatagagctaactttgtattatttgatgctcatattcgaattgaagtgtttgccccctttgaattgccccatgtgtgagggatttgccatttcttctgtcactcagaccacataataagatatggtgcaggggctggaaagatttcaggtnn

SEQ ID NO: 34212 - DNA, 667 bp, Triticum aestivum
  unsure (1)..(667): unsure at all n locations
  Clone ID: PAT_TA_34212
ctctccctcagccaccacaaaccctaggtcctccccttctgccttgctctccaccgcgccgcctcctcctccccttcaccattccctccagcggcaggaacagggagacaacggcggcgctcgatttgatccgccccgctcccctccctctccactgcgcctcggcctcggccgccccgtgctctgccggcgcccgtcggcctcgatccggcctcggcaggaggagctcaccctcgagacaggaggaggggcgcagcaggatacaggagcatggccttcttctcgcgctgcagcagccggccttgtcctgctcgaggaggaggagcagcaggaggggcgcacccatccacaaaggtagccatcgtcgagggcttcttacacctgaacctcgatctccatggtgctggcgtccagcaacttgagttcaagggaaggagaggaggatgacgcccagacatggagaggaacagcagcagctcaagaaaaatgaagcaagacaagctggagaagctcgcacggacatccaatttcttgtaccactcaactgagccgagttacttgtggagactataaggngaatttttaggaagagtttgatcaacaagatcaagataagcagccctgttcagaagtgctttatagaggtcatgtaagctttctagacata

SEQ ID NO: 34213 - DNA, 736 bp, Triticum aestivum
  Clone ID: PAT_TA_34213
gcgaattcttcgtatcgaaatgtctcccctacagaaacaatattacaagtggattctagagcgaaattttcagaatctgaataaaggagttcgcgggaatcaggtctcgcttttgaatgttgtcgtcgagttaaaaaagtgttgcaaccatccattcttgtttgaaagtgctgatcatggttatggtggagatagcattggtgatcgcaataaagttgaacgtattgttatgagtagtgggaagttagttttgttggacaagctactgctgagactgcgggagactaatcatcgcgtgcttatattctctcagatggtgaggatgctggacatcctttctgagtacctatcccttcgaggcttccagtttcagaggcttgatggcagtacaagagcggatcttcgtcaccaggccatggaacattttaatgctcctggaagcgatgatttttgtttccttctgtctacacgtgctggtggacttggtattaatcttgcaacagcagatacagtgataatttttgattcagattggaatcctcaaaatgatctacaggcaatgagtagggcacataggattgggcaacaagatactgtcaacatctatcgttttgtcacctgcaaaagtgttgaagaggatatattggagcgggcaaagaaaaaaatggttcttgatcacttggtgattcagaagctgaatgctgagggcaggcttgagaagaaagaaccaaaaagg

SEQ ID NO: 34214 - DNA, 1177 bp, Triticum aestivum
  unsure (1)..(1177): unsure at all n locations
  Clone ID: PAT_TA_34214
tctggatatgggcaatcatctgggaagccaagtgagcagaacacttatgcagacatagaggccgcttataggtgtctcatagaaacttatggggcctccgaggaaaacatcattctgtatggtcaatcagttggcagtggccctactttagatttggcatctcgtttgcctcatttgagagcagtggttctacatagcccaatttcgtctggcttgagagtaatgtatcctgtgaaacatacatactggtttgacatatataagaacattgacaaagttgcattggtcaaatgccccgtgttagtaatccatggtacggctgatgatgttgttgactgttctcatgggagagcactgtgggaactatccaaagtgaagtatgagcctttgtgggtcaaaggtgggaaccattgtaatttggaactctatcccgaatacattaagcacctaaagaagttcatcacagccatagagaagtccccaccactgaaagatgattctccagaaagttcaggcccttcagatcttgaaacaggatctgaaagtatggagagttcaagaaaaagcacggatgtgagggacaaatcaaggtcaagcactgatcacaggcggagtacagatcgacgggagaaaccaaggagcagcatagataggaaggataaaggcagaaagagtgtagatcatcctgacaaaccacgggctagtgtggatcaatctgataagccacggaaaagcattgaccgctttggagggatgatgaggtcggttaaattgtgcaatattgactgcttcaaagtaacttccacttccgggagctgaaaatagtggaaggttagttttgatagtatctgtatttatttcatctgtataatctattccattggggtgtttttaggtttgctgtggaaggtatatgggtttgggtgagggttatgcacactgaattgtttcgtgagaagaaatgatcatcattcccgaccccctgagtttcaaagccatcatttggcacatcaacaatgctaccccacggagtatgaagcaacaccattggtacactgtcataagttgtggttcattacacgtcgaatttcctttcatagaacattatagataacaaacgggaattgtgcctcccncngaaatcnctcaatangattatgcccttatgcttgcaaaa

SEQ ID NO: 34215 - DNA, 745 bp, Triticum aestivum
  Clone ID: PAT_TA_34215
gacaccccttccgtcgaaccaatgtgagctctgccctgttggtgtctgatgaagcgccgccgacggcaccgtggagtgcctagggttctatcaggccgctcgcaggtcatgggcccgcgcgattccgcagcgtcgtgatcctccagcacgggcgtgccgccgccatcaagacgaaccggcgccgccttcggtcgctggtgcgttccctcgctaataagtcatcgcaggtagcggcagcatgtacgcatcaggagcgggcgcctcttctttcgtgctctcgctagatcctcccagcagcaagtcaccctctccaccacgcccttttcctgcggactacgggagtcaaatgctagctggcccttgatctgaatgaacagacctgcaaccggtgcttgatacggatgcatgaatagtgcaagagctagcaaagtcaccgatcgccatacagaatgccaacgtgggaaggtggaagcacaaatagaagcagtgtgaagctgctattttttcctcgccggctacagatcaagcgtcttggtcagcgatgtgttacatacgttatttctccagcacaagttctcccaatcagcacagatttggcgacgccccccttttcgttgtcctctcgatgggcgggattacttccgtctctggtgcagcgacggcgttcgggtgattgtttctcgccttcagaagataagctctcaaagcacaagactctcttcagcttactgaaaactacttactg

SEQ ID NO: 34216 - DNA, 421 bp, Triticum aestivum
  Clone ID: PAT_TA_34216
gtcgactccaactgcaactccaagtcttcgacgtcactgcaactctatggtgttttatgagagagcgaatagttgcatgtctgctactacgcagacaactgcaagtgtcaccccaggctgtagctccatggtgttttgtccggaggggcagttgcatgtgtgccactaggcatgcatatgcaagtgttcccctgactgcaactctgtgttgtttttgttgggggggctaggttagttgcatgtttgtcattaggcacacaactacaaatgtggccccatattgcaactggatgtgttcaatgtgattgcaactcaacggtatttggtatgggaggagaagttgcatgtctaccaccagacaaacaactgcaacttttatacccccctttctcgactacaactgtatgccatcaatatgact

SEQ ID NO: 34217 - DNA, 725 bp, Triticum aestivum
  Clone ID: PAT_TA_34217
tgaagcacgagaaaaggattgttttcccccgtcctgtttattttgcagaaaagtgcgataaggcacaaaactcttctactacaaatgccatcctgatggaccgccagagacgaccatcaaggaaagacaccaccagcaccataccatccatctgggaaacctccagcgggaagaaagaaggaagaaggacgaccagacaagttgtctggtgccctgcgcgaccatggccacgcatcccctgcttttccgacgtccctgctgcgcctccgctttctttcccttgctcctgcttttctttctcaacgccggctgctgcttccccgcttcggtgcgctgcttgctgcttcttcttccatcccctgctcaaaactgttgctgcttcgctaactctgctgcttcttctctgatcccctgctgctgcatttctcctctgccaccctcaacgtctgcttctgctgcgtctcttcttttctcccgtgtctggctgatctactctcttggcgctcccacgcttctcttccgtacctcaattctcttcataaacaccgccttcctgctgctcccttcccccatctcgctgctcctcctcctctgtttctcctctcacgaccctgcttggcctcggctgaagcttttctctcaaccctccacgctgctgctgctgctctggaccgcaactgttgctgctccttccctcaacctctctgctgaattgccgctgctcc

SEQ ID NO: 34218 - DNA, 1154 bp, Triticum aestivum
  Clone ID: PAT_TA_34218
ggtgagatgggagagctcgagctgcagtatcgcaccctccaggccggtcagcaaaccggtcctaccgcactcaaacagcacaggcatggcgccttcacgtgagccgctgccgtctcaagcgcggagcctctacggcagcggatcctggaacccgcattcttgctgcagaaagcattcccccctccccgcaagcttcccacggatgcatccctgtcacggtcctgccgtcatggccggaggactgcggaagcatatgttgatgctttcgccccaccgacccacactctcggttgcgtgctactgctgcagaaggctttactggagcagaaccaggctgcaaagggtgcaaatgacacattgcctgactcaaatggagagagtgacgagtggttgcaagtacagaaattgcatacaaggataacccctttcagaaataccgagatagataaatggcagaggaaaacacaggtcacaactggcgctgctgcactgaaaggaaagttgcacgcatttaatcagaacataagtgaccaagttgctggttacatgagagacccaagcaggatgattaaccggatgtacctgcggaaatctgatgttggtgtatttggggagagtgcagcggagcctgctacttctgttgagggcaaagatgtggaaggtgatcctgaactcatcgatgattctgaattttatcatcaacttctcaaggagtttctcgagtcatgtgatacgggggcatctgaatccgcattttatgctctgaggaagaagcagcacaagaagagaaaacttgttgaccgccgtgcttcaaagagcagaaagataaggtacagtgtccacgagaagattgctaatttcatggccccggtaccgatgacagttcctccgatggcttcaaaattgtttgagaatttatttggaatgggcaaccaaaaggcccctgcggtctgatttaagaaacgattcaaaaatttgacatcagaagaagatttagctattccttcttacgtacttcctccgttccacaatataagatcatttcaacctatgttagcttgaaaaacgttcttatattgtgggacggagggagaagttttaaactgtaatatgtgatggccttactgctagaagagcagtaagcaaaattgttg

SEQ ID NO: 34219 - DNA, 1241 bp, Triticum aestivum
  unsure (1)..(1241): unsure at all n locations
  Clone ID: PAT_TA_34219
tgcaggnaattcggcacgaggggtggtgagagaggcgaggggcgagagggagcgagcgagagccgagagagatccaatccagtccagcccagcccagtcccctcgcccgccgtcgccgccgcttcgattcgctccggttccgcgcttgctagctcgctcaggcgaggttcggcggcgagggaggagggggatcggaatgggcgcgcgcgtgtccaaggccacctcctgctgctgcctccgcgggcagctccacggcagcacccgcctcgacgaccccggctccgaggaggacgagcagggggaggcgtacgagctgccggcgttccaggagtacaccttcgagcagctgcggctggccacggccggcttcgccgtggagaacatcgtgtccgagcacggcgagaaggcgcccaacgtcgtctacaaggggaagctcgacgcgcagcgccgcatcgccgtcaagcgcttcaaccgctccgcctggcccgacccgcgccagttcctggaagaagctaaatcagttggtcagctccggagcaaaaggttagcaaacctgcttggctgttgctgcgaaggtgacgagagattgcttgttgcagagtacatgcctaacgacacactagcaaaacaccttttccactgggaaacccaagcgatgaaatggcccatgagattaagggttgttctctatcttgctgaggctttagaatattgcaccagcaaggggcgtgctctctaccatgatcttaatgcctacagagttctgtttgatgatgattgtaaccctagactttcatgctttggccttatgaagaacagccgggatggcaaaagttacagtaccaatctggcatttactcctcccgaatacatgagaactggacgtataacacctgaaagtgtcatatatagctttggcaccttgctactggacgttcttagtgggaagcatattcctccgagccatgcccttgacctgattcgagatcggaactttagcatgcttacagactcgtgtttagagggccaatttcaaatgaggaaggaactgaactggtacgattagcttctgcacgcctgccctgtgagccccgtggacggccgcatgcatggcccacgggtcaggcttgggctcctcttcagcgaggtgttgccacccctgctttcgtcctcatggccttgccccaagccggtgcatcatctgtccaatcattgcctctttctcctcttgctgatgcttg

SEQ ID NO: 34220 - DNA, 1273 bp, Triticum aestivum
  Clone ID: PAT_TA_34220
aaacacagactgatcctgccacacacatgcatttaccaaataactatgtgagcaatgagaactccatgagctttcctcagcagctagctccatctcaacaactcggctactcccaccacgaggagaggtcgtcagctggacgcccaccacattcgctggttgcgtttggatttggtgggaagcttgtagttatgaaagagaccagctcgatgactacaaactttgacagtggaaatcagagcaattctcgaggcacactgtcaattcttaatatatcggaggttgttgctgataaaattgatcaacaaggcatccctaatggcagtgcacttagctacttctatgctttgtgtcgtcgacctattcctggcccccttgccggaggaagtgctgcagcaaaggacctgaataaatggcttgatgatattatcggaggctacgagtcttctgtcagcgatttccaggaggggatgttcagaagctgcttatatcattgctgaaaatatcatatcaacactatggaaaactccgttcaccctttgggcctgatccatcgcgtgagggtatggatggcccagacactgcagtaacagcgcttttttcatcatgtagtagtaatagtgcccgtatgagagaccattgcatgaaaaatatcccctcagaaaaccagatacaggctactgctcaagaagttcaaaatcttctagtttctggtaaaaggaaagatgcgcttcagtatgcgcaggaaggtcagctttggggacctgcactgatccttgctttacaacttggtgatgagttttatgcggatactgtgaagaaaatggcttactgtcatttcaaatctggatcacctttgaggacattgtgccttcttatcgctggacaaccagcagatgtttttaagcctgagaaccctgtcgatgccaattatgccactttacataggcagcaacagcccgcagagggtactcctgtgggcatgctgaatgactggcaacaaaatttggcaattataactgcaaacaggacaaaagcagatgagcttgtaatcactcaccttggggattgcctttggaaagagagaaatgaggttgcagctgctcattcatgctatttagttgctgagctaaatatcgatccatactccgaaagtgcaagaatgtgtttactcggagcagaccatctgagatgtcctcgcacatttaccagccctgaagctatacagagaacagagttgtatgaatatgcgaaagcccttggaaattctcag

SEQ ID NO: 34221 - DNA, 704 bp, Triticum aestivum
  Clone ID: PAT_TA_34221
ctgaggttgtattggagtaaaagagacttttatttgttatagataattcattatcagttcttttctcatttttttaccccagtgctaccaacagcaggtgatatggagtttgagtgttccagttcacaactcagcagtagattctatagtaatgctgcaactcatgagtcattgggtcaagactgcctgaagacgagtttgctgccaaagtaaaaacattgagatgccaaaatacctgttagtttagttcgtttgaaaccaggcaccaaagagttacaaaagaaccattttcagggtgttagaacatcgatggattttgtacactcaagaggaggcttggggttttcattcgtgcatcaccagaaatttacatccaacatcatagggaatatcttggattgtcacttgcattggggaagcaaaggactggatgaagtttttctcaaaacaaagtacacaatgggcgtggaggatgtgtgtgggcatggcaaacctgagaagtggttattttcctgtgagaacagcctatcacttgctagttcagaaatggtggtcagttgaggttgcttcaggttcaggacgtgaggaaagtcctagttgaaaaagctgtggcgctttcctgtgcagcccagagcaatcctccgaataggcatattgaaagaattggtttttgtggacgtggggaaaccatatatcatgccctg

SEQ ID NO: 34222 - DNA, 2725 bp, Triticum aestivum
  unsure (1)..(2725): unsure at all n locations
  Clone ID: PAT_TA_34222
atacgcgactgttcgcggtcatgcaagaccagaaccaaccaagcgtcccaaaaaaaaaatctcttaccacagaagcattatggcggtagatttccagaccgcgtcccttgaagcacgaactaaccaaaccaagctacaagtgtggagtgctccagatgcaggatccgaaacagcctgtgaaaatctgaacgatatatgctaggaccttatggcaaacgcatattcgtaaaagatgaccaatacccacccggcttcacgctagaaaatcgattgcaaatgctgaaatgcatgcaaggagaagaaggccgtttgattatcaaactcatttccaagaataaataaatgcattccttctaactctgcgtgtgcctaattttcgttaagtaaaagtatctattatgcacaaccactatctgataaagtcttacaatacctattattttctaactcaaaataggaaaaatgccgaatggtctctccaaaaatacagccagtaaatgtttgtacgtttaatttagcatgggtatttcggagtgcacgcgtccttgtgtggggcatgcatgcaagcactattctatggatggacacctccctctctagaaggcccacttttttttatatatatttaggtaacgcttgcctattttgtaagctgacacgtagcaagtatgtgtctctttgatggggcatcctgttaatctctcctactgcttaaacactataaataggggaggttcccttcttctgcaatcagttcctatagttactaaaccatcaaagcatgctccacggtctctgagcacacaccaagatggacttgcctctcctgaaagatatcaacaagcaatcatttagatggaaagttatggccaggatcgcaagagtctgggagctcaaaagaaaagacacaggaactacctatgaggtggacttcctgctgcttgatcgacagggtggcacaatggaaggtttgattccagagaagagaatggcccaatttacgaagcacatcaccgagggaacaatttatacaattgaggacttcaatctatatgatgccaagagcaagtttagatcttcagatcaccccctcagggtatgtttcacatttcgcactaagcttaaaaaagtggagccccaacccgtgaatttcccaatatttgcccacaacgccaggccattctctgttctggaagcacgtgctgagcacaacttcatcttaacaaatgttattggagtaatcgtgcaagtcacagaactcttgccaggctccagcgcaaaccctgatgagcgctgtcagatctacatcactgatggaaagtaggcaaacactatcgatccctgccagtgcaccaatcataatctgtttcgtcaataatttttgctcttcttattgtcatgaagccagtgggctgtggtgacactttgggggacacacgccactactttcacgccggtggccctcgtggagagctctgccacgcagcatatcgttgctnctttttgtaggtgttacagtgagtcactattcaggtttactcgctttcaaatcgacatcagtgaccaaattatatgtcaacatcccaataccagaaatggagaccgtcagacacaacgtgacaggtattccatcccagattgaaatgggtttggtaaccatcgagcaagaaaagagccggtagatgcaagaatagcagaaattgctgagcttgaacccaaccacatcatggacgaacgctacagattttcaattcttgtcactgaagttatcctatcaagtgactggtggtacaaaagttgcaaagactgtcgaaagaaagttcaaatggaaggcgacacgtataaatgctcacgttgcatcaccactgttcctatgccgagatacaaaatatcactgaatgccatcgatgcggacgcaaaaaggcacgaagactcgccatttgctcggttcatattttggggccagcagggagaaatcctcacaggaaagcaagtactgattttagtagcagaagccaacagcagggcggagtatacgccacccgaactgaccggtttggttggcaaaaaatttactgtcattgcaacagctactagagactccctctacggagagcatatgttctaccaggtagaaagtaccgaaccattgttcgagccagcaaacccagagaacgctcaaccaccgatcgaagaaacacagggtgaaaatgaatcacaagacaacacgcttgaggccacacccccgccttctccttctgctgcaaaggaagaagaaaacgactcaacaggcaagagaaggaaacgcaacgaccacctttccaataaaaacaaaggaggaacaaagaaagacctattcggtcagcagccagcccacgctggcaccgagtacaccgaccagaactaggcaccctgtatggcgtaaagcacgcgaagagaaggactaatcaacaagacaaggaaaggatgcatgcgagcttaaaaaaaaaaaattcagcacccttttagcttttcccctcgcgtgcagaataaaaaaactttagactcctcctgcttttcctgctcttgtgtaaaataagaaggctctccatgccttcggtcctgtagcatggaatgcgtttaaactgccttagattctgtagcatgcaatgcgcctagcctgccatgggtcctgtatcatacagtgtgtttagacccatgtaacgtgaataaaaatcaagtagcc

SEQ ID NO: 34223 - DNA, 768 bp, Triticum aestivum
  Clone ID: PAT_TA_34223
actaggtgtttgatgcgaagttgtacttatgcctgtttgatgatctcatgttacctatctttatatgaacaaatcctttgcttgttgatgagtgcaatcaataagactttattattttgagcgctccaccaagatgtaggtgacatggaagagtaacccatgagcctaattccttgtgcatttgcagtccaaagcaaattttaatctatgcacaaatttagggggagctcttacttatcacatacttctcaaacgacgatgtttttcattctttttatcctttgtcgaagctttgatctatatgttgtcatcaattaccaaaaatggggagattgaaagtgcaactagtccggttggtggttttggtaattcataacaacatatagctcattgaactaatgcatattccaagactatcatttcaggaaagctcaatgaatggcatggcatggacgattgaagtggatcccccacaatttcaaaggaaaaggattggcacaagctcaaaagatcaagaatcttcagtttaacccttagagatccatgatgacattgagtctataggaaaagccaatactatcaatgaggcttttaccttttgcttaatgagcctcttgcttcaagtgctggaagatatgctctaaataccctcgatgactttctgccttatgcataggtactaaaccttgcttagtgatatgctcacagccctcaaccactttctcatatccacatttgtccaaaactaaaattcaaactcggccccat

SEQ ID NO: 34224 - DNA, 697 bp, Triticum aestivum
  Clone ID: PAT_TA_34224
gccgctggcggcttgcgacccctcggcccccggcccggtggttggctgccgctggccggcggaggcgagcccgcgcctgcagctcctccccccctcgctccctccccccgtgacccgaggaggaaggaggaggcggcgagccggcgacctgctccaattcagaggagctgagctgcggcaagggcataatgcgggggcccctcggccgcgacgcctccggcgccggcgccgggggaggaaaaggaggagacgacgccgcagccggcatcattcgccacgaccgcaagtgccgggacctgccgttcctcgccctcttcgccgccttctgggtcgccatgattgtcaactccagcttcgggttcaaccagggcagcccgctcaggctgacttacggactggactacaaagggaacatatgtggcagcaagcacggtgatccagatttgagtgagctggatgttcgttactgggtgaaccccaaccaggtgtatcaaagtgggctcaaaaatagcacaaatgatctagctgatgctaaggccatctgccctgaatggaatggcccctatcctggcggaagaccgggcctgaactttgttttgtgattatccggaaggcgacatacggctctctgtcgatgattggatcgacagggactatgattacttcgagtatctcacaccagatatgaggaacagtt

SEQ ID NO: 34225 - DNA, 815 bp, Triticum aestivum
  unsure (1)..(815): unsure at all n locations
  Clone ID: PAT_TA_34225
tccggctggtacggcacgtacccgtggaaggttatgcaggttttgatgttcctcaacttactacagtttatacaggttaagcggatgatgaggggattctttgaacgctttcatgaccattgttctgcaatgtccgctgataatgacaagattgcggagtatctatctcctctagggttgcagcatgtgcagaatggcaatatcaagaaaatctccaagcagtatatggggaatgaatgaacccatattacgcagctttgtggcgtcggcaagtacgcagctgatgcttatgcaatattttgtgcgggtagggcgagggaggtggtacctgatgatcacaagttagttaagtacgggaattatgtctgctttgagttgctcatgtcgcagatcgtagacatcggctcctcccttgatgacattattgcacgaagaggctgcccgcgcccctcctctcggagtcccccgctgagtcaccctctgcccgataacattcgggggtaactgggttgtctagttcgtgtacatgttaagtgaagtactattggaagtttgtgttagtgatacgatgcagtgagatgttattacattacgcagtgatttgatggatgcagcgagctatgtttgcggttgccgttcgctagtgttcttttgtatatataccacgtcatgttcaaaggttagtacgattcatcgctttttgttatatacgtgtgccatgttgcaggtgccgnnctggtaagttttttttaatgtatactagtnacatatgccccgtgcgtgcaacgggagagtttttttgcgagaagcatcgg

SEQ ID NO: 34226 - DNA, 784 bp, Triticum aestivum
  unsure (1)..(784): unsure at all n locations
  Clone ID: PAT_TA_34226
aaccgtctggcaagtcaccattgccacttgaccctggccagagtcgctgtgttcaatcacaaggagccaaagctccaccagaacaagagggagagaatgatggctgcaaggggattaaaaagagcaacgggaggaaaacccgtgtacgtgtcctcagtaagcatgagctcatccaggaggcaaggaaacagcctcagccgctgcccgaaggctttgtgccgttcagcgattttgttgccagttgcacggagcagaatcctgaccattcatcgccttacagtgcatttttcgaccagttccgctataaccccgtctgcaaagatcgcaaatccccacttcccagaacccctgatcgtctggccaggttgccacctcggggtcactcatcatttgggtcatctcagctcgctgcaaatgaagcttccagagcttctaggccggacaccattctagcgtccaagacaaagcagcaagattcaggttcaggatcacaagagaaagttagtgtagaagtaaaggaaaacccggaaaacaagacgagggagaagaagcaaaggaaactatctggcaagtcactattgccatttgactccagccggacttgctgtgttcagctacaaggaaccaaagctctaccagaacaggaccaagaaactgatgccccaaagggttaacatattgaaaaaaggaacagcagaaagcccatgcctgtgctcccagcanatgcgaactctccaagggagatgacaaggagcagacgctgactgaaaggctttttggcacc

SEQ ID NO: 34227 - DNA, 1071 bp, Triticum aestivum
  Clone ID: PAT_TA_34227
aggggagcacgctgcacgcacccgctctgccccggcgccaccaccaccctcgccctccgtcgatgccccgcgatgccgtcggccgccacccgctcgtcgtccatgggcgccggcgacattgagttcgccctcgacctcgacgacatcgccgcccgcgcagccaaagcggactgcatcggcgcgctcgcctgcggccgcgcaagcttctcctaccaccgcctccccgagccgcccctccgcctcaccgtccgcaagctcgacgattcctacttcggcgtgcaggtcgccaggtcggccgctgtgtgggagctcaaggcggcgatacaaggcgtgttcatcgctctctacgatgacatggagaatgctgtcacttggcagcacgtgtggagccacttctgcttatgcttcaaggatgagaaaatgacggatgacagggcaaccttgcgtgcatttggtataagttctggtgatgagctccatttcgcccagcatctctccgttgactacagcccttgcaagagttcaaaaagtcaaagggcaacatctcacagaaggtcaaggacttcagtggaaggttttagtgtcagaccacggagtttgatggatgatctgatcgaagaagatgaggccgagaagaagcttgccgctactaggcattcaaccagtattctggatgaagatttttgtgtttatgagcaccacgagcagcacgtggaggaagatcgtaagaaaggaatctctgttcgcggttggttctcatattctagattgaggggtaacaggagaacacactccgagaatattgagcaaccctcttgcgaaaagggcagtcgaccaaagctagggaaatggctgtcttccaaaatgtcgaaggcccggagtaaatgatacccaactgctatctatcggacatctgctgctttattttctgaatgaagtgtagacgaccagtaattccttgcatgacataggataggccattagcctaggtgaccttaaaagttcagtgtatatatatatatatatatatatatatatatcaaatttgatgtcttatgtttagtgcaatca

SEQ ID NO: 34228 - DNA, 659 bp, Triticum aestivum
  Clone ID: PAT_TA_34228
gccggccgggttggggttcgtttcctgcacctcagtatgcactgcagagagagaatgtatttcctgagagacctgatcagccagaatgcatatactacataaagactggagattgtaaatttggtgcagtttgcaaattccatcatccccgggtgcgctcacagcctcccccagactgtatcttgagcccaatgggtctacgcccaggggaagagctctgcaagttctactctcgctatggcatctgcaagttcggcgtaaactgcaagttcgaccatccgatggcggctccgatgggggtgtacgcgtacggctactctgcctccgcgtcgcccaacgcgcccatggctcggcgtctcctggagtccccctccgggtctgcgtacgcctcctaacgcaaggctccctggcatttgaccctaccttgattgatctcgatgatgtataaaagccatcgcgcgctgtcgtccctccctcgggctcgccccgcgaatgttctcccccctaactccccggaatcaagttctgtaaaaatcgagtttgctaccagagatgtacagttgttatttttgtaaaaaaaaaaaataatgcgggtcagtgtttggatggatggagaagccatttgctaccgaatgaaataatgcttgaatgcagtgttg

SEQ ID NO: 34229 - DNA, 1729 bp, Triticum aestivum
  Clone ID: PAT_TA_34229
cttccgccccaggcttcgccccgatcactcgccggagcccctcccccaatggccgccgccgccgccgcgatcgcgtgatggccgacccagccgctcgccgaagatggacgaagccggaagggcctccgctcccgcggtggtgacggtcacggcctccgccgccgccccctcgcctcctcctccccccgccccccgccacggcctccgccgcggccgccgaaccgccagtcgccccgaccctgacgctctctatgaagagtgaatgtggcagcagatggccaagagcagcggcgccactatgcaatctgggccatatcctgtgcggccaggggaaccggactgcacctactacctcaggactggattgtgcaggttcggcatgagctgcaggttacaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgacccgaatgaaagtaagtgtgcatactacttaaaaacaggacagtgtgaatatgggaatacatgtaaatttaaccatccagaaattttcaatgcggtggcttcttcacgtggttcccctatttatcctcctgtacataactctggaagcactggtccacattcctatactggaacaatggcaagctggacttatccaagaggttctttcattccaagccctagatggcaaagtccttcaaactatacaccgatgattgtaccacagggtcttgttcaagtaccaagctggaactcatatcctggccaaatggtacctgtttcatctcctgagagtcgactacagtctccaggggctcaacaatactatggaacttctcgacaaggtgaagccagtgcaggaaatcagggaatgcaatcaccctacagatccagttcgtttcctgcacctcagtatgcactgcagagagagaatgtttttcctgagagacctgatcaaccggaatgcatatactacataaagactggagattgtaaatttggtgcagtttgcaaattccatcatccccgggtgcgttcacagcctcccccagactgtatcttgagcccaatgggtcttccattacgcccaggggaagagctctgcaagttctattctcgctatggcatctgcaagttcggcgtaaactgcaagttcgaccacccgatggcggctccgatgggggtctacgcgtacggctactctgcctccgcgtcgcccaacgcgcccatggtcgggtctcctggagtcccccggtcgctcccccaaggaaggcccgggttccaccgacggccgggtctgcgtacgcctcctaaggcaaggcgtccgggcatttgaccctaccttgattgatctcgatgatgtataaaagccatcgcgctcgctgtcgtccctcccccgggcgcgccccgcgaatgttctcccccctaactcccgggaatcaagttctgtaaaaatcgagtttgctaccagagatgtacagttgttatttttgttaatgcgggtcagtgtttggatggatggagaagccatttgctaccgaatgaaataatgcttgaatgcagtgttgaaaaaaaaaaaacccacgcgtccg

SEQ ID NO: 34230 - DNA, 584 bp, Triticum aestivum
  Clone ID: PAT_TA_34230
gagcggacgcgaaacttcattagtcgacaaaggtcgcgcggcgctccgcgaaggcgcggcggcaaccccatctacgcaggccgcccgccgcactccgatttcaagcaggaatcacggaccaacccgatcctcccgcccatagatactctccctccacgcatcgcctcatctgaccacctcgctgcaaaccaagatccgcatctgccgattagggtttactacgattggtatttggtgagcagcttcgaaaggggatgggtacggtcggcgcttggaggcgagcacaggatggttccgtcactaccggtgaagccgtcgaggacctggatcgatctcccatcgccgccggcggcggcggcggcggccagcacgaggctccgaacaccgcgggcacacgggccgcgcccattgacgtcgaagcgctaggcgacgagaggaggtcgagagctaagataaagcgccgtgtggttgttgtggatctggaggcggatgctgatcaggaagggtggggtgatgcaggaacaacattgaaccgtgtgaggtggaacaaaaggcggaaggatccacctggggtgtgcgtgggt

SEQ ID NO: 34231 - DNA, 653 bp, Triticum aestivum
  Clone ID: PAT_TA_34231
cccgcaagaactccctcatccgcggaggtgaaaagatcttggagctgagaagatcttggttccggcgaggggaaccgccgaccctgcggaggggcaagggaaagaaaggcgcgaggccatggccgagaaggaggccggcaacctcgaggccgtcctcaaggaggtcgtcgacctggagaacatacccctggaggaggtgttcgacaacctgagatgcagccgcgccggcctcaccgcggagcaggcgcagcagcgcctccaaatcttcggcgccaacaagctggaggagaaggaggagagcaaggtcctcaagttcctgggcttcatgtggaacccgctctcctgggtcatggaggccgccgccatcatggccatcgcgctcgccaacggagggaataagccgccggactggcaggacttcatcggcatcatcaccctgctggttatcaactccaccatcagtttcatcgaggagaacaatgccggcaacgccgccgccgcgctcatggcccgtctcgcgcccaaagccaagattcttcgcgatggccggtggaccgaggaagacgccgccatccttgtgccaggggacgtcatcagcatcaagctcggagacatcatacctgcagacgcacgcctcctatagggagaccctt

SEQ ID NO: 34232 - DNA, 928 bp, Triticum aestivum
  Clone ID: PAT_TA_34232
gattcggacgaggctctctccgtccccgtcttcctcctccctcaagcgactgcttctctccaccggccgcgccgccccaccgcggacgcgtgggcaccgcggcaccgcttgacggctccctccctccgcccgcccgctcctcggaaccacaggtcgggggcgctcgattcggcgcgctgccacgccggagacgcctgcgtgggtctcggtgagagctcagctcggctcccctcccctaccgtggtgcggcaacggacctagggtttactgttcatcagcaacagggtgaggtggcagctcctgctgcccgggagtcaggggacgagccagcttaattcagcgtcggtgtcggggggatttggactgatctgggcggtagtatgatcaagcagatccttgggcggttccctaagaagccgtccaagtccggggacaaggatccgatcggacggtcaggcgcctccgtgtccaaccctccgagaggcgcggagagggcggcatccggccacacgccaatcatctccagctctgggctcagctacggcagcggccagcagcatccgggtaacggaaacaacccgagggtcaataatggcaattcatcggccttcgaggtgctgccgggctttaaggacgtgcccaacgccgagaagaataacctcttcgtcaagaaactgaacctgtgctgcgtcacgtttgacttcagcgacccgacaaagagcatgaaggagaaggaagtaaagcgacaaactctgttggagctcgtggactatgttgcctcggccaaccagaagtttccggagatagttatgcaggagaccacgaggatggtttctgtgaacctgttcaggacgctgaccacccctcccagagagaacaacatttcagcctatgatttggatgaggatgagcctgtgatggatcctgc

SEQ ID NO: 34233 - DNA, 1191 bp, Triticum aestivum
  Clone ID: PAT_TA_34233
gttgttaagtggttgatccactcgatgcacatacggacatatgtgttcagtttatatggtttaattgcttaattattttggccatttttctattttagttgataagcagttaattaaggtaatgcgatgctcttctggtttttgttatcttatcaatggattcattggtgctaagaacatgtactctctctggatgtatgatgcaaccgtttcctactgttaattagtgatacttacactcttgattatgtcagattatgccagatgtgaccttctacttaactgtaatatttagtcggtataaaatgctgacgtccagaaatatcaaggattttgagatgcatatttaggcttgaaactaatattgccaaaacttttgtacatataacgaccccttttactttttttctgcttctaggtgatgatgtacagaccttctgaactaggttaaacatacgagatatccaggagaaaaggcagctaaatgatggctttatttagttctatttatctacacaaagatcatgtgtgctcaagtacaaaggaaatcctggtatgaactggatatattgttgaatcttctggtgtttttacaatgattaagaaagcatcggtacgcttgaaggtccatgctctagctggcgcagcctacaggccatacgtcattgtttgatcactcaggagaaggatctccaaccaggatgcatcaaggcatatgctaggggaaacaaatcggcgaacaagcttggtgaaccctccgtggaggaggccgccttggctgttggaggtctaaagacaatgttgatgccatggtggacaagatgcaagatctagaagccgtttgcacgatgtgtatcatagctgcatcgaggaggaacagacggggaagttgttgggcggtagcccaccaaattcaagtctgtcacctatgacgccgaggacgtgctgaacgatttggacgctgcagatgtatgtattaaagaagagccaatcaaaggtactcccttggtgcactctccaggtcaaagatctggtctaccaacaagtgattcacgtggagtaacacactgacatggcatgtattggacacagttatgttatctacgaaggcattcttagtttcttgacatgttaacctattgaatttgaagcgcaagcgcaatctaccgtgccaggttaaaaaaaaaaaaa

SEQ ID NO: 34234 - DNA, 1811 bp, Triticum aestivum
  Clone ID: PAT_TA_34234
ttccttccgtgttgcccaggctgccagcggcattcggggactgccggtgcggagggttttcctgaaatttactgagtttcaaatcattgacatcttcactggccttttggcattcattcctactggctggggcttgatttccattgctcaggtgatcaggccattcatcgaatccactgtggtgtggggcagtgttatttctgtggcgcgtttgtatgagatactgcttggagtgattgttatggcaccagttgcattgctgtcctggttgccaggatttcaagaaatgcagacaagggtactgttcaatgaaggtttcagcagaggcctccaaatatcccgcattcttgctggcaagaaaacgaacacaatttgaggcactaaccaggttgccgcggttccagttaggcagtgatccggtcatcatctctgtacagcaccaacgcggaaagccttccgtggcatagcttagctccatattgcaatcttttgctggctactggcgatctctctagattagatgttcagattcgtacaactttggtgatttaggcattgagtctttgcactagctgcctgttagagtagatgacgatatatttgttggcctggctagaagttccatctcctgtgctgaagaggttgtgtaattgaggattgatggaaatttcccgctgtggttgatcagattctaggtgctgcgccgcagtctgtgtcgcgcttcgaggatttcatgacctgcatctggtttccaggaggtatattttcgaagccgcagcacagctgggatagtgtggtggtatgaggagcaagatcatctgcggactactggcctttggggaaagattttggagatactgttagatctcagatacttcttttttcagtatggggttgtacaccagctcaaaatcgcagatggaagcagaagtattgccgtgtatctgctttcctggatatgtgtggcagtgatctttggtgtttttgtcctgatgtcctataccagggacacgtatgctgcaaagcaacatctttactaccgggttgtccagactgctatcatcattctgggagtgctggtgctgatattattcctgaagtttactgagtttcaaatcattgacatcttcactggccttttggcattcattcctactggctggggcttgatttccattgctcaggtgatcaggccattcatcgaatccactgtggtgtggggcagtgttatttctgtggcgcgtttgtatgagatactgcttggagtgattgttatggcaccagttgcattgctgtcctggttgccaggatttcaagaaatgcagacaagggtactgttcaatgaaggtttcagcagaggcctccaaatatcccgcattcttgctggcaagaaaacgaacacagtttgaggtactaaccaggttgtcgcggttgcagttaggcagtgatccggtcatctctgtacagcatcaatgcggaaagcttttcgtgacatagcttagctccatattgcaatcttttgctgcctactggcgatttctctagtttagatgttctcagattcgtataactttggcgatttatgcattgagtcttgcactagctgcgtgttagattagatgatgattgcgcttcagcttacccgtgagttctgatgatatatttgttggccgggctagaagttccatctcctgtgctgaaaagaggttgtgtaattgaggattgatggaaattccccgctgtggttgatcagatctaggtctgcgcctcagttatgcgcgcgctatttcttccgttccaaaaaaaaaaaa

SEQ ID NO: 34235 - DNA, 547 bp, Triticum aestivum
  Clone ID: PAT_TA_34235
ttttacgcgtccgcccacgcgtacgtccacgcgtgcgcccacgcgtgcgaattctttaggcttgcacacctccaaaatctgatgctggggacatggagtcaggtgcgggaaaatctggctcgatgttgcaatcgaagactgatgataccacaggtcacttggcaactaatgtatcctctttcaaggttcagcctgatatatgtggaaaaagtcctgatggtagtcgaagatgtcaggatatgccactgctgagctatgcagaatgggagagtggtgcgtcatatctggattttgtgaggaggcaatacaaagtatcacaggcagtgaaaggagtacagaaagcacgtcatgattcgcagaaatcagattaccttgttctgaaatatggactaagatggaagcgtcgtgcatgtcggaagtcatctaaaagcgatttctcaaaatttgccttgggctcctgggtttcagacttgattttaagttcctgttctcagtcgataagatctgagatatgcactcttataagctggctgtgcccggggtactc

SEQ ID NO: 34236 - DNA, 1391 bp, Triticum aestivum
  Clone ID: PAT_TA_34236
attcaggtgttctactccacctagccaccctacacacgctcggagcaacgcggcagataaccagacgccttctcggcaagatgagccaggggcaacagaggaggccgtcgtccgaccaagcccaggcgggcggcggcgggcagggccagggacagggaggaggcgccgtccgctacggcgacgtgttcccggccgtgaccggcggcctcgcggagaagcccgtggcgccgcaggacgcggccacgatgcagtcggccgagaacctcgttttcggggagacgatcaagggcgggccggcggcagccatgcagtccgcggccatgcggaacgagcgcatgggcctcgtcggccacgaccaggccacggacgccaccgccgagcagggtgtctccgtgtccgagacccgcgtccccggcgggcgtatcgtcaccgagttcgtcgccgggcaggccgtgggccagtacctcgcgccggatgatgccgccgatgcaggcggagccggtggcgacgacacgaagataactatcggcgaggcgctggaggcggcaggttacgcggcgggaggcaggccggtggagcgcagcgacgcggcggccatccaggcggccgaagtgcgagccaccgggcttggacgtcaatatccctggggcgcctggccgcgcaggcgcagtcggccgccggcgccaacgcctgggccgcgcgcgacgatgagaaggccaagctcggcgacgtgctctcgaatgcgacggcaaagctggttgcggacaaggaggtgggaggccgacgacgcggcgagggtggcctcggcggagtacccgaaacaagggatgacaaggacggtgaggccgggagggatagcagcgtccgtggctgcggcggcgcggctcaacaagcagggcgcataggcaggcctctgccgtgcgcgtacgtacgcggcgtgtcctctggtgcgagtggtttgcgggtgcaggccgccggctgctcgagtttagcgtgcccttttgcaagaagtgtcactgtccttcgtaccagcgtctagttctcgtgcttctagctttacccgcgtcttagtttccgtagttctagtgcttttagcttaataaagtgttcttgtgcttctagcttttggttgaagtcaagtcttagaacttgttgtaaaaatgtgtaattccgctgctatctctagttttaaaacttcttgtaaaaaaaataaaaaaaccagggggggttttcacggttcgtattcgcactgctaatcagactcaaacgagcttttacccttttgttccacacgacatagctgttctagctgacctcatcttaggacaccatgccttatcttttaacagatgtgccgtcccatccaaactctccacctgacattgtgttgc

SEQ ID NO: 34237 - DNA, 355 bp, Triticum aestivum
  Clone ID: PAT_TA_34237
gccgtcgacgcgtcgggggcagtgatttgacgtgacagacagggaggagccagttcccggagggaggacctgactcgcttccttcgcggctaaggctgatgcgcaggctgttataataatcccagccatcccccccgcccagctgagcccagctcaatcccagtccgcggatccaaccggagcgccaccgtccgatgaccatgggggcggagcgcgaggccggcgaggaggaggagtcgcggcgcccccttctcccaccctctccgtcgccagcggcggagcaccagcagcagtaccagcacctggggcggagcagctcgtcggcgctgcgcgggggcgggggcgcggagggcgg

SEQ ID NO: 34238 - DNA, 478 bp, Triticum aestivum
  Clone ID: PAT_TA_34238
agcttggatcctctagaacgcacgcccttttttttttcttttggtcgaaaatgctggttaccagactcaggatcatgtattagtttagtaacacggcccattgtgacggtgacattcactacaacatgtatatccaaaaatttcgccacccacactacaacatatcatatcaatccccaattctcccagtaccagggctcaccgaaggacatcacaccaacccagtatgtaaacctgtacttccttccacaaggggctcctcctgtcctgtatgccaaacaatcagttacatccaaagccatgagttaatggtgtgcaatctgtgttattgcacaagctcgggcatgagcctcagcaggaacgagatctcccgctgcgtgaaattcggtgtcgacgcggcatcttttgccacctggcccggacgatcattgatctccacatcggtctccggaacggcgatcgaacgcgtgggcgaacg

SEQ ID NO: 34239 - DNA, 637 bp, Triticum aestivum
  Clone ID: PAT_TA_34239
aataacaccgccattgggacgatgacattcactacatgggtatccagaaaattcgccacccacgctacaacatgtacatatcacccctataaacaatccccaactctcccagtaccagggctcaccggaggacatcacaccaacccagtatgtaaacctgtgctttcctccacaaggggctcctcctgtcctgcatgccaatcaatcggttacatccaaagccatgagttaatggtgtgcaatctgtgctattgcacaagctctggcatcagcctcagcaggaacgagatctcccgctgtgtgaaattcggcgtcgatgcggcatctttcaccaccttgccgctcagatcattgatctctgtatcggtctccgggagggcgatgagatcagagacagccccagtgatctccggcacgaggtcgacgatgaccccgttcacccccatcaggtgctgcatgtacaccgcctccggcacgttattgagagtgccgtaagttagtagggagaggtcagcctccttgatcttgggtatagcggtcgggaacctgaagacggcgcgggcctcggacacaatcccttgcatgccgctggcaaggcacagcttgaccgcctcttccaacgagttcctcccggacg

SEQ ID NO: 34240 - DNA, 605 bp, Triticum aestivum
  Clone ID: PAT_TA_34240
agaggtcagcctccttgatcttcggtatggcagtcgggaacttgaagaccgcgcgggcctcggacacgatcccttgcatgccagtggcgaggcacagcttgaccgcctcctccaacgagttcctcctcacgtcggcgtagacttctgtccctccgttcgtcaagaagtacacagggtatgtgctctgtagttttcgcatgagctgcgcagcatcgagctggaagctagagaaaatgataggcctatccttggcacactcgaagaccaccttgaggatggcctggaggatgtgagtgagctcctcatcttggtacacaagattgtcatcgaatttcagctcgacattgaagcccaatcttggattgaccttctcgaatgcttcttgaagggtgcaaagaggatcatctgactgaacgctccaattcaacacccggccgtccttcattttccgcagcaaaggcttcccattcttgccttgcttgttttgtgggccatactggaggaaatcttccaactgaagatcagtgacacgcttctctgaaattttgccatgctcctcagtaatgatgaagttgtcatggaagatgattgggcagacgtcctgg

SEQ ID NO: 34241 - DNA, 1688 bp, Triticum aestivum
  Clone ID: PAT_TA_34241
gccggccggttcgggatagcagctcccgtccactaccttgctcctcgccgcaatccccacattcattcattcttaccgagaatccccaaatccccaaccccgactgaccactgcgacgagtggatctgttccggcgcctcctgccgccgtcgaccatggcgtcttccaactccggcggcatccccatcaaggccgaacaggattcggatggctcggcccagagcacagctgacatgactgcttttgtgcaaaatcttctagttcagatgcaaaccaggttccaaaccatgtcagagaacatcatcacgaagatagatgaaatgggtgcaagaattgatgaattggagctctggagcatcaatgacctcaagggctgaaatgggccaagcgatggtatgacccctactaaaggtgaaaggacgaagaatcaaagccagcagacagctctgcctgagttgaagcagaagtagcagaagcaaggcgtattagtcttggttaccatgtcaatatcatcagccattcatcactaacttaatgcatgttatgagatgttattcgcacttgttaatatgcatatgagatatacagtacctctgtacttgtcaagggagagttctctcctagcaccctctgtatgaatagatgtagccatcgaaactccaacaacgtacatgttcacgtcgacgccccacttctcccacgttggaggccaccatggaaggccatctcaaccacccggtctgcaaaccggtgctttcctccacccgtggcttcgccagtagtcaacccatcacgctgttacctcataaggcatgagctgctcacctccaatctgtcctattgcacaagctctggcctaaccctcaacacgagcgagctctcccggtgtgtggaagtcggcgtcgaggcgccatccttcaccaccttgctgctcacatcattcagctctgtatcggtctccggcttggcgctgccatctgagacctcctcggtgatttcctgcaggatgacgtgactgaccgcgtcaactcgaaacacgtccttcctttatttcccgcagcaaggcttccattcttcccttgcttgttttgtgggccatactggaggaaatcttccaactgaagatcagtgacacgcttctctgaaattttgccatgttcttcagtaatgatgaagttgtcatggaagatgattgggcagacgtccttggtgacctggacgtcgaactcgacgtagtcgacggcgaagcgcgccgcctcgttgaacgaccggaccgagttctccttcacctcctgcagccgccggtccggcgacgccagcgcgttcatccccttgccgcggtgcccgatcaccgcgaaccgccggcccgcgccgcgctgctgcctcttcatcgtcgccgccgactccgcgtcgaggacccgcgcggcggcggcgaggtggtccggcacgacgacgtcgagggtggggacgtcggcgacgcgcgcggccttgagcagagccattgatcggtcgaccgatgtgttgtatacgtgcacacgtgcggcgtgccgaattggtggggatttcggacagcgagcgccggggtggattcggcgaggagaggagaggagaggggctcgtacgcattgatgctaaaaaaaaaaaagaataaaaaaaaaaaaaaatgcccctcgttgcattgatgcttg

SEQ ID NO: 34242 - DNA, 638 bp, Triticum aestivum
  unsure (1)..(638): unsure at all n locations
  Clone ID: PAT_TA_34242
cgggnggaagaaaaacagtacacgagcacgatggccacggcacgagcactccgtctcttcgcctcaggctcgccagcgacccggcgcggcctgcccggcgcgcacggccgcgcgctgtccgcattgtcatcgcaagccagcggcgcgggcgatcccgcggtccactccggcgaccatccgagcgacgactacgccgaggggcccccaaagttctccggcgcggaggaggccatcgagggcaaaggccaagacaagcatccgccgtcgtccgcgacgacgcggccgacggaggggtatgccaaggagcatcgcgtcccgccgttcaccccctcggggaagctcgggtcgcaggagctggcggacccggcggccgggtccacgttcacgcagaagcgccgctggtcctccaattccaagccagccggcagcgacccgctcggcgacgcgacgcccggggacgaggaggccgcggcgcggaaggtgcgggaggaggaccgggagtactaccgcacgcacaagccgtcggcgctggccgaggtggagttcgcggacacgaggaagccggngacgcgcgccacggacggcggcgccgaggaccggctcgagcaggacgggccggggaccatggtagaagacac

SEQ ID NO: 34243 - DNA, 962 bp, Triticum aestivum
  Clone ID: PAT_TA_34243
agaaaacagtacacgagcacgatggccacagcacgagcgctccgtctcttcgcctcgagctcgccagcgacccggcgcagcctgctaggcgcgcacggccgcgcgctgtccgcgtcgtctcaagccagcggcgcgggcgatcccgccgtgcactctggcgacccgccgagcgacgactacgccgaggggcccccgaagttctccggcgcggaggaagccacctcgggcggccacgacaagcacccgtcatcggcgaaggcgacgcgtccgacggaggcgtccgcgaaggagcgggtcccgccgttcaccccctcggggaagctcgggtcgcaggagctggcggacccggcggcagggtccacgttcacgcagaggcgccggtggtcctccaagcccgccggcagcgacccgctcggcgacgcgacgcccggggacgaggaggcggcggcgaggaaggtgcgggaggaggaccgggagtactaccggatgcacaagccgtcgccgctggccgaggtggagttcgcggatacgaggaagccggtgacgcgcgccacggacggcggcgccgaggaccggctcgagcaggacgtgccggggaccatggtggaggacaccgcggacgcgtcgctggcccgggccgaggccatgttccgcgaggcggcctcgcgcggcaaccccgcgtggccgcactcccgcgcgctcgccgccatgctggcccggcaaggcggagagggggccgatggcgccggcggcgccgcgccctggggaagctaagctggttcgtgtctggctcgcgtgaccgtggcgcgcgcgcgcggcactgacgctcctgtaaggataggagtggagtgtagaatataggtcgctacaatcgtgtaaaatagaagcagtaccactgaataaagtttgccagagaatgtaaatatgctggcttgatgaaaaaaaagtcgacgcggccgcga

SEQ ID NO: 34244 - DNA, 1377 bp, Triticum aestivum
  Clone ID: PAT_TA_34244
cccccccccgccccgtccccgcccccccccccgccccagcccagatccacctctgccgtccccatccgcgccgtcgtcctccgcctccagcgcccccctccgcccccgtctctccccggccggccccccccgccgccaccgtccccctccgcgacctgcacctcaactcggccctccagccaaggtggtgcaatggcctcaggcatcatgttccgacgtctttccaagacactcaccatgagcccagcaacagcactggcatctggtatgaccagccagcaccaccagcttcagcagcgtgcaccggtgagtggcacgtccaagggcaaggcgaagctcaaagctgggatgcctctgaggcgtagcgtcatagccaagaaggggggcgcgcctgccactgctgggagcggcggcgctggccgtggtcgccgtgaagccatggagcgtattactcagattgcagagtcttgtctgaagtcctccactcctctacggcacctgtcccccaaggagcgtctccgcgaggcaaagcgtgaggagcttgggctcatctccaaggaacggcaacgtgagcttgacgctgccaaggctaaagctaaagctaaatccaagggtgccagtggaggtgatggtgaccgtgttctgatgggtccgccgggccttgactatatcagtcttggtctggtggatgaggagactatccctgagtatgagctgacagttgaagatggccggcgtcttgccaaagaatacagccgtgtgctaatgcgacgacaccgtgcacgtcaaactgcggagtcaacgctcttgagcctcaagaaggaggccgttgctgcactccccgagaagctgcgggctgctgctatggttcctgacatgaccccgttccctgcaaaccggtacatggcaacactcacgccaccaattgaagggtatattgaaaaggtgcgagatgctgccaagaagtattcagtgaaggagaaacttcgctgagttcgattcaacatgggaggaaagactcttctccctacaagatgctgagagtttagacgctttcttatgctcctttaattaattcttggcctctgtctaggtttgatgactactttgtgctattttggcctccgataatcagattctggtaataagctgtcacaagttttatttgcaagatcctgccatgctgtgctgcccgaactgttcatgtcagttttagtccctccgtttctttttaccccgcatataagatttgtctgaagtcaaactttgtaaagtttgatggctacttggggtttggtgggttggtcagggccgtaataagcgtaaaaaaaaaaaaaaaaaaaaaaaaaaaaaaactcgagactagttctctctctc

SEQ ID NO: 34245 - DNA, 1457 bp, Triticum aestivum
  unsure (1)..(1457): unsure at all n locations
  Clone ID: PAT_TA_34245
gtttccccccttcctagcgcggccggccggaggccgaggccgaaaactccccgtccgatcgggccaaaagcagagacgagtcttgctcgctcccaaacggccgttttccccttccgcgcatcgccacaaatatccctcctcctcccgctgctgcccctcctcctcggcgtggtcgctcgcgggcggagatccgggaggggagatggccaagaacgcaggaggggtgctgctgccggtgtccgccgagccggggaagggcgacggcgaggccgcgctcttcaagggctccgccatgacccgccgcggcgccgtcgccgcgctctcctacatgtcctgctccgttttgctggtgatgtttaacaaggcggctctatcttcatataaattcccttgcgcgaatgtcattacactccttcagatggtgtgctcaacgtgccttctctatgttctgagacggttaaagatcatttctttcacaaatagtgaaccgtcagtaccctctgattcactattctttgtgccgttcagaatactgctgcgcacttcaccgctttcgctgtcttatttgctctatatgctagcttcaatggaatctgtgcgtggagtaaatgttcctatgtatacaactctaaggcgcacaacagtagcatttacaatgacaatggagtatttcttggcaaagcagaaacacaccccacctataattggcagtgtggctttgattgtattcggagcatttattgctggggctcgagatttatcatttgatgctcgtgggtatgccattgtcttcgtcgccaatataactacagctgtttatcttgcaactataaatcgtattggcaaatctagtgggctgaatagctttggcctgatgtggtgcaatggacttgtttgtggacctgcagtactgttcttgacatatattcagggcgacctcaagaaaactattgaatttccttacctttattcccctggttttcaggtgggtgctgctattttcatgtatactagcatttctattgaactacaccatcttctggaatacaatcctgaattctgcacttacacagtcaatgtgtggcaatttgaaggatttcttcactgttggacttggctgggtactcttcggtgggcttccttttgatctgcttaatgtcatcggccaaggccttggcttcgttggctcaggcatgtatgcctactgcaagatcaaaggaaaatagatattgatctttaaggaaccaatggaaagtagatattgatatgggcagtatggcttaaccaaagtagcgttcatcatgctgtttgctcctgcatatgggagagaaaattttgtaggttttcctgggtgtacatttataaactccaattctcctgggtagaacatgaatgaattgccattgtttggccaaggaaatatagaatacaacaagatttcagcaanntcccaagct

SEQ ID NO: 34246 - DNA, 765 bp, Triticum aestivum
  Clone ID: PAT_TA_34246
cgaggtggtcggagcggcattgcgtgggcatattgggtattatttgagctgatactccattttcttacaagagatgtggtcccgtcgatgttggctgtcgaatttgtgctgcagtccatgcccaccacgtccgagtcttcaccccttcgtcatccaacacgaacagcagaacagagtagcagtcgtgatttgccaggttggagaactgacgcagcttgctgccacggagtgctcgcccttcttctgtgccataaagcccctcggccgaaacttgcaaatcaaaattgccgaccctgtcaatctcgctggaacgacgtctagctcgttgtgctccactcactctaacggcatatctcataactaaagccatgaacaagtgcttcagttatgctggtggcaatacattgcttgaggtgacctcatgtgcaagattatccccatggagggagctggcatggagacatttgctcacatcagtactatgagcagcctggttgggtggtgacgtttccgagtgtccaagcaagagctttttttggtctagacctatgcagtggtgacttctgctacaatgtgcatcaacaccagaaccatgttcccgatcatggacgctctatccttcctcatcggctctcgccttgccatcaccgagagggttgtgcaggccactactcgcgcaactactttgcagtgtggagcatgccatcgagatagaccgaaagaagaacatcgccgacaacaacaccaacgggggcctccttggtt

SEQ ID NO: 34247 - DNA, 459 bp, Triticum aestivum
  Clone ID: PAT_TA_34247
gtcctcccacgaccacgaacatgcatgcgtacatacatctgcggactgcggggcagccacttgtcttgcatctctcccggatgcatgtctgttgtgtgtgtcagtggaacgcgacggcgaagctgccttcgggcaaggcggtgacgggggaggacgcggctgccgcggtggaggcggaggcggcggatgcccccggcaaggcgaccaagccatacggtgtgggagcggcgcttacagaggccgcaaggcgcaatcaggaggggacttgccggaaatagccggacaggcgtgtatattttcgggaccaatcggaataaagaggaagtatacataacatgtggcgaaactatttcacaaagtgtggtagcatagcgcctgtcggctgggccctgcacaaccaaggatggggcccggcttggctcctgggtgccacgctcatcaggattgaggagtgcggct

SEQ ID NO: 34248 - DNA, 774 bp, Triticum aestivum
  unsure (1)..(774): unsure at all n locations
  Clone ID: PAT_TA_34248
gtcggcgtgagctggtatggccccgtcgtggtgaagtagatggggaggcggggtggaggctgggactgcatggggaaaaagcataaagagcaagacggtagtgctgtactgtggcatggtcatgtgtgtagcctcagcacagcgttgtactgtggcatggctgtgtgtgtgacgtcggtgcagcggcaaagagtagtctttggagtagggcagcggcacacacacacatgagggtggccctcgaggcttgggggttaagcaggtgcgcgatggatcccgtggaagtggagagagaagcatcatgttcatgaacttgaaaaatgatttcgagtttgaacaaagaaagtttaccaaagaagacatcaaagaaattatatttagggagatactggaatacctccctcaacttctcaaggattacatgcacggatctgaaaatacttactatgtcctatgtttctaccttgacatatcttgtaacttttttgcctcctattttgcatatgtagcaatagtcataacttatgtcggctaatcaatatttgccactactgacaatttgcataggcaatctgctaagaggaagatggtggaaagagcgggcgagtcgagtggaaacattttcttctcccaacataatttacactatcataattcccccaactgtgacatgttatatacacacctagaccaccccacaccgncactatagtacacggacgccgctcacctgcaaagggcaaaaggctcctncttttaccataaacatgtcct

SEQ ID NO: 34249 - DNA, 1341 bp, Triticum aestivum
  unsure (1)..(1341): unsure at all n locations
  Clone ID: PAT_TA_34249
gcaggccgcttctcaccgcccgccggcttccaagcgcaaccagaaaagcaagccatgtcgccgtggcgcgccgtcgcatcccgcctctccgccccccacctcctctccagggccttctccaagcctccgccgcctcttccccagcctctgtccaggaccttctccaaggccgctgcctccgccgccgccacgtcgcacagccctagcgcggcctcctctgccggtccgaggcccgaggtccgactgaattctatgttcctgtccaagccctcttcactggcattgcctcctgattctcctcttagagcagaagatccacactatgagggaattaagcgcttgatgctcacgttgctgctgttctacagtaagcaaagcaagtccatcagaggagcaaacgctgtttatcaccgcatcacttctcatgttgacaagcctgatatctatgaagtgtttcagttggagaaaacatttaaaacaacattttcattgcttgttctccatatgtggctcgttctacgtcgcttgaaggaagaaggaaaggacggtgttaaatttgggcagtacatctatgaaacttacaatcatgatgtggagctcagagtttctaaggctggggtcaacttgctattgacaaaatggatgaaagagctagaaaaaatattctatgggaacattgtgaaatatgatactgcaataagcccagaagcaagccaggatgatcttgtaaatgtcatctggaggaatgtgtacgctgacgaaggttcagagcctatggacgcagctgctacccctgctgtccaggcactggcaagatatactcggagggaggcaacttgcctatcattgacagataaagaagctgtgttctctggcaacttcaagtttacggccgttttgccaaccgtcctcccagcccagtgaagcgacggcgatgagcgttggcattggtagatcagtattccatatgaaggctgactggtatacatggacaaggaagactggaagtcctatcatcattacaaataataggaaatttccagtatttatttatgcacgaatctcagcatttcgggccattttggtggctaaacctgcctctagctagaaatctcctttatgtttatcctctatgagcattgcattgatggctgcccttcggaatggagcacacggtggaaacgttttcctggttgaatgcgtgtactagtattttaccattttcattgctgatttggacttgagatcattcacattgtcggtactgatgtactctctgcatcacaggcacggttttggtnctcgtgggnatcggggaaaccgaattataaacaaagcata

SEQ ID NO: 34250 - DNA, 1846 bp, Triticum aestivum
  Clone ID: PAT_TA_34250
ttcggtgttcccgcccgctgtacccgcaactccccacactggtctattccacacacctattcctgccgcgtgcggaggaacacgtggctctacatctccagcttttccgtcctctgctcttgttgaatttaagactgttcctctgcctttcatcctgctttcgtgcagccctcaggctccaccagcttctacaggtgcattctctggttggtccaatacgttgtatctggctccaggggggcagccaacctccagccagttctatacggttatgcagccgactctcgtttcaaatcccttcgggacacttctagcaatgcctcagatgtccattgggaggggtggttccccacccttcttcccgtttgccataacaagtatgccggctaccgacaagtctccaccaagcagaatcagtatcaatcctgcttcctacgcaatgtggctcaaagagtggataatcctgcgtttcacacccgaataatctgtcacctgccggacagggacctactagccagtccaatatggtaatgcagccgactcttgtttcagatccctttgggacccttccagcaatccctcggatgtccattgggagtcgtggatcctcaccttcttccctggatggtatatcaagtttgccggttgctgagaagcccctgctgagcagaacattttctatggtggttcctaggaatttgccatagttgggtattaagctgctgccacgaatatataatgcaacatctgatggcaaggttccattctttgctgatgatgaagaatcccctgtaacaccaaaagcggatgcctttttcatccctatagagaacccaagaagtctgataatccgtcctgctgaccactggccttcacgtagtttggttggccaacaatcaattccaagggattcaactgataatgacaaacataaagatgcttttgttgggagggagcacaataaggctgccatgacaccaactcggtctggtacagtggggaatggtatccacattgcatcaagcgagcctggggctgtggctcggcatgtgaatggtgctactgttgagaagatggtgcctaggctctcccaggcagattacttcatggagcccagtctagaggagcttgctgccaaagaacgtgctgagccaggctactgtagtcaggttgtagacttcattgttgggcgtgaaggttatggcagcatcaaattcttgggagaaactgatgtgaggggccttgatctggagtcgattgtggaattcaataaccgtgaagtgattgtgtacaaggacgatagcaagaagcccccagttggcgagggcctgaacaaagctgctttggtgaccctcctgaacatcaagtgcatgaataagaagacgggtgagcagtacacgcaagggccaaggttggacaagttcaaggagatgttggtgaagaaggctgaggagcagggagtggagtttatctcgtttgacggtgccaagggcgagtggaagttcagggtgaagcacttcagctcctacggttttggtgaagccgaagccgacgacctggccgattccttgtagctttgtcgatttgttttcttttggatgaacggtggacactcgattccatgtagctttggtcgatgtagctggtctgggagaatattggttgtgatgcttttcttctctgaatgctgctatgagttccttcccatgttcttctgtacatattcttttttcttgcagaatgcacaaaaattacattctggcaccaatctagcacgtgcgtggattggataatgaactgacatctgtacaaatctggtcgatgaataatcttgttactgtcctgg

SEQ ID NO: 34251 - DNA, 777 bp, Triticum aestivum
  unsure (1)..(777): unsure at all n locations
  Clone ID: PAT_TA_34251
cccctatcctccccgtccatccctagcccggcgccggcggcggcgatcgccgttccaatctccacggcccctccttctccaccgtggcccgttacttcgtcagcaacctctcgccggtctgattcgagccgctccgcgccaccccggccccgaccccccttcttccaagccggcgcggccaccgtcgacggcgaggatcaataccagccgcaggaggagcaggagtgcggcggaaaggaggaggatgatcaggggaggtcgagccgccatccgccgctggccgtcgacacctcctgtttgaccacacagagagagcaccagaccgtcgtccttgcgttcgttctcctccaggaagaagacgacccaaggtgagccaccttcgatcgatctcgcagggaggtgggggaccttaacctgaggctccatggcggcgggggacgagttcatatcgccctctggcggaggacaggctccaggtttccccctcgacgagagtagcggcacggcttttgcgtcacagggatcaagcctccatcggtccttcagggccagcatcatcgtgccctctgagactacgccgccggcgtcgtgttcgccttcgagcctttggcgtccggtacatgtcgaacagacgatactttacttactttccttacagagttgcattcgagtgagctcgagttccctacctagctcaaacccattaaggagggatgtgtgcttctgtcgcctttcccaanctccncgggggcananggggattngctagctccccnt

SEQ ID NO: 34252 - DNA, 734 bp, Triticum aestivum
  Clone ID: PAT_TA_34252
ttcagtgcgtctttcaggggtggctagaggctgtggatggcagaagattggtgcttggatccaacctggcgcctactaaaaagcgggcatcccctcggcctacctcatagccatcgttttccaagtcggcgggacgggactttggctgggcatcatctgtggcctgatggtgcaagtcctgctgctcatggccatcacgatatgcacagactgggatagagaggcggataaggcaaaggacagggtattcagttcttctctcccaacagatttcgcaactgaagacaatgcaatctagagttctagactactaagcgaacaagctaggaaacgaagatgacgcaattccatccaggctaccggactacacaaactaggcttcatgtgctattccatgcagccttcatatcgaggatcactatatcagaagtagtgttcttcacctgaagtgtgtgaacgtttgttcatgtctacagcttggtataggtcaagaaaaacgtctctatatcagaaacatgggggagcggtctcatgatgaacctgtctccagctactactactattgcatcgacaaccagaaccaaactcaccacaaaatttaacatattaaatcggactgagcagtagaactaataattgaaaaacattcaggataagttaccatcaagtcagatccaccattgtgcgctacagtttaatggattgcagttcgaagagacacggaataatttccc

SEQ ID NO: 34253 - DNA, 594 bp, Triticum aestivum
  Clone ID: PAT_TA_34253
gctgatcatggggttggtgctgatctgcatcagatacgtctgggggcatgcctacagcgacgtggaggaggttgtgacttacgttgcctggatgatgctcatcatctcggtgtccaacttcttcgacggaatccagtgcgtgctttcaggggtggctagaggctgtggatggcagaagattggtgcttggatcaatcttggtgcctactatatcgtcggcatcccctcggcctacctcatagcctttgtcttgcaagtcggcgggacggggctctggttgggcatcatctgtggcctgatggtgcaagtcctgttgctcatgaccatcacgatatgcacagactgggatagagaggcggataaggcaaaggacagggtattcagttcttctctcccaacagatttcgcaactgaagaccatacctagactatcaaccgaagaaactaggaaacagagatgacccaatttcatcgagccttcgtgccaaggctcacactgttttagtttaccaaaactgtacagccttatccctaaatcagatacttgggagaagtttcattatgataatatatccagccactaccgttgcaacc

SEQ ID NO: 34254 - DNA, 1050 bp, Triticum aestivum
  unsure (1)..(1050): unsure at all n locations
  Clone ID: PAT_TA_34254
gattcggcagcctggccagaaaagggagagaaccggacgatggagctggaggcggcgacgcggcgcttccagctctggctccgcgggctgcggtcgctccgccgcgacctccggacggcgcgctgggccgacgacccggcgcagctcgccaagctggtagccggctacgtgtcccacttcgccgactactgcgcggcgcgggcggagctggacccggtgtggacgctggcggcgccgtgggcgagccccgtggagcgcggcgcggcgcactggctggccgggtggcggccgaccacgctggtccacctgctctacaccgagtccggcagccgcttcgaggcgcagctcccggacctcctgctcggcgtgcggtcgggcaacctcggcgacctcagcccggcccagctggcgcagatcgacgagctgcagcgccgcaccgtggcgcaggaggacgagctgtcgcgggagatggcgcgggtgcaggagggccacggcgcggtgggcgccggcggggagctggtggacgtgggcgggctcgtcggccgcgtcggcgcggtgctggccggggcagacgcgctgcggctgcgcaccatgaagcgcgccgtggagatcctcgagccggcgcaggcggccgagctgctcgtcgcggcggcggacatggagatcaggttccgcgagttcgggctcaagtacgacggcgtcggcgccggcggctcgtaacgtccagccagctaggtcggtcatcatcggcgctcggcaggtccagcccggtttttttccaggtgtagttggtttgactgggacagggaggctttccactcttgtaatcttgttgccgcgacgattgtccgccagatcggtagatcgacggctgtcgcgcggtgagtgtttcgtcgtagctgggccgtgtcagggcgtgctgttgaccgagcgacaagtaataaaatgcagagacacacgctgcatgcttttttggactaagaaagtgcatgttggttttgttgacaagtcggcctttgttctcctggtgccgnnnnnnnnnnnnnnnnn

SEQ ID NO: 34255 - DNA, 1589 bp, Triticum aestivum
  Clone ID: PAT_TA_34255
ccccgcggccgcttgcgtgccgagcccgtgcttggcgcattcctcctcttgttccgtccccagcaaaaactcctccgacatgccgccggcgacggcgctgatggacgatgtggtcgtggagatcctgctccgcctcccgcccgacgagcccgggtgcctcgtccgcgcctgcctcgtctccaagccctggcgccgcctcctcacgggtaacgctttcctccgcagctaccgcaagttccacggggcaccgcccatgctgggattcctccaccgcctctacgacgaggatccctgcgtcgcccgattcgtccccaccgcgaagtccttccgcccgccacgcaccgaccgccgctgctggtacgcactcgatgcccgccatggccgagccctcttctacgattcagaatcagaacagaagcctgctgagttcgtcgtctgggaccccgtcaccgacgggcaccggaggattccccttcccgagacccccaagtcctggaacgcggcggtgctctgcgccgtagatggctgcgaccacctcgactgccatggcgacgaccccttccttgtggcattcgtgggcaccgacaaggaggaggggatctggatcacgtccgcgtgcttctactcgtcggaagcgagttcatggagcagcacgagctttgttgagcatccggatgcttccatcgagatgcagccaagcgccctctctggaaacgcagtctacttcctctgcgatccgagcactcgaattctgcagtgcgactttgttggcgagaggaagctatcggtgattgaccggccggacgtgcatgagaataacatcgtcctcataacagcggaggacggcacactgggatttgcaggcgtgcaggaatccagcatttacctctggtccatggaagtcgatcccgatggagctgcagcgtgggtacaacatcgagtcgtcgacctcgggaagctgctcccctctcgcgccctcatgatcatgcccgatgtgagtggattcgcccaaggcgccggtgtcattttcgtgaggactattgttggcctgttcaccatcgagctcaagtccggccgagtaagaaaggtgtccagcaggggaagggtctgcactgccattccctacactagcttctacactccagatcgtgctatccgtcaattgaacggccagtgatgatgcattgatacatctgtcgacatgaacctgctggtgctggcttcttgcttagctcgtgcttcaataagtggtttatcttcagttgtgtagtttaagtaagagaagagcaagtccgctttatcaatctatatgtattgtttccggttggcgttttaactagaaaagtggaagtcactgtaatcaaccaactagatttgtttctagttgggaggttgaagttagaaaagagaaacgcatggtcaattagtatgtcttctcattcagctgtttgtaatcgtgggtgagttcaacatgtcaggtttacgtttatggctgctggagtaaatgccatttcaacgtgtcctgtgctgtagaggtaccgttttctctgaatatattgatgccaaaatcaaaaaaaaaaaaaaaaaaa

SEQ ID NO: 34256 - DNA, 1150 bp, Triticum aestivum
  Clone ID: PAT_TA_34256
ttcggcgtccgcccgacccggcccgccaaaccttccccgaaatcccaatccagaccatcagagcttcccccaaattccccacgccgcgccgcgccgccgatcgagcgcagaatctcgagcgccgcccgcgatgccgaagaagatgggcgtcaactccaaggcggaggccgcccgcgagcgccgctccgccgaggagtcggaccgccgccagcgcgccgagcgcgccaaggaggaggagtactggcgcgaggccgaggggtccaagtcccgcgccgcgcgccgccgcgaggaggaggccgagaagcgcgccgaggccgccgcccgcaaggccgagaaccgccgcctcgccgaggccgaggccgccgccgtcgcctccgccgtctccaagacggacgcccgcaaggccaaccgcgtcggcgccccggcccccaaggtcaccgaggccgagctcgtgcgccgccgcgaggaggagcgcctgcgcctcgagcgcgaggccgaggccgccaagaagcgcgccgcgcgcaccgccgaggaggaggagtacgagcgcgtcgtcctcgtcgccaacaccaacagggatgactccgtcatcgaggcctccggtgtcgacgagaccatcgtgcggctgtcgcttgttgacacagacgcggccttgcccgctgacaggcatcctgagcgcagcctcgccgtgtcattctcgttcaaggcatttgaagagctccagagccctaggctgagaaaagccaggcctaacactgaaacagtacaaagacatgatatggaagctatggaagaaatccccagacaagccaacgcacaaggcaactgagtgaggagggggtcccagtttattaccgaatgatatggattggaaggcatccaatggaacagaactgcagctgcctcagcatgtttgttcgtggagtggaatgatgtgtgacatggcttgaatcaaataatctagctactcatctaataatcaacaaatcgatgcaatgtatattttgagggtttgcttttgattagatagattttatccaagttcatgttgtacttagttatgtttggggcatgttagtacttgaattttgaacagttgggctaatacaggatgattatgccattttcttcaaaaaaaaaaaaaaaaaaa

SEQ ID NO: 34257 - DNA, 750 bp, Triticum aestivum
  unsure (1)..(750): unsure at all n locations
  Clone ID: PAT_TA_34257
caaaaattcgtttccacaccaacggcggggcttcaactcgaagttcatggcggcggcgttcctcgccggttccgagcgagatgacgagctccggcggagactggatacggtggcgctgcaccagtgagagagacagtggtgaggggagagatagaaagaaggaggagtggcagggagaaggagagggcgcgacgagcggcggggaagtggattggatgcttgaggaaggaggggtcgaccttgcctttctgcagctcgggaagcaccacccatggagcttcatccttctggtcttcaggtgtttgaggcatcgacaagcaacgacagggttcggcgtcagttaagatagctggttcattttgttaattgctctataatagatgttatttcttaaggttggagttgactgctgacacccaataagattgccctgaagcagccctctctctggcacatctgctaccatgcacccattgacatctgagatttctattcaccaaaaagatggagccgcctttggcaagcactgacgagcagctcagtctcagccgatgcatcgacggactgaggcgggcttccaatagaggtcataaacagggaatggccttttgagctgatggagggatcactggacctggtgttcatgtttgtgttggcttacatgcntaaataaggagtatagtaagacttttccaatagttctcttggaggtcatgtctatgccattcaaggattttcatatctgaatgt

SEQ ID NO: 34258 - DNA, 1166 bp, Triticum aestivum
  Clone ID: PAT_TA_34258
ctgcttctggccatctagcagtggatctctcatcttgatgcaagcggagatgcagttcctgtctcctctagtgccggcgcgggaggtggtcttcttccggtactgcgtgcacaacgccgacgaaggcacctggtccatcgtcgacttcccagccgacggcttccaggaggagcttctgcagcagcagcagcagaccagctcgctggtccggtgccgccgccggccctccggctgcatcatccaggacgcccccaatggctattccagggtggtgtgggtggagcacatggaggtggtgggggaggagaagcccctgcagccggttttcaaggaccacgtcgccggcggcgccgcgttcggggccaccaggtgggtctccgtcctccagcgccagtgcgagcgccttgccagcgagctcgcccgcagcatcgccgaccaaggagttatccgcacccctgaggcgaggacaaatatgatgaagctgtctcagaggatgatcaccgccttctgtgctaacataagtgcatctgggagccagtcttggacggcactatctgattctacagacgacactgtcaggattacaacaaggaagaatactgagccggggcagcccagcggtgtcatcctcactgcggtctccacaagctggcttcctttcagccatcaacaggtgtttgaacttcttgcagacgagcaacagcgctgtcagcttgagattttgtcaaacgggggctcacttcatgaggtggcacatattgcaaatggatcacacccaaggaattgcatttctcttcttcgcataaattctgcaagcaactcatcacagaatgtggagctcctgctgcaggagagcagcatccaccctgatggtggaagcctggtggtgtttgcaaccgtggatgtggatgccatccaggtcacaatgagcggggaagatccttcctacatccctctactccccatgggcttcgccatcttcccagccaccagcccttcacctggagccactagctcagacaccaccagcaacggcgaaactagtcctggcaatgcagatgagcccgccaccggctgcctcctcaacgtcggcatgcaagtgctggccaacgccgtgccttcagccaagctcaacctctcaagcgtcaccgcaatcaacagccaca

SEQ ID NO: 34259 - DNA, 1295 bp, Triticum aestivum
  unsure (1)..(1295): unsure at all n locations
  Clone ID: PAT_TA_34259
gcacgaggaggagtcggcgctgctcatcttcgcacgcctcgccgattacatcgccgaatctcttctcgaccatttgatgaccatccacaaccttctagcatctgccctggcgcacccgacctcgcctgatgttcgcatcgccgcgctgagcgccgccgttaatctcgttcagtgcctgccaactaacgctgacagagataagatgcaggactggctgcctgcgatgatgagggcgctcaccgattgcctgaattcgtcccaggaggcatctgcacaggaggcactggagctgcttgtggagctggctggtgcagagccaaggttcctccggcgacagattgccgatgtggcaggagcgatgctgcaaatagctgaagctgcacagttggaggatggaactaggcacctggctgtcgagtttgtgattactcttgctgaggccagggagcgtgcaccaggaatgatgcgcaggctcccgcagtttgttggcaggctcttccaagtacttatgcagatgttgcttgatgtagaggatgaccctgcctggcacactgccgaaaccgaggacgaagatgcaggtgaagggaacaactatggagtggcgcaggagtgccttgaccgtcttgccattgccattggtgggaatgcagttgtgccgattgcatctgagctgctcccacaatatctttctgctccagagtggcagaagcaccatgctgcgcttatcacgcttgcacagattgcagagggatgtgcaaaggttatgcttaaaaacttggagcaggtggtttcgatgatactgaatggattccaacaccctcatcctcgagtgcggtgggctgcaatcaatgccattggtcagctgtctacagatttgggcccagacttgcaggttcagtaccaccagaaggtgctgcctgcattgcccaatgccatggacgattttcagaatccacgtgtgcaggcacatgctgcgtccgcaatcttgaatttcagtgagaattgcacgcccgaaattctgacaccatacctggatggaatcgttagcaaattacttgttcttctccagaacggtaagcaaatggtgcaagagggagcattgacagctttagcatcagtagctgattcatcacaggaccacttcaagaaatactatgatgctgntatgccgtacctgaaagctattttgatgaatgcaactngacagtctaataggatgctccgtgccaagtccatgggagtgtataagtcttggtggaaatggctgtaggcaaaggtaaatttaagggatgatg

SEQ ID NO: 34260 - DNA, 476 bp, Triticum aestivum
  Clone ID: PAT_TA_34260
tgctctggttgggatagggatgccttagtacgagagcttgagtttgtttgtaagatatttcgtctaagcgaagacccaaaaggaagaaatttgttcaggaaatgtgcgaatctgattgaaagattgaggaatagttctcctgattctgtcaatcctaggatgatactgcatgcacttcgagagcttgagatggattcccctaagagctctgaaaatgaagaatcgggacgcttgatcactccccaggaggcatgtaatcgtattgcagaggtagtccaagaagctgtcagaaagatggagcttgttgctgaagagaagatgggcctgtacaaaaaggctcgcaccgctgtggaggcctgtgaccgtgagcttgatgagaaggccagacaagttcaggagttcaaggccgagaggctgcggaagaagcacaaggtggaggagctcgagagcattgttcggctgaaacaggccgaggc

SEQ ID NO: 34261 - DNA, 1035 bp, Triticum aestivum
  Clone ID: PAT_TA_34261
ccacggccacgcgcacccgcaccgccgtttggatgagggacatgcgtcctccccttcctcctgcatggctgccacctcgcagtgctcctcatcgcctatattttgacgacgcctccggtgcaggacccactaccgagcaaggtttccatacgtaccatggctgcccggctcgtcgtcctcctccttctagcgctcgtcaacgtggcgccgccacggcgtcacgccggcgtgtccgccgaagacgtcatccggcaggtgacggacggcggccacggcgccggacgtcccggtctgctcccggaggcgcagttcgcggcgttcgtgcggcggcacggcaaggagtactcgggccccgaagagtacgcgcgccggctgcgcgtgttcgcggccaacgtggcccgcgccgccgcccaccaggcgctcgacccgggcgcgcgccacggcgtcacgcccttctccgacctcacccgggaggagttcgaggcgcgcctcaccggcctcgtcggcgccggcgacgtcctgcgcagcgtgcgggcgatgccagccgcggcgccggccacggagaaggaggtcgccgcgctgcccgccagcttcgactggcgcgacaagggcgccgtcaccgatgtcaagatgcagggcgtgtgcggctcgtgctgggcgttcagcacgaccggcgccgtggagggcgccaacttcgtcgccacggggaagctcctcaacctcagcgagcagcagctggtcgactgcgaccacacgtgcgacgcggtggcgaagaccgagtgcaacagcggctgctccggcgggctgatgacgaacgcgtacaagtacctgatgggctccggcgggctgatggagcaggcggcgtacccctacacgggggcgcaggggccgtgccggttcgacaggagcaaggtggccgtccgcgtggccaacttcaccgccgtgccgctcgacgaggaccagatgcgggcggcgatcgtccgcggcgggcccctggcggtgggcctgaacgcggggttcatgcagacgtacgtg

SEQ ID NO: 34262 - DNA, 1271 bp, Triticum aestivum
  unsure (1)..(1271): unsure at all n locations
  Clone ID: PAT_TA_34262
ggagctcgccagggcgctccacgcgctgcgccctaccacgtaccgcgacgccaaccacaagcctgaaatggccgttgccgtcaccgagttccgcgccctctgcggcttcgtcagcgtccaggagctcaaggatgttttgaggactgtacctgaggttcgaatgttagttggcaaagaagatgttgtgaagcttatgactgccaaagagcacgatggaggtattggagtaaggtcatatctgcaatcagcttttactaagctaatggcaacaagcaaagaagcagttgctgaagcaatttccaaattaaggagtcgcttgaatggggagataaagattagaacctttacagagaaggagcaactagttttatcactagagcagcagtacccaggagatgttggcgttttatcagcatttttctttaactatgttaagctcagacctggtgaagcactttacattggtgccaacgaaccacatgcatatctatcaggagagtgtgttgaatgtatggctacctcagacaatgtaattcgtgctggtctgactcctaagtacaaagatgtccaaactctttgctccatgctgacatacaagcagatgttccccgaaattttgcaaggtgttctggtgcagccatatgtaattcgttacacacccccattcgatgagtttgaagttgatcgctactcactacctcaaggtgaatcggttaccatgttaccagtgcctggcccatccatcttcctcgtcatgactggggagggcgagatccaggctgatggcatgcctgacgaaggagtagcaaaggaaggggatgttttctttgtgccggcacgcacggaggtgaagcttcacgcttctggccccgggtgcttgcagctgtacagagccggagtaaacagcagattcttctgttgacatggataaccctccaagatggggtaatttcaagggccnatgggttgtttgcaagaggggatcacccgggtgttccgtaccagactgcgttaccaaggtttttacatgcacatcnaagaatactggaactttgtttgttagggtagnttagccaaagtttgtcctagtggtgtggcagggcgagtgcggagtccttgcctccatatccttctcatgcctacatattaggcacctaatttttcagtaagctgggatgagaaaatgcagtctctagttgagcttcaactatctatatgtgtacaggaaattggaaggaaaataacgcctcgttgttatctcggcttaatag

SEQ ID NO: 34263 - DNA, 1182 bp, Triticum aestivum
  Clone ID: PAT_TA_34263
gcacgaggccggaccgcgcgcgcgcgagccgacaggcagagcgctcacacagccttctccctggccaaggccgaggccgataactctcgttggagcgtcgagtccgaccgccgcagctctaatgccgtccatggccggaaacagggggtcggcagcatcggcaatggcatccacaaggaactttctgatggtgatgaccacagcgatgaagggcagccaagcgatgagatgcgatcaacagctggaggttactgcacgcagagtgggagtagtgtggtgggaaaattgggtggcggaaatggtgattctggtgatgctgatgttgaggacacatttgatgaggggggtgttgggaagggtgagatgggattagagatgaactcatgtgccaacccatttgcggaatctattttgtcacttcagagaacgcaggaagctctcgagaatgagatacggaactttgtggtgatcgggaaagaatcaaccgatgatcttgatgcacgtgatgatgaatggagcaactcgctccacattgaggaatctgttgaagaagcaaatgaaaagagaaaggatcttgagtcaagggtggaacaagcatcaatactgatcaaggagaaggattcaagaatacttgaactagaagctctcagccggacgagggcgtggagaagtgcaattcagagtgctaacaaccagctgttgcagccggatcttgatcaactgctccaggagaagatggaagcggagattcagtgcatcatcctgacaagagcctctcaaacctggacacccgttgccgaggatcggaaagctctctacaaggagcagaaatgtctgcttggcgactacaagcagctcgaactcaaactgcgtagtgccgagaaccgagcagcaatactaggggagatggtggagaagctggaggcgcaatgcaaagagctctctgcgagtgcagaaatcttgcagctgcaatctagaacaagctccgcgtcactgttatgtttcatccagtttatactgctgcttattgccataggcatctatgttgtgcgtctgtctccatcctcggccgagtttgtacctacgtgaggttagaactaccagcagttgtgccttgttactagttaagcttagaagaatataccgtgtaaacttgccagcagaagtttaaaatttcgtttg

SEQ ID NO: 34264 - DNA, 1929 bp, Triticum aestivum
  unsure (1)..(1929): unsure at all n locations
  Clone ID: PAT_TA_34264
gctggcttcatctgaacaggaagcactttccatgagtgagtatcaacgaggtgtcagcgcatggcactttgatattgaggatctgaaggctcaagcattactgattaatgatgacgatccacctgaattgaaggaagatgatgacatcgcccgaataactgaagttgataagggcacatcttttgagagtcattttggacaatcaacgcttctgaatggaaataaccacagtgaacgaacttgtaccactgcagtaaatccaggtggaaatggccctgaaacaagtgatgtattcacttctgaccttggcaatgctgatagtccaaggatggttgatggacacacaaagcaaggatcagaaaatggttcattgtcctctacatcgaagcaaggttctgagggtggaaatcacaggagtgaagttagacaaagacaaaggacattctctggtccggttatgtattccggtacccgcagtagttcactgattgaaagaggttatattattgataaggatgcaggagctcgatcacctaataaacaaaagagtgacacgggaagaatcgatgatcttagtggtccgctttcactttcaactcgtgcttctgcaaatagtctgtctgcccctattcggtcttctggaggatatgtgggctccttgggagacaagcctagggtggaaataaaaggccgattttccgtaacatccgaaaatgtggatctggcgaaggttcaggaaattccagtggtcaaaatttcaccaaaaccacaggaggtaagaactcaggtctctacaatgaaaagatcagccagtgttggtgcttggccagtgaaggctaagtcaatgtctaatagtcatcatcgaagggaattccgtgacagctcagtatctgcatcaattctgattccccatcttgaaaaccttgtacagcagaccacattccagcaagatatcatcacgaacctaatgagtaacttgcaacagaatgagaaacccaatgggccgcagactagagttcagactatggtgggtgatacaggggttgaaacgggcagtgctgagagagaacggaaactacttgctaaagtattcgaattacagtcaaggatgattctttaaccgacgagctgatcgcgtcaaagctgaagcatgttgagctgcaagaagagctgaatagactctactgccaagaagaaacaggcgagacaagagaggatgacagcggagacttttgagtggtacaaggagggagtattcattctcaagtgacgccctggctggtgctggtgcaggtgcatcgaggctttgagttgccgcctgcttcctgttggtgagaggaagcaatatatatatatatatatataatgtcttggaacgccttcatgattggggtgcagagtgagctgtctctaggaggcatatatagcaggagaatatacatacatatatgctggttggttgatggtctctagttggaggaaggattttatcttgttgctatatgtgtgtgtgtgtgtgtctgtctgtacatagcagtatctatctacagtagtagttagcagcatctgtaggtagtatggtttggttttgttgaactgacttgagttgcggtccggtatccattcattttggccgcgccgcgcttatcagtgggagggatgggatgggccattaaattgatgcaatgcacaaaagtggtacgagaatgaataaatgggaagtgtatggtattttactacaatatcaccatcatcatcatcatcatcatcaccatcatcatcatatttatatttatncccaaataagggaangggaagggnatttgggataataaagggacaaagttgggttgattttggtaatcaacctgcaacctgttatcggttttttgttttgaacttttgaagcaagtgaatatatatattgtc

SEQ ID NO: 34265 - DNA, 1314 bp, Triticum aestivum
  Clone ID: PAT_TA_34265
aaagtattcacagaatttcttttaaaaaattgaaacttcaaaatggcggtttctacctgaaacttcggacttggagacaagcctgttattagacaaaagcatattatcactacatatttaattcggcacaggcatacattccccttgacatttggatcgggtacataagcaaaggcacggaagtgcccaattcctccagagttcactagcattggcgacctagctaaacatattcaccatatgattggtggctaaaaatgatcgactcaggcagctacatcaagaaggcgattgtctccgtgatgatgcttgccttgatgatgcttgcctcgtgggaaatttgaaaggagcgaaacgctagagtttttcgcaacacggctaccccgacttccattgttgttgccaagatcaaagaggaagcccatctttgggcactgacgagtactctttttctttttgccgctctacagcttatgtctagaccttctccttaattaatgaaaatggcaagtcttttgcctcgtttcaaaaagaaagacgttatttatacaacaagcggcatactggcctagcctgtgttctgcatgccagcagcaatgcccttcatagtcaggatgagggtgtcctccaggcctggggcatactcgctcccacggttcagttgcaccagctcggcgggctccttgtcgcagaactccttggacaggggaggctgttgtggcgtcacctcaaagctggggtctcttatccgcttcagggtgtaggcttggcaaacattcaaggttgtgatgtaggactcacgcaaccgcagacgctgctttaggtaaggatccccttcaagaacgtccttgtgaccagcaacctgaaggagtaactgttttgtctcttcaaagttttgtctcaactgttccccaaaggactgcagatcttcagccacaagcaatttgtcatataaagcagcaattcctggatctcccttggcaaaaaccatctcaagtaagtcaagggtgaccctgaagaatggccactcattgtacatttctttcagagtatggatgttcctgatgtccttctgaatgatatgtttaaatgctgcaccaaatccaagccatacaggaagatgaaaccttgtctgtgtccaagcaaagatccatggaattgcacggagtgattctatgccccactaggctttctctttgatggccggctgccaatattcatccgaccatattcagtctcaggtgttgccgagcggaagtattcaacaaagcgtggttcttggaagactattgatcgatacccttctgtcgtctt

SEQ ID NO: 34266 - DNA, 2393 bp, Triticum aestivum
  Clone ID: PAT_TA_34266
tagcgtggtcgcggccgaggtacataagcataggcacggaagtgctaagttccggagacattcctgttattagacaaaagcataatatcactactccatattttattcgccacaggcatacattccccttgacatttggatcgggtacataagcaaaggcacggaagtgccaaattcctccagagttcactagcattggcgacctagctaaacatattcaccagatggcggaagacgtttatttatacaacaagcggcatactggcctagcctgtgttctgcatgccagcagcaatgcccttcatagtcaggatgagggtgtcctccaggcctggggcatactcgctcccacggttcagttgcaccagctccgcgggctccttgtcgctgaactccttgggacaggggcggctgctgtggcgtcacctcaaagctggggtctcttatccccttcatggggcagtcttggagattatgcatgatagcgttttctgacacaaacgaccatagccactcctttggctcgggttcacaaagaaagacgtccttgtgaccagcaactggatggtgaacgcgcctgttctctgcagagcttcgtcacagcccttcacctgaggattgaaggtgttctgcggaaacggggcatgctcagaaacaagtatcagttgcatctgctgtgccaatacctcgccgaagaaattcggggaccacgttggatgatggctcgtcatatcaaagttctggtctcgtatccgcgtcagggtggtgccttggaaggatttcttgatagtgtggtaggattccaacccccacagcaggtggaagcaatttagatccccttcaagcttgtcttggagctcggctaactgatggggtagggcatattatctgctgtacgagagcaggctgaatctgctcaagaggaagcttctgatgtggaaacgtaaatatgaatatgctgccaatgaggccaaaacagctcttgagaagagcagcttcagcacaggaacgcacaaataagaaagtgcaagaaagggaagatgctttgagggcagaacttgctacccagctgcacgagaaggaagaactgatagctacattgaatgcaaaaatcaaccaaactgaagttcacaagacaagtttgatgtcgaggcttgaggttactgaagcaaagttgaagaaccacgagtcagattcagtggctctgaagggagaaatcagatcattgactgataacttggagtctattaaaactgaagctcagtcccgtgagaaggaagtgaggatcctggaacaagaaaagaaccatcttcaggagaagttcctatctgagtgcaaaaagtttgatgaggccgacatgaggtgcaaggatgctgaaagggaggctaaacgagcagtcgagttggctgatttagctcgtgtagaagctgctgctgctcagagagacaagggtgaagctcagcgactagcaatggagagactcactttgatagaaagaatggagcgacaggttgaaactctagagcgcgagaaaagtaagatggtggaagaaatggagcggcttcatcagtctgagttggatgctctatccaaggtcaggatgcttgacgagagggttgatgagagggaaaagcagattggggagatgttggaacagaacaaccagcagagatccaacacggtccaagtgcttgagagtctgctggcaacagagcgtgaagcttgcgctgaagccaataagagagccgaggccctgtcactgcagctgcagtcaacccaaggcaagctggacatgctccagcaggagctcacctctgttcggctcaacgaaactgcacttgacagcaaggtgaaggcctcctactctaggcgcacgaggggcgaagccaccgagtccgtccattacatggacgtcgacaacgacgacaccgggaggcgaaggaaaaggtcgaagagcacaacgagcccgttcaagaacaatcacacggaggatggcggatccgtgttcttcggagaggacacgaacaacgggagccagcagttggaggggacggagaccgagaccgaggactacaccaagttcacggtgctgaagctgaagcaggagctgaccaagcaggggttcggcgcccagctgctgcagctgaagaaccccaacaagaaggacatcgtcgccttgtatgagaagcacgtcgttggcggcgcttgactgcctcttcctcaacaatatgtaacacatcattttaactccgtgtgctaattctagatttcgtgcagcgttgtgtgctggtgacacgttttaggtcagattgtaaaacagcatatgtataacttggcgtgggacttgttggtttgtggactttgttgttcaaaactgtgtgcgctttgctaaa

SEQ ID NO: 34267 - DNA, 1685 bp, Triticum aestivum
  Clone ID: PAT_TA_34267
ggcccgctcgcggccggccggcccctgcacctttccaccttccctcccaggctccccccacctcccccccctcccccacgcgaccgcgcggggggcagggcgaggaggagcctgcacctttccacctgcccccccccccccccccccgtctcccccacgcgaccgcacggggtgcaggacgggatccgtccgttgcttcccacggacgcctccgttccgtggactccaccgcgcccgccgtccgcccccccccccctgaaagcaacgcctgttccgattcacgagggggtcgaatgcccctgctccgcgacggccaccagccgtcacctgccgcaaggcaacgggaattttcaaaggggactgaattactgaagacaacacaaacttggtctcctgacgtggactcccggtcgacgcagcagaagccatggggccaggggactggttcaagaccatcatcagcaagaagaagtcgaaacggggcaagtcaaagcacgcaaagaacgttgctgcgcaacgcaatggagccaacctgccgcagcaaaagcccagcaacgctccttcttccagcagcgaccctgaagacaatgcagcactggaagactgggcagctacccggattcagaacgcgtttcggcgccacaaggcaaggaggacgctccgttgcctgaggggagttaaaagactgcgcattgttggccagagcaatccagttaccaagcagaccagtgccacattgagctacatacagtcttggaacaagttacaggctgagctaagaaaccggcgtgctttcatggtcacagaagggcgcaacaggaagaagaagcaagagaaccaagtcaaacttgacgcgaagctccaaaatttgcaggttgcatggaatggaggctcgaacaccatggatgaaatagttgccaggatacatctaagggaagaagcagcagtaaagcgtgagcgagccatggcgtatgcgtttaaccatcagtggagggcaaagtctgccacaagccaaggaaacttcaactatggggtcgggaacggtggctggggctggagctggatggaccgctggatcgctgcacgaccatgggagccccgatccatggtcacccctgaaaacccgaagaagggacaatcaaagaaagacaacaccagcacaaaccagtcagctctgaagctgcaaggtgcaatcagtctaagcaacaacaccagtgaccggaaagttcccaagaagaagtcatccccatctcctgacaagaagaaaccggtagcgaaaacggagcagaaaccagtagcgaaaacagagcagaaaccaaaggcggcaggccctcccaaggcgaagtcgaaggacatgaagaggaaccaagagaagcagcaacaacccgcggttcctgcgatcactgcttgaaacccgcggcgaaaaggttaccggagacgttgtatgatacatcctgtgaagtttctcttttcttttacactcttatgtggtttgtctcttacattgctgttttatcggaacaagaagtgaccaatgtagaatgtgtttgggtttgcgcgattgcacacatacctaatgagagtggtttttggtttagagctaggatctctactgtgcgcattgtgtgcgggtctgcacgtccccgggctgctgggcgtcgatggatccggtggaacaaaaaaaa

SEQ ID NO: 34268 - DNA, 538 bp, Triticum aestivum
  unsure (1)..(538): unsure at all n locations
  Clone ID: PAT_TA_34268
tgatcgagctagctggcggcgaatcatgcacaagcggcggttggaaacaaccgaagtgtctgtctggggtttctggtgtgcggtcccacttccaggtagatgatgctgctgttgcaacgaacagcagcttcccaggtccaccgtgtgagagttagcaccagatggtccattgatttggtgtggctgagcagggttcctgggttgagtgagctgagtgaagcagtagaataaagtggtgaggatgtagtgtagtgtagccccggcctcacttgagttggtaggtaagtaaggtgtaccagcagcagcagcagcagcatctagtgcatgtagtagaaatgaaactgggtccccagctttgtagatagtcctggtgagctgctgttctccccgttggaccccagcttgggctctggtcctggcgagccattgctttggctgctagagaacaattagagtactgatcatatgaatgcatatcggttgctntttaaaaaaaaaaaaaaaaaaactcgagacacctgcccgggcggccgctcga

SEQ ID NO: 34269 - DNA, 806 bp, Triticum aestivum
  Clone ID: PAT_TA_34269
atcggcgccaccacgaccatgcagcggcagaggagtcctcctcctcccaccaccaccgctgccaccaccgcgccctcctccttccacctccacacccatccatccctccctgctcgcgcccgaaaccctagcccgcgggcggccatggtgaccgagctcaggatccgcagcatcttcctctcctccgagagcaagagcggcaacttctgcaaggtcagtttgctccctccaatctcctctgcatgcgtgaaggggcccggccaaggagaagctgctgctgctgcaggttcttcctcctccccgctgtaggtgcttatgtgtgggatttgcttcgaaagttgtccacgtgagtcaatgggtgctgcttcatgtgggcattctttctgtggtgtatgtatcgatcagggttgttctcttcttatatccccttgctttggatggtcatactttacaatgcccttgcctagataattgtgccatgaatacgcttggtgatggaccaagtgtgcctaactatctattaagttacccttgatttttcttctgactgaacacatagatgtttaccgtagctgcatgtcagcatatcttcctcaatcaaagttgagcatgtgggcattttactggagtgtgttcctgaatatgtttttctgaaaaaagcattgatgggaatttatagtcatgcgtgaacacaaacaattgtattatgcttttttcctatagcgtgaacgcaaacaaatgtattatgcattttcctgatagggtgcaagcctgcagtgttattggtgcacaacattggccatgct

SEQ ID NO: 34270 - DNA, 2344 bp, Triticum aestivum
  Clone ID: PAT_TA_34270
cgtccgcggacgcgtgggcggacccgtgcgcacgcgtccacgcccctccgggccagaagttgaatggcggcggggacgaagcaggagcgccgccgggtcccggactccttctcctcaaacgaagcggcacagtttcttgcttagtgcacaatgtccatacgcgcagcaatcttgcgtattttgtttggtgcgcttacgaaggcatggatttcttgcaaaaccaaggtcgcacttttgttgggggtcctcaattgtgccaacggccatccgtcaccagccggagaatatattggtcatacgttacaacattttgctacgtacgctgatagtagtactgcttagcgagtagtttaccatgatgcgtcagtgttcactcgtggtaacttgaaacacatgggctggcatgatccaccggcggtcatgcatcagtggccccggacttcccccgtgcgtcctcggcacgccactggctggaaccccgacatccctgctggtcctccctcggtgcctgctcaggtgcgtactggacgcaccacttggatggacatttttgaaaatgctcgcaactccgccatcgatgctacgactgatgctggcaagaaagtgaaggagatgactgatgcagttacaccccatgttcaaagttttcttgaggcaagtccagatttagaaaaggtagttgttccacttggaggaacattatgtggtacccttttggcctggtttgtcatgcctatcatcttcaagaggcttcataagtatggttcacagaacccgatatcagcacttttggggaactcagtcaacactaatgcttcatatagcaccagcctttggagtgcattggaggatcctgcaaaatacttgatcacatttatggcattttcagagatggctgcagtgatcgcaccaagtgtatcaccttattttccacaagctttgaggggtgcatttgtattgtcagttgtctggtttcttcataggtggaaagcaaactttatcactaaagctatggccaaccaaactgccttagttactgatagagcaaggttatcagcttttaaccaagtgtcctcattgggactgattgcgcttggtgtaatgggtcttgctgaggcttgtggtgtagctgttcaatcaatattaactgttggtggtgtgggaggtgttgctacggcttttgctgctagagatgtcctgggcaacgtgttgaatgggttctccttacaattttctaggccattctcagttggagaatacataaaggctgggtcaatagaaggcacggtactcgaaataggacttacttcaacttcgatgatgagtccagaaaagcttcccttcacagtgcccaattctctgttctcaagtcagattatagtgaatagatcacgagctcagtggcgagttagtgtgaccaagattcctataaaacttgaggatattgagaaagttcctgctgtagcagaggagataaagtctatgttaaggtccaacccaaaagttatctcggaaacagatgctccttactgctacctctcaagattggaaagttcatatggagagcttgtcatagggtgcatcctccaaaaaatgagaaaggacgagttgatatatgcagaacaggacattcttctaggagctgccaggattatcaagtcacatggcgttgaatttggaagcaccacacagtgctgctgattctgatgttttctcaaaactcaagtagggtgaacgtcgttagcctggaggagtacatacgcggagggttagaggagattttgcttggtgcgcgtgcgaaggcagggacctcttttggaaccaaggtgggacttttgttgcctgtcctcaatttggcaaacatacatcatctgttgccggagaatcttgcgttacatcattttgctacgtgcgctgatactgcttagcgagtagtttaccacgattcgtcagtgctcagtcgtggtaacttcaaacacatggagtggcatgatccaccggaggtctgcatctgggcccaggagtatcccgtctggccttggaactctaaatgctggaacgtcgacatgcgtgcaagtgttgttttgatgcatgactaggcgtgatagacacctttgtcctgaatcggtgtgtcggggaccatgttgacacgcgtcgttcggcttttatttctagatctggctactatagtcctatgcatatgcttgttaatttgcttgtacggttgtggggtttgtggatgttgtgtttttgatagttttggcgggccgtctgtgcggttgtggggtttcatgtttaggagtagtttgtcgcttcgtttgtattggttttcgtccggtttttc

SEQ ID NO: 34271 - DNA, 780 bp, Triticum aestivum
  Clone ID: PAT_TA_34271
ccctcctcgcgcctctgcaactgcaactccaatctgttcccacatctgtcgccgccgcctcgcctcaccttccctcctcccaacagagctgcttctagggtttcgcctcgggttcctcccttccgcatctcctcgtctcgagcaactcggccgtccaccctctgcccagcggctgcgtagacgtcggtggccgtggcggcctaggcgtagccagagctaacttttctcgtgggcggcgcttcgggggaagggaggccagtcggcgagctgcggtggccatgtcgcagacgaactgggaggctgacaagatgctcgatgtttacatatacgactattttatgaagagaaatttgcaggcaactgcaaaggccttccaatcagaagggaaggtttcttcagatccagttgcaattgatgcacctggtgggtttctttttgagtggtggtcagttttttgggatatattcatagcaagaacaaacgagaagcattcagatgttgcagcgtcatatattgagacgcagctcatgaaagcccgggaccaacaacagcagttacctcaacagcggcagcagcaaccacagcatatacaaatgcaacaaatgttgttacaaagagccgcacaacagcagcagcagcaacatcagcagcagcagcaccaacatcagcagcaccaacagcagcaacagcagcagcagcagcagcaacagcagcagcagcaacagcagcagcagcagcagcgtagagatgattcttatcttcttaatggtacttcaagtg

SEQ ID NO: 34272 - DNA, 722 bp, Triticum aestivum
  Clone ID: PAT_TA_34272
gaggaattcggcacgaggcccaagagaggtgtactacgagggagtgagaggcgcccggctcgcctgcgtccgtctccacttctcgcgagcccggcgtcacccgccgccgggcacgcaccacgctcaacgccaaagaaaatagtgtaggtcgtgtaggcgaaggccgacctgcaaactaaacactagtcgatcaagatggtggtggagggatacgaagccgacaagaacatccagatatggaaggtgaagaagctgatcaaggggctggacgcggcgaggggcaacggcacgagcatgatctcgctcatcataccgccgcgcgaccaggtgtcccgcgtcgccaagatgctgggcgacgagtacgggaccgcctccaacatcaagagccgggtgaaccgccagtccgtgctggccgccataacctccgcccagcagaggctcaagctctacagccgggtgccccccaacggcctcgtgctctacacgggcaccgtcgtcaccgacgacggcaaggagaagaaggtcaccttcgacttcgagcccttccggcccatcaacgcgtcgctctacctctgcgataacaagttccacaccgagccgctgaacgagctcctcgagtccgacgacaggttcggcttcatcgccatggacggcaacggcacgctctacggcacgctgagcgggcacagccgggaagtggtgtacaagttcagcgtggatct

SEQ ID NO: 34273 - DNA, 819 bp, Triticum aestivum
  Clone ID: PAT_TA_34273
tgcacaatgatcctcttattctacctcgctgaactatcgataaatattgattatactgaactctgttctttctttgctgaataagaactcatcttttctcccggaaggctagttcatcagctcagaaatattttaggcgagggacacgtctaaattggcctgaaggtgctgttacaagagaaagcatcagagcagtcagaaaactacaccggctaaaggacttggtcgcgagaaatgctgaccattcaaaggcatcgctggcagacttgctatatggtcttttaaggtttgagccttcagagcgccttactgcccaagaagctctagatcatccattcttccgaattccaggtccaacatgacaattggaagatgctttgattccgccgctcgccaagaacaatgcctggagaagcagcgtgcacaaaaccgagagcagaatgcctttggctaatctctagcataaagatgatataagccgagctatggtgcttgtggtggtggtgataagctgttgttccagtcgctcaggtgtaatgtacaatagcatttttcctagggagggtagtgtactggatgcgacctgtacattgtgaagttgcggtgcaccacgggttgccgtctgaatcctggttttgtaatcgcactacaatgatcactgaccagcgcaaggcagccgtagaggaggtgctagtattttgcctgcctgtgccatgttctgtttctcgagaagtcttgacagggctgagagctccctgcatattcacaccatgctgaagaaagaagaaataaaatcaagttgtagtttgtgttcgtctt

SEQ ID NO: 34274 - DNA, 456 bp, Triticum aestivum
  Clone ID: PAT_TA_34274
tagccgtcttaaattctagggtcgacaatttaaacgacgtgctcaactgcgactccggagacatcgacagcatggatgacgatgcaggagataccgacgaaccaacgcccatagggcattggatagccacctcatctcacgatgtgtacatggtggatacccctaaaggaagcgacaacgaggaaaaaggggatgggacgggaaatcgaccccccgaaaagcaatcaaagcgtcagcgtaaacaccgacccaagccccgcctcaacaaaaacccagccatagagcaggacgagccggcagacgacaagcaggccttagagcaaccgtcctaacaaggaaacacggatagagaaaccgaacatccctcctccggcgaaaacagcattctcaccaacctcacgccgaataaacctatggagcagaagaatctccacgagaggctcgttgcaactgcat

SEQ ID NO: 34275 - DNA, 1739 bp, Triticum aestivum
  Clone ID: PAT_TA_34275
gccgcctcttggtcgtcgcaacacaccctcaccccgcggcgcacgaaaaagggcaacatctaatcggcggcggcggcgggcggtgagaatggcggagctgaagcggctgtcggagagccgcgacctaacccgcatcgagcggataggcgcgcactcccacatccgggggctggggctggactcctccatcgaggcccgcgatgcctcggaggggatggtcggccagctccccgcgcgccgcgccgctggactcatcctccagctcatccgccaggggaagatcgccggccgcgccgtcctcctcgcagggcagccggggaccggcaagaccgccctcgccatgggcatcgccaagtcgctcggcgccgagacgcccttcgcctccgtcgctgcctccgagctcttctccctcgacctctccaagaccgaggcgctcacccaggcgttccgccgcgccattggcgttcgcatcaaggaggaagcggagatcatcgagggcgaggtcgttgagatctcaatcgaccgccctgtctccgccggtagctcgggcataccttcaggtgctaccgctgccggcaagactggaaggctcacgttgaagaccacggacatggagacggtgtacgagctgggtgggaagatgattgaggccctggggaaggagaaggtacagagcggggatgtgattgcgctggacaaggcctccgggaaggttaccaagcttggccgctccattgggaggtcacgggattatgatgctgttggtgcgcacaccaagtttgtcaagtgccctgaaggagagctccagaagcgcaaggaggttatgcactgcgttaccttacatgagattgatgtcatcaatagcaggacacaaggcttccttgcacttttcactggtgacactggtgagattcgtgcagaggttagggagcagatcgacacaaaagttgccgaatggagagaggaagggaaggctgagatcgtccctggcgttctgtttatcgatgaagtccacatgctggacattgaatgcttctccttcctcaaccgtgctctggagaatgacatggctccgatccttgttattgcgacgaatcgaggtattacaacaatacgcgggaccaactaccggtcaccacatggtataccgtcggattttctcgaccgcctcttgatcatcacaacacaaccatacacggtggaggagatcaggaagatcttagacatcaggtgcgaggcagaaggcctggaaaggtctgctgagggcaagggtcggctcacaaagattggcaccgagacctccctcaggtacgcaatccagctgatcacttctgccggcctggcttgccagaagcgcaagggcaaggtggtggagatggaggacataagccgggtgtaccacctgtttctggacgtgaagagatcgacgcagttcttgatcgacagccagagcgactacatgttcagtgaagtgcaaggggattcagatggggatgacgccatgcagtcctagacggagaattttgcaatgtaactggggttggtttgtatggctcgtgtatcttggaatcttgttgctcgtttagattagtcttaagcgtgagatgttgttacctgacaagcacacttgatgggtgcagtgagctatgttaacggttgtaactggtgactctcacaattcgtttatttcttttcctttttttaaaaaaaaaaaaaaaaaaaaaaaaaaaaaaaaaaaa

SEQ ID NO: 34276 - DNA, 783 bp, Triticum aestivum
  Clone ID: PAT_TA_34276
agaggtacatgcctaaacggggctcattggtaacctggcctccttttggtatatcagtgaggacatttcgtcctgtgtccgccgcttcctccgtctcttcaagccatcgtcgaacgtcgtcaaccgccatcttgcttgctacctgcttgccagagagcaatggctttcctcgctatagtcgttgcttctgtgttctgttagggggttgggcagcttgggcttgctggtgctgggaggtgttggttttgtctcctttcctcgtgtgtgttgcctttgaatctcagacgggtgctaacaatatatgattgatggcaaaatccatctttccatttaaaggatgatcccttgatcggatgttgagcaggcctgccttattatgaaacctggcgatttagcggtaccacgctggctgaccaagaggaggaaaccctcccgtgttgctccgcctccactctccctcctccgatgcatacttgatgggaacagttagctcatgtctcttagataatactccctccgtccgaataatgtaggacgtttttgcaagctatgttagcttgcaaaaatgtcttatattgtgagacggagggagtgctttttttgccagaagtctcttagataatacttggtgaggcgtgtgcaggcatcttagtacatgtttctgcacccctagactcactctcccaacactgtattcaaggctcattgaggataagtgcttcaagatgcctcctactcctaatgcacataagtgcacttgtgtcacttgcctcgggagatttt

SEQ ID NO: 34277 - DNA, 1199 bp, Triticum aestivum
  Clone ID: PAT_TA_34277
gtgatgttacaaatgcaaaggaaattgttgaggagttgttgcagtatcttaacacagctgaatttgcaatgcgtgaagagctggctctgaaggcagccattcttgcagagaagtttgctccaaatctttcatggtatgttgatgttatacttcagttgatagacaaagcaggagattttgtaagtgatgatatatggtatcgagtggtaccaatttgtcaccaacaatgaagatcttcaggcatatgctgcagctaaggcgagggaataccttgacaagcctgctttgcatgagaccatggtcaaggtcagtgcttaccttcttggagagtatggccaccttttggcccagagacctagttgtagccccaaggagttgtttaccattataaatgacaggctcccaacagtatcgtcaagtactgttgccattattatctcagcctatgccaagatacttatgcacactcagcctcctgatgcgggactgcagcaacaaatcctggcaatatttaaaaagcatgagagttatattgatgttgaaattcagcagagagcagttgaatattttgaactaagcagaaagggtcctgctttggctgatgtattggctgaaatgccgaaatttcctgaacgtgagtctgctctattgaaaaaggctgaagatgctgaagttgacacggcagagcagagtgccataaaactacgaagtcagcaacaatcatccagtgctattgttgtagctgctcagccccctgtaaacggaccagccccggctgctaatcatctcacccttgtgaagatgccaagtcaaaacattgccgaagagagcaatgtcattcatgaagaaaccgcggtagaagctccaaaagaaaatggtgctcccgtcgaagttcagagaaatgttgagatcatcactgagcccgctcctgttagtaaagttgagccgcctgcatctcgtcctgcttctcaagcagacctccttgcagaccttttgggccctcttgcaatagagggtcctcctgctgctgtagagcaaactcctgctcaaggattggaggctaatcaaagtccagtaggtgacttggcactggctacccttgaggaccagtccaactctgttcagccaattgtcaatgttgaggagaagttcaatatattgtgcacgaaagatagtggagttctgtatgaggatcctaa

SEQ ID NO: 34278 - DNA, 788 bp, Triticum aestivum
  unsure (1)..(788): unsure at all n locations
  Clone ID: PAT_TA_34278
caattcactaactggtgagcgtggtcgcggccgaggtctaatactgtacaaatttagatagaaaatctgtatttggaagggagcccggggccgggaacgatcaaatcacaaaggaaagccggtgctaggaacgatcaaatcacatagaagtgcatagagctcgtggcgtttgcccaatttcgttcccaacatgagcaagccatgcgacggtgccaatcccaagacggagtggcctgagctggtcgggcgcacgatcaaggaggcggaggagaagatcaaggcggaccgaccggacctcaaagttgtcattgtcccggtaggaagtgttgtgacacaggaggtcgatctgaaccgcgtccgcgtctgggtcgacacagtggcggaggttcccaagattggctaagctagcttgtaattagcctactggaataaaagcccatgcaagtctcaacatcgtccagttaatttgccgaacaaataagcatgggtatgttgtgaagaaaaataagtattgttggtgtttcgcggaaatgtatcatgtgtggatgtgttatgtatgttattttgttgtaagttgtaataagcatcgttaatattatctggccctgtttatattgtctaaaaaaaaaaaaaaaaaatagcggagtgaaatccgtttcaaaaaaaaaaaaaataacacacgaaaacgctacccaaaaacaaataaagccccctaacaggggccccaaaggggccccatttccccacaacaatcgccccctttgggatcgccggggttggtanccctn

SEQ ID NO: 34279 - DNA, 630 bp, Triticum aestivum
  Clone ID: PAT_TA_34279
cgtcctcctggcagaggaggaagaggacaagggaggaggaggtgggctgggccggctggggaagctgggcggctggtggtgggctgctgagcgaggccaggttcgttctctcctttttatttttttctgttctgtttccctttttatttaatattattttgccactgttttcaattccaaaataatttcatacagtgccaaaacattctgaaatattttatgttacctctctggactattccaaaagtacataaaacatttcaaagcatttgaaaatatattcattatatattatgaatatatccccaaattcaaatagattattgatttaaattcagagaccaaataattccttaaaaatattccagaattttggtttgatatataactcttgccaaaattcacaaaactatttttagggcatttttggattcacagaaggcaatttaaagggtgcttgcccttcttttaattagggttttgaggcttctgaattcctcagttcaaatttcatttgaatttaaacatgatgcagcaaccaagctagtccaaggccagggtaaagctagggatgtgacacgctcgaggctgcgtcgcctcccgagtcgcccgtggggagggcgacgcggg

SEQ ID NO: 34280 - DNA, 711 bp, Triticum aestivum
  Clone ID: PAT_TA_34280
cccacgcgtccgcggacgcgtgggctcgtcttcctctccaccaaatcacgaaatccagcgcagatttgcgccgagggagcgcgtcgacgacgcgtccatggccgccgccgcgttctccatcagggattacgcggcgagcatgaggtgcaagacagcggcggaggggctgcctctcttgggaatcgaggatctcccgcctctcagggcgccgaggtgccggtggtgggcggacgaactcgcctccgccgtggctgccgcagctggggcggcctccccgaggagggcgccagggaaggcgaagccgacgaagaagaggtccatctccgacctcttcgccgcggcgccccctttgatcgtgccccccgccggtgatgccggatgcaaagagcaaacggaggtggacggcgacgaggcgctgtgcgcgatcgcgaggcgggccaaggaggagaagaaacggaagagaaagctgcaagaagaggaggcggggcagaaggaggagacggcggcagttgctgccgcgccggagagcagcggaggccgggagcccgaggggaatttcgctgccagcaaggaagcacttgaaagtccaaacctgtttgatggactggatactcactcatcacagaaaactgaggcctcacaacatcacagagaagagagagaaaagatatctgagagaaggaagcaaggggaagatcaataatataaata

SEQ ID NO: 34281 - DNA, 451 bp, Triticum aestivum
  unsure (1)..(451): unsure at all n locations
  Clone ID: PAT_TA_34281
ggtgaagtggtgtagttcggctggatggcccgttccccaactttgttgttgttgataactgcactttgcaagcatggcgtaaaaactgcagggagatacatagatggcttctgaaagtgtaccccgtttgattttgtgtggttcgaaaaaaggaggaagccgatatgtatgggtgtgtggattggtaaaacgtttggtagttgtgtatgctttgtagctcactttgttctcttgcgctgttcgctatataacttttccgtggtccacttggcaaaaaaaaaaaaaaaaaaaaaaaaaaaaaaaaaaaaaaaaaaaaaaaaatagttttgtcttggtgaaagtgtaccacggacactacgtcccgttcggccggtggagaatgcagtantgtatgggtgtgtgctgtgtgaaactacagtaattgtgtatgcttgtagccaaaaaaaaaaaa

SEQ ID NO: 34282 - DNA, 663 bp, Triticum aestivum
  Clone ID: PAT_TA_34282
gttccgtcccttccttttccccctccccctggccggctgttgcccacctcggcttgcgcgtggtcgcggggcacgtgttgctcccccgtgctttgggttctgcctggtgcacgagctggttcttcgtggttccgggtatgcaagtggtaatggttttatatcattccgcgaggatatcaggaatgaagtagcagagatcctcaaggaagaaagtggcagctaggtcctgaccactatgggcttttggttccgaagatggtgtagattgtgtcgacaagctctttctttaacattatggcgtagactatttaactttactcgtctgaaattgatagagatatagtcatggagtaataaagggcgaaagtgtatttggatattacaagtagctgcttgtgacaatagctaaatgttgtagggtggtctgtcagtagatgagttcttctatgtactgtacatctgacatccgttacttttaaccttatcctgatagtagcaaagatactcatgaaaaggacagcacatgagtttcagaataatacaatataccgctggggcttggcccagaatttgatttatatacagatggggattggccagaaaatttttttcaaaaaaaaaaaaaaaaaaaaaaaaaaaaaaaaaaaaaaaaaaaaaaaaaaa

SEQ ID NO: 34283 - DNA, 1711 bp, Triticum aestivum
  Clone ID: PAT_TA_34283
ggagtctgggagtgactggttgatgcttcattgcagaaggttgtgttagctccatctgtggaatcagttcctgaatgggcatcttgcattagatatgctgttactggcaaagaaagatctggaactcgtgctcctgttctcaggcaaaaagtattagattgcttatgtacagcagttcctcagtctgtagcaactagtgtacttgccaagagatattcttttctgtctgttgctctaattgaaatttctccacataaaatgtccccagcagaggagcagtaccacgttacaattctcaacgaactgcttgacaatatgagtcactcatctgcgcaggtaagagaggcgattggtgttgctatgtgtgtcgcatgctcgaatgtgagattagctggtgcacgttcaccgggagtcctgacagaacaaaccggaaatgaatattggtataagcgtttgacagatggagctactgagttgtctgtgagtatacagaacaatagtcaatctaagcaacttgaattggcatccgattcatccactgcgaatggcttggacaataaagaggaggctgacgctaaaagaatggaaacgattttccatttcatgattgcatctctgaagtctgggagatcttccgttctactagatgttattattgcactcttctaccctgttctatcattacaggaaacatcaaataaagatttgtcattgcttgcaaagtcagcttttgaattgcttaaatggcggactttgccgcgcccttttcttgaaacagctattatggctatcctttcttcagtcagtgatcccaactggcgaaccagatcagcgttgttatcatatctcaggacctttacatacaggcacacattcattctttctggctcagagaaatcacaaatttggcaaacaatcgagaagttacttgtggataaccaagttgaggtcagggagcatgctgctggtgttcttgcaagcttaatgaagggtatagataaagatctatcgaaggatttccgtaatagatcatatgcacaagcccaacgtatccttgatatgagaaggagaactccaaagtcgggccattctgttgctaccatccatggtgcagtacttgctctgacggcttcggtgctttctgtcccatacgacatgccaagctggcttcctggtcatgtaacactactggcccacttcatccgcgagccgtctcctgtaaaatctactgtgacaaaggctgttgctgagtttaagaggacacacgccgacacttggagcatccagaaggatgccttcacagaagacgaattggaggtcctccgtgatacatcgtcctcgtcatcgtactttgcttagattcagagactgatataccaatacagtgatagcagattttatgaatttggccaggaggaagacttagttgcactggtgatagaaaacttttatgttattttcaatcgatgaaccgccagtgatgatcatatattcatagttacataccgtgtattgtagtttcgtcaataaaggcttcctgcatacaggcgatagctttgatatatggacttgaatgagtatatatatggaatgcgcttctgcagttattctggggtgccccttccggtgcagcatgtggtctttacctccaacatgtcctgtcgttgcttagcaaaaatgcaaggttttagttaaaaaaaaaaaaaaaaaa

SEQ ID NO: 34284 - DNA, 581 bp, Triticum aestivum
  Clone ID: PAT_TA_34284
tccattcgtccgcttgctctgaatcgcgagagagagagggggagagagagagagagaggtgttaggtgcagctagctaggagcaagcaagcagatccaggaggagcggagatggcggactgggggccggtggtggtcgcgacggtgctgttcgtgctgctgacgccggggctgctgttccagctgccggcgcagggccggatcgtggccttcggcagcatgcacaccggcggcctcgccatcctcgtccacgccgtcatctacttcgccctcatcaccatcttcctcatcgccatcggggtccacatctacgccggctagaccccccccactcttcttcgccgcacatcgcttctcggctctgccgcgcgttattaagctttgttgcctgccgagcttgtctgtctcttactactattattggtgatgtactgtgtgtgtagtagcttctgttgtcttctttggttgatcggagaaacaatcggaagctagtagtatatggtttggtggtcggctggggtttcgtttgagatggctcttgtctctgggatgaaattttatccagaatgggccggtgtgtgc

SEQ ID NO: 34285 - DNA, 641 bp, Triticum aestivum
  Clone ID: PAT_TA_34285
attcctcttcttcctcctcgctcccagttttgaagcgagagagaggtgtggggtgcagagagcttggagcaagcaagcggatagcagaggagccgaccggagagcggagatgacggagtgggggggggtggtggtggcgacggtgctgttcttgctgctgacgccggggcggctgttctagctgccggcgcagcgccggatcgtggccttcggcagcatgcacaccggcggcctcgccaccctccgtccacgccctcatctatttcgccctcaccaccctcttcctcatcgccctcggcgggcacatctacgcccgctagacaccccactctccttccgccgcaccagcgcttctcgcctctgccgcgcgttatttaagcttttttgccgtgccgaggttgttgtccgctcaccttactaattttacttgttgatgtgtggggtatgtacttatcttgtcttcgtcttcttggtttgatcagagaaaacaatcggtagtgattgatggtatggttttggggctggggtttggtgcttttgtttgggctggctccatctctgggatgaaaatttatccagagaggcagtgtgtgttgttggctgccgtatccctattatgaatggcctcggcttagaaaaaa

SEQ ID NO: 34286 - DNA, 1099 bp, Triticum aestivum
  Clone ID: PAT_TA_34286
cgaggcggagatctcatgtgcggcggcgatgcccgcgccggcggcgctagccctcgcggcggctctgctgctcgccgccgcgtccatctgcgcggaggccgtgtggctcgacatgccgcagaccgggaccaagtgcgtgtcggaggagatccaggccaacgtggtggtgctcgccgactacgccctcatgtacgagtcccacccctcttcccacccgaccctcgccgtcaaggttacttcaccatatgggtacaccttacatgaaaatgggaatgttacagttggtcaatttgcattcacaacctcggaagctggaaacttccttgcctgcttctggatagatagtgcagagaaaggatcaggcgtatctgtaaatcttgattggaaaactggaatcgcaacaaaggattgggatgctattgctaagaaggaaaaaatagagggcgtagaactagagcttaggaagcttgaagtggctgtacagtcgatccatcagaacatggtatacctcaaagcaagggaagcggagatgagggaggtgagcgagaaaacaaacggcagggttgcttggttcagcatcatgtcgctgggcgtctgcgtcgtggtgtcagttttgcagttgtggcaccttcaaggctacttcaggaaaaagaagctcatctagactaagcctgttcgatgttgcgcattagcccagattgttgttcactttgtggggggaaaggtagagttgtttcttcatgtttggttcaaacatttcacgctagtggagagctcgcagcatgtactgtacgcaatgtaacaatgatccattttagccgtgttgtattaatgatcggttggagtgtccttcctatcttcactttggtcttgcccatcgggggccgctttgatacctccttcctctcgatgatgaccagtcggcgactgattggaatgtaagccgcggaattagtagcgtactggtacctctttaacaaactgtattaatcggtgatgctgtgagcactcttgtaaagaaatcagattgctggctttgtaagcaccggccaaatacgagtaagcatttcagtactgttaaaaaaaaaaaaaaaaaaaa

SEQ ID NO: 34287 - DNA, 985 bp, Triticum aestivum
  Clone ID: PAT_TA_34287
gccgaattccgggtcgccccgcgtccggcctcctcaccgtcctcctcctggtcgccgccgtcgcctccgccgtgctggccgccgcgctcatctaccttctcgcccgccgccgccgcggccggcccgagcctgaacccgaagcgccccgcgcccacggtgatcagggcctcggcgggggcagtccatccagaggagtcgccgcagtcggaggagaaggacgtggactccggcgcggctgctctaccaaagctgaagccgctgcactgggacaagttccgcgcgagctccggccgccgacggtgtgggaccagctgaaggcgagctcattccgagtgaacgaggagatgatcgagacactgttcgtctcaaactccacgaggaggatgcccaagaacggattcaaggaggcaaatggggcaccctgcaaccaggagaacaaggtgctcgacgcgaagaagtcgcagaacatcgcgatcatgctgcgggcgctcgacgccaccaaggaagaagtgtgcaaggccctccttgatggccaggcagatagcctaggaactgagctgctggagatgctgctgaagatggcccctaccagagaggaagagctcaagcttagagagtacagggaggatgctcagtcgaagctcggccccgccgagagcttcctcaaggcggtgctcgggataccgttcgccttcaagagagcggaggcgatgctctacatcgccaacttcgattcggaggtcgattacctcaagaccgccttcagaaccctcgaggcagcgtgtgaggagctcaggggcagcaggctgttccacaagatcttggatgccgtcctgaagaccggtaaccggatgaacaccggcacgaaccgaggtaacgcgcacgccttcaagctcgactcgctcctcaagttggtcgatataaagggcacagatggcaagacaacgctcctgcactttgtcatcgaggagatcaccaagtctga

SEQ ID NO: 34288 - DNA, 680 bp, Triticum aestivum
  Clone ID: PAT_TA_34288
cggacgcgtgggtgacgaagcacctattgacatcaagttgtcttatctaccgcggagcttcctcgctgcgctggttgccgttcctctggatgtattgatgattactggggtggcattgtggaaaagcccctgcatgttgttgaaaggatggcaaagactctgcgaggatctagttgggagggaagggccttttctagagactgtttgtgtccctttcgctggtttggccattatattgtggccgcttgctgtcgttgcaggagtgattgcatcattccttagcagcttcttctttggcctccatgctggattggttgcttatcaggaggcttcatttcaaatggggctatcatacatgatctctgcagtagcattgtatgatgaatacacaaatgatcttctttatttgagagaaggttcttgttttccaaggcccaagtaccggaaagcgggttctgcgaagtatgagaccggccgcgacaaagatgagcacaacgttacagctgcatctgcagagaagcaacatcaaggccagcgtaagcataggagggttctacaccggtcaaagacattcatggaaactatccaacgactaagacccattcaaatatgggattggctcttccgatcttgcgagataaatgggaggatattactgagcgaggtcgacgcggccgcga

SEQ ID NO: 34289 - DNA, 1041 bp, Triticum aestivum
  Clone ID: PAT_TA_34289
ccacgcgtccggcacaatcttccggtcaccatcggagccggcgaccggtggcaaccgcgcggggacgccgttccctctcataactgtcgcacgccgggacgccgcgcgatctcctacccccacccccatcccagtctaccacagcgacaccgtgtgagatccgtgcttcatcggtaggctcagttggtgccttggtggactagtgaactgaaactgtattaatatcttcaggctctggtgcaatggcctacgagatcagtgagatcaaaaaaattggcataggtctggtgggctttggcatcctgttctcgttcctaggtgttatccttttcttcgacaggggtttgttggctctgggtaatattttcttcttgactggagtaggcctccttctcggttggcaatctatgtggcagctatttacaaagaaggcaaacattaagggatctgtacctttcttccttggtctctttcttctatttgtcagatggcctgttgctggtataatcctggaactgtatggatcttttgtcctcttcagtggttacgggcctcctatccaagccttcctatatcagattccaatcattggatggattctgcaatgcccctttcagctatttggtctgaggcgtaagcgtgcttgacaattatggtggcagaaattcatgataattcatggggaaatagtatattgcccaatgttaaattgtcagtagaaaattcttgtagccttcatcttttgtaactatgctctttaacactgcatctgcatgacatgggctttctaaccttggttgtgatgacttctatttaatcaacactcagtagatgatagtttaatattttaagttcatacgtcaacaaagtaatgccatcaaatatgtggctggattatgggttttgtttggacttgagagacaccgaccttcgtccctcgttatgccgtcaacctgacaaactgcacagcatactattgggtcttgtgtatgtgtttatggatccagctcccccttatttttcttattggtaaaaaaaaaa

SEQ ID NO: 34290 - DNA, 950 bp, Triticum aestivum
  unsure (1)..(950): unsure at all n locations
  Clone ID: PAT_TA_34290
ctgctgcatgctgaagcacgaagcagcgacggcgaccacgggcatccactccgtccagagcgccatgtgcggggccatgcagcggcagatgcactccctcatcgggctgctctccgtgctgcagcacgacgccgccgacggcatgcggtccgagcagaggctcgtcgtggacgccatcgcccggacaagcgcgctctcgctgtcgctggcgaacgacgcggacgcggagacgctgacgatgagccgcgtgccgttcgggctccacgcgctggtcagggaggccatggccgtcgtgcggtgcatgtccggctgcagcggcgttgaattctcgcaccactcggagaactctctgcccctgcccctgcccgagtgggtggtcggcgaccagacgagggtgttccatctcctgctgcacatggtgactactctgctaggtcgccgttgcgatggcgcggcgccgggccggctcacgttctccgtcgagagctgcaatgtgggcgaggaggagaggtacagccgggacgtgatcccgatgagaccatctgcaggctgcagcatgcgtgtcaagtttcaggttgggatgcaaacgaagtttccccgtcgatcggccagctccgacatggggcttagcttcggcatgtgcaacaagatcgtgcagatgatgaacggcagcatgcgatcgtcgggatcggacggaggaagcatcatcaccgtcgtcctgcagttccagctgcagcagtcgggcgtaccncgnaagacgtcgccgncatccatccctcgcttcgacggcctgagggtcctgctcgcggacagcgacggcacgagccggggggtgaccgggatgctcctcnagaagctcgggtgccaggtgatgccggcgccgtcgggagcccacttgccttcgcctgctggggagcggcgggggcggttttcgngttgggggtttttgg

SEQ ID NO: 34291 - DNA, 700 bp, Triticum aestivum
  Clone ID: PAT_TA_34291
cccacgcgtccggcggccgttgtagtgctgtcgagaacagtggagaagctcggcgtcaggtttagggtgctgcggagggcggtgactgatcctatcagtgagacagcaacattagccgaaaagaattcagaagccactcgaatactagcagcgcaaggaaatcttctcgagaaagaaattggctcgatacagaaggttctatacgcgatgcaggaacaacaagaaaagcaacttgagctaatccttgcaattggggaagcaagtaggatattagatgacaagcaggacttcttaggccaggaaactgctatatcttccagttcagctccagattatgcaaatataagggacccgaatatcaatggaacatcagatttttaggcacggcaaatcgaatgtttttatggcaatttacgttggcgcaaggatggcaactaaacttaccaccctcggcaaacataatttgtcatgaaaaacgtttgatttgctatgcctaaaaatctaatgttagttttttttagcatttcaaaatataaaagctgaaacacttgcaggcggcaataaaacccctgatttcatttgccgaaacagaagctatagaagcgtcataagcctctgcagtaaggttttgtaccatccaaatagtgaagaggaatagatgattaaagtggtttccctgacgaataaaatcactgctttg

SEQ ID NO: 34292 - DNA, 788 bp, Triticum aestivum
  unsure (1)..(788): unsure at all n locations
  Clone ID: PAT_TA_34292
ccagcgcgtccgcaaggtggtcgcctgatgaaagaagggtctctgaatctccatcctttctagcgtagcctagggctggactttgttggcactggaagatatttgcctagcatcggttatcgggggagaaggagctgtggaggccgaaggaagctcagcaaggagacctcggataccaaagaagaagaagaagaagaagaaggaaggtaaagaagctcataaacatcgttgattgaaggaggcagggctccgaggcgcatagcaagccgtactcccagaagcagatacgccgatttccagaactttacagaatggcagaaacgagaagagatcaacaagacaatgaagacatttaaacagctccacccaaactgcacaaagacggacaaggtgtcaatgcgaggtgaatcgatcgattaactgacttcgcgccagctgcacctcatgatgctgatgtgggggaggggggggacgggatgcctcctgtgctgcctccggacctgcacaagtacatgcactacatcaccacggatcccggctgccagcctgatgcggagcctcccccgcagccgccgcggccgccccatgatcaccccccacgccacgccgcagcgggagtcggatttcctcagccacgatgcacgaaccacctccaacccttcgaccaagcctcaagatcaacttcctcaagcccgcctaaaactgcaactctacaaccccgggagcaaaagggtaattttcagcaacaacaattgggcanaaanggnggctgggttcccggnnaagga

SEQ ID NO: 34293 - DNA, 616 bp, Triticum aestivum
  Clone ID: PAT_TA_34293
ccgtgctgttcgtcgtgcaacggcagcccggcgagcggtgtctccgtgactccggccgcatccttcgaccctgcacgggggcggtctagagttttctgggcagcgtccgcgcgaccgctccttcgacgtcctcgacatcatcatctccggcgagggctgcttcgtcgacgtcctcgacaacatcgtctccggcgaccgctgcttcctcgacgtcctcgtcgacatcgtctccgccaccgctgcttcctctacgagatcgtctccaacaaactccatccacgaacaccaagtgcaccgacgtctagactaaaactctagatcaatttgtcatggatgctcatgttgcggaactgatgaaacctgaaaagtttgccggtgacaacttcaagagatggcagtccaaggtgcgtcactacctcctgtccaagggcctgtggtggattatcccacaggttaggccgctgactcgtcagcaggtaatggactttgagttagcaaacgacactgttgtggctgtcatcttgtcgctccttgagaaccagctctatgatgtataccatgggtacacctctgcaatagagctttgggatgcgctggatcgcaagtacgcggtctc

SEQ ID NO: 34294 - DNA, 872 bp, Triticum aestivum
  unsure (1)..(872): unsure at all n locations
  Clone ID: PAT_TA_34294
gttactgctattttcttttcttggccacggctgaacaaaatacacacaactgagagggcaacttggtatagtatttactatttaagtctacgccaatatatatatatagttagccagttccctggtaaggggatatcatcgcattttccgacatacgccaatcagtcagactgcttttcctccaactgttgatctgtgctggatttcactcctcataatggaagctctacatatgcaggaagccgcggcgatgggcgactacggcagcgcgatgacgcggggcaacccggacggcggctcgcagggccgcccaaagggagtgccccgcgccaacgtccagcagctcaagctcatggggcagggccacccgacgggcctcacgccgaacctgctcaagctgttcgaggcgcggcctatgctcgagcacaagccgcccgtccagaagcgcaagttgccggcctacacggggatggcgcagtttgtgtcgcggtttgccgagcctggcgacccagagtatgcgccgcctgtcccaacgtgtgagactaaggccgaaaagaaggatagaatcaggaaacttaagcttgagcaaggggcagataaggtcgccaaagagcttcagaactatgacccacaaagtgaccccaataccacttcagatccatacaaaacactcttcgttgcaagacttaattatgagacatctgagagcagggttaagcgggagttngaagcctatgggcctattaaaagggtacggctcgtaactgacaaggatacaaataaacctagaggatatgcattcatagagtatatgcatactcgggatatgaaaaatgcttacaagcaagctgatgggagaaaagtggacaata

SEQ ID NO: 34295 - DNA, 665 bp, Triticum aestivum
  Clone ID: PAT_TA_34295
gtcccactctcgccccccctctctggcttatccctctcggctcccacctagggttcttgccgaggagaaaagtcaaagatcgatccatgagagtgcctaccgccggcggggagccactccggcgtgtagatccggtggtcggccacctcaagatctactgaaatctttcagcattgcccccttgctcctgttctcgactcccggccaatctctgctgattccgaatatctcctcctccggttccgtcctttccgagatccccgttgttcagatcgcgtgctggaatctgatggagaattttctcacgaaatgttcggttgaaagcgaccttggctgaattgttgattgcaaagctattctggggaatcagtcgctgttggctgtatcttttttccttttctgatcctgagtagaaattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcgaaggaacttccagctaaggacctcactggaagttgtgacccgtatgttgaagtgaagcttggggaattataaggg

SEQ ID NO: 34296 - DNA, 713 bp, Triticum aestivum
  Clone ID: PAT_TA_34296
caggtcatctctgcgataaaggttgtcttggggaagatggatctaacagaggggccaagaaacttgctcagattcgggagaacagcaattttttccgttcagagcttcagaaaatgggttttgaggtgctgggagataatgactcacctgtcatgcctatcatgctttacaatcctgctaaaattcctgcattctcaagggagtgcttgagacaaaatgttgctgttgtgactgttgcatttcctgcaacgccactactacttgccagagctaggatatgtatctcagcttctcaatcaagggaggatctaattaaagggttggaggttatcagcaaagttggtgatctcatcggaatcaagtacttccccgttgagcaagagaaggttgcatctgttgacaaacttaagaagcttgagtgaatagtgacaatggacaattggaagaattctgctgctgttatgctagatctactgggtcatcttggtagtgcaccttgccttggttttgctcttttgtgcacctcaggacccttcattttcctttgtctgaagtggttttgattttgtacagactgtattatcatccatcatagtttgaaacttaacacggctctatacactgttttgtcgaattcaagaaaaaagaaatccctgtacaaccttgtaagtgactgaaatcatgtagatactaatttccttattattactgac

SEQ ID NO: 34297 - DNA, 4506 bp, Triticum aestivum
  Clone ID: PAT_TA_34297
cgccatcggaaacattggccggtcgccaccccacgccgccgttgacgaccccgtcgcgcgcccaggcggccaataaacaccgctcccgcccccccgccccccgccgcgtgccgcgtcgaagggagcgaggaggaggagcgaggaggaggagcgaggaggatggtgaggctcccgtacctgaccgcgctcaccacgctcttcagctacggcctcctcttcgccttcggccacttccgcgacttcttccgccggatcctcgacgccggcaaatccagcaacctcaagggttacgcgcccatttgcctggggtacgaggatttctacacgcgccgagctggcttccgtccttacattcccctttttcctatccatcctctgattcatggtataaacaggtttttcgcgtatgccggccgaactctttcaggtctgctaatccgtatagagaagaatacaacatgtaaaatttcaaactgatactactagatttggtagggaatattcacccgagccaacagtgcgaacatttgtcccacactttattttcgagtaggcacaattcaactgctacatctaactatgacccgtagcaaagttgtcctatagcttcatctgaacagcaccacctctgaatgaaccatataaaggtctcgacctcctcatgcggaatgtatcagttattccgatgaggctccggtggcggagcctcatgaacgatcttttcggccctcctgcggccagtgcgcccgatgcttggttcgatgtagttgagcgtcactcaaatgatggcaacaagacactccaacgtaccacaaaaacatccaagtgtcttaacttgggttcctacaactaccttggttttgctgcagcagatgagtactgcactcctcgtgttatcgagtcactcaagaaatattctgccagtacttgcagtgccagagttgatggaggaaatactaagctgcacacagagctcgaggaactagttgcacgatttgttggcaagcctgcggctattctttttggcatgggttatgtgacaaattctgcgatcattcctattctgattgggaagggggggctgatagttagtgattcattgaaccatatttctatagtgaatggagccaggggttcaggggctactgtccgggtttttcaacataacaaccccgcacatttggaagacgtactgagggagcagattgcaggggggcaacctcgtacgcacagaccatggaagaagataattgtgattgttgagggaatttatagcatggaaggggagttatgcaaccttcctgagattatggctgtctgcaagaaatacaaggcttacacatatttagacgaggcacacagtattggagctgttggaaagactggaagaggtgtatgtgaactactaggagtggatccagctgatgtggacatcatgatgggaacatttacaaaatcgtttggatcgtgcggaggttatattgcagcatcaaaagagatcattcaacatctcaagcacgcatgcccagcccatatttatgcaacatccatgtcgcctccagcagtccagcaggtcatctctgcgataaaggtcgtccttggggaagatggatctaacagagggggccaagaaacttgctcagattcgggagaacagcaattttttccgttcagagcttcagaaaatgggttttgaggtgctgggagataatgactcacctgtcatgcctatcatgctttacaatcctgctaaaattcctgcattctcaagggagtgcttgagacaaaatgttgctgttgtgactgttgcatttcctgcaacgccactactacttgccagagctaggatatgtatctcagcttctcaatcaagggaggatctaattaaagggttggaggttatcagcaaagttggtgatctcatcggaatcaagtacttccccgttgagcaagagaaggttgcatctgttgacaaacttaagaagcttgagtgaatagtgacaatggacaattggaagaattctgctgcttttatgttagatctattgggtcatcttggtagtgcaccttcccttgtttttgctcttttttgtacctcaggacccttccttttactttgtgtggattggttcttattttttttatattgtattattatccatcctagtagaaaattgacattactcttgaatactgcatcaggcatttcgtgtagtgtgacttcaaacatcttcaggaaagcttcaaccctggcatccagattggatggatccttcacggttgactggattataaattgcaacccacggactcctgaatcatttctctgtctaagcagtgctatgtaaccaagttgctcgaccgaacgtaattggtgaaaagccggttgcttagctacaacagcaagcaactgaagtaggacattttgtttgagatcatcctgatgaatctgaatataatgcagaagagaagaattttcatcctgctgattcaagcacattgctggataataatacctcaaacccctttcaagcttaacaattcgctttgtaagatgctgggacggtggtaatgatttgcaaacacttgtggatgaattaaacaatatgccttcactctgcccgacagcaccctccgcttcgcttggttctttattcccgccaggcttgccctcgatttatgtctttgccgccatgccaggcttgttttcccctttcttgcgagcttcaagattagaaagtgcagcaagttcttcatcccaaggccaagtttgctcctccaatatcaatgtgcaattgtacattgcttgctgatatggctgctgaaatttaaaattctcataccccttcgttatagtttcctttatcacagaaaagcggtcaatcttaacttcaaagtctgcaattttgccaataacagtgtccagaagggttctcattttgtcattatagccaaccatagtaacctgaaaaccggtgtcgttcggcctaacagcataataaagaccagcaacttcagcatcataagcataatcattcaaataatccatcagcaacctagtgaatacgtcagtatgaactgatgattcaggggagctattggacagaggacagtggaaatccatcttgatgaagaccttgggtgtgaagaacattgtatcgggcttgtaccacaatctggaaaacagtgttttcctcagcatgcaaggaaaacttgtcttttcctcaacatttttcaatgaaagatcagttggaatgaagatattaggttttggcaggtgtaaatcttcgttgggagcattttctacccatttctgcataatggaaggaggcactgcttcaacacaatatgacgtaccataccaaggttctgttaagtctgtatgcccttcaaataattttgactcccagaatattctaacattctctgtagtcaattcatttagcaccttctgaatagcatctggtgaaaactttgatggtacagacgacgcgatcagccaatcttctggtggaaaaatctgcatgtttgaggaaatattgacaacataattgctaggagggctcttgtctcgatagtggaatcccgtctcgcagatggctagaagctcatcaaaaatccactttggagttccagaggtctgaagcaatgtaatgtatctgaacagcaacccaacgacatcctccatgtgctcatggcctacatctgtgagctgtataacgacactgaagaaagagaaatcataactccaatccccttcccctgcttccaaactcatagcccatcccaacttttttagtatgtaaaagagagatccttctccttcatgaccgattagatggctcacatacctacaaggaccttccttgtaatgcctaacatttggagtgattggccacagtattcgcaaagtatgaccttgttttataggaaccgctttaacaaggatctggagatctttgcttgaacatggatgaccaggaaaagaaaagtgcttcctcccaacgttcttgatatcacagaacttactttcgacaagggtttggatgttgtcaagactctcttttccatacacagcaagctgcatcaagttggctgagtagtgtgaatcatagaaattaataagctcagcccttgtgtccaatcctttctcctttggtttaacctccagtgtgtcccaatttccagtgctgaacttgtgatatgggtggttattcgagcaaagatgcttctggagctgactcattcgccatggatctgacaatatatttttctggttttcagagtcaacagcttttatctcccctaagggttgcctcgggccgcatccatggctttataaagaattgtgcgaacctatctaaagcatcatccaggctgtcattgttcacatcaaaatagaagtttgtgtgttcagaggttgtaaaggcatttgtcgaaccaccatgctcagcgatgtacttgagtaactgtcttcgataggatattttcggacgcgtgggtcga

SEQ ID NO: 34298 - DNA, 733 bp, Triticum aestivum
  Clone ID: PAT_TA_34298
ggcgagcctggccacgctggacctgtcaacgtcggcctcgccggcaccatcccggagtccatggcggcgatgcccaggctgcggttcctggcgctggaccacaaccggctctccggcgccgtgccggccaagctggccgcgctgccgagcatcggcgccatgtacctcaacggcaacaacctgacgggggcgctggagttctcggcccggttctaccagaggatgggcagcaggttcgcctcctgggacaaccctggattgtgcacggcggagacggccggcggcgcgccgaccggcgtggccgtgtgcaaggacgcgcaggaaccgcctcgcgtcggcgtgagggacgggatggatgcggtgggggggaagcctgaggcgagctcgagcttcccggcgtcctcgtcgtcgtttggcctctcgggtcacaaggtcgccggcctctggtgcttggtgatggtgatggtgttgtaggcggcagcgagttcagatttactgatagctgcaaaggaggggacggcgaagaaacttatatagttaatttggccgatttgtttccctggtgtccttctcttttggcattttggctggtgctctgctctgctctgctctgtctactagggtgaaggaggaagaacagaggcatgaggagtcttaagtggttgctgacagacaggtagtttgttcttctggttgtaattaggcctgtttctgtgtcaagttagaggatgtg

SEQ ID NO: 34299 - DNA, 1324 bp, Triticum aestivum
  Clone ID: PAT_TA_34299
cggccatgggatcccagccggggccctcccgcgcggccctggagcccttcgcgacgctggacccggcggcgctggcctccctcccggcctccacgcccctcaccgtccgctccgccgccctctccgcgccgagcctcctctacatcggcacgggcggcgggaagctcctcctcttctccctggcgaccccctcctcccccgagttcctccgcctgctccccatcggcgccacccgccccgtctccgccatcttcccgctcccctccgtcgcccgcgtcctcgtgctcgccgacggcatgctcctcctcgccgagccgcacccggacgcgacgacccagaaggcggacgcggcgcaggcgacgggcccggctggggactagcgggcgacgtgggcgccggacgggagcgccgaggggcgcgggcgcgccacgacctccgcgcgccgggggcgcacgggcaccgcaggatgccgccgcgggcaaggcccgcgccgggaaggccgcggcgtgggaggggccggggggccgccaaggacgccacagggcaagcgcaggggaaggggaaggaatacgacgacgtcgcggcggggaaggccccgaacgtgaaggacgccgctgcggagaaagccggcgcgaccaagcagacggccgcggagaaggcagcggcagcgaaggataccgccgcggagaaggccgcggccgccaaggatgccgcgtggaagaacgccgaggcggccaagggcacggtcggggagaaggcaggggcggccaaggacgccacgttggagaagacggcgtcggccaaggacgccgcgtgggagacggcggaggcggccggggacacggcctgggagacggcggaggcggccaagggcaaggccaaccaggggtacgagaaggtgaaggagaaggtgggggaggtgaaggacaaggtcaccggcgcggcagccgacggcaagggcaagcagcaccgcaaggacgacgagctgtgaatgagcaccacccctctgcatttcttgccacagttcttcttacatgaatgtttaccgtgttcgagctagtctttttttccttgggctgttcctcttgtacaataatgtgaccatctgtagagaaccctccacgagaagaagcaccgcaaggacgacgagctgtgaatgagcaccatcgttccgcatttcttgccatggctcttcttccatgaatgttttcagtgttcgcgctagtttttcttatgctgtttctttttgtataataatgtgatcatctgtagagaacccttcacgatcaaacaagttccttttgaaaaaaaaaagacgcggccg

SEQ ID NO: 34300 - DNA, 735 bp, Triticum aestivum
  Clone ID: PAT_TA_34300
gtctgtgtcgccaaccgcccaggctccactctcgctgcctactactcctcctactccggtggttgatacgtcaaggatctggtcggcggtgagcgtgtccgtttagtcggtggtggtggtgcgccggcgccatggggaggactccctgctgcgagagcaggcaggggctgaagaaagggccgtggacgccggaggaggacaagctcctcgtcgactccgtccaggccaacgcccccggcaactggcgcatgctccccaagctcgccgggctgaaccggtgcggcaagagctgccggctgcggtggacgaactacctccggccggacatcaagcgcgggcccttcacccccgaggagcacaagtccatcctccagctccacgccatcgtcggcaacaagtggtccatgatcgcggcgcagctgcccggccggacgggccacgagatcagaaatccatcgaacaccaacctcaagaagcagcgcaacaaggcgtccatcgtcggcgagcagcaccactgcgcccacggacaaccaggcgccgaactacgggaccacgcacttcaagaaccccctccgccggatgggccccgccgcccccccgcccggcccgaccgccggctgccccgccgcgcgccacatggcgcagtgggagaccgcgcgcctggaggcagaggcgcgcctctcactcctctcctcgtccggcgccgcggcgacggccaccacctccggctccgcg

SEQ ID NO: 34301 - DNA, 720 bp, Triticum aestivum
  Clone ID: PAT_TA_34301
ggcacgttcctggtgggggcggcgtgggcaggctggatccggctggatttggcctgcggtggaccggatctggtcatgtgtggcggcgggctgcagtggaccttgctctgcggtggtgcatgaagcagagtatcgcggtgtaccggtgctcctcgaaggtggtctgctcacttgggtgaaagcctctgctccgaccggagccggcgatggcggcgcccgcgggtgtcgcttacctccttggaggcgtcgctgtcaaggtgactttcccttcgaagctccaggggaaacccttgttcctggttcttccgaaacgggcgatggcggcgcatttttgtgtcgcaatccttcttaaaggcatcgttttggtggatttgtgtggtcgctgctttctgcgggtcggatggtggtggtggtgcgactggctggggtcgacggtggtgtggtcggtgtcggtgaggaggtgctgctttgctcatgtcttctaggcttgaccattcattggagtggtttgattcttccatcagaagccgggttagcggggtgggatcctctctggaccacctcgttcctgtacgacacctctcccctctacggggtgttgttgggtggcgaccagacgaccaacgttcaaggctctccttgattggtcagatgaagatggaatttgggaacctatgagaaacccctaacacaggtccttctggggcggatgatggcggc

SEQ ID NO: 34302 - DNA, 744 bp, Triticum aestivum
  Clone ID: PAT_TA_34302
gctgtttcttgatccccttttcatttccttccttcctctcgctcctccttccacctgatgagctctgactgttagcgctgctcaactcactggtgcggccatggggtggccgtctacggtgcttggtttggctcctatactcgtcgatctctcagaccggtcaacggcgacggagtggtagcagggcccaagggagaagcggctcaagggaggaaacgagctcgtcgatcctgacggcgctgttgccgtcggcgtccatccaggtgatgtgggtgtggatcttgtctcccgcagacaggttggatccaccttgattgtgagatgctgacggtgttgttttcgatcgcatcgtcgctgcctcccgagcgaggcagcccggtaggtcatcttcatcctggactggcagcctgatttcggcagctcattcttccacttgcagaagtaaaggagatcaacttccaagatcagtgattgtggtgaaagctttaatgttaaagtggatgttaagtttcaatcatcatgatgaagacacatatttgtgagggtctgttacccttctgttgtttttagatgatagtctatatgaaaccatatatgggtgaagaattagattgtaaattagaatggcaagttcatgcacaattacgattgaagaatcgcttacgaatacgattaatataaatagactaatacgaatcttgtcttgtgttgtttttttgaaaaaaaaaaaaaaaaaaactcgag

SEQ ID NO: 34303 - DNA, 687 bp, Triticum aestivum
  Clone ID: PAT_TA_34303
ccccggttctgcccccccgcacggaggtgccgcactgccgcggtcgctttctccgtcctacggcacttccgctgcaccggcccgctgtcttcctccagggttctgggatccgacagtcccgcgccgaggcgctccctgctccggtgctcctccctttccgcgcactctatcccagagcacgagcaatgcgaaaaaaaaaacagaaacctgcgctctagtggtggtgacgaaggcgggataacttctggtctatcaagtagacacccattctcgattcctaagcgcaatggatttgtttctgttggcgaaagctgtattctgaagacaaatcattttaaaccatcgacttattgtgacaatatttaccgatatgaggtatttatgaactatgagtttctgtcatctggcccctctcatgctaccgccatctcatgtggtgtcaaacgtgctgttatgagaaagctttgcaagatgtatagggaatcacatttgcgtggccggcgtcctgcatatgatggaaggaacaggttatatgcatctggaccgttttcatttgaatctgagacctttgttataacattacaaaatgaggaagatagtcttgattatgggcaaaccccacagaggcccacgacagtggttttctgtcaccataacttacaatgcatttttgaccggagccattgc

SEQ ID NO: 34304 - DNA, 1635 bp, Triticum aestivum
  unsure (1)..(1635): unsure at all n locations
  Clone ID: PAT_TA_34304
aaacagggggccccaaagaagagnaaagccgncgcttgcctttggtgaggtttcagtctctcaacgactaccctaacctaaaaatgcagaaaccaaaagggttttctcatctcatttgtagcaacaaataattgcactcgcagaagtactgacaacattcgtgttcacataaactagaagcaatacgagatctaccaaagagaagtatcatacaccatacatcccctataacgccacacatgaactgttcctatcatatataatcatccttacagtgatgcatgcactgtatgaaaaaaccaatggaggagaaggatttaacaaggaagaaacccctccaaggaccgtatcccaacgactagaattagcacggccgatccctctgctaaataccaaaattgttctagcatatccacttcaaaggatctgatgaggtggcctcatcagatgcgttactcccttttattttcttcgtcgtcttcgtcaaaagatgtcacactatctgtgttcttcttcgctttggcgtctgttgacgaagctacgctccacccgttgttggaaataatgggccttggccttattaatgacaggctgtcctctcgatcaaacttttcacttgcgtcattggtaaatctcattgagctctgagaaggtgcccacaggtaggaaatgacgcaaagaagtgagaatgatagggcatgccagaaagcaggaattatccatgcatactgccaccgctcattgaacacatctgtcgatttgaagtaaatctcgtagccaatccagccgatagataccagaacagtaatagccaatgcaatagtgaatttcctataaatgtcaagtttggccatcaaccttcttgcctgaagttggctaagggtcttggctagagaaataaatatccaaacaatgaatgaagcatccaagatagccactggatagaccaaaaatagccgagcttttccagacagatcattcacagtacctagattttccactagctcaagaatttctgtagctacaaagaatgttcctccaagcatgaccactttcgatgtcagaccacccaaagtaggcctcacaactccataccccatcgagacaatgagaataataagacgagccactgttcttttaatagtcccaaatgttacagcccaaaatgtgatggcctttgcccgaactccagtctcattgaactcagcatattcaaaataccacaacgccatctcaagcatacccaatgtaataacaagagtaatacagttctgaagtggaagaacctctcgccagaacttcatgtattgatagaaccagtagataccaagtatcacgaaagcaaatgacatcagcccaaaaaagttcttaagaggtgccatccgacctggaaggtagccagtaggatttttccatatggttttcccgtcgatttccagtccagcaagtgccgggtcacagtgtataaagtacatgttgtacatcccagttttctttactggaatggtccttgaaggcagcgttgcaatcagatctcttccatcaaaagaagcaacaaacaactgtgtcagacaggattcacatgcgatgggcggtagatgacagagccttcaactcaagctaaaaaactttgca

SEQ ID NO: 34305 - DNA, 1102 bp, Triticum aestivum
  unsure (1)..(1102): unsure at all n locations
  Clone ID: PAT_TA_34305
gttcttccttctctctcagctttggtgcagcagccgctgtctgtcaagttcttggtggagatgcagctgatgctcaaagcgattcatccgggagggcctttgacactgccaacgaaggggtcttcagcgttttaaccactgaagaaaggtcttcagtggtttatggcaggagacctgaagaagaacaagcaactttatctaaaaatggaagagctagctagcaccatagagccccagtccacctccaagatcaagttctatacgcaattcaccgatagtgaaagtagaggaatatgaagcagtaaatataatgttggtccatagagccctactttttcattcgttcactggaagaattttgtagtttcagactggcatcaaagccgaggttggagcggtgatagcggctgcagtgggacggacggtagcaacaataagaaattcctcatccatgcctccaacaaaaagggtcatctgggccctatgctaccatcgcttgagatgatagtagtgcgagctattcacaagctctatcgagacatggaaccgaagccgtgaggctgacatcatcattttgtcagactaagtgtggagttgcaagtttgtaagtggccttggaatcctgttcactgttggaaactgctggaccttgctgttgttgtttggttcataaggtacgctcttgagaaatcgagcaagctgcttagcttttgatatattcctttttgccaaacttgatgtgtcgagctttgagctacaaacttgatggaatgtgcttggccatggaagagggggtggcactatctttcctccttcaatcagggtgttcctccagctgtgattgatctggtgtttttcctcgcttgtggagcttctcttgttcccgtcgacttctattctcattgcagctctgcgcatggtgggtaacattgccactggtgatgatttgcagactcggattcgtgtgaggcaggtccctgtgaagtatatcgacaaggcagatgaattacgccacttgntagtatgcttaatgattatgtcttcgtagttggctcttcttatggtgtttcgcttttgtatcgaacttcgtgttgaatggtcg

SEQ ID NO: 34306 - DNA, 1236 bp, Triticum aestivum
  Clone ID: PAT_TA_34306
gcggaggagcacgtctccggtctccccgattccgttccggtggtggcgtgatggggcccgctgactggccgagcgggtcagcgagcgatgacgacgaccaagggagaaggggaacggcgctgcagcggcgtgttggggcctagggagcaagcgacagacgcgatatgcaggctggggccaggagagctgactagagacgagggttggggagaccggaacacccggcacaccctttagctacgccaatgccgctcaagctctgtcgagacatggaaccgaagccgtgaggctgacatcatcattttgtcagactaagtgtggagtttcaagtttgtaagtggccttggaatcccgttcactgttggaaactgctggaccctgctgttgttgtttggttcataaggcgcgctcttgagcaatcgagcaagctgcttagcttttgatatattcctttttgccaaacttgatgtgtcaagctttgagctacaaacttgatggaatgtgcttggccatggaagagggggtggcactatctttcctccttcagatcagggtgttcctcctgctgtgattgagtctggtgtttttcctcgcttgtggagcttctcttgtgcccgtcgacttctattctcattgcagctctgcgcatggtgggtaacattgccactggtgatgatttgcagactcgggttcgtgtgaggcgggtccctgtgaagtatatcgacaaggcagatgaattagccacttgttagtatgcttaaagatatgtctccgtagttggctcttcttatgtgttctcgcttttgtatcgaacttcgtgttgaatggtcgttttttatggtcggatgaacgcatcgagtttgatcttgtatataatctcatgttgatcttgagatccactgtgttttacttctgtgtttttggagagctgactgtacaataaaatgatctacctcgcagtatcattttttcacaaaggaagaaattcggagtaattttcgctcttcatgttgtgagagaacctgttcagtaggatgccaacatgcatcaggaagccaacggacagccagagctggaaggcatggagcttgagctgcagtgacgatgacaacttgggtgtcagctgcaaaaaactacagttcaaagtgttcaaccaagtggtgaattttgctgtgatttccgtgtgtccatccaaaggaagtagatgattgatagagattcagagggagcaattga

SEQ ID NO: 34307 - DNA, 610 bp, Triticum aestivum
  unsure (1)..(610): unsure at all n locations
  Clone ID: PAT_TA_34307
cccagtctttcgctccggcgtgtatgtgctgctgtgcccccgccaaagcgccgagtatctacgcagatatcgcagctggtgcccgctgcatgccaaaagcgcagcccgcacgtctaaagccgacgaaatccttctgcggctaaaggctaaagctgccactctctgcgtctgtctggctctctctcgaggcgcgctttgttgcttgttcatatactggcgtttgccatcacgaaacatagtacagatcgactacaggtacgcacgcacaggccgcgtgttatcctgcagggctgaggagtgaagtgagccatcgtcatggcgggaaccttacgtgcggcagtggccgcctcgccgccgccaccgtcgccgctcccgccatccaggggcgccaccgcgagcggcggcatcccgtggctgctcaggaagcgcgccagcaaggtgcgccacggcccgccgctcggcgggcaagaacctgacgtccacgatgaggtggaactggaagacgagggagccaccttcgtgctctctactccgtccgccgcggacgctgttggggccggaggaggaacccncgagccgtcagggaagcgccgcgaggcgctcgcgcggc

SEQ ID NO: 34308 - DNA, 1194 bp, Triticum aestivum
  unsure (1)..(1194): unsure at all n locations
  Clone ID: PAT_TA_34308
gacaccatattgaaagttctagtgaaacattttttcatagaaaaggaagttacataaccttagtaatggactcgctgtataccggactgaaggctctggaatataagagcaagaaccaagtggggttgtccaaattaacagagacagatgctcgaagcacttctatggtgcttgttgagcaggatatgtttgccttggcagatgatgtgttaattttgcttgaaagagctacattagacacactgccacaccaacaattgcctaccaaggatgaaaaagcttcacagaaccgcacaaaggaaagcagctcgggtgatgacttcaacaaagactctattgagcgcgatgacagacgacttatagagcttggctggaagacactagaattttttgccttggctcatatattcagtcgaattgaagtggcataccaagaggccgttgctttgaagcgccaagaagagctcatccgtgaagaagaagctgctgggcttgcagaaatcgaacttaagggcaaagcgtagtgctgctgagaaggaaaaacgtatcaggaaaaagcaggccaaacaaaagaaaaacaaccggaaaaataataaaggaaaaaatgaaagggttgacatgaaggaagtagctctagagggcagtccatcagatgatagaaaccctgatgatttgtcaagtcaggctgaagaagtgacctcaaatcctgacaatcctgatgaagcatctgatatctctgataacagagatgataattctgaggtgcttaatgttgatcttgaagactgtgaatccagtcctgttaattgggaaacagatgcttcagaaactcgaggcattgttcctgaaggtggtgatgtgcaaaatgagcaatcaggaaagaggcttcatttgttgatgatagctcgtctacttgttcatctgactcggttccttcagttattttgaatgggttgaatacaggtgggngcctggncaaatgtcaaatcctcatccaatanagggaccacccgnnggaataaggatnctgatttcgaacagggcntcccttggnggatcaaatccaccaccccatggnagttttggatctaccacctcnaaggccttgaaacttgaacntggggtnaccaaattccnccaaaaaaaancaaannnccaccgggatgtgaagttccagnccctccanataaaaat

SEQ ID NO: 34309 - DNA, 1598 bp, Triticum aestivum
  Clone ID: PAT_TA_34309
ctcgtgccgaattcggcacgagccgaggcgcgcccgcctcgccgagatcgacgggccgacgcaacccaggccgagcgagcgagggaagcgatacaacccaccacaggcagcggccccggcgtcgcgttcgcgtgcggcggatattcggacggggcggcataacacccgggccgaacgggtcgcgctctctctcccggcggtcttctccccggccctctggcgatggcgacggcgacggcggcggcggtgtgggaggaggaggcggaggtggagaggccgatgctggaggacgagaggaaggggaagcagggcaaggggcgccgctacggcctggtcgactaccgggcgctgccggcctacatgcgggacaacgagtacatcctgcgctactaccgctgcgagtggccgctcccgcaggtgctcctctccgtcttctccatccacaacgagaccctcaacgtctggacgcacttgattggattcttcatcttcctttctttgaccatatacactgcaacaaaagttccaaatgtggatcttcatagcctgcagaatttacctgacatacttaggaatgctgatcttcataagattcaggcagagcttgcggcatgccttccttcattacctcacttttctgatctacaaaagatgaaggatgaattgagaagctcatggaattctatcgatgtgcttccgtcattatctcgttggcgtctcttggaattactctcaaattgcttgccggacagatttacccattccaatgaaactaatctttctgttcttgaaagcatgaaggaggatattgtaaccgtaattgcaccacactttattaggccgatctctaggtggccattctttgccttcttgggaggagccatgttttgccttcttgccagcagcacatgccaccttctgtcctgccactctcgccgccttgcatatatcatgcttcggcttgactatgcgggcattgcagctcttatcgccacttctttctaccctccagtatactactctttcatgtgccatcctttcttttgcaacctgtacctcagctttataactattctaggattagcaactatcgcgttctctctgctcccggtcttccagaacccggaattccgaactatacgagcgtgcctcttctttggcatgggagcatcaggtgtgatccctgtttttcacaagttgatccttttttggcaccaaccagaggcactgatcactaccggatatgaaattttgatggggctgttctacggtgttggagcattggtgtacgcgactcgggtgcctgaacgctggatgcctgggaagtttgacattgctgggcacagccaccagctcttccatgtcttggtggttgctggagcctacacccactaccatgcagggctgttgtacctcaagtggagagatcagcagggctgctaaaagttgttctattgttacagggtgtggatagatttatttggttatatggttgtgtctcaatgatcaatagaggacctgttgaatctgggtaaagaatttactgatccgtgtaaagtgtatactaggtacaataaacaaggaattttaaggaaatg

SEQ ID NO: 34310 - DNA, 620 bp, Triticum aestivum
  unsure (1)..(620): unsure at all n locations
  Clone ID: PAT_TA_34310
tttttttctgaggacggctcaagatttaattcacatttgtaaaacatctttcacaggcccatacgctcgctatactcatcatcacaaaagaaaaagatgtcccactttttcagctaactacagtacattattttttatctctggctgaccgagggaacattccataatctctccccctccctgtattctccttttgcaaaccgcaacctatgggctactcgtttcatgtacacgcatgacattcggacagtcatgatttctcggggctctcctcctcttcttctagggtctctgctttgcctgggaacagcgcccccggagcttggatctgcacgatctcgagcaggatcttggggagggactgcggctttgagaagaaggggcagtgggtcgccgccctttatcttgaaaatgccgtcgggcgggtttcccgggaccagcttctcctgggacgtcgggcgacaacatccggtcgtccaagcgtctggatgaaataacgggggaccgtgcatanttctccgccgtcanggagagctcccaagatcgggcaaagggatggcccatggcacgtggggggggccggtaccaattcgcctangggagtctatacgcggccacng

SEQ ID NO: 34311 - DNA, 1762 bp, Triticum aestivum
  Clone ID: PAT_TA_34311
cgtccgcccacgcgtccgccggcacgtccgatctctctatctctcccaacccaaaccctaaccctcgaatcgaagcaaccagccggcggcgatggggcagggttctccaggcggcatgggcaagcagggcggtctccccggtgaccgcaagccgggcgacggtgccgccggcgacaagaaggacaagaagttcgagccccccgccgcaccgtcgcgcgtggggcgcaagcagcggaaacagaggggccccgaggcggcggcgcggctgccccccgtggcgccgctctccaagtgccgcctccgccttctcaagctggaccgcgtcaaggactaccttctcatggaggaggagttcgtcgcgagccaggagcggctgcgccccagcgaagacaagacggaggaggaccgatctaaggtcgacgacctccgcggcacccctatgagcgttggctcgctcgaggagatcatcgacgagagccacgccatcgtctcgtcctccgttgggcctgagtactatgtcagcgtactgtcgttcgtcgacaaggaccagctggagccgggatgctccatactgatgcataacaaggttctctcggtggttggaattttgcaagatgaagttgatcctatggtttctgtcatgaaagttgataaggcacctttggagtcttatgctgacattggtggtttggatgcccaaattcaagagatcaaagaggcagtggaacttccgttgacacatcctgagctatatgaggacattgggatcaggcctccgaagggagtcatactatacggggaacctggaacagggaaaactctacttgcaaaggctgttgccaattctacatcagcaacattcttgcgtgttgttgggagtgagttgatccagaagtaccttggtgacggccccaagcttgtaagagaactgtttagggtggctgatgatctgtctccttcaattgtctttattgatgagattgatgcagttggaacaaagaggtatgatgctcattcaggtggtgagcgtgagattcagagaaccatgttggagttgttaaatcagctcgatggttttgattcaagaggagatgtaaaggttattctagcgacaaaccgcattgagagccttgacccagccttgcttcgaccaggccgaatagacagaaagattgaatttccgttaccagatattaaaacacgacggcgtatctttcagatacacactgctaagatgacattggcagaagatgtgaaccttgaagagtttgtgatgaccaaagatgagttttctggtgctgatatcaaagccatttgtactgaagctggattgcttgccttaagagagcgcaggatgaaggtgacacatgctgacttcaagaaggccaaagagaaggtaatgttcaagaagaaggaaggtgtaccggaggggctgtacatgtgagactgttcacccctctcgccgccagcattacctcctggttcacatggttgtgtaatactggaggattggagtttgtgttttgtttaaaatggttggagtattactttcctgtacttacgttttattcagcaatccccaacttaaaacagccctccaagcaatgtactgcgaccacctgaaatgcagtgatgaatcaagttaatagtggttaaatggtgctctgctagtttggtcggaaggcacattttgtgtttgtaaaatattgaattcccatggcttgaaatgaaccattgattgatttttcttaaaaaaaaaaaa

SEQ ID NO: 34312 - DNA, 424 bp, Triticum aestivum
  Clone ID: PAT_TA_34312
cccacgcgtccgcccacgcgtccgcccacgcgtccgcccacgcgtccggtcagcaaatagcaagtgatacgagcacatctttttgatcagcttgccattgagacggtgtcgactctccagaggccaaaccgcgtggattttccttgggtcacaacttgctgcaaccattgttctttttaccgaatgttgatcatttgtgccaattcgaactgagttatatagttgaatgtggtgttgggcacatgaggtgtcctcccattatgctatgtcatgagagtcaaacatatgatgattcatacaattttgagcagattcatgccgagttatattgttacatgaggtcctcccattatgctatgttcaatcgactggtgataataagataaaaaaatatgagtgcagtgaaaactgtgccggttctgag

SEQ ID NO: 34313 - DNA, 1012 bp, Triticum aestivum
  unsure (1)..(1012): unsure at all n locations
  Clone ID: PAT_TA_34313
cccccgtccgaggactcgattgccggaggtggctgcccgtccccgtggtggtaccttgtctccccccggtcgggctccgcgtcagttaatgaagtcatttgccatggaattgctcctaccagaaaacttgaagatggtgacattgtaaacattgacgttactgtatactatgcaggtgttcatggtgatttgaatgatacatattttgttggaaacgttgatgaagcttcggaacagcgtgtctaatggacctatgagagcttggagcaccctttcgcaaacggtataccggagttgaagtttcgggaacatgactgcctccttcgtcgacaggcttccaatgttggtgccgctgtgatgaaatcttattgtagtcatggcataggagtatggttccactgtgccccgaacatccctcattattcaagaaacaaggctgttggtatcatgaaagctggtcagacatttacaattgagccaatgattaacacaggactttggcgtgaccgtctatggcctgacgagtggactgcagtgactgcagatggtaaacggagtgctcaatttgagcacacccttttggtgacggaaaccggagttgaagttttgacagcaaggctgccctcatcaccggacgtctacccatggttgaagcccggtgtcagcaaatagcaagtgatacgagcacatctttttgatcaacttgccattgagacggtgtcgactctccagaggccaaaccgtgtggattttcctcgggtcacaacttgctgcaaccattgttctttttaccgaatgtcgatcatttgtgcctattcgaactgagttatatagttgaatgtggtgttgggcacatgaggtgtcctcccattatgctatgtcgtgagagtcaacatatgatgattcatacaattttgagcagattcatgccgcacgccctgttatatcgttcatcaacgggttgcccccggtcaaaaggccttnaagggggacttcttctcccgttgggcct

SEQ ID NO: 34314 - DNA, 1026 bp, Triticum aestivum
  Clone ID: PAT_TA_34314
cgattgtttgcttatgatgggcaccctactcaagcgggaaaggaagtgttaatccgtgctgttgctcaatctatccctacttatattatgagtgtgttcaaactcccgttggaggtatgtgatgatctaaaccgcatggttaggaactatttttggggtgcagagaaagggaagaggaaaacatattggtacgcatgggagaaaatgactaggccaaggaaacaaggcggccttggttttaaagactttcgtctatttaatcaagcgctccttgctcgtcaggcgtggcgaatattagagttcccaaacagtttatgctcaaggctctttaaagcgaagtatttcccaaatgggcgcctactggatacggggttcactagtaacccatcacctacatggcaggccattgcctatggtctcgaacttctgaaaaaaggcgtggtctggagaatcggaaatggtcagagtgtacgtatatggagagatcgatggatagcacgcgagccaaccggaggcttgatttcacagcgtggtaggtgccgcctaaagtgggtctcggagcttctgaatatccatggtaattgggactttgacaaaataaatcagttctttctcccggtcgacattgttgaaattcagaaaataaaaccatctgctcggctagaggaagactttgttgcttgggggcctgaaaaaagtggagtttttactgtacgtagtgcgtataaactggctagtgatgaatgctcaaatcctaatgaagtctctacaagttcccggccggatggaacaagagaagcatggaaatttatatggcaaagttctgtaccaccgaaggttcagtcttttgcttggaggttagctacagattcgctagcaaattggacaaataaagtgaaaaggaacttggaagtctcaggtacatgccttgtgtgtggtatggaggaggaggactcgttccatgtgttttgcacctgtaatcatgctgtgttcctatggaaggccatggggaacgaatggacattg

SEQ ID NO: 34315 - DNA, 650 bp, Triticum aestivum
  Clone ID: PAT_TA_34315
gatacatcaccttctgatgtgcgctcgcaccatcatcactccatcttgagggtgcactctcctgacaaactggttgtggacttgcatcttttcgacaattcggtgttgtttacggctgaagagctctgtcgtgctccggcagagatcatcggtcggagctgtgacgggacatcctacatggctactcttgacaatgggtatgagctgacagcgaagcggctgaaggaggggtttgctaagagcaagaaagagtgttcccgtgaaataaagaagctcggcagcgtcaaacatcccagtctagtctcactgcgaggctactactggggtcccaaggagcacgagaggatcatcatatcagactatgtggatgccacatctctgtctacctacctgtctgagattgaagagcgggatcttgcacctctgtcggtgggccagcggcttgatatcgcgatcagcattgcccactgtctagattacctgcacaatgagcgggtgatcccacatggcaacctcaagtcgtccaacgtcctgcttcaggactcgagcccgtctgctctggtaactgactacagccttcacaggctgatgactccggtgggcatggctgagcaggtcctgaatgcaggggcccttgggtactcccctcc

SEQ ID NO: 34316 - DNA, 1244 bp, Triticum aestivum
  Clone ID: PAT_TA_34316
gttacgtcaatcagcagatagcagcacactgatgtcaagagctcgtgcatatgccccagtagacgattctctaactctacaggggcctctttgtagagtttgcgaggaaaacaatgaactcgaaggcaagaacagctcttgtgaaggtaaagctgtgggttttgtgtacagctctgttggaaaagattcagttcttgtaactgcctggggtagtggacagctccagattgatgctctagccgatgaaatccaaccacaatggagcattggggttcctactcgccttaatgttgattcacatggacgcataaagagcgttgctatgatatgtgactctaatccacaagattcgtcggccctgagatcacatcgttcatccagtatggggtcaaatgtgaagagcaatacagaagctgtctggatgggacactctcctcctttgctaaggctctcaattgtggatttggcactaccaaaaacttctaacggtagctctttatcgttatttctggacccccttgtcccggagagattttattgtgcacatggcgggggacttgacatgggcacgttgcacttcctgccgttttcataccctgaaatggcttccacaccaccctcggtgcatcctgtactcaccacaggcaacagcgatacaagttctcccttcctttctggatttgtcgccatagctgatgcgtatggccatgtgcagttagttggcatcacatacactggcgagtgctttgtggtagaaatgaagggttggaaggaaccaacacctcttcagcttgacatatgtagcaaggacatcaaggatgtagaatcttccacaactggaatgatcagcaaagaacttcttgctggtccagatccacccatacttccatcttcaacaagcctgaggtcgttgactcctgactccatcgaagggaagtccacacttcatcactatattaaggttttccatgagcactatgtggagtatggtcacaaggtaagagctatcattatggtattttgtgcatatcccttatcaacttagaatatgtcatatgccattgttggtgcacaagtaaaagtcattcccttctggagataactgaacctgttacatcttttaatccccacaatataagcatatcactaacgattgtgggttcatttgaatgatgttcaggttttcattgagctcaaggaacacgaagattatgtgaagacagagattgaagacaagcagaaac

SEQ ID NO: 34317 - DNA, 1628 bp, Triticum aestivum
  Clone ID: PAT_TA_34317
cacgtacaaggccatcgagcgtggcatcttcgtcagtgccgccgccggcaatgcggggccggccgccgggagcgtctccaactgcgcgccgtggatactcacggtcgcggccggcaccacggaccgggcgatacgcaccacggtgaagctcggcaacggccaggagttcgacggcgagtccctgttccagccccacaacaactccgccgggcgcccgctcccgctcgtgttccccggcgccagcggcgacccggacgcccgcggctgcagctccctccccgactccgtgagcggcaaggtggtgctctgcgagagccgcggcttcaaggagcacgtcgagcaggggcagaccgtgaaggcgtacagcggcgccggcatgatcctcatgaacaagccggaggaggggtacaccaccttcgccaacgcgcacgtgctgccggcgtcgcacgtcagcaacgccgccggctcgaagatcaccgcctacttcaagtccacgcccaaccccacggcgagcatcacgttcaagggcacggtgctgggcatctcccccgccccgacggtggccttcttctcctcccgcgggccgagcaaggccagccccggcatcctgaagccggacatcagcgggccggggatgaacatcctcgccgcgtgggcgccgagcgagatgcacccggagttcgtcgacgacgtgagcctggccttcttcatggagtccggcacgtccatgtccaccccgcacctgagcggcatcgccgccgtcatcaagagcctgcacccgagctggtccccggcggccatcaagtcggcgctcatgacctcctcggaccccgcggaccacgccggcgtgccggtcaaggacgagcagttccgccgggcgagcttcttcaccatgggcgccgggtacgtgaacccgtccgcgcgccgtggcacccgggcctggtctacgacctctcgcccaacgactacatcccgtacctatgcgggctgggctacggcgacgacggcctgaaggagatcgtgcaccgccgcgtggactgcgccaagctgaagcccatcacggaggcggagctcaactacccgtcgctggtggtgaagctgctgtcgcagccgatcaccgtccgccgcaccgtgaagaacgtgggcaaggccggctcggtgtacacggccgtggtggacatgcccaaggaggtgtcggtcacggtgcgcccgcccatgctgcggttctccaaggtgaacgagaggcagagcttcacggtgacggtgcggtgggccgggaagcagccggccgtcgccggcgccgaggggaacctcaagtgggtctccccggagcacgtggtgcggagccccatcgtggtgccgccggccaaggtggtcgcgtaggcgttgggtcggtagggaggggttcggctctcggcgttgctcgtaggcgtgcgtgacagagggtaagagcattgcgttgtatagggtggcgcggtcgattaattaggcgcgtgcgtacttcgtcgagcgccgccgccattgcgacggcgcagcaagctcggctgcgacgtttgccatggcggtgggtgtatagtgcaaataatggaattttattaacccgtgacataaaaaaaaaaaaaacgcga

SEQ ID NO: 34318 - DNA, 1371 bp, Triticum aestivum
  Clone ID: PAT_TA_34318
tcggcacgcggcttcatttttgcgatccacttgctcccagttcccggtgtagtaattctttgcccttgtgagtagtactgctatcaatcaagggtgggaaacagagctgctatttagagaatggagtgcagcggcgacgaggtggtggagctgagctgtgcccgcgccggcggagaccccggggagtacgccgcggtgctgaagaggaagctgcaactgtactgcgccgccgtggccaagaccatggaagctaaacctcaagaatcttctttgaactgcctcaattcacaagcttcaggctctccgccagtggctgctccaggctcgttttgctcctggttgtccaactgtcctccgatggctaccttagtgttgttcaccgaaagggcggtcgcggttgtacatcaaaggagcagtcagatgatgacgatggggatctcgaggaaaatacagaccctgccagtgccaagcgcgtgaagaggatgctgtcaaatcgagaatctgccaggaggtcaaggaaaaggaagcaagcccaccaaaatgatatagaatcacaggttacccagttaagagctgagaatgcatctttgctaaagcgcctgactgacatgactcagaaatacaaggaagcttcccttggcaacaggaatcttacagttgatattgagactatgaggagaaaggtatatccttttcttgataactcttaactgcatcctgcaacctgctgtaactatttgaagggctgtgctagtgaatctgttgattatagccatggcataatattgtgcatcatatgtgtcattactagttacttttttaggctctgcacagaccatggttgatgttctttcttttcttgggagaacccatgcataaagcgatctgggatttgacattccttgtttagcatcatttgtaacttcctattcctaactgtacctcggccgcgaccacgctaatcttggccccgggtttggcatggccataaggaggctggcaggtactatcctcttccattagtgaacaaggagtagtttagttctatgtttcactctcttctattcttttaattttttggtgtcaagaataacaatgttttcttacaggtgtgggtgttgtaaaaacgaaacaaaatataaaaaagcgctcataccatgttgcaatgctcagagagtgtgtctcattaagcctgtggtttttggtccttatgggagggtgttctatctcataccgcacctgaggagtccaaacaggcacaatcatacatacatttgttaatgcttgtgtgtgaatatagctgaagaagctgtcaggagagtaactggagcaagcttgatgttctccactacatcaaacaacgtgcccttg

SEQ ID NO: 34319 - DNA, 825 bp, Triticum aestivum
  Clone ID: PAT_TA_34319
ccccaagctcctcctcggtttatcctttctggtccttacctgcacgcacctcgtggctgggacggcggttggtttggattcccgtgtgcctcgtcgatctcccgggccggtcaatgggagcagggacctaatagtagttgcatgatgcgagctcgtcgacccggacggttttccagcctgcgaagtagtggatctcgttccccttagctcctgcgcgattttgggaatctcggtggtgttgtccgtccccaaacgccgagccggagtggagtgggctgtccccaagcgaggcaccccgacgcatcgttttcaacctcaaaagtggcagcccgtcttcggcattgcattcttccacctacaggtcccccgatctctcatctccctttttttatgtttgtatacgattggacctatatactttaaggtacgtactgcttgctagtgacaaatgttactatcctgcatactcatttcggattgtcatgagaagtcacttcttgtccatctacaaaagccatgcagtaaatggcgtatgtctaacacaaggccggtgctttgtggacagaccttcaaaattcaggacatcttagaggagaaaggtagggttctctggaggaagtttgggtgcctcggagtagcaggaattcctgagtatatcttgaaggaggtctttctttctggtaaagtatcttttgtttatgtagatgtccatctgtactctaatctagtagtaatgaaataatagtttcttctcggatgcatgttctgctttcatgtaagatgtaacatcagattaattgtaaaggaaagaaaacaggcgcttca

SEQ ID NO: 34320 - DNA, 1077 bp, Triticum aestivum
  Clone ID: PAT_TA_34320
gggccccccctcgagatagttccaggaactctttctgcagctctgtctgccctgactcttctcgtgcaatttaacggatggctatcgtttttcctcttgctttcttacaagctgcctcttatgccagaaactcatgccacatactacgaatacaccgggttatggcacattaacgcgctcttggccttgaattcatggttctggtgtgccatatatcacagttgtgatactgcttggacagaaaagctgtacctgtcatcagctgctgcttttcttggctactccctcatcttggccatactgcgaacttcgaatctgagggatgaagcttcaagagtgatggttgcagctccaattctggcttttgtgacaacccacattttgtacctcaacttctacgaactcgacaaaggcctgaacatgaaggtttgcactgttattagcgttgctcagctccttctatggacagtgtgggctgctatcacaaggcatccttcacgcctgaaggtcgcctttgttgcccatcggcgtgtcctctcactatacctggaagcccatgatgtccctccgcgatggggatatgttgatggacacgcaatctgcctcgccatggctatccccctgtcatacctctggtggagcttcgccaaggaagacgccgagatgcgcacggcggcaattatgaagaagaaacgataacgggcttcgccagaccaaatacttccatctttggtggtgtgaaaacttgtctccactcatccaatgtaaagatgagtttttcattgtaaatttaggagatctcgtatgtgaattactgttttttccatgctactttttgcctcagctcaggaggtttacatggtttgaaacttgtgatagccctttgtatttctctcatttacaagccaattgagtgtgttcttttcttttagctgcaaaaaaaaaaaaaaaaaactcgaaactggtccggccccggcggccgcgcgatcgtaacatgatcttatgcttttgttttgattgattataggatggtactccctccgttcaaaaaaaaaaaaaaaaaaaaaaaaaaaaaaa

SEQ ID NO: 34321 - DNA, 657 bp, Triticum aestivum
  Clone ID: PAT_TA_34321
tcggctcgtgattacatttacatcaccacaacaacaacgcgaacaagagaagcgcaggacacaaacacgcggcgacgaagacgaaatgggcctgtgtgtgtcgtacgacgcggcggccgacggcccggcgaccgcgagggtggtgctccccagcggcgagctccgggagtactcgccgcccgcgacggcagcgctggctcttgaggaggcggggcaccaggagtggttcctctgcgacgccgacgcgatggggttggagggctccgtcgcggcggtggccagcggcgaggcgctcctgccggggcagatctacttcgtgctcccgagcgacatgctgcgccgccgcctcgccccccggggaggtggcatcgctcgccgtcaaggccagcgccgccctcgtcaaggccgccaccgtgtcatcagccggcagccggcgccgtcggggctccgtggcgccgctcgtgtttgagccgtccgaggaggactactcggccgaggatgccttcaccatggcgacgttcgcggtgaagccgatggtggcgccagaaacggagggtggcgtaccgaggcgcctgggcccccccgagcccctcccccggccgcaccgccaccgccggggggcgagtagacgtgcagcgcagacgagactgccaaaaa

SEQ ID NO: 34322 - DNA, 425 bp, Triticum aestivum
  Clone ID: PAT_TA_34322
tagaaattttgatcggtggaagactccatgatatctgctccagcttcgtcttcgtaatcatcatcactactgtcggggtgggagtcggtgtcgtcgatgatgatgtagtcttcagaacggatgtcctcctcaggtgcgggatctcccatgaatacttctagcttcttcttcaggtcttcattcttctccagtaatactacaatttcctcctcatatccatcgcgtgtagacttgagttcctcttcaagctccatgttcctggtcatcaccttcagatctatcatgccggcgcacatttggttctcctggcgacgaatgtgctggtttaactcctggatgaaggctgcaatggacttgtccctccgggtgctgatcatctcccattgctcatctcggcgcccacatatcagatagatagtgtcctt

SEQ ID NO: 34323 - DNA, 1157 bp, Triticum aestivum
  Clone ID: PAT_TA_34323
cccacgcgtccgcccacgcgtccgcacaatgcagggtggaagcttcttcagagggtacacgaagctctgcaagggcctcgccgtcatattgcttctcgtgcacctcttggtccagctgttcccatcggccgtcaactatctcgcgcttatccctgcaaggacaatccctttcgcctggaacttgataactgctggctatgtcgagcaaaccattccaggggtgattatcagcatcattggtcttcttttatttgggaaattattagagcctttatggggcacaaaggagttatcaaagttcgtttttattgtcaacttctcaacttcaatgtgtgtcttcgtaactgctattgctgtgtactacgtaacacaacaagagagctacctctacactcctctttctggtttctatgggggttctgtcaggattgctggtgggcatcaagcaacttatgccagagatggagcttaatcttttcgtgctgaagattaagggaaagtggatcccatcacttattgcactgatctccgttgttgtaagcttcttcatgaaggacttggtatcttacctcccagttatactgtttggcatttatatgagttggatttacctgcgttacttccaaaagaggctagagacaggcctgaaaggggatccaagcgaggagttctctttctcaagtttcttccctgcaattctgagaccagttctggatccaatagccacaatattccataggcttctttgtggaagatctgatagggcagaccggggtcagacattggaaacgtcatcattgccgggttcagattctactgaggcaaacaggaggagggaaaggggtcaaagggcactggagcaaagattggctgagaagctggccgcggtcaagagtacagagagcacgtctctcgacgcatccgacaaagtttgagccttctacaaagacgacctgccaaatgttgtgaattcccggtgctgcgttacccaagtgacgttgtctggaggacaagggagcatcggtggttcggccgcgagctctttctattccctagtttatatccatctgtaagtgcttctagggaagtggtgatgcgagaatgtgtgattttactgatttaaggaaacatatgccggactgtgcaatgatagcatc

SEQ ID NO: 34324 - DNA, 1542 bp, Triticum aestivum
  Clone ID: PAT_TA_34324
cggcccgcggcctcagcattctccgtggccaccaagcaccttaggccagagacggcgcttaatcttgtcgtgccgaagattaagggaacctgcaccccaccactttttgcactcagctccgtcggggcgcgccggttcgtcagagcccggcggtcggcggccgccacgatgatgagcagcgctctcccctccggggccgtcgcgcccttctcgcggtggaggcttcagaaacggctgcacgcggctccaagcgggcagctccctcttatggcttcctgcccaccacttgggagaccagttcccatcacccgtccactattactcgctaaacttctatagggactatccgttacggcaggacgttgacaaacactggaaacgtcatcattgccgagttcagatgtgactgtgggaaacaggtggagcgatatagttcgaaacgcaatggagcaaagattggccgagaagctggctgcggtcattcgttcagagagcacgcctctcgacgcatccggcagagtctgagccttctgcaaataggacctgcgcttgttgtgaattccaggtactgcgttacccacgtgtcgttgtctggaggatggggcgcttcttggattcgaccgcgagctctttctgttccctagtttatatccatctgtaagtgcctctaggggaggcggtgatgcgagaatgtgtgattttactgatttagggaaccgaaccatatgccgatccgtgcaaggattgcttcatctctggttgcttacctgcaatgctgtgtctatgagttgattttaccgccgttactttcaatagagttcttagagaagcctgtaatagggcccacgggggtcgttcttttgaaacggcttcttccccggatttctgttctactgagggaatcaagaggagggaaaggggtataggctcctttgtggaaaatctggtagggcagaccggggtcatacattggaaacatcatcattgccgggaccagtttctcctgaggcaaacaggaggagggaaagggctccaagggcactggagcaaagattggctgagaagctggctgcggtcaagagtacagagagcacatctctcgacgcatctgacaaagtttgagccttctacaaaaatgaatgctgtgaattcccggtgctgcgttacccaagtgacgttgtctggaggacagggagcatcgtcggttcgaccgcgagctctttctattccctagtttattatatcatctgtaagtgcttctaggggaggtggtgatgcgagaatgtgtgattttactgatgtagggaaccatgccgaactgtgcaatgatagcatcatgtctgttagcacaatttagccgcatgctgactgctgagagtctttcgctttgcatttttgaggcccagaggcgttccatgagcaatgaacaagttagcgcattggtttgcttgtttgtcgatccgtttgattctatctgcttgagttatgatagcctgacgatctgagaaggtgttgtggtgaattaaattggcagtgattggt

SEQ ID NO: 34325 - DNA, 625 bp, Triticum aestivum
  Clone ID: PAT_TA_34325
gccaaaggagcggggcgcctccctcataagcggaggggcggagcggctctcacgttgcggaattcggaggcccccaggaatagccagccggtcgggccaggcgcggaggccggagggcggaggcggaggaggggatggggaacgtgacgtcgtcggtggcggcgcggctggccttcttcccgccggagccggcgacgtacgaggtggcggcggcggagggcggggccgggctgcggatgacgggggtgctgcccgacgccaacgtcgacgtgcacgcgctgcccaccagggcggggacccggcgtcgtcgccgccttctggcgctaccccacagcgcgcctcacgctgctctactcccacggcaacgccgccgacctcggccagatgctcggcctcttcatggagctccgctcccacctccgcgtcaacatcatgtgctatgactattcaggatatggggcctctacaggaaaaccatcggagtataacacgtactacgacatagaaggctgtctatgactgtttgaaaaacgagtatgggatagtccactaactgctgataatatgtgggcaatcagttggaagcggaccgacgttgcacttggcctcacgtttggataaacta

SEQ ID NO: 34326 - DNA, 977 bp, Triticum aestivum
  Clone ID: PAT_TA_34326
ctccggcgcgtggcgtggcgcccccacttgggccaggccgcatattcccagggcccatgggccgctcgtcacaccgatggcctcgctcccagcacgggtccggggtctgtgctccccgaagctccactgccttccacgttcagcgacccagatgatggccagtttcaaagctggtgagacgattagagctgctgagcctctcaaagggcatggagatggagatacttggggtataagtatctgtatcttagaagaagcatcattcgccgaggcgagatgatggcgacgcggcgggagcttttcttcttcctcctcatgtggtaggaggaggaggagaggccgtcggcgtctcgcatggagttcccccattcacacttcttggctctctagttcctcgtcgttcgttcaggtagggaggggtggccgcctgtgtcgccgtcgtggcatgccgctcccccatgcgctcgtctcggctctctctctcctcgctgcgtgttgttgctgcagctttgttgagttatgatcctggaccccccgccgcggtatcgggtcgttgcatgcagcggcttgattaattatcctcattgtttgcgtcgtgctgaacagagggaaggagggcacctcgtccgcgcccgccgcttcgtgtgtttccttcgtcatttacagtgatatcagtctgtactctgtagtagtctgtcttacactgtaatttccaggatttttggtttcttttttgtaacttcagatatgtgcaacttccggtgtaaatggtggtacatttaactgaatttccgcttccagtgttttgttacatggcggtacatcaactgaaatttcagtacatagagaaagtaatttacggatgtagatgtaggtatgcaaatgttgaatctcctggtcggttgagtctcgtgatgtataggtgttggtctgaattttttttcagttttagttacactgatttgactgtaatttgt

SEQ ID NO: 34327 - DNA, 571 bp, Triticum aestivum
  Clone ID: PAT_TA_34327
gccgtgtcgtcgacaagttcagtatcaagatcctccgagaggaatttgagcgagccgccaatatattgcagtatgatccaaacccaagtgtgaagctctttgagccgtatgtgccccctcctccatctgggacccttgacgaggaagggattcttagtaccgcgggagctataatatgatgatactacaaacctgtatcatggaacccctttgtttacatgtttgttatggcttacctcagttgtgcatagctgtacaatagatgcttagttgtaaagtaactagatgtgatggtaggagtgtgtacctgctatataagggtgtctattatcatcagatccagagtcttgattaattattttgcgtgtacaaggcgatgtttggaccagacgactgaatatagattagtaaaataagtctgctgctgagaggaaccctaggctgtgtatctgcctttcaaccaccgttagatctttttcttttctaactagttaaatgcccgtgcgttgcaacgggagcatatattattattctaatggtttaataaaaaaaaaaaaaaaaaaggccccta

SEQ ID NO: 34328 - DNA, 708 bp, Triticum aestivum
  Clone ID: PAT_TA_34328
ggatcaagacgctgattctaccccctttgcagcatatgcagaacgtgcgctcccgttacatttttcaccctgatgatagccttttcactgacaagtttgacgattggagatcttcctaaatgtgatgatttgtctccaacggctatcgatctatctatatattggtctagcatggccacgtttccgatttgggatatggcatgaagggttcaagtggctattcacattggtaatctgtgatattgatactgcagaccaaatgcggaggtaaactctggtttgtggtgttctaagaagttcccaagctcgtgcatacagtgttgaccccttagtcacctgctacgtctgcatcctgctctgcatccagcacagcacactcatcaccaatgccatggcacgcccctcttgctgcatgcggttgccacatatcatttcttctgagccttcctggttcctgttcgattggtggagcattttggactagaagcagttcttcgtaaatttactgtaccgctttaagattagtaggggcatggttcttcttgatgtgtaagctatgattgtttgtgatcatttggagatgtgattgtatgtcggtaaaaactaacgggttggatattgaagagcaggggaggagattgtatgggttgagaatacagagtcaagaattctaggattagttaaaaaaaaaaaaatgttaatcatata

SEQ ID NO: 34329 - DNA, 880 bp, Triticum aestivum
  Clone ID: PAT_TA_34329
gcacgaggcggctcgcggccccagcggtccagcaccctgtgctcccctttcccaccaccacttccccttcctccgcgggcacagcagccatggccgcctccagcgacctcctcgacgtcgacccgcccgagctccagttccccttcgagctcgacaagcagatctcctgccccctcaagatgatcaataagaccgacagaaccgtcgccttcaaggttaagacgacgagccccaagaagtactgcgtgcgccccaacaatggcgtcgtgcggccgcggtccacctgcgaagttgtagtgacgatgcaagcccagattgttgcaccaccagacttgcagtgcaaggacaaattcttggtgcaaagcgtggtcgtcgccgatcgcttatcggccaaggacatcaccgctcaaatgttcacgaaacaagggggtaacgctgttagggaggtgaggatgagggtcacttatgtgatgccaaccgaatcgtcgttagagattgcggaggaaagcgatgggccacagcgtatcttggtgcctatgcagcgaattgtggatcatgggaggagcgcttcggagctgtcgagtggctcggtatccttgagatcagctgagctggggacagaggtgggatcacctactggaccagttgtaaggactgaagaattactgagggctgcaggacatgctgctgatgcacgatcttagtctgggcccgatgctctgcccctggagctgttggcttgttggacgtttgcctctatggcatgggactctggccttcagccacatatcaggccccgctctcagtccctgctcgtcgggcgtgatgccagtaaccaccgaggattcgcgctgtttcttgtaccggtgtgtgggctgta

SEQ ID NO: 34330 - DNA, 776 bp, Triticum aestivum
  Clone ID: PAT_TA_34330
ccacgcgtccgcggttatctgatagttgcccatgtgatcggatcaaagaccttaaagctgtagagctttgcagaattgagggtcttggttattcagcttatggtgaaatctgttgtacattagcacttaaattcattgatgacacttcaagcggatttggcaaacagtttataatcacattgcttgagctggctgacttttctgattttcttgtggaaagaacacggtttgaagctactattgtgcagaactggactatcagagataagtgcaaagtttggagcatggatgatggagaggaagaacgaagttggtgggagggacatgtgttggcaataacacctgattcgcctgattttcctgagagtccatggcttaaatatgctatacagttttatgatggctctgactttctgtatagcccctgggagctccatgctgctggcccattggttccatggaaacatccacatattgattccagtatcaggaataaactgttatcagcagtgaccactttacagaaaatgtctcacaaaaaccaggattactatggtgttctgaagttggatactgttgtaggagaatcagatttcataaacaggtaactcctttatggttggcaaatcttgtggcatgcatgaaacatagattttgctaattgacattctgtcattaaagtcaaagaaatggctgtgttgacctggctggctgtgcctcaacaagtcccattttccatttcaattatgaggcattagttgttagaatacatttat

SEQ ID NO: 34331 - DNA, 1644 bp, Triticum aestivum
  Clone ID: PAT_TA_34331
atttaatccattccgtcctgtcaagacccgaaattccttcaccccgttctccttggcagccgccgcagacgacgcctcgactatgcgcctgcttgcgctggggcagaaggaggagaaggagggagccgcactcgcaaaggaatcgagaataacgccagggatcgactggctgcccgattactggaacaaagtgagccacaatctcaagggaaaagtttacccctttgggaagacccccaagaacccatgggcggaaagtctgcgccagaaccaccactgattccattccctgaggttccagatgaaggagtttttccaagggccaaacatggcccacaaggttgttgaccaaggccccttggaggccctggacggccctgattggggctccaatctttagataagcggatttgccaaaaccgagagggtccaccgcctcgggctcaaccgccccctaaaaaggcgaatcatgccgaagagcccggcggttgagtatctggctcttatcctcctctcgagctgaaacttaacataaaggtgttgcgtgttcagtgcatttccaaactatgatacagctttgtgcttgcgcgtctatcttctcctgtatcccggggattgctgtacaatggtagatgtctgacgtagcagagagttgcatgtggcacgacattacctccgctaccttccagtgtatgaagaaacttacaagagcttaagatctaggggaattcgcttccctggccgcgatgatgagagccttgcgccaatatttactcctccccgttcagtacctgcagctgaaccatattctgatgcagcacaggacgggtagcaagaaatttcagatgaaagttttgctccagttcgtgctgccccttctgtacaagtcgacgaggcttttgaggtggctcgtaatagcgttgaacttctttccacagtgctatcatcatctccacaaaaagaggctctagaggatgacttgactaccaccctggtccagcaatgccgacagtgtcaatacacgatccggagaatcgttgaaactgcaggtgataatgaggctcaactcttcgaggcactgagtatccacgatgaactccagaaagttctgtccaagtacgaagacctcaaggagcccatcgtcgcagagcctgagccagaaccagcgatgattccagtcacggtggagcctgaggaatccccacgcgctgttggcaaagacaccccctcgaggaaatcagctgggtccggtggtcgctctagcggcggggatgacttgcttcaggatctcgacgacatgatctttggtaagaaagccggcaccgcctcccagcaggaaaggactccccggaaggagcagaaggacgatttcatcggcttatgatcaacgggtatagatatctgtccggctgaaacttgtcataaaggtgttgcgtgctcagtgcatttccaaaccatgatacaggtttgtgcttgcgcgtctatcttctcctgtatcccggggattgctgcacagtggtagatgtttaacgtcgcattgagtttcatgtggcactccttttctttctgtgattgttatgcgagccaaattattgaaatgctggggctgctctcatgcatcgcatgggtaagtatataatttgt

SEQ ID NO: 34332 - DNA, 1300 bp, Triticum aestivum
  Clone ID: PAT_TA_34332
ccacgcgtccgaattttgataattcaaaagtatctaaatgttaaaatgctaaagagcgccaatgagctggtgaaacaatatgaccttgcagaagagtttccggatgttaattacttgtataaagagagttcgctaaagaagctggcagagaaagggtgctgggatgttgcagaagtccgtgccaagaaggatacaaagctgatggaatacctggtatatcttgctatggaagctggctatatggagaaggttgacgagctttgcgaacgatactctcttgaaggttatgtcaagtctttggttccagaagaagtcatgtgtcagtctgactacttagagctgaagaaattgattttagaagagattgtctgggttgatgagatcaacggattacttagtgcaacaagttatattgaagcttgtaaaattatcggtgtggattgcgaatggaaacctaattacgagaaaggcagcagacctaataaggttgctatcatccaaattgcgtcagataagaaagctttcatctttgatctgattaagctgtatgaagatgatcctaaagcattggactgctgcttcaggcgaatcatgtgttcatctaacatattaaagctgggctataacctgcaatgcgatctgcatcagctgtcacagtcgtatggagaattgttatgtttccagtcctatgaaatgctacttgatatccagaagctgttcaaagagactactggtggtctctctggattgtcaaagaaaatattaggagctggtttgaacaagacacggcggaatagcgactgggagcagcgacctctcagccagaatcagaaagagtatgccgctcttgatgctgcggtccttgttcatatattccatcatgtcagggggcaacctcagtttggtgtaaacgagggacgccaggtggaatggaagtctcatattgtttcccgagtgaatcgtgcacgtagccccttacggttctagaactaccagggctgcgcaaggcaataattgggaatgaagttcctttgagttctgacagctacaagcaagcacctactggtcagcttcatcttctcaggaaccaacctgttgataggcttctgtagttttctggcaccctagctggtctcagtggctggcgtgtgactcagtagtaacccctcccttgtaaatattacatgcttctgagtccggcactctcccctttgccgcattttggttaatgcagttggtgccacctgaaacctccatcatgttgatggtgagtatggaaataggtaaaccatggtttagg

SEQ ID NO: 34333 - DNA, 1704 bp, Triticum aestivum
  Clone ID: PAT_TA_34333
ctgctgctcccactcagtgtgaggaggcagcgggcctgcctcgccgcggccctcttcctgaccatcttcctctacgggttctggcgcatggggattcacttccccatgccttctccggagaaaggtttctttacgatgccgcagttggttagtaggattggcgtgattggagtgactgtcatggctgtcctttctggttttggtgcggtcaatcggcgatacagctacctgtctctctttatcagggaaattgacgaaatggacatcaaagctttggaacggcagctgatgcaatccatggaggcatctattgctaagaaaaagaaaattattctgtccaaaatggagatggagaggatccaaggatcagaggagaagcttaaagccagatcatttctgaagcgtatagttggaacagtggttcgatctgtgcaagaagatcaaactgagcaggatatcaaaaacttggaagcacaggtccagggattggaagagctttcgaaacagctattccttgagatatatgaactacgtcaagctaagatagctgctgcttattcccgaacctggagaggacattttcagaatctgctaggctatgccttgtcagtatattgtgtttataagatgctcaaggccttgcagagtgtagtctttaaagcggctggctctgttgatccggtaaccatgacgattaccattttcttgaggcattttgatattggtatcgatgtcacgctattatcacagtacatatctttgttgttcatcgggatgttggttggcatatctattcgaggtttcttggcaaatgttatgaagttcttctttgctttttctagagttgggaccggctcaacaacaaatgtcgtccttttcttatctgagatcatgggcatgtatttcatatcttctattcttctgataaggaaaagcctggcaaatgagtacagggtgatcatcacagatgttttgggcggtgacattcagtttgacttctaccaccgctggtttgatgcaatattcgtggcgagcgcgttcttgtccttgcttttgatttcagcccagtacacctcccggcaagcagacaagcatccaattgattgacgcgtcttgtcccacttgtgcatagtgttctttttaaccaccatctgccaaggttgacacattctttaaagtcagttcacaaaaagggggttgtttcttaggagacctccacacacggttacggaaattatagtggtacatcagttaactcgaaggcaactgttcgcttgaaagtttgttcgcaagttggcgatgaatcatcattaacagctcctccatagttttcaagccatcagtgctggccctgcagtagtcagaaaagtattgcgtggtgatgctgcaacagggcaggttgcaatgcttttgtcaagacaagcgaggaagccaccccttttactcttaggaatggtgaaggatggtgtgtaatatagcttttgaatagctgttagcatcgtctgcagttggtgtaccttccacaattctttgagacattgggcaatatttgccacaaaaagaaaaaaaagattattagtattcttgtgataattaatatcttgggaagtaaaaaccattagccacccgcatgctgtttgtacctgtaagctttgtgcaagaagaaacatatatattctttgatgtcttggcatcacaacccca

SEQ ID NO: 34334 - DNA, 982 bp, Triticum aestivum
  unsure (1)..(982): unsure at all n locations
  Clone ID: PAT_TA_34334
ccattccccccccagaccctacggccgtgactgcgtcctccccccctccccctccactccccctcggctccggctctgctcctgcagtggtccttccctgcgccggcccggcggcggccgctgggtttctgcctgtttcgtaggccgcttccaccacagcgatcttgcgcaccttccgccggctggtgggccgcgttgccgccccccgccctttctgctgggttgctaggcccgcgggtgtggaccgcgcgccggctgccgggccgcgcgcccgggctgcgccctgtcagcagggtggctcggccttccggaggggtctcctcgcgcgtgccccgtccgggcgcccctgagtgaactcagtgagcaagtagtttcaagattgcgtaggagtgtcgtgtcgcttgcttcgttcgatggtgataccaagttacgtgaatgcacaggcatgtgcattgaaacctcatgttctgattctgaagctacaatcctgacatccagacggctgattccacctactcacccagctgcaagtttgaatattaaagtacgccttccgaatgatcggattgtcactgggtggatagaggatcctaagatatatgttgattttttcattgtcaacatcaagaatgtgtctggtgttgatgccgcaagtctggaccgtgacatgcagtttgagcctcatacgaaggtagcagctgttgccgctgtttctgttctggatttttaacagccacaagtggactaaatcttgcctctccaaccagtgagaaaatcgtaagcacatgccggatccacaaggcggagacctggaggcccccttgttgattttgatggcaactttgtcgggatgaactcctctcgtaccaaaatggagaagactgcttacgtgcgaagggangggaattttccgattcttggtgcttctgggaaaggtcagtgttagagttaagggaaggtttcatgatgcttcaagggcaag

SEQ ID NO: 34335 - DNA, 837 bp, Triticum aestivum
  Clone ID: PAT_TA_34335
caatagcaagactattgctgtggcccatcaagtgcagggaagttgccagtgggaaactcttgaactatatttggataaatataaagatttgcatccaaggctgcctgtcattgttgctgaaacacttctttacactgatcctgagattgagctacctctttggctggttcagatgttcaagaccaccaagggtggaaataggatgatttcatggggaatgtctggcaaagaggcagatccagctgcattatttcgactatatacaaattatggccggcacacagaagcagccaacttgttggtggagtacctggattcttttgcttcatcgagaccgatggacgtgctgcaccgcaaaaagatgtcggccgcctggttcccgtacaccactgtcgagaggttttggtgtcagcttgaagagatgcaaagtgctggccacagtgctgatcagtgtgataggctcaagaagttgctgcatggagccctgatgaaccacctgcagcaagtggtcgtcgattcagaagacgtactgtcatcagttggaggaggtcaaggagtggagagccaaagcagctgagatcatgttggtcgtggattacacagtccaagcattgttgtatcttgtatgtgggttttgtatgttttctccccagagccgtaggctctgtatggctgatagtgtctatgcgaggcgccggtcggaatgtggttacgcccgctgttaacgtttcctgtcgtagatgacggactgatgttccgtttgtaatgtgaatatgcatggcatggtaagttacatgtcgtttggttgatgacagatacgtagatggttagcccatg

SEQ ID NO: 34336 - DNA, 414 bp, Triticum aestivum
  Clone ID: PAT_TA_34336
atccggtgaaaaaaggcggcttttaagcagaggatgtgggagtgttggccacatttggttttcgacttgggtgtctaaatattctcaccatacttggctccctctcggcctttgcgtcattggcgcaacgagtcatctagttaacattcaatgaagaaaggtatgtgctactttgaaggtttagggtttagggttcatggcccagatccaacaagtgtagctttcgagagtgtgtactgaaaccaagtgtggtgttggtttctgtgaatagacatgaaaagagaagatcgcttggagcagtctgcacgttgttgtctcattcacccatgtatgtatatacaacagttgttgctggagataattgtatctatagtcctcatactcgccggcgacgtccaactcattcctggaact

SEQ ID NO: 34337 - DNA, 838 bp, Triticum aestivum
  Clone ID: PAT_TA_34337
actctctccccttcgctcctcccgccgggccggtccataggcggcggcgtttgcaagctctcttaggctctcttcctttctcctctcgcggacggttgatccaaaggcggcggcggcggcgctacgctgcggtaggcatcgagctcggcggaatcatggcgctgcggatggcggcggcggcgttcgtgcggcgcctggcgccggcgcgccccccggcgctcctggcggagggggaggccgtgacgtgcgggcgcggggacaagaagaccaagcgcgggaagcggttcaagggctcctacggcaactcgcggccgaagcgggagaagaagatcgagcgcatcaaggaccgcgtcgaggtgccccgctccaccccgtggcccctccccttcaagctcatctgagctcagcgagcacccccctcggttcgtcaggccacctagggttttactttaccccctatcaattactgctgctctcagctgttttcctttagctccacttccatggctgcgcctgcgcaatcatgcgttttacttagttgtttcccattttaggctgtgttggatatgtactatgggatcgaattgccatgttgcaaccattttcgacagcgctgtcgatctggatgaaatgcatcatgtttctgtgtcaaaaagttatctaggatgatggtgataataaatcattgcaaatgaaagcaagacccacgcatgggttcgagttggggacccgaggtttgcggggccccccgcccctattcgcggattgattgatggattaataaaatcatttgccaaatgcaaaaaaaaaaaaaaaaaaaaactcgaggcggggggcc

SEQ ID NO: 34338 - DNA, 636 bp, Triticum aestivum
  Clone ID: PAT_TA_34338
tgcaaactgttcctgtaaattttgtcaggagcatttgaatcatgatgctccagacaatgctgaagttgattcattacattcttgttcccaatgcgaggagaaatatcacccagcttgctctcctgagactgaggacctatccagtgtctccaatcaggcaggaaatcatttttgccaacaaagttgcagactgctgtttgaggaattgcagaatcttcttgcggtcaagaaggatcttgaacctgaatttgcatgcagaattattcagtgcagccatgaagatgcaccagaaacagttcttgatttggatggaagggtcgagtgtaattccaagattgcagttgctctttcactgatggatgagtgctttcttcctattgttgaccaaagaactggcatcaacttgatacgtaatgttgtgtacccctgtgggtcaaattttctccggctggacagctcatggatctcatatctttattttggagcgttaagatgaaatagtatctgcagcatcagtcaggatacatgggaccaagttggcagagatgccattcattggtacacgacatatgtatcggcgccaggggatgtgccgtcgacttttagatggaattgaaatgatcctcagttctctca

SEQ ID NO: 34339 - DNA, 1259 bp, Triticum aestivum
  unsure (1)..(1259): unsure at all n locations
  Clone ID: PAT_TA_34339
ggcggggatcatgcgcggagcaaagaggccgcggggatgatggcgctgcacgaggcgctccgcaacgtctgcctcaactcggactggacttactccgtcttctggaccatccgtcctcgcccgcggtgccgcggcggcaacgggtgcaaggtcggcgacgacaacggcagcctgatgctgatgtgggaggacgggttctgccggccgcggatggcggagtgcctggaggacatggagggcgaggacccggtgcgcaaggccttcagcaagatgtccatccagctctacaactacggagaagggctgatgggaaaggtggcatctgataagtgtcacaaatgggtcttcaaggaaccttctgaatgcgagcccaacatcgccaactactggcagagctcttttgatgcccttcctacggaatggactgaccagttcgcctcaggcatccagaccatcgccgtgattcaagccggccatggcctcctgcagctgggctcctgcaagatcataccggaggacctgcacttcgtgctgcggatgcgacacatgtttcgagtcactgggctaccagtcgggcttcttcctgtcgcagctcttctcctcctcccggggcgcctcctccgcgccctccttcccgctcaagcagccgccgccggcgcgcccgcccccgcagctcttcaactggccgggccagccgcagctcccccacgccgccgcgtcgcccctcttcccgccggggccggccgcgttccacccgtccgcgcgctcgtccatgccgcattacccgggcggcaaggacgagagccacatgtaccacctcgcgccgtcgcagcatggcaagccgccgcacctggacgaacaccagcaccagcaccagcagcagatgcggcccggggaggcgcccgacggcgacctcaagtggcccaacgggctgtccttcttcaccgcgctcaccgggcgctcagatgactcgaagcttttgtacggcggccccggcggcggtggtggaggcggcgcaagacgacgggaagccagcgcaggacgcgcagacagggcacggcggcgcggagaacgtggaggagtacctgagcctggagagccactcnaacaaggcgaagangatggagaacaccaaagcgccaantcaagaggacttcacgttgccggcgaggatgantcctcactccgcctccccgtccgtgtcggctcnaaggggccggggcgcaacaacagcancaanggatggggtaccgagcgca

SEQ ID NO: 34340 - DNA, 1621 bp, Triticum aestivum
  Clone ID: PAT_TA_34340
tgtacaggcatttcattctccaggtttccgtggcttcgagtttatttctaatgagtttgttgatgcttttgcttgactctaacccctgcacagaatcgtcatggaggaacaatagtttacgtggatgatattggtatacgtcctccagtttctccgcatccgtttactatgtgcaagtcagaggcagaagcttacggctatccatgtgaagatcacaaggtcacaactgaagatggatatattcttagcttaaaaaggattcctcatggtcatgatactgataactcaaccggggatcagaagacaaggcaaccaatactgctattccacgggctttttgtggatggcgtttcttggctactgggtacaccagaacaatcacttggctttattttggcagatggtgggtttgatgtttggctagcgaacactcgtggaactaataccagccgcaaacatacatcactgtccccaaaagatacccgcttatgctgcgcaactggtggacgagccgatggaatatgatcttccgcccctccgtgagtgtcgctacctccactctcgcccccagcaagccctctgcagcggcctcccaccggcctctgcaaccaaccaaaacttcaaccacatattccttgtccgagtatatggcttgtgtatggtcttagcatatgtctgcgcatcactgagcggagctgcctccgatctcacccggcttgctgctcaaatgttcctggcagaagcagttcactgtataggtcttcatgagttcaatcctgttggaaaagctgcagctcaacttctagccaaagtatgtggcgaccctaaaattgactgccacgatgtattttctgctcttgcaggaccggactgttgcctcaataaatcaactacatgtgccttcatgctgcatgctccacagcctacgtctatgagaaaccttattcacttgtcgcagatggtcaggaacgaaggggtcagaaggtatgactacggcaatgccaaggaaaacatgaagcattacaagcagccacgccctccgctgtacaacctctcatccattccgacccatgtccccatgctcctgacgcatggcggccaagacttcctcggcgatgtccctgacaccaggcacctcctgaagacactggtcagaaaccatgactccgataacatcgaggtgcaatacttgcccgactatgctcatgctgactttgtgatagcctataatgctccacgcctcgtatatgaaccgcgggtcgacttctttcaacgtcactgagggttactacttcacgtctcttcatgatcagcttcagctgtaatttggttccagcctatgcaaccgaaacttcaacttgcaagttgtccatgtatatggctagtcaagccatagtatatacctatatttgtcaggctgatcatgctagagagtaaactacgatcaaatagtcggtttcatgtaaccaatttatccagcatatcctatggagtaagtaccaaaaatattatatcagacaattattggaagatctcaaacttctgaagaaaatgctgttaaaccttctcagctaatatcttattgtttcctatctaaaagaaggaggatagggtataaaaa

SEQ ID NO: 34341 - DNA, 631 bp, Triticum aestivum
  Clone ID: PAT_TA_34341
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaagaacccaagtttacgaccccgggctggcaaggtcaaagtttttttatggggcccccaaaattaaattcccgggccggggtttaacaacgcggggatgggaaaaccccgggggtacccaaattaaagggcttggaaaaaaacccccttttccccagtgggggaaaaaccaaaaaggcccgccccgatcgcctttccaaaaagtggcccaccctaaaggggaaagggaaccccccctgaaggggcccataaaccggggggggggggggggttccccccagggggcccgttacctttgccaggcccttagcccccgttcttttggtttttttcctttctttttccgccacgttggcgggtttcccccggaaggttttaaacggggggctcctttaagggtcccaattaagggtttaagggcccctggccccaaaaaacctggtttagggggagggttaacgaaggggcccatccccctgataaacggttttcccc

SEQ ID NO: 34342 - DNA, 531 bp, Triticum aestivum
  Clone ID: PAT_TA_34342
tagcgtggtcgcggccgaggtactcccaccacgcccggttcactggcaaagggtcgactatttttccccttcggccagcaggtgttcagtgccaacatctggctgctgtaaagagctaattgtgaagttaacttcattcttttttcttacccgtgctatgttacttgttctttctaacatcggtggccaagtacaaccgtagctttaggagagtgcaaccaaggcacaaaggtgcgaattgtacaaataggagtagggaaagggtagaagcaaagaatatgttcctggcatggtagtacatatgagatgtaaacgcactcgtagtgcagttaatcgtattttttgtagctagtttatcatagttttgatgatcggttcggttgtatggctactcttatcagccacgctggaggtgctgccgtttttttgtttcacgtgcatgataacaaagatggaagtcccttcgtgaaagcacatatccttttgttacatggtggccttatctgtctaatatagggatgtaagtggcaa

SEQ ID NO: 34343 - DNA, 532 bp, Triticum aestivum
  Clone ID: PAT_TA_34343
tcaagagtaagcttgcagtggagggtgatgaggaccttgatagcctggaggatgatgacaagctcgagtacgatggagaggtgcttgaggaccaccagttgattgctgatattagcaacaaggatgatgctgtgattcatttgttcatccgcaaaccagcaaaggtacgaacacagcaagttgataaggatactgtggtcacagttgacaaccctcagaagaaagagaacctacagaatgaatctgttgtggtgacccctgcaaaaccagctggtggcaagcctgctcctatcgaaccaattgttgttaaccggaaggcgaagctgtcgtctgaagtgatgaaaatgattgactcagcaatagctggtcttgagaatggatatacaccagttatgtcagcagaaggttcagggggtgtttacttcatgcaagactcatcaggccagaagaatgttgcagtgtttaagccgattgatgaggaacctatggctgaaaacaacccaaggggtcatccactgtcgactgatgggga

SEQ ID NO: 34344 - DNA, 847 bp, Triticum aestivum
  Clone ID: PAT_TA_34344
caaaaacttcccctcccaactctctccgcccctgcgtgaactgcggagcaaggaaggaggagcccgtcgggctactaatctcgggggttccccctctgatccgggcggtctcggccgttagctgcttggggaggagcggcgccggttcgtggcgccggcgtcggtggccgggggtcgtcggtccttccttggttctctcgtcatcggaaaaataaatcggtcgatctgcctctggtgagggatttctcagattgcgtcgcgcggttgggttctccggtggggcaaaggcaggattttgagccactttgcccctaaaattaaatctgatttaatgggcgacgaatccaaaatgtgcctgtagcatcatcggttgtgccgtttctggtgtcgggctttcgcagagggtttcctccatccatcatagaaggaaggaacggaacccttggcttgactacgcgtgggcttctactaattcctagtgtagagcttctaactccggtccattgtaaatattggctgtagttgaggaagctttcggcctcctgtaacccccctcgccaagatgtcgtcagctggtgtcattgcgcttgctccgatgaccgacgacctcgccttcttgcccatcaggtttgatggtagtcgttcagcacactgtttctccgggtcacagctgcaggattccattctcatcttcctcgctgtgcctggtgcgccaccaatgccgatgagtgtgctgggcactgattccatcgcctcggtcaagctgcgcatccagaggttcaagggctttgtggtgacaaagcagcggcttgtgcttcgtgggcatgagctggcgcgcaacaactgc

SEQ ID NO: 34345 - DNA, 1461 bp, Triticum aestivum
  Clone ID: PAT_TA_34345
gcacgcggcctcccccaaccctttctgttccttcctctctcacccccacccaacccaacgaccacaaacatcgacacctcccctcccccccctcccgcgccgcctgcgccgcaagggaggagaaggggaaggagtacggcccctgggcttcccctctccgatcctgacgctcccggtccgggcggcttggggcggggggacgagcggccggggttcgtggggccggcggcggtcggccggggggtggcgtcggtccttcggtcattcgttggttgtcgaaaacacaaggcggttgatctccggttggtgagggctgtggcagagggcttcccggggttgggtcctctggtgggggaaaggccggatgttgagcgactgggtgcgtaaaatcaattcaggtcaaatggaggtcgaggttcaatttgtgactatggcataatcgtttgtgcggtttatgggtgtcgcgctttcgcatatgggttcctcccccaaggatagaaggaagccaacggtacacttgtcttgagattcatgtggagggcttgaacagaggcacgcgtttaggggagggtgcactaagggaagttgcggttcatattctcgaccgtgcagttggtgatggtgaatcgggccacggtgttcggttttcgggagtgcctcccacaccattggtccgaagcttacataggaggaagaacttcaagttttgatctctgcagatgtttatggagaacgatggaggatgctaggatttgggtccccgtgctttgcctgtgaagccaggtacacttaatggcagtgttagctattagatacgcgaatgctgatcgtcagccggggaacattctcgtgtctaaggaagaacgtcccacctgcaagctgctttcgattgatcatgcgtactctctgcctcgacaagtttgaggtgtggacctgcgagtggcgtgaccggactcaagctcgtgaggggtgcagtgttgaaaccattgcattcattgaatctcctgacgcggaaggaggacatcaagcttctcaggttccacgggtgggagctgtcttcgagctgcgcccgcttcctgcgcatcagcaccatgctcctgaaaaagggcccggcgcgaggcctcacttccaaacaccttagaacgtatactgtgcagggatacggtgaatccagtttgtgtgatctaggacatcatccaggatgcggaagaccccgtcctcccggggacgagcgagaacctgttcctggagacggtgtcggagatcatagaccgctacctcctcgtcaagtaatatctgtttagaaacactcagaataactgatctagttgttcggctgtatccggtttgctgtaagtatgtttcacaaggcactgccccaggcctcctcctcaagggactaatgatttcatttgtttctagccccgaacgattccgtttgtttgtacccgctcaagacca

SEQ ID NO: 34346 - DNA, 560 bp, Triticum aestivum
  unsure (1)..(560): unsure at all n locations
  Clone ID: PAT_TA_34346
ccaccagtagcaacaaagccagtacgtagcgcaagcagagtttagctcgctcccagcccggccgttcaccatgtggaccaagaaggtggcgacgcaggtggttttggtgctgcttctcctcctcatcgcacaggaggcggcggtgccgggggcggaggcgaagatctgccggcagcgcagcgcggggttcaaggggccgtgcctgtccgataagaactgcgcgcaggtctgccagcaagaacactggggcggcggcaactgcgacgggcccttccgccggtgcaagtgcatcaggcagtgctgatcatatgtgctacggctagctggccctcgccgtacgtcagctagctagcccatggaaccatacgtctgtgtacctacttgaatgtgtgcgtgtgtgccaccttctacgtacgtatgtcgtatgtatgtccgtatcaccactagccagccagctgctgcatctcgatcgaagcatgcatgggcgggctaaggtataataataagaataaaacgtacggttcacggttaaaaaaaaaaaaaaaaaanaaannnnaana

SEQ ID NO: 34347 - DNA, 785 bp, Triticum aestivum
  Clone ID: PAT_TA_34347
attcgggtgcgcgaccagctccgcagcaaagccagtacgtagcgcaagcagagtttaggtcgctcccagcccggccgttcacaatgtggaccaagaaggtggcgacgcaggtggttttggtcctgcttctcctcttcatcgcacaggaggcagcaggttaggggggtcggaggccggccgctcaccatgtggcgcaagcaggtggcaggggcacggtggctttggtcttgcgtctccttcccatgattgccagcaaagggagggggccgtgggcaggggggggagggccaaggtcccccggcagcgcagcgcggggcttcaaagggccttgcgtgtccgatatgaacggccgcgccggtctgcctgcaagcaaggctaggggccggcgccaactgcgacggacccttcctgcctggtcgcaagtgcatcaggcagtgcgtatgtttgtatgtgctccggctagctcgccctcctcctgacttcagctagctaagcccatggagatcatacgtctgtgtacctacttgaatgtgtgtgtgtgtgccgccttctacgtacgtatgtcgtatgtatatccgtatcaccactagccagctgctgcatctcgatcgatgcatgcgagagaataataataagaataaaaacgtacggttcatgttcaaaaaaaaaataccgtaactttgcaaaaaatgtgatcgtccggtcgtctcggtattttgcaaaaaaaaaaaaaaaaaaaactcgagggggggcccggtacccaattcgccctatagtgagtgtat

SEQ ID NO: 34348 - DNA, 996 bp, Triticum aestivum
  Clone ID: PAT_TA_34348
attcatcggagcatacctgtctcgtgggagatcgtgtcaacaccacaccaccgtgcgtgtcagccatgtcgctcatgccttggttcggcggcggccggggagggatggaccccttctcctccgacctctgggaccccttcggcgcttcgtggcccttggacgccgggcgccgaggcggcgaagggcggcagccgtgacgacgccaccgccatggctcgcaccaacgtcgactggcacgagaacgacaaggagcacatcttctcggccggagatccccgggggtgagtgaagggaggagggtgaaggtggaggcgtggaggacgcgcaacgtgctcaagatcagcggggagaagacgcgggaggaggagcacaaagggccgacggcctggaaccgggtggagcgcagcttcggggtcctttcatgcgacggttccgcgctgccggcatgaacggccccaagcggcggacggcatccggtgcaccatgcaggacagggccgtgctcacgcggatcgtcgtgcccaatgcacgacgcaagcccagaagcaagcggcaacgtccgcctccatcgacatcggcctaacggcttaaagcaccgcaccgacgcatgcagtacaacggcttcctagtgtgacatgccctctctcttcagtaccactgaactatgtttgacagatgacgtgtctcttactttatgcgcctgtactgttagtagccattctgtatcgtgtgttctattttagcagtatgtactgtaaggctaggctattctgtacggtagtttagaagtgtgttgtatgcgccatatagctgctacagcatactgtacttcccatctccagtatccatcgtaaactgcagtacgaaggaccagaaatatatttttaagcccaccacccccaacaaccacatcgcctacacgctccgcacctacccatgcagccaacggcttcccagcgtgacatgccatctcctctagtaccactacactatgcat

SEQ ID NO: 34349 - DNA, 604 bp, Triticum aestivum
  Clone ID: PAT_TA_34349
gtggctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccctttaaaggaacccaatttaacccccccggcctggcaaggaaaaattttttttttggggcccccaaattaaattcccgggcccgggttttaaaaagggggggaggggaaaaccccgggggtccccaaattaaatcccttggaaaaaaacccccttttccccggggggggaaaaaaaaaaaggccccccccgaaccccctttccaaaaattggcccaccctaaagggaaaagggacccccccctgaaggggcccataaacccggggggggggggggtttccccccaggggacccgttactttggcaaggccctaagcccccgccctttgggttttttccctttcttttccccccaggttggcggttttccccggaaaagtttaaaaggggggcccccttttggggtcccaattaaggcttttcgggcccctgcccccaaaaa

SEQ ID NO: 34350 - DNA, 732 bp, Triticum aestivum
  Clone ID: PAT_TA_34350
gaacagtggggaagtggcggacgtcgaggcgaggtggcccaggtcgggatctaatgcggcggcgcggaggccggcagcggcaacgctccatggccatggctgctcggtctcctgggaagaagagaggagggagagaggaggtgagatggagagaagagaaggcagagtagggacggcgcggcttcctgctgctggtccggcgatggctccaggtttgattttcggattcctctccttcccgctgcacgatgggggttgcccagccgccactctccctaccccgtgcacctcctccccctagccgcacctccctgcttccatgaagatgccgtcgccctcgcctgcatctcgctgttgttttgttgtccatggataaggagcgacagatttgacagaaaatagaagagaaaattttctagcgtaaaaggagaggatctcagaatgaagggattttttagctgtatttaacggacaattttgtgtgattttttcagaatttatagccaaagtctatttgatttgtgcaatgaaaatcagatccatccattgattgatagaatttaccatccttcttcattttgagaggtcaatctgcgttgttatctattcattggtggtgctttgcaaaagagagagcaggaggcaatgacaccgttgtcaacagcacggtgcagcgaggtaggaagccgtgtgcaagggatgaaactggcagcggtgcgccatgacaggccc

SEQ ID NO: 34351 - DNA, 941 bp, Triticum aestivum
  Clone ID: PAT_TA_34351
tctctttataccactccctctccctcactccgctccgcactgcagaatccaatccaatccaatccatcgagctctccaagtcgactcgcaccgtcccatcccacttcccacccacccacacacagcgagtaaccaacccgaggaaggaagaagccatggccgagctgctgttcgcccccgccgtggccggcctcgtccacctgccggaggtgctcgagcgcctcgccgccgcggacgccgaccaccgcgaccacgcccaccaccacaccgcccacgggcacgggcacggccacccccgcgcgcagatcgggggcgtgggcggcggcgcgcccgtggacatcgtggagacccccgccgagtacgccttcctgctcgacgtccccggcctctccaagtccgacatccaggtgactctggaggaggacaacgtgctggtgatgaagagcgccagcaacggcggcggcggcgccaacgggaaacggaagcgggaggaggaggaggcggactgccgctacatccggctggagcgccgcgcgtcgccgcggtcgttcgtgcgcaagttccggctgccggaggacgcggatgcgggcgccgtggccgcgcgctgcgagaacggcgtgctcaccgtcaccgtcaagaagcagccgccgccggagaagaagaccaagtccgtccaggtcgccatcgcctgatcgttcgggccttccttcagtcgcgcgaaccttcggtacctcgtcggcgtttgtcgtcagcgatcgttccggcagtagagtagtgtggcgagtctggtagatttgggtcttctcaagtcatgtggtctcatgctctgttcgtggtctggccggacattaggtgtgctcgtcgtgggcgtgtcttgtgaatcatgctgtgaatgcaacgatggagcacgaattgtatcttcaaaaaaaaaaaaaaaaaaa

SEQ ID NO: 34352 - DNA, 605 bp, Triticum aestivum
  Clone ID: PAT_TA_34352
cggacgcgtggggaaaaatttgctataacatcagggtagccactcaaatattacataggaagcatacattggatttgaagaggccccatttgtcttccatgctaaagttggcaggtggctgccgtgcttaggctgtatggggtctgagacgatccttgacaatacaacagaggggaactcaagtcgactgtctatgcaccctctggataatgtgttcccctgtcttgttttatttgtttgagcatcctcaacgatatacttgggtggtattgcaatcttctataactttccacctgtaatcatatgtattatgtattgcggatggaccagctgattcaatggttgacagaaaggactcaacctgcaaacaagaccattgttcccaaggtggtgaaatacaataccctgggccacatcttccagaggatatttggtgtcatatatattccctactgccaatgcgagattgttttccgttactacaatgccaaagtctgtaacattgatagctggtttcaggctgctgttacaccggggattgaagaactcactatagaactatcttcaaagtcaggaagatattacaactttccgtggtcactttt

SEQ ID NO: 34353 - DNA, 2019 bp, Triticum aestivum
  Clone ID: PAT_TA_34353
gatcacatttgaggcagatgccgggcacgccaccttgctagcctcaagcctgtgaagttcattggttgcccctccgcgggcgccgtcgcaacccccaccccccatccggttcgatccaaatcgagccgtgctcgcgagagcgagatccaaatcgagatttctcgaccctaggtctcgtcgaaccatgggtcagctgatgctcaatcgggtgatatcgatgcagcgggaaagtcgtcgcctgcaaatacaaccccataatggaacagcagattcaatggttgacagaaaggactcaacctgcaaacaagaccattgttcccaaggtggtgaaatacaataccctgggccacatcttccagaggatatttggtgtcatatatattccctactgccaatgcgagatgctgctcgagctgcttgtgtgtctcatgcatttaaacgtacttggagatgctatccgaaccttgctttcaatatgataacattgggcattgatatagaatcatgtggagaggacggaatagctagaaattttaccaacaaagttgaccacatattgaaaaaccgcccatgcattgccaccaagacactcgagattgttttccgttactacaatgccaaagtctgtaacattgatagctggtttcaggctgctgttacaccggggattgaagaactcactatagaactatcttcaaagtcaggaagatattacaactttccgtggtcacttttagccaatgagagtggaaactcgattcggtatctaaatcttgcccgttgtgctttctctccgactgacgagttgtgctttaaaagcttgtcaagactcgagctaagcgatgttgctattacgggggaccagttgggatccattcttcacaattcttttgctttgcaacggatgcaactaaagttttgcaataagataatttgcttgaagataccttttcatctacaacagctcagatatctggacgtgtttgatggcggcagcttgctgcgggttatagaggtagaagctccaaacctctctaatttccagtttatgggtcatcgcaaagtacacctatcgtttggagtaggattgcaattcaagaagttcgacttgtactttcctggtgctatcagctatgtttgtgctgattttctgtccagcttgcgatatgttgaagatctttccctaggttcacgttgtgagatgattgatacaccagttctacatagcaaattcctgcatctcaagcacttgaatgttgatcttcaagcaatgacattttccccgacctacgactattgttctttgatatcactttttgatgcttctcctttcttggagacccttgtcatgaatgtgttgcagcaaaagatgttgcacgagtcaatcgtgggagatacatcacatttgaggcagatgccaggacaccaccatgatagcctcaagacagtgaagatcattggtttctcctctgcgaagagcttagtagagctaacatgccatatcattgagaatacgagctcacttgagagccttacattgaacaccacaacaggacatcctttcgatagctgtttaaccaacaatactggaaagtgcaacctgttgggcgtggattttatggtggaagttggtagagggctcttggctatcaggacatatgttgagccaaaagttccctccggagttgagctaaatgttgtggagccttgccgccgatgccatgatcaaccaccgccgatgccatgatcaaccaccgccgatgccatgattcctgtgtaaaagttcccgcaagtcatcataagtaccctatgattcctgtgtaaaagttaaactagaacgtcgaggaaccttctgctgctgctacccgggttatatacccaaaacccaatatttaatgtaactagtaggctgtgagttgccaggtaccctttgctgtttggccagccagtttttagagaaaatccaatttttattgtaacagccgtttttaacatcaatttactataacagcctaaacc

SEQ ID NO: 34354 - DNA, 900 bp, Triticum aestivum
  unsure (1)..(900): unsure at all n locations
  Clone ID: PAT_TA_34354
gcacgaggagaggagactacaagtatgggagtaccaacaactacattagatttccaaaagaggccaaaacttcctattacagcgccaagaactacagaagtgttccaagaaaatcccattcgtactatgacgagcagaactggacagaatctcgtatctgttatgtgaatgctaaaggttacaacaatgcaccacccacgcgcccggggaaaccatcaaggccctaccaacctacctggaagaatactttccaaacctcttcagtgcaaaacaataggacatattccagatcacggaatgaggagggctgttctgatacaggtgtgggaaagaactcacatcgaactttaggtttgcagaatgaacaagagttttcgtcgaagcaagaaccctcctttgtagaaagaaggaaagcacgacctgacattttaagtaagctcttctcatcctccgttcgaatggcacatagttctctgaaacctcaatctcgtcccagttttggagtgaaggcatttgctccttctggtgagcatggaaatactgctggttctcttagtatggtaaaaggcatgcctaaccttggttctcattcaactgtatcaacatcaaatagccaatattcagaatccagggatcaaggaagtggtttgaacattggtgtccccacagagaacaaactttctgctcagatatttcatcaaaacattgccagtgccagcaaaattcagtctcatccacaaaatacactgataagttcaactgaagatgcagagaccagtccccctcctgggtcaaacaattctttagcaccgtctgttataatagtgcagaatgataaggtagaagcagtgagtggctctttccttgtgngggaaggtcatgctcttgatgttacagtag

SEQ ID NO: 34355 - DNA, 681 bp, Triticum aestivum
  Clone ID: PAT_TA_34355
cctttttccagcagccgtaccaaaaacggataacacctccaaaaccgacagaagaaaatctcttggatcaaagccagagaaagttcagctgattgagttgaggagggcaaacaacacggagatcatgcttacaaaagtgaagatgccgctgccagacttggtgagtgcggcactggcactggatcagtctaccttggatgttgatcaagtggaaaacctcataaagttctgtcctacgaaagaggaaatggagcttcttaagaactacaccggagacaagcaacttcttgggaaatgtgaactgttcttcctagaactgatgaaagtcccacgaatggagtcaaaactgagagtattctccttcaagatccagtttggttcacaagtcgcagatcttgggaaaagtttgaaaaccatagactcttcatgtaatgagatccgaagttctctcaagttgaaggaaataatgaagaaaatactgctccttggaaatacgttgaaccagggaactgctagaggtgctgcagttggcttccggttggacagtcttctaaaacttacagatacccgggcaacaaataataagatgacattaatgcactacctctgtaaggtacttgctgcacgatctccacagcttttaaacttctatgtggatcttgttagcttagatgctgcatc

SEQ ID NO: 34356 - DNA, 1566 bp, Triticum aestivum
  Clone ID: PAT_TA_34356
ggcctttctctctcctcaccgtcgcgcgtgtgcccctcctttctgtctctttctcctccgcgcgcgctccctcactctcctcccatccgtctaatggaggccctcgccggcgccgccgcctcgtccgcgctcctcccggccttccccgcccaccagcctcactcccgcgtggcgctccgcgcccgcccctgcggcccccttcgcgcgggccgccggcggcgggaggcaaggacgacgccgccaagccgaacgggacccccgtcgtcaagttgaaggttgatccaagtcaaaatggagctctcggtccggtcacaactgacaagtcacgcacgacctcatcaaccaattcaactcccgactccagcggatccagagctggcttgttcagaacccctatatctggtggtgtgcagagtgcaacttttgcccatggtttacctccaccagctttggctgttcgcaatttaatggaacaggcgcgatttgctcatctatgcactgtcatgtctggcatgcatcatcgacgcgctggatatccatttggttcacttgttgactttgctaatgactcaatgggccacccaatattttctctgtcgcccttagcaatccacaccagaaacttgctctctgatccaagatgcacacttgttgtccaggtacctggatggagtggattgtctaatgctcgtgtcacaatatttggtgatgtctaccctttgtcagctgaacaacaggaatgggcacataagcaatatgttgcaaaacatcaacaatgggcgtctcaacagtggggaaatttttactactacaggatgcagaatatcagcgacatatattttattggaggctttggcactgttgcatgggtagatgtgaaacagtatgaaactattcaacctgacaagatagcagttgacggcggcgaacaaagcttaaaggagttgaacgctattttctctaaaccacttagagagttcatgtctgctgaaggggaggttgacgatgctgctcttatatccgtagacagcaaagggatagacattcgggttcgccagggtgcacagttcaacatccagagacttgcatttgatgtaccatacaaggtggagactctagaggaggccaagagagcactccataagataatcaagacaagcagcaaataagccgaagcgcacacgacctgcacttggtttcaccaagccctgcaagcccgcgccgtgagtcgacaaaaataaccaaggatatgtaatctagcgtacacagaggcaaaataagatgatttctctttaataatgagaaactccctggcaagtccccatatagtgtgtacccatatgcttgtatcgcttgaactgtagtgaagctatgttgtgcagcctgtgcttgtggaagccggacgcttttgtcggacaagctagttgttggtttctgtgtcccggcatagtttattttgactatgatatgaagcatcagcatctggactcaactggtacaagtttgaatgtgcttgtgatgattttgacgctttgtgaagtattttttttgccaaaaaaaaaaaaa

SEQ ID NO: 34357 - DNA, 1156 bp, Triticum aestivum
  unsure (1)..(1156): unsure at all n locations
  Clone ID: PAT_TA_34357
acgacgctcaaggctccctaacccccgctttgtccaccccgaatccctcctgctgcctgccctgtcgccgcttcccgtactgccggccgtcctcgccgagagccgctaactttggcgccaccacgagccgggtaagaagatggtgaaggggatgcccaaatcaagacctatcaaagcggcggccgaggtggtcttcgaccccgtccgtctctggcccccggaagccgcgccgcgccgagggcgccctcgtcgagcagcgaagtatcaccacttcatggggtcgagtctttcaaatctgtaccacaagccagctccggcgaaatctaccgacatgtctgatgatgaccctgacatcgatgctccgaagttgttgattgggaaggagcttttcggtgccgctcccgggacggacaacaggaaaataccacaccgcaaagttgttgaactgggtggaaaggcctttaagaagcagcgtacaccattatctgtgccaatcccagctatgaagaatcaccagaaaagggaacaagagaagattgaggaggaaagactgcttgggatttttaggaaacaaaacaagaataagaaatttgagaagcttagaccagaggaccgagtactcagggcaactgaagggcgcttcaagaacggtatactcgatgtngaagcacctcatgggaggaccaaagcagtcctcgtcgtcatcgttcagagatgcgcccgagcgggagatgagaaagggtaagaaagggaaaggaaagggaaaggggaaaggaaaggggaagggaggccgaaggaacagacgttgatggaacacctgcctattgtgctttgtataccagatacatgcaggaagaagaggcttgagccgacaccttgaaccgtttttgcatcgagatatcttgggttatactaaatcaagacatttattttgagacagagagagtacttgtatcttaagtaatctctcagtcgaagtgaccatcctatgttacataacgtctgatgttacccgatgagcatttcagcttcccagaattcctttattttgcttctggggtgcttgtgcacttcgacctgncatcaaagacattaatttatttcccctgtgcttgtgcacttcgacctgatcagcagaagacattaatttatttcc

SEQ ID NO: 34358 - DNA, 1521 bp, Triticum aestivum
  Clone ID: PAT_TA_34358
tcggcacgaggcccagcccaatacttcgtcacccggggagaggcggcggcgaccaccccggggactccgatggcgacggagaaggcgcggcagctcctggcccgcctcgccgccaccccggacgccgccgttcctaacctccccttcctccaccgcgcactcctcctccctctcctctccgctgcctccgctgcctccgccctcctccgcctccccgtcatcctctcctcctctccgctacgctcgcgacggaccctaccggtccccgtcatcagcgtagggaacctcacctggggcggcaacggaaagacacccatggtcgacttcctggcccgcaggtttcacgccatgggcgtctcgccactcatcctaacaaggggttatgcgggtggcgatgaatctaagatgcttcggaggcgccttgctgatacttccaccaagattggtgttggcgcaaaccgggctgccgtgggttcttccatgttgcaaaagtatggccatgtcgatccttgtgatgccttctgccgggagaagttagcgtgcaaccgggtggcaagcggtaaaagtgcgaaaattggagtcgctatactggacgacggaatgcaggcagcaccggagcctgcttcgagatgtggagattgtgatggtcaatgggttgacaccttggggaaatacccatttcattccacgaggacccatgagggaaccgttgagcgcacttactcgagctgatatagtggttattcatcatgcggatctggcttgtgaagcgcagctggaaacaattgcacgtacagtccaggatagtggcacaacatgttcagtgttctttagtaaattggccccatcacatattttcgaggttcatcaaccattacagaagagatcccttattctgtcgggcggcgtgattgggccacgtgttgctgataggttggatttcagtgatcatcatttcttcaatgattatgacctagaattaatccaagaaagagtgaggcagcttgtggatcaacataacaaagagaccgtagtcttagttactgagaaggattacgaccgtgatccagatgtccttagaatgttgggcgtgaaggtttgggttccgtcttcttctttgcaaattatggccctcaaggaacaaggagaagatgaattgctgaggaaattaaaagacattatcacagcaactaggcatgtggtccagccatgagttgctgatggatctggttatattcggctgggcatatcttgaagcaaaaacagttttccattggtcctgttaattccgtataatgttatatcagatttatctggttaattcaaatcctgttttggcgttttggaacatgcagtattttagttttttttttcaactgggtcagtggtctgagcctccagttaacttgaactggatctaacaagataatgcaggaggggattccccgtcctattgcccatgtgatgcttttggtttcagtttcttttggaaaaagttgttaggtaaatatatccatcaat

SEQ ID NO: 34359 - DNA, 955 bp, Triticum aestivum
  Clone ID: PAT_TA_34359
ccacgcgtcccgcttgagagtctcccgaggcttcccggagcctcccctctcttcctctgtcggccctgccggcaggagaagggacgggccaggctgccggatcttctctgtagatagtaggaatagtagtaagtttagtttgagtttgccatcgggtggtctggctttatgccttagtttggcgtcatgccgtaggggtggtggtcgcgggtgcctgcgagcggcatccagcggtggccggctgcttctcccgttcgttgtccacggtggatggcggcggaggaggtgggatccggtgagccccttctcaataagctcgttgggttccccagatctggagatgtggttccttcctttgcagctctgttcttgccgccgtggtggaggcagatgggctgcggaggccgcatccatctctagtcgagttgcaactgcagtcttcttcctcgatcttatcagcaggtgtgttcctggtggagcttcggcgcgcctaggtcgtttgccggtctctgtcgccaccctgctttttctggtcgaagggcgacctattgaagccgtgatggctctgttctttcctcccgacgcgccgtcgtcagatgggaggcagcccagtgcaagccaagctcatgctgtcgtttcttctgatctggtgaagatggcgcagcggagccgccgccccaagtggtttgtccccggcgacggagggtttggagttcggcttgttctgttacagagaactggattgcgtttttgctctcttttctggggtcctctttgcaagatgcaaggactggtctgtaattttcttttctttaggggtccttgtgtaaggtgtgcttgtactgtttgcagttatatctaatgcacgctcggggtccttagagacccctcttctgttcaaataataataataatataagagacaggatttttgcacccgggagaaaaaaaaaaa

SEQ ID NO: 34360 - DNA, 397 bp, Triticum aestivum
  Clone ID: PAT_TA_34360
gggccgactcccaagaaggggaagaatgtcgagctgcctaccgtcaaagtcacaaagaacagcgttggcggcggcagggtctccgtcaccgttgagaaataagcttggcttgcagcagtaggcccgccgtcgccaagtgatccaatcaagccggcggcagagatttttagcccgtggtattttgggtagtagttaatttagcacaagatattttgagttagttaattccggatgatggtgccggtatctgttagatagtttgagtgtgcctgtcctttagtttcgtgaaacattctcgtctgccctagtgcaaattcgaagtaactatacactccaattgcaaattataaatatatatgtgcctgagttatcgccatgtttgtcacgcgatctctca

SEQ ID NO: 34361 - DNA, 1314 bp, Triticum aestivum
  Clone ID: PAT_TA_34361
gcacgagggtcgcacgcgacttcgcgagaggggggagaagcagcagacgaaagcgagagacctcctccttccccaaccccagccccgctccaaaccctaacccttcctcagatctcgcgcccgtctgccctcccgccccgccccgccccgcctcgatgtgacccggcccctagggtttgtgccggtgcggtgtggtggtgggtcccggttcgtcggcggatttcggacccgaggagttggagctggcggcgcgcgcgcacatgaaggacccggcgcaccgcacgaaggtggtgctcaggcggctgccgccggcgattgcgcagcaggccgtcgtggaccaggttgacgcgcgcttcgctgggcggtatgactgggcctgcttccgccccggtaatgccagccaaaagaatcatagatattcgcgtctctaccttaacttcaagagcccagaagatgttgttgagtttgccgagttcttcaatgggcatgtatttgtgaatgaaaagggtgctcaatttaaagctcttgtggaatatgcaccatcacaacaggttccgaagtcaaatatcaagaaagatgctcgtcaaggaactataacaaaagatccagaatacttggagtttcttgagcttatatcaaagcctactgagcatttgccaagtgctgaaattcagcttgaaaggaaagaagccgaaagagcagctgctggaaaggtgccccctgttgtgacacctcttatggtttatgttcgtcagcaaagggcggctaagagtatggctcagaggtctgtaagtagtagactaagcagaaaagttgcaggcgtggtaactagtagttctagtccatctaaaaggtcttctgaaaggcgcagggcctccacttcaacggtactatgcttggtcgagaattgtcacatgaaacggatcttatccttcccgccatatgttttgagtaggcctactcattaattttgtacttgaaatagtaacatgtaatgaaaagtctgttccaagcatgtatatggtgacacgaaccttttttattggccatttttggattataacatgtggtagcaggtggggctcaaatgccagcacattactgtgtcatgtttttacagtgttaggtgtaggctgttgtacctctatgcctgactaagtactttgagcgccactgtcaactctgcataaatctgttacatgggaatgggacattcttcatgtttgtaagaacagactcatggctgagttgtcatgcgtgatgtgcgtggcgcggaatctagctaatattggaacctttaaaaaaaaaaaaaaa

SEQ ID NO: 34362 - DNA, 1794 bp, Triticum aestivum
  Clone ID: PAT_TA_34362
tcgaccccgcgcccgccgggtcccccgctcggccctcccctccggcgccgggggaagcggcccgccctccctgtcctcggacccgtggccgggcgcgcgggcgcacgcgtgggcggtcgcgtccgcgagagttgaagcgtcatttgaattcacttgaggagcgacttctggaaagcatggcatgggagaaaggctcctcaatgtacaattccttaattgttgctagacctacattgtctgcagaaataaaccggctaggtttactggctgaaccaatgccttcgcttgatgctattgcggtgcatcatgatatttcactgggtggccttccacctctcccatttcacaagcaaccagataaagatgaagttagatcgcccaaaagagcatgtactgaaaggagaaatgtgctggtggacaactcatttagatcaccagtaaaggatgccatcaaatcaaagtttctacctcctcttcagtcggcgtttgcaagcccaacaagacctaatccggcagcaggaggagaaacatgcgcagagacaggaataggtgtattcttgagcaagataacaaaacttgcagccattagaatcaaatgtctctgtgaaagattgcaacttagtcagcaaattctggagcgagtatactcccttgtccagcaaattatcagccaacaaaccgctctttttttcaacaggcacattgaccagatcatactgtgctgcatatatggagttgcaaagatatctcaactagcccttaccttcaaggagattattttcagctacagaaaacagtctcaatgcaagccacaggttttccgtagtgtttatgttaattggccatcaaggagccgcagcgggaaaataggagaggaccatgttgatatcatcactttctacaacgaagtatttattcctaccgtcaagcctttgttggtggatcttggacctggtaccagtccaaacagaaacaatgagccaaaaagtggtggtgatgcagccccatttccagaatctcctcggctgtctaggtttccgaaccttcctgacatgtctccaaagaaagtttctgccactcataatgtatatgtctccccgctacgatcgtcaaagatggacaccctgctttcgccgagctccaagagctattacgcgtgtgtcggggagagcacccatgcatttcagagcccctccaaggatctgaatgcgattaacacccgcctaaacagcgggaagaaagttaacggaaggctcaacttcgacgtggtgagcgatctggtggtggccagaagcctgagcgaccagaacggcagctccgctgctgcgatggcggtcttcggcaccaagacgccggtaaagggcgagcagcaggacccttagcttggtcgtgcggcgtagccatcacgacctattgatacaaatgctaatctgttaggtgtgagcccgatctagtagtgttggatgttttagtctctgatatgtgttccctgacatggggagccactctgtgtgagcagctctttactcttgtgatatataaaaagaagggctgccctgagagagagggacccgctgacctgtgccgcgtgcattctgacttttgagcctctcttggtttgcaaggggtttatgctaatgtcagcgataagtagtagtactacctctgtttctttctaatgtaagatgttttgacggtctaaacggccctggcgggtcgtccgacggtggtccaactgccccgtatagagagaaaacaaaaaattaaaagaaaaaaaaaaaaaaaaaaaaaaaa

SEQ ID NO: 34363 - DNA, 643 bp, Triticum aestivum
  unsure (1)..(643): unsure at all n locations
  Clone ID: PAT_TA_34363
cacagcgaatttttcatctagtggactttttaacattatataattcaacaatagagaatatagataagcaaacacctatttttatggagaatataccatttttggcgaccttcatgtgaccagcagtgccggggtgatctcgtgtctcctgctgcaggtcgacgaggaacaggcgtgacaatgaaaacaaaaccagtgaacagagtgggagtaagtggtggtcgagcggcagatggagccccacaactcatgcacccgcgtccaccgccgaccgccgccagcccagccaaactccatgaggtccacctgcgccacatcgccatcatcgtactccatcaggatctccatgtacattgcgttccacacctcatcgtggaagcccaccttcagcaagaactcgcttgggaaccaactgctcgatcgtagaccatactcgtccttgtgggactgccacaagcgtcgaggtcgaactattgcacanaagaaataaatcaggaactcatgggatgcagggtcgaaatgttgcagaaaaatatggtggtttctcttttttgctgagacattcccacaaatgtaccaagtgcacaggttgaactgatctcgggcacgggacgaacttgctcgagggttggcttgggaggct

SEQ ID NO: 34364 - DNA, 710 bp, Triticum aestivum
  Clone ID: PAT_TA_34364
cgcgggttcccgtcggggcgccgtacccgtacctccgtcttccctgcggctgcccccgtctcccctgcgaccgcccccgtctcccctgcgaccgcccccagcgctcctcccccggtctcccccgcgacaccacagccgccaccaccgccgcctctcgcgccaccgtctcccccgcctcccaaagctgtcgaccaccgccggccgccgccccccgcccctgcttcccctccgtccaccgcgacctcctcaccgcccagcacctcgtctgcctctcgaatcgaccgaactcggtgtgaactctttgatctccatcggcagatagttcctcttgttgattcatggggttggcagaagtccattgttgagaggagaaaaccgttggtaggcatagacacggacacagatgaagatcactcggacaccttaatcacgctgcagcatccaccagtttatacactgggcaacggcaatagcgagaagtacctcaatttcaatatagaagattctcctattgagattcatcgtattgatcgtatatggggacgtgacatatcatggtcctctacagctcgttctgtacccgattctcaatttgcggtatcaaaagaaggatcttaactggtaccaaagatcacttgaaactgtgatcattcgtgcccttcagtccgcattctctattaaggcatcaacaatagaaggcctcactggcg

SEQ ID NO: 34365 - DNA, 1098 bp, Triticum aestivum
  unsure (1)..(1098): unsure at all n locations
  Clone ID: PAT_TA_34365
cacagatagccaatgtatacttggatacatatgttatcacgggagatgagtattattcttcagttgcacgtgatatacttgattacttgaggagagacgtgattggggaagatggtgaaattttctcagcagcacctgctgacagtgcagaatatgaaggtgctccacgaaaaaaagagggttctttctacgtgtggacaagtcaagagatcgaagacacacttggggagaatgcggagctgttcaagaaccactactatgttaaatcatctggcaattgtgacctttcggggatgagtgatcctcacaacgagttcagtggtaaaaatgtgttaatagaaagaagaccgggttcattgatggcatcgaagtatggcaagtctgttgatgaatattatggaatcctgggggaatgcagacagaagttgtttgatgtccgatcaaaaaggccaagaccacatttggacgacaaggttattgtttcatggaatggattagcaatatctgcctttgcaagagcttcacaaattttgaagtcaggaccacctggaaccaaattttatttccctgtagcaggatgcgatccagtagaatatcttcaagttgcagaaaaggcagcaaactttataaaggaaaaactctatgatgcaagctcaaaaaggctgcatcatagttatcgaaatggcccagcaaaagcaccaggatttttagatgattatgccttcttaatcaatgccttgctggatctctatgaatatggtggtaagatagagtggcttctgtgggctgtcgagctgcaagtcattcaggatgaattgttcttggacaaacaagggggtggctatttcaatacacctggagaagacccttctgtccttttgcgtgttaaagaagattatgatggtgcagagccttctggaaactcgatggcagcgatcaacatggtcagattgtccagtatatttgatgctacaaaatctgaaggctacaaacgcaatgttgaacatctcctggcggtttttgagactagactganagaacttggcatagcattgccggctgatgtgctgcgcagcagacatgctcagtgtcccgtca

SEQ ID NO: 34366 - DNA, 1302 bp, Triticum aestivum
  unsure (1)..(1302): unsure at all n locations
  Clone ID: PAT_TA_34366
gatttgagcagagttcgagnatnaaaaaattgtattgaatccagaaagcgtaatgcatcctttgagctgctatgttagtcacttcaatttgaccagacagcaggatgcttctgaagcttttgttcatctattgacatcactgagggatgaattttcccattgctatgtaccatataagagctctctggcagacattaccatgttccactccaaagtatacaagcaaagggaagctgtcattggacttcgagaattttcactgcttgcccctctctcccgtggctgatataaatggagatattattaatgggtgtagtttggtggattgcctgaagcatttcactgtgttggagcatcttgacaattaccgttgtgatcattgttggcataatgctgctgccaaatatttctctcttcaatcagaagttgatgaggaaaaagttaacaaactgcgcacctgtgtcgactatgatagttgcaattgcaagcatttatttggtccagagaaaacaacatggtcagtatcttcgaaagccacaaagcagttggctatcactcgttgtccgaagatcttgtgcattcatttgttacgtgcttctattagttttgatggtgaactcgtaaagcgtcagggacacgtttcttttcctttacttctcaatttatccccatttgcaggaggcacattcaccactggacagggacctggaccttcagctatgaacgtgcaaaaatatgacacgccgtctctcaaattctataggcaactaaatgcacacatgcccattaatatgtttcctactggtgggaactcatcaagtcaggcacctaaggatcaagtaacaaatggtggtgtccactcacttaatgagggaaatgctgatgtggctttgagttcttcgtcaccatcgccgtccgcatcaaggatggagctatataggctatcagctgtcgttgagcactatggtgtatgcggaggtgggcattatgcagcttaccggagagtagcgtcaactcctgacgctaatgatcaagtaggacctcgtcgcaagcactgggtttacgtctcggacgaccatgtatcacaagtttcagaggacgatgttttgggtgcggaagccaccctccttttctacgaaagactgtagcagcagcctgttgagtaggagacgtttttggagaaatcgatgcggtagcttgtcaagaaacagcccctcttatttgagcaaaatagcttaggataacaggcctttcttgttttgtaatctgatgcgtaaatgttcgttggnataaaatacgaga

SEQ ID NO: 34367 - DNA, 645 bp, Triticum aestivum
  unsure (1)..(645): unsure at all n locations
  Clone ID: PAT_TA_34367
ggaattcggacgaggccgccgcgacgcccgccggccgctggcagccactcctgccnccgctgctgcgccctccccctacctacgcgtccggggagagagagagagagagagagagagagagagaggcggcgatggcgaggcacttcctgctcaacaccggggccaagatcccctcggtggggctcggcacctggcaggccgaccccggcgtcgtcggcgccgccgtctacgccgccgtcaaggcgggctaccggcacatcgattgcgccagagtctacggcaacgaaaaggagatcggtttggcgctgaagaagctatttcaagagggcgtagtgaagcgcgaggatctatttatcacctctaagctatggaatgatcatcatgctcctgaagatgtgccagaggcactaaatgaaagcctggatgatttacagcttgtgttgttggatctttatcttatccaggggcggtttagtgggaagaagggaacgaacaacaaccctgaaaacatcgttacacctgacatccctgctacttgggcggcaatggagaagttacatgatgctggcaaagctcgcgcaattggtgtgagtaacttttcatcaaagaagttgggtgacttgcttgctgtagctcgtgtacctc

SEQ ID NO: 34368 - DNA, 1063 bp, Triticum aestivum
  Clone ID: PAT_TA_34368
tcttcctgtggcgtattggtcagcttgcgtgcgttcgggcgccgacgcccttttccacacccgggacctgtggctgggagggtggtgtccttgttgcggtcgggttctcgctggcatttgtgatccatgaatctgcaaatccgcatatagctgttttgggccgtttgcctggcaccactgtgtacaggaatacattgcaataccctgaggcttatacatacagcgggattgttgttgtccgtgttgatgcgccaatctactttgctaatataagttacataaaagacaggttgcgtgagtatgagctcaaactcccaaattcaaaccggggacctgatgttggaagggtgtattttgtgatcctcgaaatgtctcctgttacgtacatcgactcgagcgctgttcaagctctcaaggacctgcaccaagaatacaaagcacgcgacatccagattgctatagcgaatcctaaccggcaggtgcatctactgctgtcaagagcgggcatcatcgacatgattggcgcagggtggtgtttcgtccgagtgcacgacgcggtgcaagtatgcctccagcatgtgcagagctcatcgtcgaatgccattaagttatccccacaggcgtctgggaacttgacggagtctcccaaggcgcagcagcggtatggcttcctgaggaacctctggaaagcacaagacgggaatgggagcgccggtgacgaggcccagtcgttgctgcgccaaaaccttgtgtagccaattgtctccctccctcagtgccaatcatgatgcatgcatttgtatttgtgttgttgtatgcatgtagattgtgcaggaaaataaaaggatgtaattttgtcaatcccccctgtcttgctgttaatagagtgggaatttaggactgtgttgtaaaaatacagtgtagatacgtcagtagcatctcttgtcgaggcccagttatctgtataataaaaaatgtaatctgtatcacaactccacggggtagcgatctggctaccgtgaaaatttgagattcttgcaagagaaaaaaatgatgaatgtat

SEQ ID NO: 34369 - DNA, 903 bp, Triticum aestivum
  unsure (1)..(903): unsure at all n locations
  Clone ID: PAT_TA_34369
gccgcccgggccggggtagcattccaatcattgtagtagcagcagcaacctcccaatcagctacgtagcaagcagcagcactcagcatgatacttcggtgacatggcctgcaagaggaaggcgccggcgcagacggtcctgccccgtcggccccctcgcggcgacggcgcggggcggtcgccgtcggggcccaggcggggtgcgacaaggacatcgacgcctgcatggcgggcgaggcggcggccgccggaccgccccgccggcgccgtggcgcgcgcggagggggacggcgggacgctgcggacggcggacctgcggtgcccttgctcctacaagaactccccctggctcagcctctacaacatcgaccccaagcgcgccatggagctgccggccaagtgcggcctcaccacgccgcccgactgctaatccaccctcccaacccctgccctcctgggtgccccggggtgggccggatgatgcatgcggtacaaatggcaagagcccggaggtatagtatacatgtaccgagtccgtcatatacatgtgctcatcttgtcgtacgttgtcgctcgtactacgtacctgtcggtgtgtagaagtgtgtgtttccgtgtcccctcttgggcagtgactgcgtctgtgtgtaacattgccactacttcaaaaaaatgtgtgcactttatacatgtgcatgtggtttctgtaaacaatctatttcgggggttaattaatccaccgccaaaacaacaaaataatcgcaaaaaaaaaaaagcccctaccaatncncctanatgatcctataccccctcatggcgtcntttaaactctacgggaaaacctgggttaccaantaancctgnanaancccttccatggtaancaaagcccccgttcctcaaa

SEQ ID NO: 34370 - DNA, 863 bp, Triticum aestivum
  unsure (1)..(863): unsure at all n locations
  Clone ID: PAT_TA_34370
cgacccacgcgtccgaaacaagtaatttctttttaaagaaagcgaaagaaggtacgccgacccgaaccccatagcgacgacgttcgccgcgacgtcccccctctcttctcttggctaaatctcccgccgccggtgcagctcggtcgctccgtcgctggaggcgcgagaggaagggggaaagatgaagacaactaagggagggaaagtcatgaatcccaccgacgccttccgcaaggagcagcgcaggaaggagcttaagcggaacaaaaaagaaagaaagaaggtacgggaggttggcattttgaaaaaggacccagatgctataaaggatcagattgagaagttggaaaagatgaaggctgatggtgctctggataaggctaggaaacataagaaaagacagcttgaggatacttataatcttgttgtgaagaaaaggaaggaatatgaagaaaagatgaaagaaaagggtgagcaaccagttatgttcagccatcttggaccaccaaagagacggcctgcagcagacgaagatgacagagctaaaaaccctatgcctgaggattctgtttactatcacccaaccttgaacccatctggggcaccaccacctggcaaacctcctatgtacaaatcatcgataggaccaactattccactgccttcctcagttggtccatacgcttcatcttccataacagaatctgtcgacgcaggtccttccaccatgcccnctcctgcaccgncccctncactgccagccaattcagaaccttcagatctatctgtcccttctttaccctttacccccaccaccggcccccaccccggctaagcctgctggcgcctgtatagcaccaggc

SEQ ID NO: 34371 - DNA, 854 bp, Triticum aestivum
  unsure (1)..(854): unsure at all n locations
  Clone ID: PAT_TA_34371
ctagatttagcggcggcggcggccggtgagctcgcgcacaacggagcgggccccgctctagaggggagcagccatggcgggggacggcgacgaggagccgccggcgacgggcggcgacaagctgatcctgcggggcctgcagttccacgggttccacggcgtgaagcaggaggagaagaagctgggccagaagttcgtggtcgacgtggacgcctggatggacctcgccgccgccggggactcggacgacatcgcccacaccgtcagctacaccgacatctacaggatagccaagggcgtggtggaaggcccgtcgcgcaacctcttggagtcggtggctcagtcgatcgccggctccacgctgctcgagttcccccagatctccgccgtccgggtgaaggtcgggaagccccacgtcgcggtgcagggcatcgtcgactacctgggtgtggagatactgaggcgcagaggggcatgagcacaagaactgaacagaattcatctcagttgagccgatcgatctctgtctcttatacctatgtgtgaatgaacatatgttgattgcgctcatgaaacaacaaatcacgaacagagttatttctgatctatgctgttcgagtgaaggttgggaaacctcatgtcgcggtgcaaggcgtcgtggactacttgggagtggagatactgaggcacagaaatgcatgagcagaacttcatcatatgagaaagcctgaccaaaatgctccctcagaatcgcagtttccggtgtccctggtcctataattataaaacgtggtgttgattgtggncttactccccggctgttgctgaaattgccgcaatcatggatttttttt

SEQ ID NO: 34372 - DNA, 1376 bp, Triticum aestivum
  unsure (1)..(1376): unsure at all n locations
  Clone ID: PAT_TA_34372
ctttctccggacagaaaatacacacactgaagatatcagagtcacagagattaacacgcgtcgtgtatcagcaccgaaaagtaagcttgcaattcagagggagctgctagctctgaaaaagaaggcactagcgttgagaagggaaggaaaggtggatgaagccgaggaagagttgaagaaaggcagtattcttgagaagcaactcgaagagcttgaaagctcttccaatagacccgtagccagggaaaacatggtctttagttcaaagtccccactcattgctgaaccccctagtctggattttgctgatgaaggctatgaacctgaggtgacagacaatgacatgcaggatccagcattgctgtctgtgttgaaaaatatgggatgggaagatgatgataatgattctgtgaaaacaacagataaaccattgaatcgttcacctgtagttgctcagaagccaaagaagaataagggtcagattcagaaggaactgcttgctatcaaaaggaaggctcttgcatttaggcgggaagggaagaacacagaagctgaagaggaactagagaaggcaaaggtcttggaggagcaactggcagagatagaagaattggctaactcaactgcttctcaaaaaggttcaggtcctggtgaacatgagactatggaaaataaatatgatattcaacatgtccctaatgttcatgctactgcatcttcaataagacatgcattgaaggaggatgtttcgttgccagtgaatgcagctgaatttagttctggaagcaaaccacaaagtgaaacagtcacttctaaacctgctcacaaattggaggtaactagtgatggagcatactcggctttctccaggtcacctattgctgatcagttgcaaactgcagaagcatcacattcaccttctgatgttgatcataaagaacctccaaaggcacatggagacgacacactcagagatgatatcttactccataagagaaaagcagttgcttttaagagagaagggaagttggcagaagctagagaagaattgaaactagcaaaactcttagagaagcgtcttgaagcccctcaacaagacagtgaggatggtgcacatgagttagccacagcagctgttcagcagagcaattcgatccagcagtctgccagcgtcaccactcacaccaatccgttgacctatgcccctccagcacaggaaaacaagtcggttgagcctcaaaaagcaatgtccagccgagaccgtctcaagaatccaacgtggaatcccccccccccgcgcgcgcctgaattaagagaaaggaagacgcggaacantcggaatcaattggcaancacnaagaccactggagatcagg

SEQ ID NO: 34373 - DNA, 487 bp, Triticum aestivum
  Clone ID: PAT_TA_34373
ccccgggctggcaacgccttagtttttttttagggcaccctaatttaatttactgggccgtggtttaacaaggtggggatgggaaaaacctgggggttaccaacttaattggcttggaagaaaatccccttttggcaagtgggggtattaccaaaaaggcccgaacggatggcctttccaaccagtggcccagccggatggggaaagggaaccccccttgaacggggcctttaaccgcgggggtggggggggttacccccagggggaccgttacattggcaagggccttacggccggttcttttggtttttttcctttcttttttggcaaggttggcgggttttcccggtaaagttttaattggggggctccttttagggttccgtttaagggttttacggaccctgaaccccaaaaaactggattagggtggagggttaacgtaatgggcccttggccttgataaacggtttttgccctttggacg

SEQ ID NO: 34374 - DNA, 660 bp, Triticum aestivum
  Clone ID: PAT_TA_34374
agggcggagcagatccccaaggaggatgacagcaagtcgttctacgaggtgtatgacgtggtgctctacctgggcatcatcgacatcctgcaggagtataacatcaccaagaagatcgagcacgccgtcaagtcgatgcagtacgactcggtctccatctccgcggtcgaccccgagttctactcggagcgcttcctcaagttcatccagaccgtcttccccgagaactcgtagcgcctcggccaaccatcactccggcgaacgctccagccccaggcatggcatgatcttccgccactggcgggcctgtgtacagaacgaggaacgagggcatccgcagagagtcttctggagggctggattattttcaagcataagcacaaaccatgtctttattctgggaataaaggtggcatggctgggttatggaggatggagaatccaccgacgtcccgctgtgtgaagagcatctgactttctgcgcgaatatatgtgtccgtcgagatcaggagcgatgtgctgggcatctggaagatgtcgggaatagattcttggtctacttttgttgtttgtttcttttgcaagcagtgctgctagtgttcactaggaacacacctgtataaagaaccactacccaaagatgaaaactgaatttccaac

SEQ ID NO: 34375 - DNA, 534 bp, Triticum aestivum
  Clone ID: PAT_TA_34375
gaattcggcacgagctcttccggccccggcacacgcgggacaggcaacccaatccatccccagctcgtcgagcgagagagcagcggcgccgcacgtagtgcgcatccggtccggaagcacccagcccagccgaaagacggcacgatatagcacagtcgatagctcgatcgccggcgcgttcctttttgttccggaatagattcgacccccttcccattcttgcggtcggtcgtggaggttcgcccatttttagcgcgaccgttgctggcccgagagcttttgttggagcgagcccgcccggcgccagagccccccgcgacggtccttgtgcgtctgcccgctcgcgcgaaccgaggaggaggggcggagggagcgatggccgggagcatgcaggcggcggacgcggcggggcggatcagcgcgctgctgtcgctgctcgcgctgcgccggatcctcgccgtgctccagcccttgctcctgctcctgctcctgcccttccgctggcgggcggcgcgccagggggacgccgccgcg

SEQ ID NO: 34376 - DNA, 659 bp, Triticum aestivum
  unsure (1)..(659): unsure at all n locations
  Clone ID: PAT_TA_34376
acccctctcctgctcctcgccccgccccgcgcgcctcgccgtccccggcgtgcgcgccggtggttgcctctgtcgcgagagtagccggccagctaggtaggggagagtggcagtctggcagagaatggtggcgcccgacctgacctgagcagagctgagatcctcctttgcgcatgctttcttcgtcttgctccgtcgcggcgtgcggcgttcgtgcgttccggctcctggccgtggccgccgtccggctcccgatgctcctcttctgcgacgccatggtgtgggccgtcaccttcctcaccttccccgtgcgcctcctcgccgccgccgacagggagcgcaagctggagcggctggtgggggagatgcaggggcagatggagcgggtggtgtgggagaacagggacctggagcagcggctgcggacggcgctcaaggagaacgcgaccatggagggcatcctcgacgagatggaggaggagaacgaggacgccttcgcccggatcgacctcctcgagagccagctcaaggcgctcaagaagganaacatgcggctcaaggagcanaggggcaagtccgtgtgggacaaggcggcggccacggccacggcggcgaccgtggcggtggccggaattggcggcggcaagaacaacctggcg

SEQ ID NO: 34377 - DNA, 1027 bp, Triticum aestivum
  Clone ID: PAT_TA_34377
ggcgttcccggccagctccagcacctcgggctgcgaggtactcgaggacggcggcgaggtagacgggggcgccggagccgacgcgctgggcgtagcggcccttcttgaggtagcgcccgatgcggccgacggggaactggagcccagccttgatggacttggtcaccgacttcttcctcggcccgccgaacttcttcgccgccaccttcttcgccttgctgccgtccatcttgcttgcttgctccttgctgggggctccggcgagagggtttgagagtgggtggaagttgagctgtggaggttgaggtggtcgtgaggggcttgttcatgtatcgcagatggcaagcagacgagtagccaatgcaaaggaggtggtgaagcgtgatcaggaggtgttcgtgaaggtagtttcggtaaagggagataagttgagtctctcactgagggatgtggatcaggatacaggaaaggaccttctgccaatgcagcgtggtgtggaggatgctccaaggactaacccatctgttggtagtgctgctgctgctgggtctggaaggaggttgggtctatcggggattgtgattacagaggaggatgaggttgcacccatctcgcggcgtcccctcaagcggatgagctcaccggagaggtgggaagcgaagcagctaattgcttcgggtgttctcgatgtgagggattacccacagtttgatgaggatggtgatggaatgttgtatcaggaggaaggcgcagaggaggagttggagattgagcttaatgaggatgaaccagagttcttgcagggacaaagcagattctcaattgacatgtcacctgttaagattttcaagaatccagagggttcattaagtcgagcagcagctctccagactgccctcatcaaggagcgccgtgaggttagagaacaagagcagagagcaatgctggactcgatacccaaggatctgaataggccatgggaggacccattgcccgacacaggtgagcgacaccttgcacaggagct

SEQ ID NO: 34378 - DNA, 1020 bp, Triticum aestivum
  Clone ID: PAT_TA_34378
gagtgagggcgaaacagaagaagcactcgcacaaagaaagccaaaccacactcgatcgccgccactctctgctgataccacaccccaggctagcagccatgatggcttcacgagccgccgccgctctccgcgcggccgccctgcagggctacttccggaggtcggcctccaccgcggcggcgcacgccgagaggcccaaggccaagcccatgggcgactacgtgccggtgtacgtggcgctggggatgatcggcctggcgggggcgctgggactgcacacggcgcggcagcagctggcgcacgcgcccaacgtctgggtcgacaagcgcaagcgcgaggcggtgcccgaggtggcggacccggacctcgccctcgacgaggccgagcgcttcgtcggcggctccgtgttccggaaggtcgcccacgtccaggatgaccgctccctcaccgccggcgtcgccgaccccgtcaccgactacccggcgaggaaggctgtgacgctcaaggacgtcggcgtggacccgccgggaatccccgagcagagcagggaggggcgtcctcgacaggatcttcaagaagaacaccgcttaatttcggggaggagcaggcaacagcacgcttcagcttcagtccctttcttgcgttaactagctagctttgcgttctcaatagtcagatcggctgcactttttctggaagccggtccatgtatcgcgaacgtgacacgcgatggtgttgtaaatatgtatccagtcaactatgcacctgcgccgcgaggcgtgatcgttgttttgagtttgaaatgctagggtttagtacgatctgaaggaccgctaacgcacctagcatccgaataggcctgaagatgtatgtactttcttcggtcatttttactctgcatattagaattttctaaagtcaaacttcacaaagtttgaccgtatttatatgaaaaaataccaacatctgtcatgctaaaattatataatatgaaactttaggtcaaaaaaaaaaaaaaaa

SEQ ID NO: 34379 - DNA, 1346 bp, Triticum aestivum
  Clone ID: PAT_TA_34379
aaagaagttgctcacgaacgccagaaagaagaacagacttgagaagggaggagaggtttgagattcagaaggcgtgatcattcatggcgagcgccaaggcgacgatggggcaggagaagcaagaccacttcgttctcaagagcgggcatgccatgccggccgtcgggttgggcacctggagggctggctcggatactgctcactccgttcagacggccatcaccgaggctggatacaggcatgtggacacagctgctgaatacggagtagaaaaggaggtcggcaaagggcttagagctgccatggaagctggaatcgacaggaaagatttgtttgtcacgtcaaaattatggtgcacgaacttggtccctgagagggtgcggccagcattagagagcacgctcaaggatctacagttggactacatcgacctttaccatattcattggccgttccggctgaaagatggggcacacaagcctccggaagcaggggaggtgctggaattcgacatggagggggtgtggaaggagatggagaaccttgtcaaggacggactggttaaggacatcggcgtctgcaactacaccgtgaccaagctcgaccggctgctacggtctgcaaagattccgcccgccgtttgccagatggagatgcaccatggcgggaagaacgacaaggtgttcgaggcctgcgagaagcgcgggatccatgtcaccgcttactcaccattgggttcttcagagaagaaccttgctcatgacccggttgtcgaaaaggtggccaacaagctgaacaagaccccggggcaggtgctcatcaggtgggctctgcagagggggacgagtgtgattcccaagtcaagcaaagacgagaggatcaaggagaacatccaggtgttcgggtgggagatccctgaggaggacttcaaggtcctgtgcagcatcaaagatgagaagcgtgtgctgaccggagaggagctgttcgtgaacaagacccatgggccgtacaagagtgcatctgaagtctgggatcacgagaactgagctcccacctaagtcaccagtcgccatctacgacgactcacaacaatggaggctgaaggagtggagtggagatgatgcagcaggctcttcttgatgctatgtaaacaacgttgtgtacaacacaataaataaataaataacaacggcttcgtcgtgccccttacaacaccccccaccatgggggccggaggaggcggggggagctggtgccgccggcacctctcgtggcgctgtgtacaccgcggtgtgcaccacactatatatatatataacaacggcttcgtcgtgccaaaaaaaaaa

SEQ ID NO: 34380 - DNA, 1319 bp, Triticum aestivum
  unsure (1)..(1319): unsure at all n locations
  Clone ID: PAT_TA_34380
cacgagggcaagccaaagcctccgcctttctcctccttttccgcccaaacaaaccgccccctcctccccccccctccccctcccgtcgccctcacctccgccctcgccggcagtagtatacgcccgccaccagctccgacgacccgcgccttcccccccgctcgcccgccgtcgtctcccccgcccgctcccccgtccgctccgccgcgggtttgttctagagggtgtatctgaagttctctcagcatccgagtgcgcagctttgtacaaaaggaaccattcaggccatctcagactgtcttcatggatgaatgataggatcaccagttgctgtcactttaagtatctacaagtcactcttttcataatatttctgagcagaggttggggagtcaagttgtaagggtgtaaagatggactactctaatggttctttctttccttcatggcctgacaattccgcttctgagaattatagctttgttgatggttcagtggaatcatatgcagaagaaggaagtatgccacctgcaggctatttcagagctagatcaaatcagaatttaacatttgatgagcatgaacagaaccctgctatgcttgcaaatgggtgcttgccgtacaacacccagactgatctattatctggtgagattctgtcagagaacaaaccttccaacagccttatggagcttccacaacttcagaacaatggcagtctgcaaagtaatttaatcccaccagggactcttcagtgcacttcaacacctggaacatttgacctgcagttggatacccctggccttctagaacttcctcatgccttgtccagttcaattgaaagcaatggtagtgaagtttcagcttttcttgctgatgtacatgctgtttcttcagcctcaactctctgttcgacattccaaaatgttccttcctacatggagccagtaagcctagaagctttcagttttcaagggatacaaaatgctcctatgttcaacaatacaagtcattcaaatgggaaacctgtcagtatttgatgaggcaaccatggcatcactacatgatagcaaagagtttctcagtgggtagcatctcatcttttgggtatggccgagcagtcacaactagctggtagtggtttgaaggctgaacatcaaggagcaaaatgcgatgtgcaatattccgctccctttcgcttctggtagtcagatggcagtgagtgaagcacaaggggcactgaatccttcaaagatagggtcaacgatccttcacaataggagtccgtaccccgccccgcgcncnaaanaggattagcc

SEQ ID NO: 34381 - DNA, 1153 bp, Triticum aestivum
  Clone ID: PAT_TA_34381
gtacattgctgccatgtacccccctagtcaggtctgcgccctgctctccacaactgcctacgactgtactccaatgcttgtgcaatacatcgccagtattgctcctggtcgaatttgtgctatgctgcccacaactgccactgatcatcctgcctcgggtgcctccccatcttccttggcttcagactcatcccagtcaaacaagctcaaatcttatatatctttctgggataggttgactgtggcattcttgttgggagcaatgttcctcattgctacggtgaagccacgagttgatgcagcggcaaaggctgaggaccgtgctgccagcaaggatgacaaggtgtatgaggctgtgcttgatgagctgtgcaaggaccatagatatgccgcaagagcccaagcagaagtccatgaggccacccgctgtacctttcctgcatcacatgccctgcgtcccgatgttgctcgccgcatgcgcacccgtgatgacgctgtcaaagcgagagaagaggcttgcaagaaggttgacgacctaagggcagtggttggtgtggccagaatggggaaggttgaaaggttcatggtccgctgtttttttgtcctctcgatcttgttctccttgagtgcagggatctgcagtgcagctgctttcttcagatctgctcaactagagaaggggggttcgatgagccttgctgctgttattggcactattgctgttgcaggagtaccgatggtcttggcgcatgcccatttcttatatgttgctttgtacgagaactagtttttgcagcgccaatacattgtgttacttatggtttgagaacttatgtggaaaagtgaactgtaggctgatttattgtaattctgcatgttatccctgtattcagtccactcctcatcttttaattaagaaccaaatgatcactgctgcatctcaaataagagacatagtggtgttgtgctgtaactgcacatgacaaaagctattgttcaagttcttgacattattttgaatgcatttaatcctgtttttgaattaaatgctatagactggatcctctttttattcccctgttatgttgaatgaacttttgaatattgggcctgtgcttgcattcaagttgatttgtttttttcagatgtgagt

SEQ ID NO: 34382 - DNA, 420 bp, Triticum aestivum
  Clone ID: PAT_TA_34382
gtcgtctcggagtctcggcgcgtcgcctgcggggagcaaggagccaaggtgcgagcgccgccgcagcgagctcgtccttccgaaggttagcagcatccgacagccatggcgaagcatcaggccgatctcatcatgtgccggaagcagcccggcatcgccatcggccgcctgtgtgagaagtgcgacggcaagtgcgtcatctgcgactcgtacgtgcgcccctgcaccctcgtccgtgtctgcgacgagtgcaactacggctcgttccaggggaggtgcgtcatctgcggaggggtcggcatctcggacgcctactactgcaaggagtgcacgcagcaggagaaggaccgcgacgggtgccccaagatcgtgaacctggggagcgccaagaccgacctcttctatgagcgcaagaaatac

SEQ ID NO: 34383 - DNA, 1198 bp, Triticum aestivum
  Clone ID: PAT_TA_34383
gcgcggcccggccgcacactttcgtcccgccgcctcgtctcgtcgactcggggcaccgcctgcgggcggcgcgggagccgcagccgcgcgcctcgtctgcgcgccgttgccaccgtcggaaagcaaggaccgacacccccgccgaagccagccctcgctctgatcagttagcgtccgccgagcggcggcgcagcatgatccgtgtctgatcatgggcccgcagcggcctgtaagtgctcttggtctcctgtgtgccccgggtgaccgcagctgggtcctgcgacgagtgcacgtgcgcctgggtccgctggtgggggggtgcgacgagtggagctagggatcgttgcaggtcaagtacgccaactgaggccaggtaggcgtccgaaacgaccactaatggacggagcgcatgcaccaggatcatgagcgaggtggaagcgccaagatcttaaccctacgaagagcgaaaagagatctcttttaagaacgcgatagacgaacttttctggcacgatggttcgcgtacagaggattaggcgggtccgccgtgcctcgctgtcttttcttggacaccaatagcagatgtacggaacggagagtactgcattgttgctgtgttatggtatgatcttgatatacaagaactcgtccctgatatgctctgtaatgactagttctgttgtatggttcaaaactctagactgcctatgcagtatgcacttgatatgaatgaccaatgaatgtttgacttgaaaaaaaaaaaagctgcccgggccgtgccatggtcctgccccgtgcaagttgcgacgacgtgacataaaaaaaaaaaaaaaaaaaaaaaaaataaaaaaaaaaaaaaaaaaaaaaaaaaaaaaaaagaaaaaaaaaaaaaaaaaaaaaaaaaaaaaaaaaaaaaaaaaaaaggggcgcccgttttaaaggtcccagttttacttacccgggcttgaaaggtataattttttttttggggcccccaaatttaatttcatgggccgggtttttaaacgggggggatgggaaaaaccttggggtcccccatttaaatcgctttgaagaaaatccccttttcgccagttgggttttaacaaaaaaggcccgccccgttcgcctttccaaaaggttggcccccctaaaggggaattggaaccccccctgatgcggccctttaagcccgggg

SEQ ID NO: 34384 - DNA, 528 bp, Triticum aestivum
  Clone ID: PAT_TA_34384
gaaggagcaggcggcggtggtgcccgaagacgaagaagcacggcgacctaccccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctgggtttcatggacatcatttccattcccaagactggtgagaactacaggcttctgtgtgacaccaagggccgcttccgccttcactctgtcagggatgaggatgctaagttcaagctctgcaaggtcaggtctgtcaagttcggccaagaagggcaatcccctacctggaaacctatgttagccgcaccatcgcgctcccagaccctctc

SEQ ID NO: 34385 - DNA, 624 bp, Triticum aestivum
  unsure (1)..(624): unsure at all n locations
  Clone ID: PAT_TA_34385
caatntgnaggcatnntgggcttttgtattacnccagtgngaagggntttctcaagcgattaagttggtacccaggttttccngtnagagtttaacgacgccgttagcggggtatangatcactntaggcgattggtacggccccccccgaaangtaacttgtccaacgcgtccgatcggccgttcatcagttcggagaagatcgggttcgatttagtcgcggaaccaccatgagctccactgaggtcgccagcggtgagtgcaagaagatgtcgtggccggaggtggtcgggctgaccatcaaggaggccaaggagatcatcctcaaggacaagcctgacgcagacatcatcgtcgtgccggttggctcagcggtgactgaagacttcaggccgaaccgcgtccgcatcttcgtcggcactgtcgccgagaccccccacgttcgctagttggattgcccttacttcccgtggccggcatagatgctggctcatgaataaatcagtaatggaggaataaaactgtgaactgtgaagtcaataatctacaggtttgtgtgaactgtgaagttccgtccatagctgattgagaaaaacttagatctgtgcgtaaaaaaaaaaaaaa

SEQ ID NO: 34386 - DNA, 1123 bp, Triticum aestivum
  Clone ID: PAT_TA_34386
gcggccggaccacccacaccgccgtctctccacgcccacacgacgccggagaacctcgcagcgccgaaccggaagaggaccctgcgagcgccgcctggctcggtggcgtccatcgccgggaggcgagagcgcgtgccgcgcgcagcggcggaggcttttctcgtcccccaccgcagctcctggaaccccaaccctctcttccgcccaaactccacgcgtcgagaaattcggggaggatgtccggattggccgcgagcgcgctgcctctcgccgcaggcccgtctccgcttccgcggtgcagacccactcgacccagcggcctaacgaggcctccactactcaaggttgccgagctgcaaccatgtctttcttcgccgattcgcttcggccagacggccgaaatgtgtggctgcgtcgggcaatgggcgtcagggacttcgcgccagccagtaccggtttgatgatgatgagccgctgtggcttgcggtggttagagaattcgctgtgagtgtgaggaacttggtggttttcttggctgagcagccagggcaattgaagcacctcgaatggccggccttccgcaatacgttgaggacggcagcacttactctcatactcgttgtggtgttcattgttgccttgtcttccgttgatgctgccctttcatacatttggtcttggctacttcggaattctgcgtagtttactgacctggcaaattatgaaggagtagatgatgctatatagcgaggtgggaaggtggttaatgtcccagtataccatgttatcctgagtgttgagagaatcgaaaggaatgctctgcaactggtctgtttttcgcgaatgtataatgtatttatgcagttgcttactatggtagttaaatgctaattatttctatttggttgagaaaggaaagaagacagagttactcatttgcccctaattctgtaattcaaactcttatctagttgtcgtcagttcttgttgaatgtgctccacccagtgagaatctcaacttgttacgttaagaactgttttctttttcttgtaaatgtatcggtccatattctgagatctgaataaatttgcatttcttaaaaaaaaaaaaaaaaaactcgag

SEQ ID NO: 34387 - DNA, 1722 bp, Triticum aestivum
  Clone ID: PAT_TA_34387
atgagggacgggccgccaggacacccccagaccccgcccccacaggccagccaacccaccaccggccggcgcgcacgcggcggctcgtctcggccccccccccgcgcccccccgtgctcctccccctcctcctctcccccctccgaccccgtcgcccctcgccccctctccccggcgggcgcgagccgcctggagcggaccgccctgtccgggggactcctcagggacggacgggggtcaggcctcaaggactcgggaagcagacctgaggcggaggggtccctcaaaggaccctgccagatccctgatgccttaagagccactgataggactttccagctggatgaaagattccgggccttacgagtctgggttagatgaaataaggaaactttaatggcgacgttgggagctctaatgggtcaaaataatggtcctcttgaaccgtgcaactcaactgaaaagggtctattgattggatctcacatggatactgtcgttgatgcttgcatgtacgacggagctttgggtattatatgcgctttctctgctccgaaggtcttgagaatcactggaaaacttcagaggctcactataccagtagaggtgattgcattcagcgacgaggagggcgttagatttcagacaacatttctgggaagcgccgctgtagctggtattctacctgaatcaattttgcaagtatctgacaagagtggcactaccgttcaagaggctcttcggttgaactccttcgaggccactgctgctgctcttggtcaggtcaagtacagcccggagtctgtcggcagctatgttgaggttcacttggaacaagggcctgtcctggaagccctccgatatccccttggcgtcgtaaaagggatcgcagggcagacacgattgaaggtaatagtagacggttcccaagggcatgctgggacggttccaatgaaattgcgccgtgatccgatggttgcagctgcagagctggtggtgacactggagggcctgtgcaaagacccgagcagattcctgacctacgacgaggagtgcggctgcttcaccgaggagtccctcgccggcctcgtctgcaccgtcggcgagctgctcacgtggcccagcgccagcaatgtcatcccaggccaggtgaacttcacggtggacatacgcgccatggacgacctggtgcgggagacgatcgtggcgagcttctcgcggatcgtcatgcagcggtgcgaccaccggctggtcgactgcgccgtcgagcacaagcactcggcggcggccacaccgtgcgacccggagctgacggcccagctgaagcgcgcgacgcggtcggcggtgtcggcgatggcggcgcccggcggccacgcggcgggtgccggggagtcgacgccggtgctgatgagcggcgcggggcacgacgcgatggcgatggcgcggctgacgcgggtggggatgctgttcgttcggtgccgcggcggggtgagccactcgccggaggagcacgtggcggaggacgacgtgtgggccgccgggctcgcgctgctccgcttcctcgaccagcacgccgtcgccgagctgtgaaatgtgtgaatgtgattggtcggttcgtgcctcaggctgtgcgtgtacatatggtggactggactgggctgccgtcccattgggccagcaagaaataaatgggtctcttcgctgagactctttattcaaaac

SEQ ID NO: 34388 - DNA, 747 bp, Triticum aestivum
  unsure (1)..(747): unsure at all n locations
  Clone ID: PAT_TA_34388
gcccctcctcaccaccgtggggagcacgtccctccgctccccaatggctctcctcccccaaatcctcccctccccgcgcccccatccccacctcgccgcctcccgccaccctttctcccccgcccacgcattccgcacagcgcctcgcctccacgcctctggccaccgccgccgaggccgcctcgccgcgtcagggcccgggtcgtcgccgtcgccgtcgcccgaccagtacccgtccgagcccgacgatggccttgtggagctccctctgttccctctcccgctcgtgctcttcccggacgcgacccacgcgctgcatatcttcgagttccgctaccgtatcatgatgcacaccgtgctcgacaccgacctccgcttcggcgtcgtcttcgccggctccgacggagcctccgacgtcggctgcgtcgggagaggtcgtcaagcacgagcgcctcgctgacgaccgcttcttcctcatctgcaagggccaggagcggttccgcgtcgcccgcatagtccgcaacaagccttacctcgtcgccgccgtgcagtggctcgaggaccgcccgcccgcggagacgccctcccctggggaggacgctgangcgctcgccgtcnaggtcgaggcgctcatgcgcgacgtcatacgcatcgccaaccgcctcaacggcaaccccnaaaaggaggtcnnngacctgcnccggggcctnttccccaccccattctccttctacntggccaacacct

SEQ ID NO: 34389 - DNA, 1062 bp, Triticum aestivum
  Clone ID: PAT_TA_34389
gtttatgacaatctaactcccaagttggagaggtgcatggtgtcgtttgctgtcaatgtcatttccgtcaaagtaaccgaatccgaccggggttatccaatcagcgtatatggcactgttgttgcaagggatacgattgactacagatgtgtctatctcttcagacgtgcaagggaagatccccagatcatcaactccaaggatgatatgctaaaattgataggtccacggcgaggattagttcagttagataatatttattttgagttaaatctgagggtgaagggtgatgctggcgacgaagattttagcaaaggtgtggtagtgctccatgttggtccctatgatcctgaaccaatcacaagggtgctgagcagttggctaagcagagtggagttggtgcttgcaactgttgaaagtccagtggcagctagccttgaagtcaaagttttgaaaggagcagcacctttcagtggcaaaatatgtgctgggactagtgaaaacccgaagactcagatgattgtgtatgatagcagagatacgaagagcggctcctctgttgtgttaactcgcaacctcgtagctgtccctgacccggatgacgacgaagatgaaattggtgtctatgttcgcttccttgatgatggcgatgacgtcgatgatgaggatacaggcaccttggtcaagctagcataccctgctgaagagcaactttgctgtcaccgcgcctgggagctgcaagtgaaggtttcctggactgccatcctgtgcaaaccaatggcaaaacatgtcttaacaagagggaccagtatgcccagggattatacttgccctaggtatgcgcctcggttctgattggtcgtgctctagaatttctgttcatgcccgtagtacatgtaagaagaattgtgcctgtgctgttgttttacccgtggatggtaatggagggatgtaatgaaccaaccgcgtcttgtctctctatttatgaataaattggcatgccatgcgccctgttgttgtgttgcttagtcaacacaatcatacaaaaacattttgtattaa

SEQ ID NO: 34390 - DNA, 409 bp, Triticum aestivum
  unsure (1)..(409): unsure at all n locations
  Clone ID: PAT_TA_34390
cacgggctcgccggcgcccgggatcatgcctccattgccctagggtttggccggcgcgcgcaattggtccgcccgcatgctcgattcgggccagcggcaccgcgtccggggcggctggtaggcaattcgtgcgctgccactggagatgagatcccctccgcggccggcgagctgggaattggtctacggcctcgcgctctgcgggaggcggcataagccctagtgattcgatcccgagctgggtttcgtgcggattcgtggcttctgtgctccgtctcccaatcacatattgggggggttccgaggaggggtggtggttgtatggatacagttagaggggaggcttggtcgatggctccacctnancancancggcanccgncggggcctcggggtccgcaaccgcacc

SEQ ID NO: 34391 - DNA, 748 bp, Triticum aestivum
  Clone ID: PAT_TA_34391
ccctccgtaacgcacagtgtgatacgcagagatagcgatcgagccgagcgccatggccgaggaggcaacaagggcggtcagggaagaagagctgtcgccggtggcggagggggcgcccgtgacggcccggcggcccgtccgagcggacctggagaagcgcatcccgaagccctacctggcccgagccctggtggcgccggacgtgtaccatcccggagggagcaaggagggcgggcaccagcaccgccagaggagcgtgctgcagcagcacgtcgccttcttcgacatggatggcgacggcgtcatctatccatgggaaacttaccaaggactgagggcattgggcttcaacatgatcgtctccatcctcatcgcaataggcatacatactaccctgagctacacaactctgcatagctgggtgccatctctccttttcccaatctacatcgacaacatccacagggccaagcatgggagcgacaccgcgacttatgactccgagggaaggtacatgccggtgaacttcgagaacatattcagcaagaacgcctcgccggataagctcacattccgggaaatctggatgatgaccgacggccaacggcaggcgaacgacccatttggatgggtggcgagcagggggagtggatgctgctgtacatgctcgccaaggacgaggaggggaaccttccggagggaggctattcgccgctgcttcgacggtagcctcttcgagtcatcgccg

SEQ ID NO: 34392 - DNA, 1079 bp, Triticum aestivum
  Clone ID: PAT_TA_34392
ccgccgcgatccctccccaacgcccagtgtgatacgcagagatagcgatcgagccgagcgccatggccgaggaggcaacaagggcggtcaggcgaagaggaactcacggcggtgcgatcgggccgagcgccatcgcggcggcggctagggcggtcagggaagaagagctgtcgtcggtggccgagggggctcccgtgacggcccggcggcccgtccgagcagacctggagaagcacatcccaaagccctacctggcccgagctctggtggcgccggacgtgtaccatcctggagggagcaaggagggcggtcaccagcaccagcagaggagcgtgctgcagcagcatgtcgccttcttcgacatggatggcgacggcgtcatctatccatgggaaacttaccgaggactgagggcactgggcttcaacatgatcgtgtccgtcctcttcgcaataggcatacatactaccctgagctacacaactctgcctagctgggtaccatctctgctgttcccaatctacatcgacaacatccacagggccaaacatggcagcgacaccgcgacttatgactccgagggaaggtacatgccggtgaacttcgagaacatattcagcaagaacgcccgctcgtcgccggataagctaacgttccgggagatctggatgatgaccgacggccaacggcaggcgaacgacccatttggatgggtggcgagcaagggggagtggatgctgctgtacatgctcgccaaggacgaggaggggaaccttccgagggaggccattcgccgctgcttcgacggtagcctgttcgagttcatcgccgacgagaggaggcagccacacgggaagcggcagtagcatgcaacgctgccggcccggaatgtccttcctgtctaagactgtgtgtggactgtggactagctaccacatcctcatgtactcctaccatgaagtaataagttgtgccctcctcaaagtttcatcaggaaaaaaaacacagtcgttttcaatgataattttaaacaagcgcatggaattgccgcgggttggggtacggcccaacaatttgca

SEQ ID NO: 34393 - DNA, 1113 bp, Triticum aestivum
  Clone ID: PAT_TA_34393
gttttcgattagttcatcctcctcctctctgatctgctctacctctcaccctctcctctttttccttctctctcagatttggtgcagcagccgctgtggatcaagttcttggtggagatgcaacggatgctcaaagtgattcatcagggaggacccccgccagtagagggatggctcctgtccaagaaaggccatccatgggttatggcaggagaccaggagaagaacaagcaattttatctaaaaatagaagagctagcaccaaagagccccagcccacctccaagatcaaattctatataattcatgaatagtggttgtcgacacatcttctaacaaagattagcgtggtcgcggccgaggtaccgaatctttatgcaaatcgattatcctgggctaccactatgccattctcttggaatgtaatgaatcttggtgcaaatcagttatcctgtcaaatcttgatgcttttttacttaaccactattattataaatatgcattctgttgaaccagctccttctatgggagacgcttgaccattgccttacacaggcactacacgttgcgctttctgatgtaaatcacttcctggacaggcgacacgcatcctgatgcaaatcagttcctggacaaccaacttgagatcaattatccggacatatacccggattgcatctatgttctaaaatcttatccagacctgatcaatatgtgaaaatttagtgaggggtgcccctggttactcacgtcgctccaggttcacattgtattgacttgcagcgccagcctgccatttggcctgcagccctggtcgttgcaagttagccttacataggtataagggttttagtacctgcccgggcggccgctcgaaagcgaaaactgctgcatcgaattactaatggagtcgtttcgatgagaactgataaagaatatatttcatgactgagacattgatatgaaatttgagtatttaatagagaagtccagttcatatatgaagaaaaagaaaggcattatgtactacattgacagtgattgttagcccattatggtacttcaaatcggataaagaatatatttcctgaccaaaaaaaaaaaaaaaaaaaa

SEQ ID NO: 34394 - DNA, 1152 bp, Triticum aestivum
  unsure (1)..(1152): unsure at all n locations
  Clone ID: PAT_TA_34394
tgaggaattcggcacgaggtngcgcggtggcccagcccttcctctccggcggcgtgctcctccgccccccaccccccctccccaagccggctgggccggcggcgcccccgcggccgccgcccctcgtgcccctcgccggcccccgcgctgctgctgtgcggcccgagtgaagggagacctgtaaattgtgtaccatattaaggttatttcgtatttctccatctgttctggtaggaaccaagctagacaatggcgtcgccacaagaacccaaacccttgtgcttgaagcgcaagcttgtcgacaactgcctgtcaaaagagtgcaagtctcgtcgagtcgtggttgacaatggaccctctgatccatctgctaaacggtgcaagtgctgttgcacgcgacctaatcttgccagtgattgtgtcaattatctgaaaagtggagttcccagccgtatcgtgttttacaaacaagattcttggcacaattttcctgagctaataatgaagtccctgattgaaggatttaaaggtggcaaatctagtgttgtggctgtgatggatgatgagcctgttcttgttgatttcttgtcaatgagtcttgtcaacctacaaacaagaaaacagcgatctgttgcatggtatgatgatactggaaagggcttttttccttctctgttctttgatgaggaaggtgatgaaacggccaatttggactctagtaatgttgaggatggtgcacagggaataatgctggataaggctgtaagttctccagaggaagtggtgaagcaagttgttcttgaatctggccctccggggccacataaaccttccactgcagacatattacgtaaaaagatcacatctgtggaaagaggaagcgaagactttttgcttgttccagaacctttttctctctggtatgggtccgtttgcaacaccgaataacatacttcatatccaccgctactccccgaatgatatcactgctcagtgtcgacttcaagctgttgaaaaacaaatgagctgcaccaaagaagatcgggggggattcanatgtaagatatggatggctgggttctacaaagagtgacatagttaggattctaattaaggggttggggaaaccccgggaaacctgctgaaaaagcc

SEQ ID NO: 34395 - DNA, 756 bp, Triticum aestivum
  Clone ID: PAT_TA_34395
accatcacaccaaataataaatatttacatgcttaactggatccctttggccaattgttcttttgataagaaaaatagcaaattaatatactagtaatttggtagatgattcccacaggtggacagttgtgatgcaaacataaaatccactatcttagaaattaagaccttcaaacttgtatatgtagcttttttttttgcttacgagggatgatgtaatctttaaacactgctatttaatccattgctgtgccattatgaaaacatggacttccgattataatgtcttttcatttttttaatatggttcacatgacacaatttgtccatccaggcataaaggaggtgcaaaagaggacattcttgtcggggcatttgagcaacttattgatttattggcacaagaggcactacctgttggtgaaggaccagtgtacatcaacaatttgttacgctgtgcttggatcgaatggatgatgcaacagaaaaacagagaggatgacaccttcggttcaggtgttgttcaagctgggccgtgcatggttcatgataaacaaacatgtttgcttctagtcaaaattattgagatttgtggtggacgaactgctgaagcatcatcgatgataaacaccatggatggtgcctggtttattcaacttgcgtcctctatttgcgacaaccttcaccacaagatgttactttctcaggacaccaaaacgaacgagacggcgatgagccacatgaacgagaaaatcg

SEQ ID NO: 34396 - DNA, 1549 bp, Triticum aestivum
  unsure (1)..(1549): unsure at all n locations
  Clone ID: PAT_TA_34396
tggcggtcggccagtacgtggcgacggggaagataaaggagtcgggaaagagcggcggcgagtcgcttcggccggctcgccccccgcttctcccctcggcgccggacccaccccaatctctccgccggcgatcgccggggcgcgcgcccgcctccgccgggaggcctccccctccccttagccatggccctgcaggggaagaacctcataaacaaccccgacgatgtggtgacggagttcatcgaggggctggtggagacctacccgggcctgcagtacctggacgggttccctgagattaaagttgttcttcgcgctgatgctgtgggcgttgcctatgacaaggttgctgtcatctcaggtggtggaagtggccatgagccagcccatgcgggatttgttgggccaggaatgttgacagctgttgtttctggagatgtttttgcttctccacctgcagattctattttagctgctattcgagctgtaacgggcactatgggatgccttctgataataaagaactacactggtgatagacttaattttggattagctgctgagcaggcaaaatctgaaggctataagatagagatggtaattgttggagatgattgtgcccttcccccgcctcgggggatagctggtagaagaggtttagcaggaacaattcttgtgcataaggttgctggggctgctgcagatgctggtttatctcttgcagatgtcgctgcagaagcaaaacatgcatctgaggctgttggtacaatgggagtagcactttctgtttgcacgttgcctgggcaagtgacatctgatcgtttaggtcctgagcaaattgagcttggccttggaattcatggagaacctggtgctgctgttgttgagctacagacagttgatgtggtggtcgaacatgttcttaagcagatactatcacaggaaactcagtatcttcctatcacaagagggagcaatgccgttctcctaatcaacggattaggcgctactcctgtcatggagcttatgattgcagcaagaaaagcagtccctgagttacagttggagtatgggattgctgttgatagagtctacactggcacatttatgacatcacttgatatggctggactttctatcaccattatgcgctcagatgaaaacattttgcagcgacttgacgctcccactaaagctccagcttggcctgttggttctgaaggaaatcgcccaccagcaaaatttccggttccagtaccaccatcaccttcaatgaaggatgacgagattctttcagaacgccaggaactaagcaagcaagggtgtatgttggaggccgctattgaagcagctgctaaagaactcattgatctcaaggataacctaaatgattgggacagtaaatcggtgatggtgactgtggaactacgatgtatagaggtgcaacagtatccttgaagatatgaaaacgcgtttcatctgaacgagcaactggaacattaaatgagatgggtcaacatcccgaaggngatggtgggacaagtggatc

SEQ ID NO: 34397 - DNA, 708 bp, Triticum aestivum
  Clone ID: PAT_TA_34397
ggcacgaggcagaaggcaaagttgttactatcatcaggcttaaaccaccgtgatgaagtccccagtgaaacagataactacatggatgcacttaacacacttgaatccgagacagagactgaagttgactttcaaactaaaaaacgagggaagccagtacattccttcaatgctcatgcacctcaaatagagtcggcagataatatcgtctcacttcctgattcttctcccgctgaatttcctgatacaagtccaaattccagaatgttacatacttttgaaagaactgctgatttccccagtttgtcaagtgcagatgcttcggatatttcacagcatacattgtcaggttatacagatatacatcctaatgaatggtcatctgttaccaccatccctgagaataatgaaaatgatgctgctggagaccccactgaaatttcagaaccggcaccgcaagcatatacagctacaccacccaatgaaaggtcccctcatgcaaatgagattcctgagagtaaggcagaagttgcccccagagattctcctgagatttcaaaaccagggctgtcaacctatgcagtttttcctcccaataaagagtctgttgtcaatcagatccctgagaataatgtagaagatgcgtcagaagatggtactgttgaaagcattagttgtcttgtacaggaacctgccatttcctttgct

SEQ ID NO: 34398 - DNA, 819 bp, Triticum aestivum
  Clone ID: PAT_TA_34398
ccgcgcggcggccgcacccgtccccagacccaagagcgagccgaccgaagatgtcgaacctgtccgacgccgccgccggagccgggggcggcgacgcgctgttctcgcggtgcctgctcgcgctctacgtcatcagcccggtcaccgtgttcctgctccgcttcgtctccgcgccctatggcaagctctcgcgcccggggtggggcccggccatcccggccgcgctcgcctggtgcgccatggagagccccaccctctggctcccgcccctcgtctcccccctcccgctgctgctcgccgccgccgcggcctccggctccccgctcgccgcgctcccgacggcgctctacgcgctccactacgtcaaccgcacggtcctccacccgctgcgcatcctgcgcctgcgccgcgccgcggcgcccgtgcccgttctcgtcgcagcctgcggcttcgggttcaacctcctcaacgcctacgtgcaggcccgctcctgggcgctccacgccggccgccccgcctccgccttcgcgctcgcccgctgcctcgccgggctcgccctgttcgcgtgggggatgcgggtcaacgtcgcggcggacaaggagctcctgcggctcaaggaggccgggggcgggtacaagatcccgcggggcggctggttcgacgcggtgacctgccccaactacttcggcgagatcgtggagtggctcggctactgcctggtggcctggtcgccggcgtcctgggccttctttctctacacctgcgccaacctcatgccgagggccagggaccaccgccagtggtacctcaacaagttcg

SEQ ID NO: 34399 - DNA, 500 bp, Triticum aestivum
  Clone ID: PAT_TA_34399
cgtccgctcctcgccacttttctctcccgtcctcccccccatctcgctcgctgctgcttccatcaagacacaacaagagagagggagatagagagagagagaggccgagaccttgctggtctcatatggagtgcagttcagacgagtcgtcagagctaagtgacactgatatcgatgactatgctgagaaggcctacacggacctcaagtctggcaagcttgtggcgaggttcggcgccgacaggtttaggtgcccgttctgccctgggaagaagaagcaggactaccgctacaatgagctgcttcagcacgcaattggtgtgggcgcatccaaccgtgctgccaaagtgaaggcaaaccatcaggcactggccagtcacctcaagactgatcatgctgatgcagcaggttcgttgccaccgcgacaggccgaggcgctgatcaacccttcaaagccagtccaggaccaggagctgttttgtttggccctggatgggcat

SEQ ID NO: 34400 - DNA, 2309 bp, Triticum aestivum
  unsure (1)..(2309): unsure at all n locations
  Clone ID: PAT_TA_34400
acgacagaaggggagattcagagaggaggagagggtttttggagaggagactcttgccattcctcgccggccgcatctttgctcacctcgccggccgcttcaatcaatcagtgttgattaatcggcgtcggatccgtcgatctaggagatccatgccaccaagagatggggtctcgtatggagtgcagttcagacgagtcgtcagagctaagtgacactgatatcgatgactatgctgagaaggcgtacacagacctcaagtctggcaagcttgtggcgaggttcggcgccgacaggtttagatgcccgttctgccccgggaagaagaagcaggactaccgctacaatgagctgcttcagcacgcaattggtgtgggcgcatccaaccgtgctgccaaagtgaaggcaaaccatcaggcactcgccggtcatctcaagactgaccatgctggtgcagcaggatcgttgccaccgcgagaggccgaggcgctgatcaaccctcctaccccaatacaggaccaagagctgtggataaagccaatggaggtgtatggagtcttgttgaccaacacaagtaaagagaaggaagctgccctgaacaaagtatacttgttatagaagcagcttgatgagaagcatcagctggagctggatattcaacagcttagaggcaaattggaggtggtgaagcacatggagggagagggcgtcgatgtgaagaaacgtaccgaagagctgaataaggatctacaggatagaatcgacgcaatggaagacctggcaagagctaaatcaagctctgattatcaaggaaaggatgaccaatgatgaactgcaggatgcaaagaaagagcttatttcgggcttggtggatctgttgggccctcgtagcaacattggaatcaggaggatgggtcaagtggatgagaagccgtttattgaagcttgcaaaccaaagtatggcgcggaggcggatacaaaagctcttgaattttgctccatgtggcaagacaatctgagggatgctaattggcacccttttaagatagtgaccagaggtgaaaagtctgagcaaatcatcgacaaaggggacgagaagctggtgggactgaaggaggagctgggcgaagaggtttacaaggctgtgaccaccgcgctggtggagatgaacgagtacaatgccagcggcagctacgtggtctcggagctgtggaacaacaaagagagcaggaaggctagcatgggggaagtggtggagcatatcctcaagcagtggaaggccaagcgtaagaggtgatcaacgtgtggtacccagtacaagcagtggtttttcattttggggattggagaagacttgacaaactgtttccctttaataatgttggtgaactgcaagacaagttatgtgctgctcagctcagtcagtctgagagcagtgatgtatcggaaccccttttattccattcgtagttggcagacaatgcttgcaaatcatcgtctgattatcaaggaaaggatgaccaatgatgaactgcaggatgcaaagaaagagcttatttcgggcttggtggatctgttgggccctcgtagcaacattggaatcaggaggatgggtcaagtggatgagaagccgtttattgaagcttgcaagccaaagtatggcgcggaggcggatacaaaagctcttgaattttgctccatgtggcaagacaatctgagggatgctaattggcacccttttaagatagtgaccaaaggtgaaaagtctgagcaaatcatcgacgaaggcgacgagaagctggtggggctgaaggaggagctgggcgaagaggtttacaaggctgtgaccactgcgctggtggagatgaacgagtacaatgccagcggcagctacgtggtctcggagctgtggaacaacaaagagaacaggaaggctagcatgggggaagtggtggagcatatcctcaagcagtggaaggcgaagcgtaagaggtgatcaacgtgtcgtactcagtacaagcagtggttttcgttttgggggttggagaagacttgacaaactgtttccctttaataatgttggtgaactgcaagacaagttatgtgttgctcagtcagtctgagagcagtgatgtatgggaaccccttttcttccgttcgtagttggcagacaatggttgcaatgaatcgttttctcttccttatgattggttcttttttctgcaatggatcgctttattgtcattncttagtgtttttttagcatctggcatgcatgaacgcgatcgacctattttctaaaaaaaaaa

SEQ ID NO: 34401 - DNA, 915 bp, Triticum aestivum
  Clone ID: PAT_TA_34401
cccggctgcaccccccggctccttctctcccgacgcccctcccgttgaatacagcgtgagctctgccctgttgatgtccgatccagcgccgccgatttctccatggagtgcatggggttctatcctaggtcgctcgccggtcacgggctctccctgccctgtgcgactcctccgcagtgtggtcatcctcccgcgcgagcgcgggtgtgccgccgtcgtcgagatgaaccgcgccgccttcggtcgctgccgcagcaggtatgcattaggagcgggcgcctctttttaccacgggaatcaaatgctgctggcccctgatctggatgaccagacctgcagccaactcttgatatggaagcatgaatagtgcaggagctagcaaagctgccgctcgccgtatggaacaccagtaccaccgtgggaaggtggaagcacaaatagaagctgctctttcttcctggccgagtatggatcaagcgtctcggtcattagcttggcagctatgcaacatgccgtctcgccagcacaacttcaacccatctgcacaggttcagcgacgccccccttcccatgtcctctcgatggcaggattacctcgatctctggtgcagccgtggcgttctggttcttctttctcgcttgcagaagataagctttctaagcacaagactcttcagcttactgaaaactttcttacccacaaaacttcttgctgatatctaaaaacgaactgataggacaacttcataatcttacacgtttatagcttaggacctgctatttgtctcacttcattcatctgcatgtgagttgcatttgggtctcctaagagccaattaatgaatgcataggctttcatttcgattcccactgactaatgtttcttggcatgtgtttcttttctcttattggctg

SEQ ID NO: 34402 - DNA, 1023 bp, Triticum aestivum
  Clone ID: PAT_TA_34402
gcacggccgccacctccccgacccaccagcccaccagtaccccaacacacaaaacttgcacaggatcaaagatggcggcgtcgtgccacgacgtggacgtgccggggaagccgacggagacgggcacggcgctcctggaggcggcgacgggcgccatccaggggttcgccccgatcaaccagatccaccagcacctctgcgccttccatttctacggggacgacatgacgcgacaggtggaggcgcaccacttctgcgcgcacctcaacgaggacgtgcggcagtgcctcgtctttgacgggcccgacgccggtgcgcgcctcatcggcgtcgagtacatcgtcaccgaggagctgttcctcacgctgcccgacgaggagaagccgctgtggcacactcacgagttcgaggtcaagggcggcatgctctttatgcccggcgtccccggcgtcgtcgagcgccgcgacctcgagcaggtggcaaagacgtacggcaagaccgtccacttctggcaggtcgaccgcggcgacgccctcccgctcggcctcccgcagatcatgatggcgctcacccgcgagggccagctccggcaggacctcgccgactgtgtggagaagaagttcagcgtgtcgttccagaaggagagggagaaccgggcgtacatgagcgggccggcgcacggcatccacccgctggccaacgctgctgggaagggcttgaagacggagatccgcgaggtcgatcttccggctgccaatactggagccaggattttcacctgatctgcccttggcgtgttctcgtacgtgtccgagagatgggtgtgtgatagctggagatagggtagttaataaaatgtctcccacccctttgtttttcctcttggaaatggagcgagtgttcgaagaatgatggacttccgaataacagtcataggcagtggcggagcgaggaaccgaggatgtagagttagaagggatcaaataatcaataaactctttattagaggaggcaaaccaaaaa

SEQ ID NO: 34403 - DNA, 652 bp, Triticum aestivum
  Clone ID: PAT_TA_34403
gctagaccgctcccaaattctcaaccgggcccggctgccctcctcgccccgccccccggcgcccctgcccgggccgggcgggccccggccccccagccgccgccgccgcccgccgataaatccctcctcctcttccaccccctcctactcctgcgtgcgtggtggtggcgcgctcttttccgagggccgaccgtggccgtggggagcaatgctgtgacacgagatggtactgcctcgccgctcccagaggtgcaggtgtaaatgcaatcgaaatatccggcatgagccctctgtctgagctggtgtggtctccggatgatggtctcagcattaaaatcgcagcctccagcctaagcacaagaaaagcctctcttcgctggaatgcggatactttgaacatagtgatatcttcgcctcagcagagcggcggcaagagtggtgataacgtagatgccaccctaagggatgcaggagaaatgccgtcgcaacctcgaactcgaagtgacagttcagtgagagtatccgcggctagtccaaatagaacacgaaaccttgatgcgcaacaatctacttctatacgaccacaggaacaagattcaaaatgctctggagggatcagtgagatgagtgagggggaagaattgtctgacag

SEQ ID NO: 34404 - DNA, 1227 bp, Triticum aestivum
  Clone ID: PAT_TA_34404
gaagacagcactaggttcaactacaccagagtgtgaagatgaatatggatttcctgatgaagcagatccacactcattgaagaacgagagaggttcattgattgttgaacaatcaccatgtagtctgccgacccttttcatgcaggaaagtgtagaagaacgcagtgaatgtgttgtcctttcttcagcaagagttcaggctgaaaatggagtttgtgagtcaaatcctggttcagaccatgatactagtgcggactttagtgcagtttccaaaagtgaagattgtttggatacttctcagcaagataatgaaaatgaaggattatcggaggttagtcacgaacaagatgatttccaagtacaagaaggtaccgtggagaagacaacactaggttcagatttaccagagtgtaaacatgaatttggattacctgctgaagcagaaccccactcattgatgaatcagagatcaagtattgagcaatcggcatttggtccgcagtcccttatcttaaaggaggaaggacaaggcactgtagagaagatagcagtagattcagctacaccagagtgtaaacatgaatgtgtatcacctgataaagcaggaccacactcattgaagaatgaaagatatccatcaagtattgcacaatcatcatttgatctgcagcccttttccttgcaggatgatgtacaagtacatgaaggtaccctagagaagacagcacaaggttcagctacaccagagtgtaaagatgaatatggatttcctgatgaagcagatccgcactcgttgaagaatgagagaggttcattaggtgttgaacaatcacttagtttgccggcccttttctcacaggaaagcatagaagaacccagtgaatgtgttgccctttcttcagcaagtgttcaggctgaaaccggagttaatgagtcaaaacctggtttagacaatgatactactgtagattttagtacagtttccaaaagtgaagattgtctggttacttctcagcaagataatgaagatgaaggattaacgaaggctagtaatgaacaagagcaggtggcaactggtcagctagatttggaggctgcaagtatcatggaggacgctgattctgaggaagtagcctatgatgaagaaaataagaagcctgttcatcctacagacattaattctttgtgtcaaaaaataaatgtcagcggacctgttgagcatgcttc

SEQ ID NO: 34405 - DNA, 944 bp, Triticum aestivum
  unsure (1)..(944): unsure at all n locations
  Clone ID: PAT_TA_34405
ctttgtagagagcgccgtcatgttggggtggaatgtttatctccagaagaaaaacttattattttggagagacgtcaaaagtctgggcaagtgaagggagatatccagaaggttgtggatgaagtacgcagcatcaaggaaattttgaaggatgcaaaacagtgtccacgatgcaagatggctatatctaagatagaaggatgcaataagatgacctgttggaactgcgggcggttcttctgctaccagtgtaatgctgcaatcagtggatacgatcatttcaagggtgattgtgtggtatttgatcaggaggaaattgatagatgggaaatgcaaatgaatcaaaggcaacaacgccaagtagttgcgcaagcgcaggctgaaatcttcgaaggagaatatggttacccatgtcctacttgccgcaacccaattccaaagatcggaaacaacaaccatctatactgctgggcatgccaacggcacttctgtgcattgtgccggaaggtcgtcctcaagacgtcgcagcattttggtcccaggggatgcaagcaacatacagcagacgactgacgcaggctctcccatatctccagcctcggtgcaagtgcagtttccgaagcttccctgtatgtgcatacacactcgtcccaaggtgcatttgccttggcggcgttaccagcatttggcggcgaacttggttccaactctcctacatccgtgtgctcgctcagttatttatagtgtttatgaacataaatctgcgtctttagcccattcgtttccgtgtctgttgttgagaagaatctgcatattcaggatgccagctgtccccttgtatcatgaacggaaccgttgcagtgaaaccttgcaaaaatctttgatatttactggtactggggttgtgtcgnatagttccatgtctagcaaataaatttacagtg

SEQ ID NO: 34406 - DNA, 725 bp, Triticum aestivum
  Clone ID: PAT_TA_34406
atatcggctcgccggtcacttgacagctagaagtgatgtctacagctttggtgtggtccttctcgagctcctgacagggcggaagtccatcgacaaatcccgggcaagcagggagcacagcctggttgactgggttcgccccaagctgagcgacaagaggcggcttcaccaaatcatcgacccaaaactggagggacagtattcagtgagagcagctcacaaggcctgcagccttgcatactactgtctgagccagaaccccaaggccaggcccctgatgagcgatgtcgtagagacgctcgagccattgcagagtggcggtgggagcgatggagccgttgttcaagccggcggcctccctgactatagagttcgccgcggcctgaccggaaacagcgtccactgcagggccattcccaaccccaagtgctcccctgccgtgccggcgtgcagggtgaggtgataacagcttctgcagtttcaggttcatcctacccactgctgcaatagacccagttgtacattgcaagctttttccgatgtgtaaatttgatccgcgcgcgccgctgttgtttttcgtttctgctgcttgtaaggcccctctaattttcgcgggggtggccttaaggtatccttgaacagagcgatccccgctgaaaccgacgggtttgaatccctggaaatgaaatgccgaaccaagagtggttggttggcaaatgttatgg

SEQ ID NO: 34407 - DNA, 711 bp, Triticum aestivum
  unsure (1)..(711): unsure at all n locations
  Clone ID: PAT_TA_34407
nctcagagtnctagacggntcgccgcgcaaggagggagagctatttggcnatctgagtgagtgaggnctgagagagattcgagctgaggaagcactccacccgccgctggccctgcgtcccgcggcccagtgagggtcaatagcacagaggttgtcagggttgattcgcagaattttcacagcaaacagttcaattcacgtgaatcaaagaggccctaggatcgaatatagctgcgttgatcgatcccaaaatacactatgtctggaacttaaactggttggaagctttctggccaaaggataacctcaaaaaccgggggcctaaacctgtgtagatcttcacagatgtccccatcatactctatgaagttcagcaccacgtgctgtgcttcgttaataatttcagaaaattagttttgagtgatttaacatgtaatttgtaaaaaaaaaaaaaaaaaaaaaaaaaaaaaaaaaaagggaaggaaaataaaaaagatacaaaaaaaaaaaaagcaagcatgaaaagaaaaaaacttttatatggggccaactaaatccaatcaacatggccaaaataaaaaaaagggggggcctgtttaaaaggctggtgtttcccacccgggcgggggagacgtaatttttttttttgggggccgcctaatttattatgagggccgggtttttcaacctgggggacggggaaaaccctgg

SEQ ID NO: 34408 - DNA, 851 bp, Triticum aestivum
  Clone ID: PAT_TA_34408
gggcctcggccgcggcggtcgcagcaccagtagcgggcgcgtcgtggaggaggtgagcgccgaggccgcggccgtggcgagcggcatggcgcctggcgccggagccggcgaggcagcgcgcgcgacgaggacggcgatggcggcggtggtcgccagcgacgcgagccagcacgccctggactgggtgctcggcgacgtcgtccggctcgacctgggcgcgtccgccggcgccgtcctcgtcctccatcccgccgaccacgtcggcaacgctgtcgccgtgcgccgcggccaatgcgcccccgcccacggcggtggactccgtgaggaagacgcacgaggagaactcccggcgagtggtgtccgccgcgctcgatggctgcaggcagaaacagcgcgccgccccggcgggggtggtggagggcgacgccaaggaggccatctgcccggccgtggaggagatgcgcgccgacctcctcgtcctcggcagccgcggcctgggcatgatcaagacggcgttgctgggcagcgtgagcgactacctcgcccatcacgcctcctgccccgtcctcatcgtgaagccacccaacaatgcgcaccacaagtgaaacaactactctactacctacgtttactagtttatatcgactagttgtctgagtagccccagcttgttggcgactcgtcctagaaataaaggagctgcgatgcagtaccctgtgtagtatgttcggtaggctagcatgtccatcatgtgtagcaggttcggaaaatctttatttctcgtataagtgcggcagaaccgctgcctcaatcatgaagttctcccaggaaaaaaaaaaaaaaaaaaaaaa

SEQ ID NO: 34409 - DNA, 787 bp, Triticum aestivum
  Clone ID: PAT_TA_34409
cgaaatctacgagagagggagaggtggggagagataagaagagttcctcccagtggagagagggagaggtcggaggagtacaagggctggttgcggctgcggctgcgactgcgactggtggattccatttcttcccttcttggtccggggcggcggcggcggcgggcggcgcggccatggccaagcagctgcgggtctaccaagtctggagaggcaacaacataatctggtgtggtgggagattgatctttggaccagatgccaaggccactctactatctttctcgctgatcgtggcccctgttgttgtcttctgcatctttgtgggcaaaaatctcattcacatctttcctgcatataacgcagggtatgcaattctggttgttaccgtagtcctgacaattcatgtactgttactgctcttcttgacctcatctcaagatccaggtattgtaccaaggaattcaaatccacctgtggaggaattttctcatgattcttcagctcctcatactctccagttccctcggataaaagagatcatggtcaatggtgtgcccgtgagagtaaaatattgtgaaacttgcatgctatatcggcctcctcgttgctcccactgttccaaatgtgataattgtgtcgagcggtttgatcaccactgcccttgggttggtcaatgtattggacagcgcaattaccgctacttcttctggtttgtttgttcagcagcaatcctgtggttctatgtatttacaatgtctgcatttatatcagtcttctcatgaag

SEQ ID NO: 34410 - DNA, 786 bp, Triticum aestivum
  unsure (1)..(786): unsure at all n locations
  Clone ID: PAT_TA_34410
cgacatactggtgaaagaaatggtgatggatcaacgtgctcgcccgtcagacaggacaaaaaccccagaagaactagctcaggaagaaaaagaacgtcttgagaagttggagaaggaacgtcacaagcggatgcttggaactgctgagtcctctgacgaagaagatgatgatagcgaggatggtgatcatcatatgagggcggataactcaaaacctatatctggcgatgatcttggtgattccttctcttttgacgagccaacaaaaaggaaaaaaggttgggttgacgaaatttatgagaatgagggtagaaagataggtgaaggtgtagcatctggcgatgaaggaagtgatgacagtggtgaagatgaggatgaggatgaagaagatgctggtgatgaagaggattcaagtgatgatgacttccgtaatatgccggcaagggactgggagcaaagtgacgacgatgaggttgctgtagaagaagatgaaaaggatgatgtcaaagataaagagcaagttattggggaaaaagttatgaaaacaaatgcacaaaatttgaagagagtatctaatgcgaagcaaaaatcacatggcaaggatgaagatcttcctttcgtgatagaagcaccaaacaacttacaagatctatgctccttggttgatggtcgctcanaaactgaaatagctgagattattagccggatacgtacttgcaattcaataaggctcacacctgaaaacagaaagaaaatgcaagttttctacggtgttctcctgcagta

SEQ ID NO: 34411 - DNA, 1020 bp, Triticum aestivum
  Clone ID: PAT_TA_34411
caaaggttatgcctcagaaacttttcaaagagccagtgaggattgcagagaagtatcctgctggccaagaaggtgatttgaaaaagaaatatatggtttgcactaactggctgttgtcagaggagccactggacgtagagacagagcttgcacttggtttcctggatcacctgttgctgggcactcccgcttcaccacttataagaattcttcttgaaagtggtttaggagaggctattgtgggaggtggtgttgaggatgagcttcttcaaccacaattcagtataggcttgaaaggtgtatctgaggataacattgagaaagttgaagagctggttatgcagattttgaagaatttggcagaggagggatttgcaccagaagcagtggaagcatctatgaacacgatcgaattctctctcagggagaataacacgggatcatttcctcgagggctgtcactaatgcttcgttcgatgggaaaatggatatatgacatggaccctttcgagcctctgaaatatgaacagccgttgcagcaactcaaagcacgcattgcagagaagggatccaaagcagtattctccccactcattgaaaaatatattttgaacaatgtgcatcgtgttacagttgaaatgcagcctgatccagagaaagcttcacgtgatgaagctgccgagaaagaaattttaaaacaagtaaaatctagcatgactcaggaggatcttgcagagttggcacgcgctacaaaggagctgaaggacaaacaagagactccagatcctccagaagctctcaaagctgttcctagcctgtcgctacaagatatccctaaaaagcctattcatgtaccaatagaggtgggggagataaacggtgtcaaggtcttgcaacatgatctcttcaccaatgatgtagtctactccgaagttgtatttgatatgggttctatgaagaaagaacatctacaactgttgcctttgttgtgcccatctccagtaaggattggcagtgccg

SEQ ID NO: 34412 - DNA, 913 bp, Triticum aestivum
  unsure (1)..(913): unsure at all n locations
  Clone ID: PAT_TA_34412
gggtcaacgactacagaacggggacctctggatatgtatgacatgatgcgacgcacatgcaacaagaattgacatcctctaatgctaactgttgaccattcttctctgaagtatcagaggtgtggattggaatcagttttttttgctgcacccccattccgacgaggtcacgcacacataccaccgggaatcccacgaaccctatgttcgagcgcgagcgacggcaatagcatctgcaagtacttgaccaacacgctacccgggtgtggtatccactattgaggccaagcaacctagctcggtcatccttaagtgtgcttgtgtccaccacctgatgaagaacgggagaagattgctgactttgtgcctaatgatggttgcctgaacttcgtagagcaaattgacgaggtgttgattgctgaatttggtcttaagaggcacgtcgtgggagatatcccttgtggcaggttcaaagttgtgatggtatctggtgtctcccagcgagatttgttccttctcttaacagttactattaaggtctaactttggtgtccttctctgctggtccccggccccagcaagatatgggtcagttccagcaaaaaaagatcgccgccatggtcacagggaaataaggaagggaagaaacaaatagggaacaatcagacgaagcatcaaggaaaatggattgaacaatcagatgaagcatccatctcgaggagaagcatggtctgcaaggagaccaatcatcttgaggtggtctttcantactgcatgtnccattnggagaagggncttagtcgatcttaggagccagactctgctttccttgcaggagaattaataatggtgtattactctccaacaatctntatnctcaaaatgtgtngacctttttanactgaatctgaan

SEQ ID NO: 34413 - DNA, 755 bp, Triticum aestivum
  Clone ID: PAT_TA_34413
gcagccccggcaggaggaaagcttggccggagtttgcagcttggcagcgagaagaggaggagcatcgtccgtccaccatgtggccggagatgaaggcgtgggcctccatggccgacgacccgctgaagcgcgcgtcgtcgtcggcgccgagcccgcccagccccatgcgccgcttcagcccccccccgatggcggtcggcggcctcctcaccgtcgcgccccgtcggctacttcatgttcatgggcaaggacgacaggcagcgcgagcgcgaccggcacaacgagcgcctggctcagcgcacctgagaagccgccatcgtcgcccccctcctctcagggaggcgaacgccgtccagcttagcgtactagccgctgccgcgtaatagtaataaaatccaacccccttccgtgtacggtgtataaatcgcgtgtgttctgttgtttatgtactcttttatcagtggaacatgcatagatttcactgagcataaaaaaaaaaaaaaaaaaaaatgctgaaggggggaccggtacccaaattcgaacttatagtgaggtcgtatttacaattcactcggccgccgttttacaacgtcgtgacctggggaaaccccccgtgacccaacccaacctcctttagcatctccccagttgccgccggcggaagcagagcctacttgcctgccactaactactctgatgatcttgtcgacctcgagggaggaggagtagatcaggttggtgaaccagaagcaggc

SEQ ID NO: 34414 - DNA, 598 bp, Triticum aestivum
  Clone ID: PAT_TA_34414
cttcttttcgcctgcaatgcgcttctgctgtggtagcagccgtagctgtgaaggctgggcatctcagcctggtaacagcactcaaagagtacatcgtcttctcttttgcgacctttgcactggtggagccatttggccttgcgccatacatcctcaagcgtcggaaatccctcacctcagtctttgaaattattgaccgagtacccaagattgatccagatgatgccagtggcctgaaaccgcctaatgtgtacgggagcattgagttcaggagtattgatttttgctacccaactcgaccagagatgatggttttgagtaatttcagccttaaagtcaatggaggacagactatcgctgtggtgggtgtatctgggtcagggaagagcacgataatttccttgatcgagaggttctatgaccctactgctggccaagttttgctggatggccgtgatctgaagttgttcaacgtgagatggctgcggagccacatggggctggttcctcaggaccctgtcatattctccacaaccataagagagaacatcatatacgcgaggcacaacgcgacggagtccgagatgaaggaggctgc

SEQ ID NO: 34415 - DNA, 739 bp, Triticum aestivum
  unsure (1)..(739): unsure at all n locations
  Clone ID: PAT_TA_34415
cccgggccaacaaatgctcaaaatcttcaacccatccttgtttgactttctattttcaataatcatgtagcaaaaagctagtatggctcatagtcatgaaattatttcccttgatttcttgcttagttacatgcacatattagataacaaaaatttgttaattgaaacatagggaaaatggcgaagagaaacactgttggcctactacttgtccttgcaattatgttctcctacaatgtcttggagggcggtgcacaccagagccaagttgtattctctcgcaaagtgacgaatgcagagcacaaagcatcctttagcgggatgacttcatcccttggtgggcgtgtttctggtgcgaccaatgcaggaggtgtgagaaataatgctgaaatagcaaatgttgaaactaccactaccatagagtcccaccgtgatgtctccgtgggagattttccgtggtattaatcacaaaccaccaacttataacaggccataatgatgaacctaagacaaaaggaccatgggcaccaactccgatatcccgtggatgaactgattatcaagttggcgatttcgacattaaagatgttagttcttcattatatgcgtgtgtaagtgtaactgcttgtaagacctacgatggtgtgttgggagtgtcaaagctatttactgatgtactactactaatattgtcaaggtagtattgtncaacactgcagaataaaanaaaaaaaaaaaa

SEQ ID NO: 34416 - DNA, 2128 bp, Triticum aestivum
  unsure (1)..(2128): unsure at all n locations
  Clone ID: PAT_TA_34416
ggaagacctcagcttggggcgaagaaaaggcatcgacgacttcgaggccatctccgcaaggagggatacagaaattccccttcttcatgaaattatcttttcttccaatgacaagccaaagctccttagtcagctatctacgctgctgtcggatcttggattgaacattcgtgaagctcatgtgttctccacaacggatggattgtgtttggatgtgtttgttgttgatggctgggaaacagaggagacagatggtttgctgcagcagcttaaggagacagcaaaacgtaatccctcattatcgaatctaacaagttcagcctcggagagaatatcagagctgcaagaaaagattggagaatctgaatttgacagggatctgttgcagattgtagaaaagattgcgtccggatcttctggagacttatatcgaggaacttaccttgatgtggatgttgcaataaagttccttagaactgaacatgttaacgataattcaaaagtggagtttttgcaagaaataatgattttaaggagcgttaatcatgaaaatgtcgttcgcttttacggggcatgcacaaagcagcgaaagtatctcattgtaacagagtacatggctggaggtaatctgtatgacttcctgcacaagcataacaataccttggagctttccttgattcttaggattgctatcggcatctcgaaagggatggattatttgcaccagaataacatcatccatagagacttgaagtctgccaatttattaattggcgatggtcaagtcgtgaagattgcagattttggtgtctctcgtcaacgatcgcaagagggagatatgactgccgaaactggcacctacagatggatggcacctgaggtgataaaccataagccttatgatcacaaggcagatgtcttcagcttcgctattgttctatgggagttggtcacttcaaaggtcccgtatgagaacctgacacccttgcaagcggcactgtcagtaaggcagggacttcgcttggtgattccctcgggcgtgcatccgagaatatctaaattgattcaacggtgctggggcgaaaacccccatacacgacctgttttctctgagatcaccgcggaacttgaagatatcttgcagcctattcaggccgcctccagctccaaaggaggccatcgacataccaaacaaaagatacagatgaaatcacagcgatagaaagaaggcgcctgctcatgaagccggacccactttttcacattgtcgcccactaaaaagcgcgacatgcacacaccgtctcctgtatatatgtcatgtacataaatttttgtgctcggttgttttgattccccctaaaatactcacaggacgaactgggttaagttagcacacccgtgctacataacctgagtgatatagttttatgtttgatgtggttatttgttttgcgagtggcttatagttcggtgtgtttgaattttggttcatgtacgattatgagttcgtcttgtaaggaacatgagatgaaaatgccactatcacatgttccattttggttattatttaatatattttcttgtctggaacacgataaattaacaagcttttgcagcttcgtttggaatcatatttttgcaggaaacaataataattcggtggccacaggaatcgagggaaaaaatgatcctgtatgtggttgggcttggcccagtaattatcaccacgtgaccatctcggctctcgggaaacaataacaactctcagcggcggcagaaattgaaagaaaaaaaaaaccgtatgggattgggctaggctcatttgtatgaacatacttcatctcgggtaaggatctcttggcccaattggcgtattttttatttccattccaagagaaaaggatagatctaaaaataataatgtaaaaatggtctcgctggcatgctcctattccagtgctttctagatgcagggcggagcgcggaggggcacggtcggttgtcggtttgcccattatccttgtaggtcctatccnctttctagaaaatatcanatgccctatattagctcgaccactcttttattgtcggcacatgcatatatatacacacgactaaatccctgaac

SEQ ID NO: 34417 - DNA, 704 bp, Triticum aestivum
  unsure (1)..(704): unsure at all n locations
  Clone ID: PAT_TA_34417
gctactactccaggaagcaccgactgcacctcctgtgccggtgactgaaccctagcagctccattttctcccgccggcgccttcctctccgcccggacgacgtgccggccggccgcaccatggatcggttgtcccgccgtcttgagggacatcaccacggatacgaaggggttattccaccatgattgccacggtccaagaccgcggtccgttccggagcctcgccgaggcactggccgcgctcagagagtatgcgcccaggccaaaatcgagcctgcctggactgctccgtttccatagcgctgaggcgtacgggcaagtattcccgctgatgggggaaagcctgctgttttgcacaccatggtccggttggaagtatcatatggccttgaagggtggcttctttcatgtctatcctcctcacattggcgggccttttcgaggcctaagtgaagctgtcgctgcgattgagcgccatcgggcttcccttgctccgccgcctgctgcccaggcctcccttgctctgctgnnnggntgccgaggcttcccctgctccgccgcctgctgcagaaccttcacttgccgcggcgcctgctgccgagccttcccctgatccgcaacctgctgttgatgcttccctcgctcgaccgccttctagccgagaggcttcccttgatccacaacctgctattcaagattacttt

SEQ ID NO: 34418 - DNA, 1899 bp, Triticum aestivum
  Clone ID: PAT_TA_34418
gccatctcgcctcccggcccacctccccatctctcctcccagaacctcgtcttcctcctcctcgccgccgccgccgccgccgccgccgagcatggcggcgaagcagccgttggcggccgcgcccgccgcgccccgcgccccccgcatccccgactcccggttcttcgcctcctccctcggcgtcccgcacatcgacgtggaggacgtcatcaagaggctccccgccctccgcgccctccggagtgcggacatcaccgagggcgcgcggctcctcggcggacgggggtgctcaccgaccgaggccaaggggtatgccgcgaggggctcccccgccatcccgcccgtcgcggcctccccgcccgagggtgcctccaagggcgcgctcaaggagagattgggggacgtgtccgatattgggaagaaggctgcagccaagaacaagtggattggatttgagaagggaaacaaagacctcgtactgagaaaggttgaggataccagggatgaattgcaagagcagcttagaagactggagaatggggaggttattgctgacaaagtaatagatgatttgaagagaagaaagcttgtaacaaaagagaaatctatttggtattcactgaagaaggggcctgaatttgttgcaaagagaaaaacattggcaaccgatgtgacacgagaacatctcaagagtggcgactggaaggatctggaatttaaagattataactatggagctcaaggacaacctattgcgataggatatagccaaccgttgttagaggtccgtgaggcaatccagaacatttttctcgagatggggttcagtgagatgccaacgaacatgtatgtagagagcagcttctggaatttcgatgcactgttccagccacaacagcatcctgctcgtgattcacacgatacctttttcctcaaagcccctgccacaacaacacaattacccgatgactatcttgagaaagtaaagcaagtacatcagtctggtggtcatggctccaaaggatatggttacgattggaagcgagatgaagcagagaaaaacctgcttcgtactcacacaactgcagtttcaacaaggatgctatacaagctagcacaggagaaaacttttgctcctaagagatactattctattgatcgtgttttccggaatgaagctgtggaccgaactcatcttgcagaattccaccagatagaaggtcttatttgtgattatggtttgacgcttggtgatctgataggtgtattggaagatttcttctccagactaggcatgtcaaagctgcgtttcaaacctgcctacaacccgtacactgaaccaagcatggaaattttcagctaccacgatggtctgaagaaatgggtggagataggcaactcaggcatgttcaggcctgaaatgttacttcccatgggactgccagagggcgttaatgttatcgcatggggtctttcacttgaaaggccaacaatgattctgtatgggattgacaacatacgtgatctctttgggccaaaggtcgacttcaatctgatcaagagcagcccgatttgccgcttggggctgtagtgtggtgagcttgatagaactttatctggttgtccggatgcggagtatgtttatgtgtggttttatctttgaaaaccagtcctttgaaatctagtacgggtgcatttaaaagagggagtgcagaaatacacacatgttgtggggtgttaatgttcgatacaagttgggtcttccatgttctatgtagttcaccgtacttgtgctagcaaaatagaatgctaaatgtttttgtaattgttgtaccatggatctctgatttttttattgtccacttacatccgagtttcaaaaaaaaaaaaaaaaaaaaa

SEQ ID NO: 34419 - DNA, 851 bp, Triticum aestivum
  Clone ID: PAT_TA_34419
ctcgtgcccgctgcgggccggcgccgccgagctgcggtccctggtgtggcgtccccgcgagcggcagtggcgtttgatcatccggagagtgttccttgccaatgagccagtctctgtgaagagtggccaacacattgtagaggttaaacctcagagtgtgtcagcaagggatttgtcgccggagaagatcctatcgatgctgacagagaagaaaagacaagcagattttgtcctctgcataggtgatgatcgatcagatgaggatatgtttgaaggaatagctgatattatgaggcggagcattgttgatccccaaacctcgctctatgcctgcacagtcggccagaaaccaagcaaggccaagtattatttggacgatactaatgatgttttgaacatgctcgaggcacttgcagatgtatcagaggaggttggttcaccagaagaatcggagatactttccccgtcggagggggcatgatgaagtcgtgtcgaagagcatatctcatagtccattgcaaccagcaatcttctgtctaaattgaagccaagttcagatagctggaatgcaactttagcaatatacagatagtcagatcaatgtcaataacctagtgttggtctagttttggtctcttttaccgtctgccttctcgtaattttggagtatttttcacattctgtctagatagagaaatgacctggagggaaaaaaaaatccatggtaggtatcttttctagacttcttttttctgttagtagcaggtagtgtatgtaagattcgagtgtttctgcagtttatatacactataagtcgaaattagtagatgagcatttgggccattttgcct

SEQ ID NO: 34420 - DNA, 1245 bp, Triticum aestivum
  Clone ID: PAT_TA_34420
aactcctccactgcagcctgccggctgcctcgagcccgcgcaccctcctcccagccatggtgaagctagccacggcgcgggactgccgcgcgtacagcctcggcgccacgggcggcgagacgtcgcgcaaccggcggtgggagtacatcaacgccggggtgtacgtcttcgccgccgtcctcctcgtcgccggcttcctggcgcagctgtggccgtgggcggtgtccaccaaggccggcctcgccgtggccgtcgtcgggctgctgggcgtgctgggagcgaacgcgcacgacctgctggcgcacgtcgccggcgtcgactacaaccttggcctggccgggctcgacacccagttcgtgctcgtcgagctcgccgcccccgccgtgcagctcgccggcgccgcgctcaccctggtcgcgctcatcttgttcgaaatccagatggagagagggcaccggcgcggcctggagaggcacggcctgaacctgctcatcgccgggccggcgctgtggtgcctcgggtccatacacaacatgtgccaagtctacgagcgagccaacgggcacgtccagatcctccagaagagcgtgcacatcccgttcctgctcggcagcaccctcttcttcatcggcggcgtcgtcaaccggaacgacgtccacggccgctcctcccacagctccaccctactggggaggagctgggcgtggtactgcctgttcgggagcttgctgttcctggccggagggctgctgaacctcctcaaggtgttcaagacccgcccggcgggcgcccgggggctggtgatgctgcgcggcggtgcgctggagcggctcagcagggagagcgagggcaaggtgcctctcatcctggaggagggccggatggggaagcacggaggcaatgtaggggatacctgggcgccggggccggcgccgcggcacgagccgagggctccgcccgtcccgccgccgccggagggttcttacaaggacgctgtcgtgagcggcggcaactagtgtgatcttgtcgtccacggcggtgacgaataataagagaggacgtgccatggcggctggtagaggagaaacattggcttagggcgacgccatcctgtattttcgtatatgtacacgatgtcatgtgaattatatcgacttgctgcctatgattctaaaaaaaaaaaaaaaaaaaaaaaaaaaaaaaaaaaaaaaaaaaaaaaaaaaaaaaaaaaaaaaaaaaaaaaaa

SEQ ID NO: 34421 - DNA, 681 bp, Triticum aestivum
  Clone ID: PAT_TA_34421
cgtggtccatctgctgtaatgatgtacagggagcagcagcagcaacaacatgatcacatattatcaaggacgccacctgatgcaaatgcaagtgcaaatgcccatggaattactggaaggataccgcatggagatcagcatatacttcaatttgcaggtggcaggacactcattggagaacatcatatccatccatccacaggtgccagaataccacacaaaggtcagcggcagcaagagacctgcttggcagacatttcacaaggtgatcagaggtggcagggccatgcctcgcggaatctttctgctgggactgtgcttgagatgttaggtaagatgccaatgaaggaaaaacaccaggtgacagcaccttctagcagttcagttgacatggatgtcaggggggatagaggtaagaaatttctggcagaagcaactggcttggaggttggagttggggaagtaggttttgaacatggagtgcacgggcgggttgtagtggatgcaaggaatttcaaggtatcgtgccagaacagtgaggttagatttgctgcaaagaaagatgaagatgatgctgacagcaaggaggaagatgctataattgagcagctcatggataccatggtgattgatggaaatgatgaggccaagggcatggtgatgcgggacagtggctcaagg

SEQ ID NO: 34422 - DNA, 1156 bp, Triticum aestivum
  Clone ID: PAT_TA_34422
gcgcccgcgctaaatacgccgtaatggcccttaggtgcgcggccggcgccggcggcggcgcctacctgacgccgcggagaagcagatgctgcggcgtcggctctgcgcgaccctcagccaccaccagggggacacgagggctcagcctcctcctgaggatcccgtcctcacaatactccaaagctccatgggcgttgcggtgctcgcctgattccccccctctggagggtgaccagcattcagatcgaaccggggcgccgggggcgctgaaggccatggtatgcgacatgttcaggcccctggcgcgcaacatctcggatatccgatcccttcgcaccgtctttgacctcgaggattatcaagtcggcatgctgtttggtgcttttcttggctgcgtcgggtgctaccagctgtggaaggctgctccttccatctttgtcgatgctgcccttgcctatgcattctataaactgagcgttgtgtcctcggaggtgcgccggcagggcaaatgcaatgatttgctgactcgtttgaaatttggtattgtggttattatggctactaaggacttcaggaagaactatgaactcttggatattgtcaagatgcctgttttctttctttatctttcgacattcatttttgatgtggcacgcatgaagaaatatgcaaagcattatctgattctcacagttaatttattgagaatgaagggcggagctcaagaattgttcagaataatgttttatccgagctatacatctccatatgatgattgcttccgtaggaaataaaatgtagacccctgagattgtgtggatctgtttatgtgagatttttatataagaatttttagtataatgtgtaataacatttatgtaatgctagtttaattgcccatggttgtgtacagttttgtggcattcttcatgcacaaatagcgagatagtctactagttgatacaatttcaatcttgaagagcatttgcaatgtgtcagcattctttaaagtctgtaacagccggatgagatcctatataccatagtagttataaagttttcataaatttcaatcttgaagaactttaatggcacacatgataaaatgggaacagccggatgagatcctatataccatagtagttacaaagttctc

SEQ ID NO: 34423 - DNA, 1487 bp, Triticum aestivum
  Clone ID: PAT_TA_34423
cgatgacaccctagcccgccgcggcgccccccacgaacacccgagcccgccatgccgcccgcgccccgcctccgtcgggccctcgccggcgcccctgcctccggtgccctccccagtccggctgcctcccccgcggcttccccccatcgctccccccgcctcgcccgtttctacccggggccgccgcgagcttaccaacggaggtggcaggctgggcactggggaactgcggcgaaggcgcttcaggttaagaacaaggcattggcgcctctccctgaaatggagacatttccacctgctcaataaacagctcgaactactccattgtgttcatctcccctgcagtcaccctcacccctagccttcacgcgcggtgctaattcatacctacctatagaccctctccgaagacgtcgtagggtattaggagaataagaagaagatgtatgcccttcgctcatgaacgtagaaatgttatcaaagtgtcacggatgaggaagagttgtttttatcttgcctgattcatatttatacccagagacaaaggagttcggaggagacaaatatgagaatggtgtcataactccaagaccaccacctgttcagtatagcaaactgtcaaggaatgatagaaaccgcaactatcgtggaaattacgaaaacagtcctccaccgcaaggtaattaccacgaacagtcctccacctcacggaaattaccaagaacaggtcaccaccacaaggaaacttccaaggctcccgacagcaacaagtaagaggctacgctccacagcagaattactcacaagctggccaggatggtagaggttatgggaggaatgattccgccgtccgtccaggttacaatgcacctggtgggtaccaagggcgtgtaactgaagccggtcaaggtttccaagatccacaagagcgcaggagtttctcgcaaggacaggaaggagatctcaggcctggtggcccttcagcacctggaaattatggtcaaccacctgcacctggaaattacggtcaaccgcctgcacctggaaattatggtcaaccgtctgcacctggatcctatgggaagccatttggacctccagcttatgggcaaccgtctggatcgagatatgctggaggtaaccaagggggtcctggttatggtggagacaacagacagggtgcagcgcctgcatatggaggagataacttacaaggggtttccgatcagtatcctagcccaggtgaaggacaacaagggaactgacagggtaggcagtaaggatctgatgagaagtagcttcacgaagaacaaggcattagttgctctacttgaaatgtagaaatttccacctgtaaaataaacaaccgaactactttattgcctcctgttgcctgcattgacattgtagacttataaatcgatgtgcgttactatttcttgcagccatgtctttgactgttggaaagctttgggggccgtccattc

SEQ ID NO: 34424 - DNA, 513 bp, Triticum aestivum
  Clone ID: PAT_TA_34424
cccacgcgtccgataaaagggtattaaaggatcaatatggtaagtacaccaaataaagattatcgctttgaagttggtagatgcaatagttaccgacttcctttcactgatgcacaatagcagcttgtttcatttactttgccaacttctcagacttgggcaatccataatactactttattgcaataccacatcaagcagatgatgtgccatctactccctctgtcccataatgtaagacgtttttttacactagtgcattatgggacggagggcgtaaattcctaccgaatcaataaatgtaactataccaattctttgctcgaaagagagcaaccaaatgtctgcttgctaggtcttgtttaccaggaaatcccaacctgatacttctatctacatcctttttggtgtggaatatgatttttcgccactacttgactttgatgatttgccagtggttactttgcaaatgatattttgtcacttcttacttgggactttgaggatttgccc

SEQ ID NO: 34425 - DNA, 1002 bp, Triticum aestivum
  unsure (1)..(1002): unsure at all n locations
  Clone ID: PAT_TA_34425
tcggcacgaggcagacagagcaagtctagggtttcttcgcataagcagagcggcgatggcgaaggcggaggcggaggcggaagtggactcctacattaattatatgttgatgcagaggagggaggcgatgaggaaggttgatgaggcgcgggagaggatgaagagaggaggccccggccgcaaaatgaagaaacggaagacggagacgggaaagagctcaaagaaggcggcggcggttccggtggagatgagcgtcagcgaggtggggagcagcccagcggaatctgaagatctggcgaggacaagggagattgtggaagcagccatggccaagattctggcgcggatgaaggggatcgtcatcaaggagccggtcaagacgatgacagaggaggacgtcgcggcggcggccgtgtacagagccaaggcggaggaggcgcgcaggaacgaggaccggccggaggagtccagcgccctccggaagtggatcgccacgggagaccccgaggccgtcaagtgccgcaagaggtggattgcggaagacatggaggccctgaggctcaaggacatggatcccgacgaggatacctccgactggcgtgccttcgaggccaaggagttccgcgagttctgggaatatctttatcccaaatccttcggaaatttcaaggacaacacgcgtatcccaaacatgctttacacggacaagaagtcgtcaggtggcacagcccaccccataagaactctgcaggtcttttctgtcaaagttgcgggactacaagatggagtgcactggccgctgcaagtgtttggcgtcgttgctgcacgagattgtttggatcataatcgcaatgttatcttccagcgcgaaagggataactgccaaatgatccacaaggagaatccgtatttgacactgacaggtcctagccgtgctattgtggtggtggatcctgtgtggttttggaggttgctttganagtgaagggcgctactggatct

SEQ ID NO: 34426 - DNA, 1014 bp, Triticum aestivum
  Clone ID: PAT_TA_34426
gcgaaccacgaaacttggggggactggtaggtggctgttgggtcgggtcctccctttccacgggcagcttggtaatggggcccctctataagctgtggggacaagccgtgggagggccccaacccggggcccgtcccggccgccggcgccaaccccccccccgcccccgccccccccagcgcaaccgtgtggctcctggcggcgggctcgtgatcccacctaccacgacggcccgcggcgaggatgccccgatgaaagtcacgcgcagcatcatgattaagcggccggcggggtacccctcgtcgccgaggggcgcggccagcacgccgccagcctcgccgctaggaaccacgccgcccctctccccgttcgccggcggcggtggtcggttcagaaggaaatcatcctcggatgcgtacgagagggctacaccacctggggcgtcgaccagtcaccctcctccaccctttgaagtgtgactgcccagcgcgctcatgctcgtttttgctcctcggcccgctctacttaatgcaagcccgaggaggaagagaggacgtatcagagaaatctgagaaacgccaagggtctgcctttcctctactgtgatagtataatatagatgaatgtgtagtgttctgtttttactatatatgcagtgcacgcgtgtatggttatgtatgtgtagagaaggtgttgaaagttgctgctgctgtgctgtgctgtgctgtgttagtatgtacttgctgtgttagtatgtacttaggtcgtcacccctgggctggcacgcagctcctcgtttgtgttttgtctactatgttgtggaggcctcgtccttccatcacgttcgtgtgtgctgcggatggaagctgtaatgttaagtaggggggtgagatacggtgtacgtagtacgtgtaattttgcttgatggtgttatctcgagtagtatctcggtgtttgcttgaactttgcaagtactagcttccgtgtgtttgccaagggaaaaaaaacaaaaca

SEQ ID NO: 34427 - DNA, 938 bp, Triticum aestivum
  unsure (1)..(938): unsure at all n locations
  Clone ID: PAT_TA_34427
ctccgcgcggtaaactagttccgcaaaggcacggaagccaccgcctccctccgccgccctcctgggcgttgccccccctccccctctctctctctctccttccccctcccccaccgcccccccttcgctcgccgtaaagaagccgcaggcaggcggataggagaggagcgagtagcgtagtagcggggctgggagaggaggagatcgagaggaagggcttgagaaaaccgaaaggaaacgagtgtttctgctccccggctggaaagtatcccatcttttcttttcccctggggaagctgaattggtcgattgattcgcgtgctgtgtgtgcgtgcgcggtcatggcgacgaggcggatcttcggatcggggaggaggggagcttctttgttgtttcggttcggcgccgagcggagaattattgggtgtttgggaggaaggaggggtcggggagcaagctagctgatgtacggctcgccggcgtccaaggatctgaaccagccgccgccgccgatgaactcctccggcctcctcaagtacagatcggcgcccaacacgctgctcggcgaggtctgcgaggagttcctccagcccggcccccgcgccgccagccccgacgccgccgccgccgacaacgtcttctcccgcttcctggccgaccaccagatccgagacaccaagccgccgccgccgccgcccgtcgcccccggaggcccacttccctgatgactccgccatggcatcgcagcagcagcagcagcagatgatgttccacccncagcaccagcaccaccaccaccagcagatgccccccgtcggcgttcgagggctctaccgcaccgtcagctccgctggggatggactccgccggncgggncaccgccggaagcgccagcagcctgctccggcagaacagctccccgccggcttcctcatcat

SEQ ID NO: 34428 - DNA, 752 bp, Triticum aestivum
  Clone ID: PAT_TA_34428
cctcgccccgagcctcggccctcctgacctaaccaatccgacccaaggcggctccatctctcctagactgtaccacgccgtgccctgccgtagcactgcgttaccgccgacgcctcacccccacccctccgcacccccactcccacaacccctccgcccctctcacgcgcctcgcctccatcgccgtccccgttcttccccgtcgccgaatttcgtccctgctgtccccgccccgtccgcaatctcgggccattgggttttgaggtcccagggattggcgtctggaatgcaatggtgggtatagcctgaccgtccagagcccgaaagaagagcacatttctcgttccaatctcggttttcttggatttcgattcgtttgttcagggccggccgagatggacgacgacggcagcttgagcattcggaattggggcttctatgagacgatgaaaggcaacctcggcctgcagctgatgccatctgtggccggcggccaccgggacacaaagccgctgctccccaacggcaccttcttgcagcaccacaacgccccgcaccacccgccgcattcacatcacccccgcgactatggtaacggcgaaccctctggtggcatgcccaccgagccgccggctattcacatggattttgtgcgcaatgaggcctggatgcacccctcgcagcatcagcatcagcagcagcaccagcaccatcacccagaccaacatcaacagcagcatcagcatcagcat

SEQ ID NO: 34429 - DNA, 926 bp, Triticum aestivum
  Clone ID: PAT_TA_34429
agccggtaccggtgggtgtggagatccacgactggacagcgcagacgcccagatggcgaggaagacgagtcattgtcgctgccaacctccgcctctgcccccacacccctgacgcgagctttgcctcctctgccgctgctgcatcttctccagtgcctcacccccatcggactcgtctgcctccctgtcatgcaggtgctcctcgcgtggccatgctttcaacctctctctctatctctgttgtgtgcatctccctcaatagccactggatgttttatctggtccattgtgagatttgccatacatgattagtaataacagtaggttaatttgatgggcataagcattagtgaggtgaaatatgtagagtttggattgatttacaggttcttctaatgaacacactgagatgggcgtagattttctgttcggtatgcgatcatatggtaagcgtgtttattttgttgggcacccgtgtcctttgctccatgcaagaaatttcttatttctttgtctgatgtatttgaaaaatcaatgtgagagatgagttttgggtgattgtctacatatagtgttcttgcatcttagtgtgagttgcgtcggatggtattgttttctcaagggaataaattcatatgcttggtaagaaaaggttcaatctacatgcaccatgagttaaaagataactttgatgagtcagatagatgtagtatgatccacaaccatagttctgatccacacaatgcatgatattccactttagcctgagtcttgtggttagtacttgctacttctccctgaaatagaattcataccgacactttgtatggttggttacaaagagccacaactgtaccaggaaatctagaaacccaactggatatgccaaaaaataccaattcctagaacgtcacatagtgattgaa

SEQ ID NO: 34430 - DNA, 1267 bp, Triticum aestivum
  Clone ID: PAT_TA_34430
aatggacatcaaggtagtggggataactctacctgtaatggaacaagcacttctacaagctagagatggtagaaagcacattctaaatgaaatgttaaaatgttcgcctccgccatgtaaagcactgtctccccgcgcgccgctcattcgcctggtgctgggtgatcctaacaagggctccctgtggagcggttctggcggttgcaccaccacgcgtccgctcgaggagactggagtatatgccattgatgctcgagatgatggcacggtaaaaattactgcaagggacatggaaagcttagagaagtcgaaaaatataataactaatcttaccatggttccaaaagttggagaaattttcaggaactgtgagatcaaaacaattgctccctatggagcttttgttgaaattgcaccagggcgtgagggtttatgtcatatcagcgagttaagttcaagttggttggccaaggctgaggatgcttataaagttggtgatcgcattgatgtcaagcttattgagataaatgacaagggtcaacttcgactaagttgcaaagcgttgcttcctgatgcaaaccaagaacctggcagcatcaagcagcaaacgagcagttcagtgaaagaaaaggtagtatacaaagatgatatcattaagatgacaactagaaggtccaaacgtaagaaagaagttgagccgtctgcagctgaaaatgccacaccaaagacccttgaaaacagcacagctgacagtccttaagcatttggactcacaaagacagtgaaagaaacagggtgacacaagcaacatggcgcttcatcacactaattgcctaggattgcaactacaatatccactgactgcattactggaactacatgacatggcttgctgcccaaattgcccacttgcccccttgagattggacacctacagaagatctgttcaaatctttgtgctcgatcatgctccaaatggagtagatgcgaaatctcacctggtttatgttgctgctttagcatgcaactattttggttgtgttcccatatgcacatcctgcattttgtctagtgcaacaaggagtgcctactatggctttgctacattgctttaacatggcctagctatacccgtgcgttgccactgaacaacaagcaaatgtgcgtcattgttttatttcgtcagataaacgcgtgttttgttttcaccgtgtagctaaggggggggggggggggggggggggggggggggggggggggggggggg

SEQ ID NO: 34431 - DNA, 936 bp, Triticum aestivum
  Clone ID: PAT_TA_34431
ttcctaagcaagagcttgacaacaagtcacttttatgtatggagttcctctccaggtcatcttctagtgatgcccctcttgttgcattcggggcgtccgatggtgtgattagagttctctcaatgatgacatggaagcttggagaaggtatactggtggacataaaggagcaatatcttgcttaatgacattcatgtctgcagccggcgaggtacatttagtttctggtggtagtgatggcctgctggtattatggagcgctgatcatatccatgactctcgggaacttgtacctaagattagtttgaaggctcacgatggaggggtggttgcggttgaactttcaagggtaatgggaagtgcgccacagctcattacaataggggctgataaaactttagccatatgggataccgttacattcaaggaaataaggcgcattaaaccagtacctaaacttgcctgccatagtgttgcatcttggtgccaccctcgtgcaccaaaccttgatattctgacttgtgtcaaggactcccatatttgggccatagaacatccgacttattctgctttaacaagaccactctgcgaattgtcctcgcttgttcctccacaagcccttgcacagcataagaaactgagggtttactgcatggtggcacatcccttgcaaccacatcttgttgctactggaacaaacatcggtattattttaagtgagttcgatccaagagcactaccggctgttgctcctctaccagcactgacagaaagcaaggaacactctgctgtttacattgttgaaagagaacttaagttgctgaatttccaattgtcaaacacagcaaacccgtcccttggaagtgcatctgaagcaggaagatcaaggagtgaatctatagatcagctgatagttaagcaaagcaagaagcatat

SEQ ID NO: 34432 - DNA, 411 bp, Triticum aestivum
  Clone ID: PAT_TA_34432
attagcctcttgagaggcgatgatgatgatgaatcctcgaagctggctggctgggcctccctcggctgccctgaattagaagagaagcacaaaactggagtaataatgatggcaagtaagtacgtatacatctgtatcgcttggcctgtttctgtacatagagccccctggggcggggctgcctcgtgtatgaaccaacctggcaacgtacgtaccactctgtctgtccatctgggtccatctgggtgggcattggtgcaggtgcacgcactcaataaattcgctcgattagcttcgattacttgggtttgggttcgtcggcgtacttgagatccaacaaatagctttgcttcggcgtcctgattgattcctggtatgagttgccctggacgtcggccggcttataaaaat

SEQ ID NO: 34433 - DNA, 985 bp, Triticum aestivum
  unsure (1)..(985): unsure at all n locations
  Clone ID: PAT_TA_34433
gcacgagcctgcggcacatgttgctctcgggccccttcgctcggcctgcgccggctgggcccctcgcccccggtgcccgcgccggtgcggcgtcctgccttcatgctcgcaagctccgctcctagtctgctctcctgccttcgaccgcgcgctctctctctcgtcccttctcttggcgagcgacggctgggtgatactgctacggttgccgctaccagattctgcttcagtcctggagaagatgcggaaaattaagagggatggtggtgatctcacaagaagcttgcatgggaacaaaagagctaagagtgtggtgacgacctcgaaagaatcttgcttagaaatacgagagccaatccagatctcaggtgacttagatggggactcaaatcaagatgtcttgactgagctcagtgatgaagttaaatcaaatttgtcgaaaagtgttgcctcacttgctgtgtgcagtggggacacagtgttatttgcatgctcaggcttagctatagaacgccacggatatgttacaaggtttgtgacttcagcagaattggctctagttttcaacaatgaaaaatacaaagaaaaacgtcacaacgtaaagattgaagtgcgccatgaaggcagcgaagtttaccagggttttctggcaacctatgatgtagattacaactattctgttgtcaaggtcaagaccttcctggatgttaatgttggacttattgaacatgcggtagggattctgcctgatggtaaaggtggtagctctagggcgtggcacctgtggtgaactaatggcaagaagtgtgatgctggctgacgatctgagtgtgtgtgaagatttaaagatcctgtgtcgtctatgcttaatattacaaaggcttggcaaggtgggccacttttttcttttgatgggaactntgttggcatgaacctttttctcattatggaaagagcttttttcctacctgggggtgtactgctc

SEQ ID NO: 34434 - DNA, 1138 bp, Triticum aestivum
  Clone ID: PAT_TA_34434
ggaggtagacgaagatgctgggcggcggcgtgtccttctcattcagcgacgtgctgaccatctgcgggctgctggcggtgcagtgcatcttcggtctctacatgatgttcctcaaccggctactcgtagccggcgtcccgtcgctcttcatcatcgtcgtcgcatgcgccgcctcctccgtcgtcgttctccccttcgccatcgccctcgagaggaagaaatggcccaagcgctggagccccgtgttgataatccagctcgttatgatctcccttggaggggtatcaatataccaagtcttgatgatgctcggcgtcgagcggacctcaccagcaatcgcctcggccatgcccaatcttggccctggcttcatcttcgtcatcgccgcctgcctgaggtttgagagatttgagtggaagtgcaagtacaccagagcaaaaatcttgggtacgttggtatgcataagtggagcaatgtgcgtgagcttcctgaagaatccggatcccggcagagtgccagagtccgttcccagggaccaagagttgtctggcatgaaaatcgacagagactgggtccttggctgtgtgtacctgctcactggagtcacggtcttcgcttgcaacactgtcctgcaggctgcaaccctcaagaggttcccggcgccgctgtccatctgtgtgatcaccgccatgatgggatcgatcttcagcgccatcatccaggtcatcatggacggcaagctcggcgcgggcactacaggcaacatccccagaataatcgctgaaattgtgctcgtgggaggtgtggtgatcggcctgtgcacgacgttccaggtgtcgagcatcggccgcaaggggcctgtcctggtgtccatgttcagcccgttccagaccgcgttctcggccttcatctccttcatcttctttgggcaatggatcggcacagggtgcctggtggggattgcgctcatgtttgcgggcctctatgtggtgctatgggccaagaaccgggaggacaagatgttcgccgagcttgcgctgccgtctgactctgacgcaactgaatctgatatcgagaggccattcttgcagtgatgggttgggcaaaaatcaaaatcgcttgcttccactactggcta

SEQ ID NO: 34435 - DNA, 1189 bp, Triticum aestivum
  unsure (1)..(1189): unsure at all n locations
  Clone ID: PAT_TA_34435
caatgataccattggagttattcccaagaattcttggtccattgacccatttggctattcatctaccatggcttatctactgaggagaatgggtttccataacatgttgatccagcgaacacactatgagctgaaaaaggagcttgcgaggaaacagaatcttgaatatttgtggaggcagaactgggatatcgaagaaacgactgacatatttgttcatatgatgcccttctattcttatgacataccacacacctgtgcccctccgccagcccccggccgtccctcgcgcccggctcgaatgcgtggtttcagctatgagtcttgcccatggagatatgatccagttgaaacagattcaaacaatgtgcaagagagagcaacgaaacttctagatcaatacaggaaaaagtcaaccctgtacagaacaaatacacttctcattcctttgggagatgatttccggtatgttaataccgaggaagcagaagcacaatttcgcaattatgagaagctttttgattacatcaattctaatccccatctgaatgctgaagtcaaatttggaaccctggaggattacttctctacactgagagatgaagctgaaaagataaactatacacgccctggtgaagttggttctgttgagctgcaaggttttccaacactttcaggggacttctttacatatgctgatagaaatcaggattactggagtggttactatgtatcaaggccattcttcaaagcagttgaccgcgttctagagcagacactccgtgcctcagagattctgagttcatttgttcttggatactgtcagaaatttcagtgtgcaaaacttcccatcagtttctctcacaaactaacagcagcaaggaggaatttggcactttttcagcatcatgatggggtaactggcacagctaaggatcatgtcgtagtggactatgggactcgaatgcacacttctttgcaagatttgcagctatttatgtcaagggcagtcgaagtgcttttgggagatgtctatgatagatctgatcctacaattttatcacattttgagccgttgcaggaacgatcaaagtatgatgttcaacctgtgcatagggttctcaaccctcatgaagggaagacacattctgttgtcttttttaacccattagagcanacaagggatgag

SEQ ID NO: 34436 - DNA, 1081 bp, Triticum aestivum
  Clone ID: PAT_TA_34436
tcctacgcacccacagccgcgacctccaaccatctccctccccccgagctcgatccgccgccgccccaatcgtcgatgaccctcaccgtagacaagagcgagcccatgcccagattcacgagtggagcccggcgaagctgcccgcaaactgctcctcttccccacccccgattcctctccaatcttcgccgccgccgccgatccccacccccaccgccgacctcgtctccccgtcctcggccccatccccacctccggccgacctccctcctcatctcgtccatccacccatggaaacctccttttccacggatccacacacccacccacgcccacccatggatggatggatggatggggcgcaccagttccggcgacggcgacgccggatccacacccacctacacaatggaggccggccgcatcgggatccatcgcctgctctcggtctggtgcggcacagcagaccacactggagattgctactgcggtggccatcgacgacggcgcatctctggcgggacctagatgcccaaggcatgcatccgtggttggtgaccttgcatgcggcccttgccggaggctggttggctggatggacgggcatccgggatgctggtgtttgcagccttatatctcagggaagacgcctgctaaaatgtgtgcatgccaagattcctacagttccagactgattagtgagattacagttataagggtggatcgattagcatactctgcctactgaatgccagtctgagaggtagcatctgctatcgtcaggttatataagctcgtgtggatgggaggtggatgccagcacggatccggcgtctccgacctcggcatccacaaggaggagcggcgacaattacatacccaaccatggggcagcctccctctacctctctcacattccctgattttgctgctgctctaaattcattttcacttgattgaatctagtgctactgctctaaattcacttgcatgtttgactaaatcataaaagaatgaataggtgttggctttagagtgctagtttgtatactctagcaggcgaagcacgtccgtgcaagct

SEQ ID NO: 34437 - DNA, 801 bp, Triticum aestivum
  Clone ID: PAT_TA_34437
ggaaccatgtgctataatgcaccaatgctgctttcggatgacgacgacaatgccaaacgcaccatcacctgagatgattggtgggcagaattaaagagggattaccaagtaaggaaatacacccgagcaagcagctagacccaaggtacaaatgtaaatcgctcaaccattttgatatttagtctctcaagagttcttttcttagtatattattcttcaagatccactttcattttactcagtcatgcccaaatgccttttctataaatcattctaaaagatccatttgtgacttactacccccctctgcccatatttttatctatggatgctgctctctctctttctctctctctgtgtgtgtgtgtgtgtgtgtgtctgtgtgtgtgtgttatagccatgtttagtgcttccgtttagtccaaagggagtagctcaattgtgtcctgcataaattagatcttttcgaaaacattttaaccaggatccagctttctatacattgataactagagcataagtgcactcgctcaattctgaaattgttcatatttatggcttcggtatagtatacatagtaatcatgactagattgtagaagttagagatgtacaaatgattgattggaaatatatatttgtatttgcaacaacacactagatcacgtcaggtaaatatttttgtagaatataaggtcacgtttagaacttttgatgacgacagctgaaaaaccaaagtaaatccatgatatatagtcagtatactatatatttagatattcatagatattcatggcattgc

SEQ ID NO: 34438 - DNA, 983 bp, Triticum aestivum
  Clone ID: PAT_TA_34438
gaattcactagtgattagcgtggtcgcggccgaggttcgagttttttttttttttttttttttttttttttttttttttttttttgattttcaaatttctaaattattttaacctctaatctctaatcaccacccctcatcactgctcaatttatcctctaatctctaatcacccctcatcattccaaatcatctaactcccagatggtcacccatcctctcactactccagcctgagcacgcttaacttctgggttatattctccctcgtttccaagtctgcacttgttgttttcctgataatagtaagatgtcaatcctatacctgcccgggcggccgctccaaatcaatagtcaattccggccctgccggggcgggacccgggcgccctccgaaccccagtcccccaatcacccccttattgctggagtacgtagtttgaccttcatctggccccggtctgtcctgatttggccgaaattcaaaaaaactgaaataattatttagtaacactaatatttcttgaataattagtttgaccgttgtttcaaacatgacagaccagatttgaccaaaattcaaaaaactgaaataattatttactaacactaatattcttgaataattatttagtaacactaatattcttgaataattatttagtaacactaatacttcttgaataagtagtttgaccatagtttgagcagatttaacaaaaagtaaaaaaaaataaaaaaaactaaaatttaagcataactttttttctttttaaaatttgaggattttaaaaatttgcaaacaaggaatgtcatgggaatggagatctgccgtgccggcattagactagacgattagttgatgtatgttcaaaattttacctccagagtcggacgagcttcgcttttagttgaagtatgtcggaaatataatgaatttcgtcctgtttatatgaaatccgttgtgtttgcattaattccgt

SEQ ID NO: 34439 - DNA, 978 bp, Triticum aestivum
  Clone ID: PAT_TA_34439
aaaagatctcgccgtgttacctgagtgagcgcccagctccgccgcgcgctggtctcccttcctcctcctcctgatctccggcggcagcagaggaggattcggtccgccgcggggacgaggaggcgatgcgattcggggatttctcctgcgctcgcttgggctgggctcaggcgcccgtcctcctctcctctcactgtatgggcgtccaacaggccatgcccgacggacggaccgcacaaggttcgttccaccttccacgggcggtgccgacacactacgctacgcgcccccaggaaagcacaccaggcgtggaacctgcggaggaaacgtggagctacgcgtccccgagcaaggcacacgaggaggcggctaaagctgagccgtccatgtccttcgctcctctttttcgtccccctcctccacccgactcggcgacatttctttccccctccgcccgttcctctccggggtccggaggccccctggagccgggagaccccgaggagccacgcccctctcccggcctccccgctccggtgcgtgataccgcgcttcttgccgaatttcgggctagttcggtttcttgtatttctggccggcgtgctagctctgcttcggttagggaaataggaacctaggaaagatgctctcgacatttttttgctgatccgtgcgtgggtggatcttggcacgggtgctgcttcggttgtagagtatcaggtttcttgtgtgcgagataaagctgttggcgttcttgttggttggccggtcgtttcctttgctctgttatgtacacttacattttcatccaccaaattgatgctctccagttcatcttggggacggctggttcttgatcggccttcttttgccgtatgaccgactgactgaccaaagatgatcttcttgggctagcccatgtagtccttctcctctccgggtggtgggtgtatagttcagtagcactcaaagcaattc

SEQ ID NO: 34440 - DNA, 807 bp, Triticum aestivum
  unsure (1)..(807): unsure at all n locations
  Clone ID: PAT_TA_34440
gcacccgggcccccgccgcccccagccccccccgccccccccctccgcccccagtcgccctccccgcccccccacaccccccggcgtccgaggcgcaccccccccccgctccttctcgaagacggcggcccggccgacggctcggacgcgtgggcggcccccctgattcaatgatgacaacacgcacacctttccctgatgcttgggcaaaggcatgtatgtccgatgtgcaggcaaaactttatagatgcagattacatacattagaaattgccaactcggtggatgataaatactatgacttgggactcagaaaaaagatcaacacgtagatgcagattacatagatcaggacttgctaactcggcgtatgacacatactaaacgacatcaacacgtaggtgagaccattgactattagaggtgagtcggcaagctgttttcttctatggtttggcatgtaactttgtgttctctagctctttttagttttatatttttctaacaaacaagaccaaccttaacttaagaagaaaagcatcattataaccatgaaaaaaaactgcttaaatgtaaggcttttggttcgtctattaagtcattacccttctaaacgagacacggaaatgatgaattcttacatggtaagtttttgtttcattntcattctttgccttatcccgtgttggaaaaagagttcaattgntttttttcctcacaatgtaccaaagattctgatgaaagatgcttatttttctctcagcttcaagaaacagtcactataatactctggtttgtatatattat

SEQ ID NO: 34441 - DNA, 1829 bp, Triticum aestivum
  unsure (1)..(1829): unsure at all n locations
  Clone ID: PAT_TA_34441
ctgttcctcccaaggtgatgagagatttcttgttgcagagtacatgcctagaaagacatatcttccactgtatgttaactgcttgtgagcaggccagtactttacaaattttactacagcagcaaggacgctatgctttgaatagttgagccgccctctgtttttcatccatgggcagagtagatggaggtgcagtggcttaggatgtcaaggtagggatggaacctatccttatttcatatgtttctgttactatgaaaagtgaatcatgtttcttctgtgtaatgctaggataaagtttgattttctctgtactactccaacttggtcctatctcgaactacaaaaatattatgtatcgttttaatttagatttgattattattagaattagatggtgtgcattgaatttgaaaatagggccaagtactgccatggcttatatcctattgacttttcatgggaccttgaagcttggtgttgatctctttgtagcttataaaagatagttatatcattttactgaatgaataatcagaaaggtgggccaacaaaccgtaacatgtggcataaaaattatgtacggtttgatattgtccattgggatcatcttctcttaacgtttaattaatgccacatcaagattacttttgtgatgtttattttttatttttgagtcagcagaatgatgaaaattntagaacaagatgtagaatgaccgcgacggcggccggttcctttccttctgttgcctccccctctgtcattgggtgcatgtctcctttgtctgtcggcgcggtcccctgtcctccaattctctactctttctatctatttgctacagcttgatgctgtcggtttgataactcgaccttatttttcctgcgtctggcttgtttaacttgtagtcttcgtgtccatgattaacattgctgctggagcttgctttatgcactttttgtgcggattcaattttcatatttttattacagtgctatggaggactatctccatttgtcaaggagggtcaacgatatcctaggtttatgggtttttatctctgtgttgctgttctagatgcattgtttcggtgtattgttcatattgatttcaacagtgccagtcatatgctaagattttccccatttttggtcaaaaattagttacgcttcacgctgatttcatatatgctgttcagcgcttcctctgtgcaaataggtcagcagattaggtgttacttctcctgtcgacgggatcgctgcttgcttatgttaggtgaagtgcctagaggatgttatcctgttagcgtgaaaaagattgttgtcttgtctaccgggaccaccaactttgcacagtctcccaccactttggcagtggagcgccgccgctgcttgttagcttccctcgccctctgctgttgtggacgcctaaagcgacatagattatcaagcaacacagaataatcaagtcacattagctgtggcgatgtgtaaatcggccaaccggtgttcccggtgttcccaaccatgggttattggcccctgcctgattgcaggcatatcaaccacaggaaagcgtagcacagaagattcttgcctcccttttttgttttggtgtgaaattgcagtcaagctacttacatacgactcttatcagggcattcgagaattttcaaattgggtctgcttctgctttagcctgatttatgtttctactgtaggtgttgctctatggcagtacatattttttgcactattgaagggataagaacagcgtgctacctatttatgcttttagtattgcttgatagaccgaggnccctgttgtgg

SEQ ID NO: 34442 - DNA, 934 bp, Triticum aestivum
  Clone ID: PAT_TA_34442
gacaattaattcgttctcatccaaagtaatttacttcccccctttatgtatcatggatggatatatgtgatggttggttgtcattactgaagcaagaattgttgatgatgactacctttcgagcaggtttaccgctcgtcttgctaatgttaatttgtatgttttcatttgtttttccttctccattttattgtataatctatggatgttgtaggataaatgtgaattgaaaatacaacagcttccagaaagtattttgcaacttcagaaatccaaaattatggttctgatgttaatgaccaggatgatgtgatagcctcttttgatccgtatctattttttcgaagcttgaaagatatacttgcagtatgtctgtggatctcctttgctttgtgatactgaacccattttggaacaatatggcatcaaagcatttgttttttgtccggccaataatgtaatggtctatgggcaaataaatcatggtttaaatcaggctctttatttctcttttgattgatttaaggtattcacatatataatggttcccaatacccatagaattattggttttaattggcttcttggcttcttgcgtccgcgggtcatctagcgccaccgacatcgttttctaccaggctcacttcctatcttatattgattgttgtactgcactacctcagttttaaagatcatcatcctaaattcctaatcgacccagaaaagcacaggtgagtaccagctagcctctccatactaattgtctacacattggtttctcctgctctctgctctttactatgctaatatttcattcgatctaagtaattaggccccagagcatatattcttcaccaaaaataaactgtgtagtaaactcacttagatagttcccagattttacatacttcctatttttgtcatgcacacaaga

SEQ ID NO: 34443 - DNA, 1219 bp, Triticum aestivum
  unsure (1)..(1219): unsure at all n locations
  Clone ID: PAT_TA_34443
ccacgcgtccgcgacacgaggcctcgtcaatcttcaggttgcatctgcatcgccgctgctacaaaaattactagcctgttctgaaggaggagatttcatactagatgtcagacattcttgcagtagctctaggaggagctgcaggaggtttggcattagttggtgccatcacactcattgtagtgctatgcctacggcaccgcagaaggaattcagattcttcagagagtaattcgtcgggtcaagctctttcagacgtgcaaggagcaagatgtatgacactggaggaactaaggtctgctacaaataacttcagcagctcgaatctcgtcggacatggaatgtttggagaagtatacaacggtttgctacaggatggcacaatnntagcggttaaaaggcggcattctcctcctagccaggagtttcttcatgaggttaattacctgtcgtcgatccgtcgtcaccccaaccttgtaaatctcttggggtattgccaggacaatggcatgcagatgcttgtttatcagtatgtccccaatggcagcatttctacgcatttgcatggcaacggcaattctccaacggtgaggctagaattcaagcagagacttgctattgctcatggaaccgctaagggcctgagtcacctccagtccatgacccctcctgctgttcacatgaacttcaaaactgctaatgtcctggtggatgcggatttcttaccaaaagttgctgatactgngcatccgaggcctacttgatcgactaggcaatgctggcccccctccgatgatattcaatgatccattggttgatcctcgggggaaggagtccatgattttttccatacagagtgatgtctacagttttggtgtgttccttgtggagttgatcagtggaaggacggctgcgtctgatcaaggcattattgaatgggttcagaactttcaagaatcaaagtgatatctctacaatagcagataggagaatgaccagtggctttaccccacaaggcatgaaggaattgttgcgcttggcattgcggtgcgtgaacccgacaagcgagaatcgtccgtcgatgagcctggtggaagctgagatacaccggatacgcaagcaggagatcaggaggacgacaggcatgccactgggcgacacaactgtgaccctatgcagccagctcttcacatcagcaagatggaaaaacatgggaaat

SEQ ID NO: 34444 - DNA, 750 bp, Triticum aestivum
  Clone ID: PAT_TA_34444
cgcaaaccccaattccagtccccgtcccagtcccaatcctaatcccgcccccaccagcggagcggcgtagccgccgcctcggccgccctcggcgcccgcgcctgagagccggcgacgatggcgaaccgcacggaccccctggcccggagcatccacggcaccaaccctcagaacctggtggagaagatcgtgcgggccaagatctaccagagcaactactggaaggagcagtgcttcggcctcacggcggagaccctggtcgacaaggccatggagctcgaccacaccggcggcacccacggcggcaaccgcaggccgacccccttcctctgcctcgccctcaagatgctccagatccagcccgacaaggaaatcgtcgtcgagttcatcaagaacgaggactacaagtatgtccgggttcttggggccttctacctgcgcctcactggcaccgtcgccgacgtttaccagtacctcgagccgctttacaacgactaccgcaagattaggcaaaagctcagcgatggaaaattcacgctgacacacgttgacgaattcattgacgagctcctgaccaaggactatagctgcgacactgccctcccccgcattcagaaaagatggatccttgaagcttctggaactctagaacctagaagaagtgcacttgaagacgattttgatgaagaggaggaagataaggaggatggacagcctatggacgtagacgagcctaacactcgtgaaaag

SEQ ID NO: 34445 - DNA, 1051 bp, Triticum aestivum
  unsure (1)..(1051): unsure at all n locations
  Clone ID: PAT_TA_34445
gctccgcacccgctcgtccctcctcatcccccaacccctaaccctaggagctcccgccgccgccgtctacttcgcccagcccgccggaccgccgccatccacttccctggcgtcgtcgccatcgtcctcacctgcacaggcaggaggagcgcccccaccatcttctctcctcctcccctcatcacgagccaggacaaggagggccaccgtggccaagcaggtcaggcgacgcgtccagatcaccaaggaaccgcccgtcggccatggcgcgaccgagcagagcaggtactatccttgtcgtggattgctgcctcacgtgtcttgccttctgttgttactaatgcaagttgcaatgtcagtttagtctaatgcaaccaagatgaatgtgcatcagtctggaactgagattctcaatattcacattgtcgataacaaggtacctaactatatatagtgaagtctacttcttttgtccttcctgttgttaatagcttttgcatcgctattagccaatcagcaggatttgaatcattatatgagtgcaaggagatttcatgtgtcatgtaaattgtaagttatgtatggcttggttattgcagttttgggttgggttgcgagcacctcatctactcaacatcagctatacttgatgtgtacttgcatatatgtatctgccgcatatcatgatactaacgacactttcctgctaccttggtacttcagtatggtacaacttttctgaaaagtaataaggtaaattagtcattgttttgtttgaccacgcggagggcgcgcatccggctctcgaaccctagaattccgnttctgtttcttcttccatctttatctttttttcctttctcttcacccgattgacactanatttgtttgtatgctttcttatttgttttgcaagtacagatcatgggtggttgattgctgactcgcctttcaacaagcagtgcagatttctttgggtgttcagggagtttgattcaatacttgatggcctcaaaaggatacgggatctggtggaatcaagaaggcatta

SEQ ID NO: 34446 - DNA, 665 bp, Triticum aestivum
  Clone ID: PAT_TA_34446
taacgatggcagacgttatcctgcagttaatatagttatattaactgaggtctccttcgaatatgtttcggcagaaaaccattaaccgaaccccctcaggatagctctcccggaattgtgatctcgatcaaaaatatggatgattggcaattgcgttgggacaattttgctcgatacaacaagctgttggtgtattcgttttacgacaaaaattcccccctgtccaaggccatggacaagctgttggagaaactccccaaccagtataaaggcaaggcagacttttgcaagttgggcgtcgacaacttcgagtttttggcggggctttgcggagtggagggagcgtatccgacgttcgtgctattcaagaagtgcaagcaggtgggcaaggtcgtcggcctcaaggacgacgaactcgagcggagcatcgagcgagcgctaaactagtactcaatgtttttcgtgtgaaggcttataatatggccttcatgctacagaactactatatgtagctggaataagcatggtacgaaacttgtcgagagatattgagtatcagatgtactagtccatggacctatatgctccggcatgatatgagctactcccctctgtaaacaaatataaaagcgtttagcacaaaaaaaacagaaaattaaccaaaa

SEQ ID NO: 34447 - DNA, 954 bp, Triticum aestivum
  Clone ID: PAT_TA_34447
gtcgacccggtccgtcctgaaccgctcctagtccagcatgaacagctactattactacttggaggactcgcggcagtggttctggtggagcgccggctggcgcaaaactaacgatggcagacgttatcctgcagttaatatagttatattaactgaggtctccttcgactatgtgttcggcagagaaccattaaccgaaccccctcaggatagctctcccggaactgtgatctcgatcaaagatatggaggaatggcaatcgcgttgggacaattctgctcgatacaacaagctgttggtgtatgcgttctacgacaagaattccacactgtccaaggccatggacaagctgttggagaaactcgccaagcagtataaaggcaaggcagacttctgcaagttggacgtcgacaacttcgagtttttggcggggctttgcggagtggagggagcgtatccgacgttcgtgctattcaagaagtgcaagcaggtgggcaaggtcgtcggcctcaaggacgacgaactcgagcggagcatcgagcgagcgctaaactagtactcaatgtttttcgtgtcaagacttataatatggccttcatatacgcatcgggagtgcgaggtacatgcatgtgcatgctacagaactactgtatgtagctggaataagcatggtacgaaacttgtcgagagatgttgagtatcagatgtactactccatatttcgtgtgaagagatataatatgaccttcatatacgcatcggcagtgcgaggtacatcaggtgcatgctgcaaaactactatgtacagtagctagaataagcatggtacgaaacttgtcgagagatgttgagtattaaatgtactagtccatggacctatgctacagcatgatatggagctacagtagaattttagagcatcttcagcggcaaaaaaaaaaaaaaaaaaaaaaa

SEQ ID NO: 34448 - DNA, 765 bp, Triticum aestivum
  unsure (1)..(765): unsure at all n locations
  Clone ID: PAT_TA_34448
cccacgcgtccgctcactcgatccatccagaggggctgtcccctcgcctccgctcgccgcttggccgtagaaaagaagtccgggcagcggacatggccgccgccgccgcctccaagcagccgccgctgtacattgccgtcgccgacgaccaccgggggaggagcggcttccgctacacgcggcccgtcctgcagagcgcgctccagctcatgggctgcaagccgcgccacgccttcaagatcagcaagagagtgttcgatgtggccaggagcgccttcgtagactcgtcgaaactgaatggatccaccacacaggaggatggcatgaaggtcgccgagctcctggacgcggagaacatgaccaacataccgttcgagctgtacaagacccagaccactgccgttgtttccagggaggagttcctggatgtcgtgtgcgacgccctcaccttgtacaagtacgtcgggcccaatcagagagccgacctgctcctcgcctgcaggataaaggagaggaaagaatcagtgacagtactcttgtgtggcacaagtggatgcggcaagtccactctatcatccttgctgggtaacaggttgggtatcacaaccgtggtttctaccgactctatacggcacatgatgaggagtttcgtagaagagaaagaaaaccctctgctctacgcgtcaacctaccatgccggagattatctagaccccgntgcggttgcccaagctaaggcaaaaaacaaggccaagaaactctctg

SEQ ID NO: 34449 - DNA, 793 bp, Triticum aestivum
  unsure (1)..(793): unsure at all n locations
  Clone ID: PAT_TA_34449
agaggagggagggggagaagtaggaccgagggagcaaagaagtaggaggcagcagcagcacccgaggccgccgagccgagctatcccttccctcagctctcagatccaaaagccgaagagaatcgcgccaactcgctcgccctcgccgtagctagatgcgcgccgcaggctgctactgttcctgctgctaggtttctgcggagatgccgggcgctgaggccgacggcgccggcggccccggctcctcctcctcctccactgcagatagttttgacgccgggcagtacgccttcttcgggaaggagccgcgcgacgggctcgagctaggttgcttggaggctgatggtggccatggcaatggcggtggattcagcgggccagaggatggtggcttgtaccggctctcttcggttggagaagagattgacaatctaagtaacttgtcggacgtcgatgatcttgcgagtacttttgctaagttgaaccgaaccgttagtggaacacggaatcctggtgttatcggtgacagacgatccatttcagagggaagttctttaactgttgattggactgaggatgcagagtttcccaattatcaagatatattagaaaatgaggaattccaggaaggtaaaagatggggggcatcacagtcacattctttggtgcagcaaggggacagcaagccgctaagtcgaacatcttctttctttcagcagctactgcagcaccagggaaattttacagaccacanttnttcgttaacctnttncnccccngggggnaaaacccn

SEQ ID NO: 34450 - DNA, 1159 bp, Triticum aestivum
  Clone ID: PAT_TA_34450
aattgtagacacgccccctacagaagcgaaagagcgggaataaggaagctggcaaacttagtgcttcatggtatttcagtagaaaggaagtcgaagagaattctccgtccgatagggatggcattgatttaaagaaagagacttaccttcggaaatcgtattgcacttatctacaagatttggggatgcgactcaaagtgccacaagtgacaattgctacatctattgtgttctgtcaccgtttttaccttcgtcaatctcatgcaaaaaatgatagacgaacaatcgctactgtttgcatgttcttggctggaaaagtcgaagaaacacctaggcctttgaaggatgtcatcctggtttcttacgagcttattcataaaaaggatcctgctgctggtcagaaaattaagcagagggaagtatatgatcggcaaaaagaactcattttacttggggagcgagttgtacttgcaacacttggttttgaccttaatgtgcaccatccttacaagcccttggttgaaacaataaagaaattcaagattactcataatgcgcttcctcaggttgcctggaattttgtcaatgatgggctgcgcacttcactctgtttgcaattcaagccccatcatattgcagcaggtgctctctttttggctggcaagtttctcaaagtgaaatttcttccagatgacggtgagaaggcttggtatcaggagtttgatgtgacaccaagacagctggaagaggtttagcatcaaatgttagagctgtatgagccgcgccccgttgtacagtcgcaaccaacaaatgggaatgaagctgaagggagctcagctggtgtgcctaatcaaaggatctccgtaaaagcagaagccaactccgaggaacctcctgttgtgcatcatccagcatccaaacagccagattccaatccctctacatcaacaggtgttccaattcacaatggtgctgagcactcaaagccacacaagcagattggtagccagaaaagtcttcagagtgacaatggtggccatgaaaacgacaaaacaagcagtcagagtggaggtagagttgatactagtacaaaggatggtgtgctcgatggcacaaagtccttgccgagaagttccaggcccagcgacaaacctggtat

SEQ ID NO: 34451 - DNA, 624 bp, Triticum aestivum
  unsure (1)..(624): unsure at all n locations
  Clone ID: PAT_TA_34451
attcggcacgaggaccaagtcggacgaggagtacctagnacctggccatgagagaaaacggctactggtccgacgatgagcagcagaccagcctgatgaagcagcccccggccccgggcgcaggaggcggtgaagatgatgataacaatgccatgaagaaggctgacaacaagctgaaccagttgctggagatgggaaacgacggcggcgcagagatgccatgcgcccaccctctgacaatgaacggcgggaaccgtggctgcgacgccaaggtgaggcgacgatgcgcactcggcccggaagggctgttgtagaaccggtgccgccatgtcggttgcgaatcagcagtgtggttgtggagtggggcctgaagttcccatgatccagtaggtgctgctggatcccatcatatctactgtagctgtgttgttgttcttgttgtaagatggtagcaagtagcatcccatcatatgctgttgtattagtttctgaagtagatcaggggagaggagcagactatccttccctccctgacaggatggatcatggaaggacacataattatatatacatatacatgagtagtagcaaaatgaacatgaagaattccccttaaaaaaaaaa

SEQ ID NO: 34452 - DNA, 889 bp, Triticum aestivum
  unsure (1)..(889): unsure at all n locations
  Clone ID: PAT_TA_34452
gcccaccccaaaccgctggctcgccggcttgccaggcaaccgctggcttgttcttcctctggccaccgctagctcgccggccgttcaccttcgccacctactgaaggtcggctttttgaaatagccatcatgtatacaacaactacggcagtggccttggatgcgcccaacgaaggacaacgataggcaaaaaaatgctagtgcagctgcttgcctcctcttcatattccataccagaaaacatccttcgcccctttattttctttagtaagttttcattaaaagacctcagaatagcaagtagaagttcggcacaaggacctacatcagttcaactacagaaacagaacaagtccatgagattataattaagttcaaaattactacatggtcatgtatttaacagcatgtccatgaattagtacatgagaagtacaaaaaatactactggttatagttcatttaaatcatgacatctgaatcggggtcaacccttgccaccatgcttctacacggccggacaccatgcctcctttcaccaccccatggcaagagttagtttggttggaaattatgtgcactgaacttgtcgattgttgtatctgtgagagttaaatttttgttttaaaagtttaccattaattagaacaattttgatgaaccgtgggagctcagttagctgacaaaaaatcttttgcttagtgcctatatgataccaggaggcactgttcatgtaagaggttcaaagattgtagtggagcaagtctagcttctttntcagttcagatcaatttctaaatttcattcagttcaagccttattgtagtgtaaagctcagttgggaggtattcgtccagctgccgatgcagtgctggccattcttggcgct

SEQ ID NO: 34453 - DNA, 1127 bp, Triticum aestivum
  Clone ID: PAT_TA_34453
tggaagctggcgagcaaggcgaaggggaagaggcgggggaagaagaagaagaagaagaggctgtgcaagaggaagacgatgcgcccgagcagccggatccgtctcaattctttgcgtcatcggaaggagcttcttttagtgcaaggtcgtttcttgagctcaacttatcgcgtccactcattcgagcctgtgaagcactgggctaccagaagccaacaccaattcaggccgcatgcatccctctgggcattaacagggagggatatatgcggcagtgccatcacaggatcagggaacgacggctgctttctctctgcctgtgctggagcgtctgcttttccggccgaagcgcgtgcctgcaatcagggtgcttattctcaccccaaccagagagcttgctgcgcaggtccatagcatgattgagaaattggcccagtttactgatatcacgtgctgtctcatagttggtgggcttccaacgaaagaacaggaggtggctttaaaggcgaatcctgacattgtgctttctctccctgcgtgtagaagcgtctgcttgtgcgacccaatcgcgtgcctgccatcagggtgctcattctcgctccaagaagaggcctagcggctcaggtgcatagcatgattgagaaactggcccaggttaatgatcttgggtgctaaaacatccagggtgggcttccaaccaaggcacagacggtggccttaaggtcaaatcctgacattgttgttgccactcctgggcgtatagtggatcatctgcgcaactccctttctgtcgggcttgaagatcttgcagttttgatccttgatgaagctgaccgtttgctggaattgggtttcagtgttgaaattggtgagctgattcgcatgtgtcctaaaagaaggcagaccatgctcttttctgccacaatgacagagcaaatcgatgagcttgtgaagctttctctgaacaagccagtccgtcttgaagctgatccttcgctgaaacgccctgcaacattgactgaagaggtggttagaattcggcgatcacgtgaagcaactcaagaagctgttctgcttgctctctgtttgaagaccttcaaggaaagagtgatcatttttagtgggac

SEQ ID NO: 34454 - DNA, 708 bp, Triticum aestivum
  Clone ID: PAT_TA_34454
ggagacgctagggaacccgtgcgtcggaggcaacgacttcctccggctgacaacgttcctgtctcagagcacattcgtgctccccctccctggcttgcccggcacgttcatcttcatggcagacaggtggaacccgtcggatttgcgcgactcccgttatgtctggctgcccttgtccatcggaggtttggcggacgaggcgttggactacagtttcgggttcccgtcgtggtcgagggtgtcgatttactggcacaggaaatggcggctccctgaaggttggaggaagagttatgcctgaatcctaccatgggcatggcgacggttatatatgacacagcatcagtaggtggaagcaatctgggtgcagatacagtggtgattgttcaggatcttgcttgatgtatccaaggaatgcactctgagcaggaatgctctttttttacggtcaatctgaaagtagatacaatataggatagcattggctcatgaaatttcatatatgcgtggaattttgctggtggaagcaatctgggtgcagatgcagtggtgattgttcagggtcttgcttgatgtatccaacgaatgcaatctgagactagatgcctttttttctacggtgaatcttaaagtagatacgaatatacgatagagtcagctcatgaaatttcagaattgtgtggcaacgtaacatcaaaacacagcccg

SEQ ID NO: 34455 - DNA, 697 bp, Triticum aestivum
  Clone ID: PAT_TA_34455
gcccgccctgccccgccccgccgcctcgcccgccctgccccgccccgccgcctcgcccaccccgccccgccgccccgctcgccgtggccgtggccgatgaccacgaccccgccgtcccgcctcgcccgtcccgctcgcagtggccgatgccccgcggcctcgccagccccgccccgtccgtcccgctgcccgtctcgccagccccgctacatttacggtcggcatcaccgcgcgccgcccgaccaaggtattctcccgcgtgcgcgacctcctcgccaagtccatcctctacgcgcgggccatcgccgactcgctcttcctccgttgtgacctcgtccacgacgcccgtggcaccgatgccgtccgcgccgacgacggccaggtccaacaccgtcgacgagaccatcgccatggtgctccactatgcctcggggatcgccgatgcgcacgttggccttccgtgcgtgacgccgtcgtcgccgtgccgccctatttcggccaggccgagcgccgggccctcacgcaggcggcccagctcgccgggttcaacgtcctggcgctcgtcaacgaacacgccggggccgcgctgcagttcgtcctacagcgccaaggagttcgggaagatggtgtgtgtcaacgagttccagaagccagctaacacgtgaaaaatttgaagagctttgtgcctatttatggg

SEQ ID NO: 34456 - DNA, 2295 bp, Triticum aestivum
  Clone ID: PAT_TA_34456
ggagcggagaggaggcggcggcgggggccggggctccggcaaggggccggcggcggggaagatgatgtcgctcaacgagttcgtctcctccatggcgcccctcatcgacctggagaaggcggcggagatatcggcggagtcggaggcgagctccaagaggaaggagaggcgggggtccgtcatgcccaacctcaagtgcaccgacgcccagagtagacggggctgatggggaagacgctcctggagttccagcccaacaagggcgacgtgcttccacctcacaagtttgggacgcacgacgtggttgccctcaagccaaacaaagcagatgctggatcccctgcacttgggcaaggtgtagtttatcgcttgaaggattcttccattaccgtcgtttttgatgatattcctgaagatggattaaatagccctctccgtcttgagaagcttgcgaatgaggttacttaccgcaggatgaaggatgcattaattcaacttagcaagggcatccaagcaggaccttccgcaaaccttgttcctgtgttatttggagagaactcacctatgcgttccaaggatgccgtgaagttcagtccatttaacaagaatttggacgactcgcagaaagatgctatctcgaaggccctcagatcaagggatgcttttttgcttcatggacctcctggaactgggaagacaacaaccatcattgagataatattgcaggaggtcaagcgtggagcgaaaattcttgcttgtgctgcttccaacattgctgtcgataacattgttgagcgactctcacagtacagaacaaaattggtgaggttagggcatcctgcccgtttactaccgcaagtgttggacagtgctcttgatgcacaggtactgcgagcagataatagcagtttggccggagacattcgcaaggaaatgaaggtgcttaatagcaaattgctgaaagctaaagatagaaacacgaaaagggacatcaggaaagagcttaaaacccttgccaaagaggagcgaaaacggcagcagcttgcagtcgctgatgtcataaaaaatgcagatgttgtgctgtcgactttgacaggtgcatcttccaaaaagatagctggcattacatttgatctggtaattattgacgaggctgctcaggcactcgaggtggcctgttggatagccctactgttgggccaaaggtgcgtgcttgctggagaccatcttcaacttcctccaacgatccaaagtgttgaggctgagaagaagggtatgggaaagacactctttgaacgccttactgaaggttatggagaggaaatcacatgcatgctcactatccagtacaggatgcacgagctaattatgaactggtcatcaaaagaactttacaataataagatcaaagcgcattctagtgttgctgggcatatgctctatgatcttgaaggagtgaataaatcttcttcaacagaaccaactattatacttgttgacactacagggtgtgatatggaagaagtgaaagatgaagaggagagcaccatgaatgagggcgaggctgcagtatccattgcccatgccaagttacttgttgagagtggtgtccgtgcaattgatattggcattattactccatattctgcacaggtaacctgcctgaaaatgctgagaaataaagatgctaaattgaaggacttggaaatatcaacggttgatggatttcagggtagggagaaagaggccataatcattacaatggtcagatccaacccaaagaaagaggtcgggttcttgagcgaccataggcggatgaacgtcgccgtaacacgagccaggcggcagtgctgcatagtgtgcgatgccgagaccgtaagcagcgacagattcctgaaacgcttggtggagtactttgaggagaacggcgagtacctgagcgcgtagcggtaccagagccgctgaccctgatagcatgatacggatagcatatgtccgccgcgcgaccatggcagagatgccggaaacaagcaactgatggctccacaactggacattttggtgcagatcccatccgatgcataatacattgccagagatgacccacaggtggtgctacacttgggttcctcttcaccccgtggtgcgaggtggatgtcacctttaacccgtgtgtcctgactcctgcccgggctgccgctttgttgctattattatttttcggagactacatgatgtacccctcctgcaatgtcgttttcctacatggtccctgcccgggcggccgctcgaaaa

SEQ ID NO: 34457 - DNA, 737 bp, Triticum aestivum
  unsure (1)..(737): unsure at all n locations
  Clone ID: PAT_TA_34457
cttcgccgtctcagcttccgaatcgccggcgaggaggaagggagcggcgatggcggggaccatctcccgcatccggctggagaacttcatgtgccactccagcttgcacatcgagctcggcgagcacgtcaacttcatcaccgggcagaacggcagcggaaagagcgcgatcttgacggctctgtgtatcgccttcggctgccgcgccaagaacacgcagcgggccgccaccattaaagatttcatcaagactggctgcagttatgcagcaattgctgttgacatcaacaaccaaggggaagactcgttcaagcctgatgtatacggaaacttaattaaactggaacgcaggattactgagtcatcaagttctacgattttaaaggatcaacatggtaggaaggtggcaaatcgcaaagatgatcttaatgagataattgaacattttaatatcgatgttgaaaatccttgtgtaattatgagtcaagacaaaagtagagaattcctgcactcaggaaacgacaaggataagtttaagttctttttcaaggctactcttcttcaacaagtcaatgagttactggagacaataagagatcagctgaacaatgcagactctgttgttcaagagttggagaagtcaattaagccagtgatgagagaacttgatgaattacgagagaagataaagaatatggaacacatagaagagatagcacatgatatncgatatttga

SEQ ID NO: 34458 - DNA, 846 bp, Triticum aestivum
  Clone ID: PAT_TA_34458
ggtcatcttcttccccgccctcgccctcgccccagcaaccgctcgccccaaccgcggcgccacccatcgcacagtggccgtgtgcggtggggtggttctgcgaggctatggcgatggcgaggaggcagcacatcacaatattcaccacggcgagcctgccgtggatgaccggcactgctgtcaaccccctgttccgggcggcttacctcgccaaggccggggactgggaggtcacgctggtggtgccgtggctgtccaagggggaccagatgctggtttaccctaacaagatgaaattcagtgggccggcggagcaagaaggctatgtgtggcggtggcttgaggagcggactgggccgttgccgagattcaacataattttctatcctgggaagttctcgacggagaaaagaagcattctacctgttggggatattaccgagacgatatctgatgaaaaagcagatattgcagttctagaagagccagaacatctgacctggtaccatcatggacggaggtggaaaaaaaaattccgtaaagttataggtgttgttcacaccaactatctggaatacgtgaagagggagaaaaatgggtacattcaggcatttctcttaaaacatatcaattcttgggtcaccgacatctactgccataaggttataagattatcgggagcaactcaggaagtcccgagatctgtaatctgtaatgttcatggagtaaacccgaaatttattgaaattggcaaattgaagcatcagcaaatatctcaaagagagcaatcatttttcaagggtgcatattatattggggaaagatggtctggagtaaaggctacac

SEQ ID NO: 34459 - DNA, 855 bp, Triticum aestivum
  Clone ID: PAT_TA_34459
ttgctcgtcgtcaaggagacccctgaggctgcacccggcgctgccattgctcgtcccaagggagtgcaacgagacgtgcaagatcatggggtacgacgtgcccaaaggcttcgtcgtgttcgtgaatgcatgggcgatcggcagggaccccaagttctgggacgacccggaggagttcaaaccggagcggttcgagaactccaaggtcgacctcaaggggacggatttcgagttcataccgtttggggctgggcgcaggctctgccctcgcctggcgttcgggctggccagcattgagatcgctctggccgctcgtttctagggagtgcaacgagacgtgcaagaccgtggggtacgacgtgcccaaaggcttcgtcgtgttcgtgaatgcatgggcgatcggcagggaccccaagttctggggcgtcccgcaggttctgtatcagaggtgtaggagttcttttttctcaaaggaggggtacactccgatgtccaggcctccggcataatcaacatgttccgcatagttgcgttgctccgtcaatggtgcattgtgatcccgctcgccgtgctgctctaccactttgactgggagctcccggacgggatggccccgagcgagctagacatgactgaggagatgggcatcaccatccgaaggaagaatgatctttacctgcgtccaactgttcgtataaaggtgtaggttctctttcgaaaaggagggtttacccctagcctctgcataataaacatgtgatgcatagttgctttgcatcgtcaacggtgacgagtttgtccaatgtactgcccgtttatcgttacttgaataaaataagcatgaggcatattttc

SEQ ID NO: 34460 - DNA, 1714 bp, Triticum aestivum
  unsure (1)..(1714): unsure at all n locations
  Clone ID: PAT_TA_34460
gactcgatcttatccaagaccaatggtgtccggcgcggctggcttcccaccaaagaagaccaacttttcttgcatcgaaatgaacggaaaggaggttttccgctttgctgtacgttgtgttccacagtccatcgagaaggcgctagaggaggccggcctacctgcctccagtatagattggctgttgcttcaccaagctaaccagcggatcatcgatgccgctgccagtcggttatctatcccatcggaaaaagtcatctcaaaccttgccaattacggcaataccagcgcggcatccatcccattagcactggacgaggctgttcgcggcgggaaggtgaaggcgggcgacatcatcgcagcatctggcttcggagctggactcacctggggttcggctatcgtcaaatggggttaatcgaccgctctgcacagcgaactatcacagcaaaccaaacaccggttccaaagcttttgcctgcatacggccctaggtctaagagcctctgcggggtcatctacctacccttcgcctgtccggcatttttcttttatatcaccgtccgtccgtccgtcgtattttcttgcacatgaacagcggcagtttgccttattcatccattcctttggcccgttacacagctcagctgtcattgtggttatcactactgtacttgtattagtattgtgtcgtgcatcctctttggcgatgctgctggtgctgttttgggatggaaatgcaatgctgatgaagatggcttgctaggtttttgtgtgcaaagcgatgtgttgaggcaaattcgtatgcattggtttttgtctggagattccgcatgaatagtcatcagttttggtgtccctggctttaatccgaagaagaccaacttttcttgcatcgaaatgaacggaaaggaggttttccgctttgctgtacgttgtgtcccacagtccatcgagaaggcgctagaggaggccggcctacctgcctccagtatagattggctgttgcttcaccaagctaaccagcggatcatcgatgctgctgccagtcggttatctatcccatcggaaaaagtcatctcaaaccttgctaattacggcaacaccagtgcggcatccattccattagcactggacgaggctgttcgtggcgggaaggtgaaggcgggcgacgtcatcgcagcatctggcttcggagctggactcacctggggttcggctatcgtcaaatggggttaatcaaccgctctgcacagcgaactatcacagcaaactaaacaccggttccaaagcttttgcctgcatatggtcctaggtctaagagcctctgcggggtcatctacccgtcgcctgtccggcatttttcttttaaatgtccgtcatattttcttgcacatgaacagtggcagtttgccttattcatccattcctttggcccgttacacagctcagctgtcattgtggttatcactactgtacttactagtctacagcgagtctgtattgtattagtcttctgtagtttgagtggcacgcttcagtattttgcatctgggatggaaattggaagtttttagctggtgttggaaggaggaaacaaaaaaaaccaggcgggggcccccttcctatcccctaagtgatctatacgncgccacggccgtcgtttacactctactggaaaacctgcgtnccaantancgctgannaatccctt

SEQ ID NO: 34461 - DNA, 789 bp, Triticum aestivum
  Clone ID: PAT_TA_34461
ggcgggactccctgtctgtcgtccagatcacaccgcgctttcttccttccccgtcgccgatcgagacgaagcgccgcacgccggttcccttcacccccgcccgccaacgtctccggccgggttggatccatggcggaaaagaaggtcgtgctgaagctggacctgcacgacgacaagcagaagcagagggcgctcaaggtcgtctccactctccacggcatcgaccagatcgccgtggacatgaaggaccagaagatgacggtggtgggcaccgtggaccccgtcgacctcgtcggtaggctgcgcagcaagctcttccccacggcgcagatgctctccgtcggcccggccaaggaggagaagaaggacggcggcgccaagaaggacgacggcaagaaggagggcgacaagaaggacccgatcccggtgtacacgccgtggtacccgccgccgccgccgctgtaccacccgcacccgtactaccacaaccacagcgccgaggaggaccccagctcctgcgtcatctgctgatcggcgcgcgccgcgctcccttgtacattttgtagctggccgtgtgctctgctgcctgacgatcgatcatgcctgctacggtgatcgacgcggcatgccccatacataaggccgtgtaaggatttgcgccggtgacacgccggctgtgcatctagtgagtttataaattgcagatatagaatggaatcacagtgtggagcaaaatcaaatagaactgcgcacttggatttgcaaaaaaaaaaaaaaaaaaggccccta

SEQ ID NO: 34462 - DNA, 793 bp, Triticum aestivum
  unsure (1)..(793): unsure at all n locations
  Clone ID: PAT_TA_34462
ncagcacaccatagagctcgatcgtcgcccacgcctacagtcagcagcgccgcacgccgctcgatccctgttttgattgatggctgccatgaacgttgtgctgaagctggacgtgcacgacgacaggcagaagcagaaggccatccaggtcgtctccgcgctgcacgggatcgaccacatcgccgtcgacatgaaggaccagaagatgacggtcgtgggcaccgtcgaccccgtcgccgtcgtggccaggctgcgcagcaagcccttccccacggcgcagatcttctccgtcggcccggccaaggaggagaagaaggagggcgagaagaacgacgcgggcaagcaggtggagtacccgacgtactggtacccgccgccgccgtaccacccgcacctgtgccacctcgcccgaggaggaccccaactcgtgcgtcatctgttgatcgacgcgcgccgccgattcccgccattgtacactttgtagctggccttccttcctgcttgccgatcgatcagcctacctgcccggtgatcaacggcgtggttatatatatggatggccgtgtaaggcgtgagttgcaccggtgatcgggcagctgtacagcacacctgcatgtgcctgtgcatctgcttagtttgtaatgtgcaaatacagaattagaacagtatgttgttgagaaaggaaacgcatccagttatttttcagcatccaccaaattgatgaattgttttccaatggtgatgagaaaatatccagatctgaatagcagagctgcgcacccattttgggttg

SEQ ID NO: 34463 - DNA, 746 bp, Triticum aestivum
  Clone ID: PAT_TA_34463
ccttgtctccagattaaccgcgctctcttcctcccttgcacataacaagacgaagcgccgcacgccgctccgtcccatcccaccagccaccggcgcctcgggcctcggccgcgcaccgcccaagagttcgtccgtcccggcgggactgttggatcgatggccgccatgaaggtcgtgctgaagctggacctgcacgacgacaagcagaagcagaaggccatcaaggtcgtctccactctccacggcatcgaccagatcgccgtggacaccaaggacgacaagatgacggtggtcggcaccgtcgaccccgtccacgtcgtcggcaagctgcgcagcaagctcttccgcacggcacagatcgtctccgtcggcccggccaaggacgagaagaaggacggcgccgctaagaaggaacccatccctgtgtacgcgccgtggtacccgccgccgccgtaccactaccacccgcacccgtactattacaaccacagcgccgaggaggatcccagctcctgcgtcatctgctgatcgagttgcacatttcgtagccggcccgccgatcgatcagcgttccttcgccggtgatcgacggcgtgcggcatgtacctggccgtgtaaggcgtgtacgttgcgccggtgatccggcagccgtgcatctgcttaatttgtaacgtgttgatactacagaattacagtatattgtacacaaaaatatatcatcaaataaaaaaaaacaaaggccccta

SEQ ID NO: 34464 - DNA, 766 bp, Triticum aestivum
  Clone ID: PAT_TA_34464
ctcgaggcggccgttcgggaaccgcgctctcctcctccctggccatcgccgagacgaagcgccgcaagccgttccgttccatcccaccagccaagagttcgtccgtcccggcgggattgttggatcgatggccgccatgaaggtcgtgctgaagctggacctgcacgacgacaagcagaagcacaaggccatcaaggtcgtctccactctccacggtatcgaccagatcgccgtggacaccaaggacgacaagatgacggtggtcggcaccgtcgaccccgtccacgtcgtcggcaagcttcgcagcaagctcttccgcacggcgcacatcctctccgtcggcccggccaaggaggagaagaaagatgacgccaagaaggacgacggcaagaaggacccgaccccggtgtacccgccgtggtacccgccgccgccgccgtaccactaccacccgcacccgtactaccacggccacagcgccgaggacgaccccagctcctgcgtcatctgctgatcgagtgcacatttcgtagctggccgtcctgcctgccgatcgatcggcttgcctgcaccggtgatggacggcgttcggtatatacatgatgtaggcgtgtacgttgcgccggtgatccggcagctcagctgtgcatctgcttagtttgtaacgtgtatatacagaattacagtatattgttcagaaaaaaatcaacaaattgtcaaaaaaaaaaaaaaaaaaggccccaaaaaaaaaaaaaaaaggccccta

SEQ ID NO: 34465 - DNA, 762 bp, Triticum aestivum
  Clone ID: PAT_TA_34465
ctcccgatacaccgcgctctctccccccttgcccatcgccgagacgaagcgccgaaggccgttccgttccatccaaccggccaacgccgcctcggccgcgcaccgcccaagagttcgtccgtcccggcgggattgttggaccgatggccgccatgaaggtggtgctgaagctggacctgcacgacgacaagcagaagcagaaggcgctcaagctcgtctccagtctccacggtatcgaccagatcgctgtggacaccaaggacgacaagatgacggtggtgggcaccgtcgaccccgtccacatcgtcggcaagctgcgcagcaagctcttccgcacggcgcagatcctctccgtcggcccggccaaggaggacaagaaagacgacgccaagaaggacgacggcaagaaggagccgacccctgtgtacccgccgtggtacccgccgccgccgccgtaccactaccacgcgcacccgtactaccacggccacagcgccgaagaggaccccagctcctgcgtcatctgctgatcgagctgtacatttcgtagccggcccgccgatcggtcagcgttcgtgcgacatatacctggcggtgtaaggcgtgtaagttgcgccggtgatccggcagctgtgcatctgcttagtttgtcacgtgtagatacagaattacagtatattgttcagaaaaaaaagcatcaattgtaaaaaaaaagggtctggagaaggatcagatagaactgctgcagtagttttttcagag

SEQ ID NO: 34466 - DNA, 983 bp, Triticum aestivum
  Clone ID: PAT_TA_34466
cccgacgcccctccccctccccccttcccccgctttcttcctccccgccgtcccccgccccgcggcgcccgccggccaaccgtaggtcccggccgggtctgatccatggcggaaaagacggtcgtgctgaagctggacctgcacgacgacaggcagaagcagaaggcgctcaaggtcgtgtccactccccaaggcatcgaccacatcgccgtggacatgacggaccagacgatgacggtggtgcgcaccgtcgaccccgtcgaccccgtcggaaggctgcgcagcaagctcttccccacggcgcagatgctctccgtcggcccggccaaggaggagaagaaggacggcggcgccaagaaggaagccgataccaagaaggagggcggaagaaggacgcggtcccggtgtacatgccgtggtacccgccgccgccgccgcagtaccacccgcacccgtactaccacaaccacagcgccgaggaggaccccagctcctgcgtcatctgctgatcgccgggcgcagcccattcgctcccttgtgcagtttgtagctggccgtgtgctctgctgcctgccggtcgctcctgccagctacggcgatcgacggcgtgcgccatggtgccatacatcagggccggtgaatgcagctgctctgctcgtactgcttcagtgcttgtgcatctgcttcggttataaagagcagatatggtatttacaaatgtccggattgggacgtcgttgatagagttctcagtgctcgtttatgtgatggttcactcttggttctgagatagaactgctggagtttattacagtgtgtagaattactagtactagatagaactgctggagttggattttgagtgaaagttcactgagtgctctgctctccatttgatacaaagtagtgaataaataattgaagaaaagatatgggaaattcaggagagttgctagattggtctctcctgaacctcacactta

SEQ ID NO: 34467 - DNA, 790 bp, Triticum aestivum
  Clone ID: PAT_TA_34467
gggggagaacgagtggtacttttactgccagaaggaccgcaagtaccccaccggaatacgaaccaaccgagccacaaaggctggctactggaagaccacgggtaaggacaaggagatcgtcaatccacattgcacgtccatgctcatcggcatgaagaagacattggtgttctacaagggcagagctcccagtggggagaagaccaactgggtcatgcacgagtacaggctcaagatcaacaagcagtcaacaaccagcctgcccagtgccataggaaatgctgcttctattaacatgtcttccaaggagtatgtggtttgcaggatcttccataagaacgctggaagtaggctttcatccatggtgtcacatgagggcaacggtggtgcaacacccaccgacaagatctggtcgatgagcatgggtacagatggggcatgttgaagtattgataatcagatgatccaagacaacatatatatgtgtgtgggcattaattagtcatccatcagaagatccatcgatatataccaacatctatattggtttgcagcgcattttatttttagagagtttgcatgcaccacatcagaagatcggtcgatatataccaacatctatattggttggctcgtttggcttgccgctcttgtgctagtgttgtgtgtatgtgtatcggcttgtacatgcaccacatatcggtgtatacctagctacatttgcattgtaaacttcctaggagtgtacaccatgcatgttttaatcctatattgaatatactaatttgtt

SEQ ID NO: 34468 - DNA, 2094 bp, Triticum aestivum
  Clone ID: PAT_TA_34468
cttgtctcctagtcaagagctactactacaccatcgcaggcttgggcatctctcttttgctacattgtttcgtatttacccctctcttttcaagttgtgtcctagggagctgcttgtatgtgatgcttgtgtataggattaagaagtgccaaaccatggactaagaaaacggtgtttcatatatctagactacgagttcttctcttctcagctggggccctcctcacaagtaccccctagacaattctagggtcaagatggttctgcaggatcagggaacgctggtgcaggtggtagccgcggacgtcggagttgtggcgccgcgtgaaaggggcttatcatgatcagggatcatcaggaccagggaaagctggtgcaggtggtggccgtggacgttggacttgtggcgccgccgggcaggtacgtgctaagcgaggagaaccggccgaccaccgtcgaacagcaagccaagctggtcatccccatcgtggacgtgagccgtctggccaggcccgatgatgttgaggaggcggccaagcttcgctctgcgctccagtcatggggcctctttgtggtgaccggccatggcatgccaaaggagttcctggacgagatccttgaggcgtcgaggaagttcttccacctgccgctggaggagaagctgaagtgcggcaatgtgatcgacggcatcatgttccagaatgaagggtacggcatcgaccgcatcgactccgacgagcagatcctcgactggtgtgaccggctctggctccagctccagccggaggacgagaggcggctccagttctggccacagaatctaagggatcccctacacgagtacaccttagagagtgggagagtgaccatggatgtgctgaaggccatggcaaagcttctgaaccaggaggagaacttcttcatcaacatggtgggtgagaggttcaagtcatactcgaggttcacctactaccctccctgcccacgaccggacctcgtgaacgggctgaagccgcacaccgacaactccgtcatcacactcctcctcatggacaaggacgtcggcggcctccaggtgctcaaggacggccactgggttgatgtccccgtgctcgggaatgacctgttggtcgtcgtaggcgagggcatggagatcgtcagcaatgcaatcttcaaggcgccatggcaccgcgtggtgacgagcgccgagaaggagaggctgtcactggcgatgttctaccagccggagccggagaggatcatagggccgccggtggtgctggttcacgagaagcgcccggccatgtttaagaagtgcctggtccagaccttggccgatggatattgggatgcgtttgcagcgggagatcgcaccgtcgacttcctcaatgtcaggatcaatgctgaggccgacgccgaactagaggcgcgtgcagtggttgcaaacaactaaataatttacagtagggagtgagtgcatgatgttcctctctcactcgcataagtgtaatgtgaataggagttgatcgatgtacctcatatatgatcacctccctgaaataaaataaaaagtcaattacatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaagaaaaaaaaaaaaaaaaaaaaaaaaaagtgaaaaaaaaacaaacaaaaaagaaaaaaccaaaaacgaaacaaaaaaaaaaattaattaaagcaaatacaacattaaacaagctggcgtaaaccaaaaaaggcaagaaccgatcacccttaataataaaaacacagcctaaatgggaaatggaaaaagcactgtaccggtgaataaaacacaaaggatgagggggatactggcaagggaaccattaaactgttccatgcccaagcgccaactccttgcgcttacttcccttgctttttcgcaacaagcacaaaattgccccgtcaagactaaaatcgcaagctccgtttaaggttcagatttagggctaaaaggtaactagaccc

SEQ ID NO: 34469 - DNA, 685 bp, Triticum aestivum
  Clone ID: PAT_TA_34469
gtctggatgggttacaggcagatgaagctttcccagaagcttggcatgctgatgctgcgacagtgcctagcgatggtctagcaagcataaggtctaaggtgtatttaactcctaagctttggtatctcagggtaaatgttattgaggcacaagacctggtaccaagtgacaagtgccgctatccagaagtttatgtgaaagctacacttgggaatcagtccttgaggacaaggatatctgcaagcaagagtgttaaccccatgtggaatgaggatctgatgtttgtggcagctgaaccatttgaggagcacttgattcttagcgttgaggatcggattgcgccaaacaaggacgaggtattagggaaagcatgtattccactgcagaatgtagacaggaggcccgaccacaggccagtgcacagccggtggtgtaatcttgagaagcatgtagcgggagatggggaacagaagaaaaaagatgtcaagttctctagtcgtattcacctcagatttctttggatggtgggtatcatgttctggatgagtcagcacattacagtagcgatctgagggccaccgagaaacagctgtggaagcctacatttgggggttcttgagctaggaatcctaaatgctcaaggattactggcaatgaagactaaggatggggaatggcaccacag

SEQ ID NO: 34470 - DNA, 1504 bp, Triticum aestivum
  unsure (1)..(1504): unsure at all n locations
  Clone ID: PAT_TA_34470
caccgcatggtcggcccggaccccctctccgttctgcccattctggtggacctggcccccttgggcctggcactgtgggtctcccctccgctgccggcgcatcctggtaaggatagaaaacatgacgggtctattgatgggagggcaaatggaaatcctaaggttgtaagcaatgttgttcagagcagtcccatgagcccacaagcatcaaatgaaagcacttatggcacaccagctgttaaccgatttagagtagcagttcggaaagttccaagaaaaaaatatgaacagctcaatgacaaatccaagaaggataccagtaagagaggcgctagcgcaattttcagtgacaccataagtgaagactctgatgaactattgaacaccatggatgaaaaggctggcgtggaaaactcatcagatgattcatccacatctgctgactcaggaatttcatccacggcctgggagggaagcgacgtacctgatgatgaaggcattgcatcgttgtcacagaggagtgacatcaactctgtcctccgaggctccagtagctacaagaaggcgaggctgaaaccaaccgagctgctggaggacaccgaggtgcctgatagccagcctccagacagtctttggggctgaatcggacctggtgcttaaatcaacgcgagtctcacgcaattcccagtttttttttgcgcatttgtggatttagctgctgaacatgttaaagtgaagttcacacctccagatgtattgagtttgtggtcgtgactgtcctcaaaattcgtcaattgtcctttttaccggtgctacgattaagagtagcagttcgcaaagttccaagaaaaaaatttgaacagctcaatgacaaatccaagaaggatactagtaagagaggcgctggcgcaattttcagtgacaccataagtgaagactctgatgaactattgaacaccatgggtgaaaaggctggcaaggaaaactcatcagatgattcatccacatctgctgactcaggtatttcatccacggcctgggagggaagcgacgtacctgatgatgaaggcattgcatcgttgtcacagaggagtgacatcaactccatcctccgaggctccagtagctacaagaaggcgaggctgaaaccaaccgagctgctggaggacaccgaggtgcctgatagccagcctccagacagtctttggggctgaatcaatggacggacctggtgcttaaatgaacgcgagtttcacgcaattcccagttttttttttgtgcatttgtggatttggctgctgaacatgtctggatatcatgttaaagtgaagttcacatctccagctgtattcagtttgtgggcgggccccgccgctattttcgtcaattgggccctttgcgccggcccgtgggatgagtccgatgaatgtctaanttgttacacctccagctgtttggtttgtgattaagattgccaanaggttgccacgcttangttnaggca

SEQ ID NO: 34471 - DNA, 1002 bp, Triticum aestivum
  unsure (1)..(1002): unsure at all n locations
  Clone ID: PAT_TA_34471
ccgaaggccaagaagacgatcttgagaaagataatcagctccggcaaggacaaggttttttgtagaaaaggaatcggaagctcggagagacctcaagtcggaagcttggagagacctcacgtgactcaacaggcaattccctatgggcaagccttaaatcattatgttggacagatacttgcactttatcgcgacagaatatatgctgtgaatgcaatcggccttggtgaccgctattcagaatttaggccagtggaagaagatggggagtgtttctacaggagcttcatattttcctaccttgagcaagttcttgataggaaaggcagaaatgaggaacgccgcctccttgcagctatccaagagttggctgaggaacctgcacgttttggatgggcctctgaattttctaggagccatgatgcattaaggagttgatgaagaaagtaaagagatggaagaaaaaatgcagattgatccccgtattaactgacagggttttgatatgtttggtttgctgcaattccgggaagtgttgctgattaattgaattattgcttcactttcatacatgtatgaaaaatttgcataattttactttaaaggtgacgccggagctggcgaatttgagtcagggcttttttggcggctttgctcctcttttaaagaagataccttcagaggataatggtaattaaatacccataccgcaacatcatcagtagtcattaagagtaattttctatcttgatgatttcatccatgactgtgagatatattaactcttcaacctcagttttaatcaaggacaattgaagcctaattgattttgaattgttgacacatnggtttgcttgagacaagtgaagctgncggaggttgatttgtacacctaaactgcttcaagtattcgcccgatttgcatggcaagaatagtnaggattatacaggtttaatgtcaagggcttgaaaagtgtgaagggaagtaaaatggatctgatg

SEQ ID NO: 34472 - DNA, 419 bp, Triticum aestivum
  Clone ID: PAT_TA_34472
ttccgggtccactacgccgccgaaactaggtaccaactcgaggagatcgccaagctcacctccagctagaagaagatgcaagaggagtatgcctgctcccctcgaggagattcccaagctcaccgctgcctgctgggagaagatgctccccttgaggagatagatatccaggctcatcgcactagacggagccatgttttggccccaagtttcctgaagtgtagtgctgcttcagccgtgtctttctgccgtgtcgctcctcaaatgtagtggtaacttaaaacgtgttatatatgtagatgtttgattcggaggacatcggggtattcttctgttctactatctgtttgatctgcaaccttctgcatatgacaaggatgtatgcagatccactgctagctgatgttaaacatgttctg

SEQ ID NO: 34473 - DNA, 2153 bp, Triticum aestivum
  Clone ID: PAT_TA_34473
cgtccgcgccgccgccgccgaacaccacctcgaccgcccacgaaatcttctgcccgaagacgcgcgaaccccgccggagacgagaggcatgggacgccaagtcggtgacgccgggcgccgtggctctcatcctcgccaaccccacgccggagtcgcccgacgacgtgccggagatcgtggcacgggtcctcgaccacaagcccatcggctcccgcttcattttcatgcagagcgacggggacgcaaaggacaaggcgctcctccccacccactgcgccgcagaggcactctccggcacgctccaaaatctgcgtctcgtccgcacccaaaactacacgtgcaacgacatcccacaaaagacggacgagatggtgatcatccccaagtgagagcgtgtccccggcgcgcgctacgcagagatcgagagagaggtaaagggaagagccggcggggctcacatgccccccgaggaggccgctgcggccctctacaaccccctggggggggccggcgccgagtttacggagaccaagatgcatgaggaggaccccaagtcccatcgtgtgtgtgagcaggggaaaggctgctccctctccgagggtgctcccattgaggcgagcgagcagttcaagacagtccagaatcactatgagatgaccctgaatgagactgctgttgttaaagaggctgagggggtaatctttcactgcatcccgtgcaatacaactttgtcatgaatgatatgctggggccatatgtgggtgacagggagttagtagatattattggtggtgctcagagtgtatcactctaccctgtagcatcagaagaaagattgacaatgagtcaatcccaaagcgtgacattgttgttgcagatgactcgaacaaaactgtcaccatttctcttttggaatgatcttgccaccactgttggtgaggaactcttggacatggttgactctgcacctatcattgcagtgaagagcctgaaagtatctgactttcaaggtgtgtctgtttctacagtaggcaaaagcacacttgtgattaacccagagttgcctgagactgagaagcttagagcttggtatgaatctgaaggcaagggtactaccttaggcatcagttggtgctggaatgggtgcatccaacgctggtggcttgagatcaatgtactctgacagagtttttctgtctcacatcacaagtgaccctaacttgggccaggataagcctgttttcttcagcctgtatgccaacataagcaacatcaagcctgaccagaccatgtggtaccgtgcctgcaccacctgcaacaagaaggtgactgagtcactcggatcaggatactggtgtgaagggtgccagaagaactatgagcagtgctcattgaggtacatcatggtgatcaaggtctctgatcccactggtgaggcctggctgtctcttttcaatgaccaagcagagaggatcgttggctgcagtgcagatgagcttgatcggatcaggaaagaggagggcgatgacatgttccagctcaagctgaaggaagccacctggattccccacctgttccgcgtcagtgtcgtgcagaacgagtacatgggagtgaagaggcagaggatcaccgtgaggagtgagtcgccggtcgactatgccgctgaagcgaggtaccagctcgaggagatctccaagctcacctccagctagaagaagatgcaagaggagtatgcctgctccccttgaggagactcccaagctcaccgccgcctgctggaagaagatgcaagagtattgcctgcctgctccccttgaggagatatgagacatccaggctcaccgctttgctagatgaagccatgttttggccccaagtttcctgaagtgtagtgctgcttcagctgtgtctttctgccgtgtcgctcctcaaatgtagtgatcacttaaaaacgcttttgctcctgtgttatatatgtagatgttcgatttggaggacatcggggtattcttctgttcgatctgcaaattccttcagcatatacaaggttgtatgcccacacgccgctcccccttgttaaacatgctctgagcaagtgctcctcgtggcttagtatgcaagaatcactgcactaaaaaaaaaaaaaaaaaaaa

SEQ ID NO: 34474 - DNA, 864 bp, Triticum aestivum
  Clone ID: PAT_TA_34474
tcccagtgctaagcacactggtcttcgcaacatctttgtttttgcaatgaagggggggacggtgcctacatggctagagctactgctcgcaacacagttctttgcaatatgcaccaaccatctctcctctactcgcaatgagtgtaacctgttttgcatagattgcgaggaatcaaaggctgccttatgctattattgccgttcacaccatcattccacccatcgagtaatccagataaggcggtcatcataccatgatgtggtcagggttgccgagttaaaagatgtacttgatatcatgtgatgtacaaacatatgtgatcaacagtgcaacggttgtatttcttaatgatgcgcccacaacaacgtggttgtgggtgtttctgttggtcaaggcatcaatcatcatcaatatcacaattgtgatgatgttgcaatcagtgctacctccttgagcccacttccgcgttcatgctccctgggttgcaaccttaaagcaatcaaagaggatatgagtacgagcattccaaatagagatattattgactatacaaggacaaatgatgatacagattgcagtaacacgagtggaaatactggaaacaatgtagagagttgcagcgatgcagattattgcaacgaaaaaccatctacagcaagggttattcgtctccgtcgaagggggatccctcagcgtgcacctttttattgagagaaagctgttatgaataatttgcttgcatcatagcaaatgaattggaataaatacttttattgaagatcatatatatgtaaggtgtcgaatatattaataaattacagcttgttatctgcaaacaaaataagaaattacagcatttttat

SEQ ID NO: 34475 - DNA, 848 bp, Triticum aestivum
  Clone ID: PAT_TA_34475
tgaggacagcttgctgtaatgtggatgccgaaccaccacctatagtggacaatccgcttctacgaggttcaccgtcatccgtatccgtgtcagacgaccaaatgatcattttccattagaactcaaataaatgacaagagggagacactaaatgcacggtgtaattttgcggcaattacctccgttttcacgatgaaaggaaagaccaggatgacaggttgcagcaatatcaaaggcacgtgcacgtgccctccgttgctcaagggaacggttctcatttccgtcgcgttcaccatctgaattgtcattaacaccatgaccgcctagcaagatgaggccgttcaacggtgggtcttcgtccaactcatctccttcccttccgcttccaaccaccaacacggctgcattttgcacaaaaaccagtggatcggcacttgtgatgccacggcaaggaactcttcatctaagtctgtcacatacatcgtctcgtcttcacccctggataaaaacctgatgactcagagtctacatcagtctccacgatcgcgaactagttattcacagtgccttacattgttaacttgtgctacttaagtgcaaaactacaaaaacctcttacagtgaatatagttgggtactctcttgtaaggtagattagcctcctgaacaccggccttgtgtaaacgctgatgcgggggagggtgtacggctctacactatctggcccgaaatccatccagtcgaagaaccatggctgcaaacaatcaagggggaacaattagttacatacctatcaaatgcaacacgctagatggttcatgttaagacaaggcatcctttttggtcac

SEQ ID NO: 34476 - DNA, 777 bp, Triticum aestivum
  unsure (1)..(777): unsure at all n locations
  Clone ID: PAT_TA_34476
cccccccccccggggccggggggagggcccctttttttttttccccnnntntttttttttttttttttttttttttttttttttttnttttttttttttttttttttttttttttttttttttttttttttttttttttttttttttttttttttttttttttttttttnnnttatgaaagcctgcctcattatattggacaaatcataacagacaggtttattattatctcggatcatacgagcattattaagcatgtaacatatgcacacacatgctttgcatgcccaagaccaaaccgacctgaagattagacagctctgcggctcatccgcccaccacgggggaaccctatgccgccttcgcgaacccaatcttcatgttgccatagtcgaagacggtatggtaggctcccatgaatatatcgcccaggatccagagagggccacggggacgaggaatgtccatggccgtgaatccgctgatgcactgggtagcatccccctcaccgatcttcaggatatattgctctggtgtcagcacaaactgtttgcccccgatggagaaagcgatgtcaggcatggatgcaagtctgccgcagtccacagatgattctcccatagggctaggaatacggtcacatagctgattaatgtacttaaaaataagatcctgagtttgattctttgcaagttggttcgtcatccatacaacagccatctcacaaagaatcaaacacgggatcttatattgaagtacattaatacgctatgtggc

SEQ ID NO: 34477 - DNA, 1867 bp, Triticum aestivum
  Clone ID: PAT_TA_34477
gctggccgctaccggccggacaccactgtcgactgtggtgacttctctctcggtcgatcctgcttgccaagcaaccatggcaagccgccggccacctcatgctcctgtcctgcgtgctcctccacgccctcctcgccggtcccgcggagggcctggtccgcgtgccgctgacaaagcggccggtggacgaggacggccccgtcgtcgccggagaggacgcccagcgcctcctcgcgtggcggcacggcctcgtctacaacgccgacgtacagcccacaacaggttctgaaaagggccacgccgtggcgctgaagaaccacctcaacgcgcagtactacggcgaggtcggcgttcgggacgctgcacgcacaacttcaccgtcatcttcgacacgggcacgcgccgacttctgggttgccctcctccaagtgcttcctctcgattgggatgctatctgcacgcgagctacaaggctagcaagtccgccatgtacaaggaagaacggaaaaaggggtcgcacttacgttacgggaaccgggagtcaatttctgggcggtatcttagccaaggatcaatgtgcaaatttggtggttgatgttgtaaaatatcagttttacattgaagcgactagtgaaccaagtattacttgcatgtttaggaagttcgatggcattctcggtcttggatttaaagaaatcgctaggggcggtgttgaacctgtctggtacaacatggttaaccaacatctggttggtagccctgttttctcgttctggttcaaccggcatgctggcgaagggcatgggggagaaattgtgtttggaggaattgatcctaagcatcacaaggaagaacataaatacgttcctgttactaagaagggatattggcagtttgatatgggtgatgtcttgattggaggaaagtccacaggattatgtacatctcgctgtgcagctatagcagattcgggaacttcgttgcttgttggtcccactgcaataattactcagataaatgaaaagattggtgcacctgggattttcagccaagagtgcaaggaagttgcttctcagtacgggcaacggatcctagatctattgctaaatgagatcgacccaacaaaaatatgtccttctgttggtctatgcactcacagtggaactcaaggtgtaaatgatgtcagctttggtattcggactgtggtagatgatgaaaccgggagatcaaatgatgccgtgtgccatgtttgtgagatggctgttatgtgggcaaagaaccaacttgcacaggatcaaacacgggatcttatattgaagtacattaatacgctatgtggctatatccctagccctatgggagaatcatcagtggactgcaaaagacttgcatccatgcctgacgtcgccttctccatcggcggcaaaaagtttgcactcacaccagagcaatacatcctgaagattggcgagggagatgctactaagtgcatcagtggattcgtagctatggacattcctcctccccgtggtcctatctggatcttgggtgatatattcatgggagcctatcacactgtctttgactatggtaaaatgaaggttggcttcgcgaaggcggcatagatgaccggatgagctgcagaggatccggcttttcaggccaatttcatgctcatagatgcttcataatgcatgtgtggtctgagattaataagtatgtatattttgatttggccaagatatagtaatgattccatatagacatggttactattaattgtcccaacaaggtgtgcatgcctccggtattactattcttactaaaatggaaaaataaaatgaaaactaaggcaacatgaactttg

SEQ ID NO: 34478 - DNA, 510 bp, Triticum aestivum
  Clone ID: PAT_TA_34478
ttggaagtcagcagaactcggttccatcgggtgggttcaactttggctgaagatacccggttggacgtgtacctcggctacgtgggtgggactagtcagatttggggaagtcttgtcgttcgagtcattgttgggtcctgtcggtctggtctcaagcagtcgtcaagtcagtctaagcagggtcagtccttgggctgcatcgtccgtggtgcagcttggtcaatggtcagtcttcaaggtcaaccggtcggatcatttgggttctgcctcaccagaggacgtccagagccgcatgtgttgtcgggagagtcggattttgcctcctatatagcttgaaccaaaattatattgatatatctgtgtgaggtaaaaagaaccttgaaagatagggttttcacggttgtcggctgtgtcggtttttgtcagatgcgtttctgtgctgtattaacttgtcgaaagagtatggagcacaccttataaacatcaatagcaactgggttttgggagtcc

SEQ ID NO: 34479 - DNA, 1101 bp, Triticum aestivum
  Clone ID: PAT_TA_34479
gccgcaccctccccaaaccctaaccaacaccaggtaaggcccccgccgtcgatctctctccccgccgccccacaccccattctccaccagttctccctctgcccgccgaccggcgacagccatgagtaagctgcagaccgacgccctcaaggaggccatcacccaggtggtggcagacgccaaggagaagaacaggaagttcaccgagactgttgagctccagatcggcctcaagaactatgatccgcaaaaggacaagcgtttcagcggctctgtcaagctgccccatgtccctcgccccaagatgagggtctgcatgctcggtgacgcccagcatgtgggagaggctgaaaagattggtcttgattccatggatgttgaagctcttaagaagatgaacaagaacaagaagcttgtcaagaggcttgccaagaagtaccatgctttcttggcctcagaggctatcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgcctgtacatcaagagcaccatggggaagccggtccgtgtgttctaagcttgtgcccctgccgccccaccctatatcaatgctacctacagtactggacctccttactatgtttcaagctcaaatatgtctactcgtcgtagtttttatcgaattttgcgcgtgtcctggttaatgaagatgatgaaaagaccactactgtttcccctgagttgtgattctgatggaacattatgtttcatcaagatcattccagtacctgttatatataatgttgtggttgcatgttttgtacccttgtatgtttgtcgggtctctgatgcacctgtttgccgtcgtgcctttctatatgacctgtacccgcatatagggttagt

SEQ ID NO: 34480 - DNA, 4253 bp, Triticum aestivum
  unsure (1)..(4253): unsure at all n locations
  Clone ID: PAT_TA_34480
cccacgcgtccgcccacgcgtccgcccacgcgtcccctttttcgaatcgagcccaaccgcatcgtgcgtgcgcaccccccccccccccccactcccccctagggtttcgaggttctccgacgatgtcgctgcggcccaacgagcgggccgaggtgcggcgcagccgctacaaggcgtccgtcgacgccgaggacgggcgccggcggcgggaggatcagatggtggagatccggaagaatcagcgcgacgcgaacctccagaagaagcgccgcgacgggttcccggccggcgccgcgtccgctgccggtggcgcgccgcagatgggccactcctcggctctccagcagaagctggagggcttgcccgcgatggtgcaggcggttctctcggacgacaacgccgtgcagctcgaggccaccacccagttccggaagctgctctccatcgagcgaagccccccaattgaggaagtgatcaacacaggcgtggtgcctcgcttcattgagttcctcacacgggaggactatccccaactccagtttgaggctgcatgggcgctcaccaacatcgcgtcaggcacatcagacaacaccaaagtggtggttgagtattggtgctgtgcccatctttgtcaagctactcagctctcctagggagggatgtccgcgaacaggctgtttgggctctggggaatgttgctggtgactctccaaagtgccgtgaccttgtgcttggaagtggtggtctgttccctttgttgcagcagctcaatgagcatgccaagctctcgatgctcaggaatgccacatggacactctccaacttctgccgtgggaaaccacagccaaactttgaacaggtcaaaccggctctctcagcactgcagcgccttatccactctcaggatgaggaggtgctcactgatgcctgctgggctctctcgtacctgtctgatggaactaatgacaagatccaatctgtgattgagtctggtgtttttcctcgccttgtggagcttctcttgcacccttcggcttctgttctcattccagctctgcgcacggtgggtaacattgtcactggtgatgatttgcagactcagtgtgtcattgatcaccaagcactttcatgtatcttgaacctgtcgactaccaaccacaagaaaagcatcaagaaagaagcatgctggacaatctccaaacatcacagctggtaaccgggaccagattcaggctgtcatccaggcaaacattattggtcctctggtccatctcctgcaaggtgctgaatttgacattaagaaggaggcagcgtgggcaatttcaaatgccacttctggtggaacacatgatcagattaagtaccttgttgcccagggttgcatcaagccgctctgtgatctgctcatttgcccggatcccagaattgtaacagtttgcttggccctaccctaaccccccccagccaagcccgccgccgtcgacctcgcgccccgccgctccccccctcctgttccccacgaggtgaaccggcgaccggcgggccaacgcgtcgccgcagcgcgccacgactacgccaaggagccatcccctcagggaggcgagccgccaggagaggagcaggacgttcaccgaggcagtagagctccagttcgccctcaggcagtatgagcgccccaaggccaagcctttcggcgtccctgccaggaaaagcgacgaccctcgtccagcgatttccgtcagcctgccccatgtccctcgccccatgttgagggtctgcattgtacggtgatgcccaccatgtgggagaggctgaaaagagtggttttgaatcctcagatggtgaaagtcgccagaccacgaccccgcaaaccaaaaccctagggccgcaccagaatgagccggcgcccggcgagtcggtgcgtcccctgcggcgagacattagacagctacctgaccgtcgcatctccaggagggcaatcacccaggtcgtggggccgatgccaaggtatcagaaaacaggaagttcaccgacgacagtcgagctcctggaccggccccaagagctacgacgcgtaaaacgacaagcgttgcagcggctccatgaaggtgcagcaggtccctcaccccaagatgagggtcgccatgctcggctgatgcccagcatgtgggagaggctgaaaagattggtcttccattccatcgatgttgaagctcttaagaagatgaacaagaacaagaagctttgccaagaggcttgccaagaagtaccaggctttctcggccccggaggctatcatcaagcagattccacgtctccgttgatccgggtctcaataaggcaggaaagttcccgaccctggtttctcgccaggagtcactggaagccaaggtgaacgagcacgaatgcgattattaagttccaagctcaaggaaggtgctgagcatggggtgccgtggtaggcaacctgtcgatggaggagaagcagatccagcagaacatccagatgagcgtcaacttcctgttttccctgctcaagaagaactggcagaacgtgaggtgtctgtacatcaagagcaccatggggaagccggtccgggtgttctaagctcgtgcccctgccgccctatatcaatgctacctacagtactggacctccttactatgttcaagcttaaatatgtctacttgtcgtagtttttgacgaattttgcgcgtgtcctggttaatgaagatgatgaaagaccactactgtttccaccgagctgtgattctgatgcaacattatgttcatcaatgtcattccagcacctgttaaatataatgttgtgttggatcttttaaacatgcaaggatcttgagggacatcctgaagaactgggtggcgaggataaaagaaccttgggagcaggggatgtcaacaactatgcgcagtatgattgatgacgctgagggactggaaaagattgagaaccttcagagccatgacaacacagaaatatatgagaaggcagtgaagatgcttgagtcctactggttggaggaggaagatgaggtcatgccctcaggtgataatgcccagaatggcttcaactttggaagtcagcagaactcggttccatcgggtgggttcaactttggctgaagatacccggttggacgtgtaccttagctacttgcttgggactagtcagatttggggaggtctttgtcgttcgagtcattgttgggtcctgtcggtctggtctcaagcagtcgtcaagtcagtctaagcagggtcagtccttgggctgcatcgtcggtggtgcagcttggtcaatggtcagtcttcaaggtcaaccggtcggatcatttgggttttgtcgggagagtcgggttttgcctcctatatagcttgaaccaaaattatattgatatatctgtgtgaggtaaaaagaaccttgaaagatagggttttcacggttgtcggttgtgtcggtttttgtcagatgcgtttctgtgctgtattaacttgtcgaaagagtatggagcacaccttataagcatcaatagcaactgggttttgggagtctattcgttggtttgttgtatgttccacagtttttgtcgtgtcaagtcgtatccactctgtttggagattgttccacgtctgtctagcgaaagagtagttgtatcacctactgtggtgatgagtttgagtatatggttggagagcagggtttaagttggttcccacttttactgcggaacctggtttagtgttgtatgatatgattacggtcatggaacatagacgcaaaaaaaaggaaattcttggttacaaaaaaaaaaaaaactggctcgtgacaagagccacaatcaagttccagctcaagaaggtgctgtgcctgggcgtggcggtgggcaacctggcgatggaggagaagcacatccagcagaacatccagatgagcgtcaacttcctggtttccctgctcaagaagaactggcagaacgtgaggcgcctgcacatcaagatcaccatggggaagccggcccgagtgttctaaagcctgtacccgtaccgcccatctatatcaatgctacctnataatactggacttacttactatgtttacgcataaatatgctcggtgtccgtgtcgctgtttttatcgaattttgcgcgtgcctggcgaagatgactgatcgaccactactgtttctcttgagttgcgtttctgctggagtgatgtgctcttcctaatcctgcc

SEQ ID NO: 34481 - DNA, 1179 bp, Triticum aestivum
  Clone ID: PAT_TA_34481
cggctgagctgggtgtgggccggccacgagttcatctctgacgtgatcggcgcggagacgacggagcggggcaactgcaccggccgccacggcgccaacggcgcccctccgcattgctgcgagaagcaaccggtcatggcggacctgctgccgggcgcgccgtacaacaggcagtccgccaactgctgccgtggcggcgttctctcgtccgtcacgcagaacaacaggacggccacctcgcagttcgagatgtacatcgtcaatttcgcgctcgacgagcacggcgaccccaagatgccgaccaccttcagcatcggcgtgccgggctacacctgcagcaacgccaccaacgtgccggcgacgaggtccaaggtcgacgagcagcgccacgtacaagttctgcggacatggcagatcatctgctcgtactcgcagttcagggacgcaccgtcgccgtcctgctgcgtctccctcacgaccttctacaacaacacgatcgtagggggtgcccgcgggacagctgcggtggtgcaaactctccctcggcgcatcagtgcctcagcggcggcgagcagtccaaggtcctggcggcgctgcctgacgccgagggcgctccgcccgtgccggtcatccggtgcacggagcacatgtgcccgatccgggtgcactggcacgtgaagcagagctaccgggggtactggagggtgaaggcggcggtgacgaactacgacgtcgtcagcaactacaccgactggaacctggtggtgcagcaccccaacctccggagcctgacgcagctcttcagcttcaactaccagcccctcatccagtacggcaccatcaatgacacggggatgttctggggaatcaagaactacaacgagatgctgctgggtgacgggaacgtgcagaccgagatgatactggagaaagacccgagcgacttcaccttctcggggggctgggcgttcccgaggagggtctacttcaatggacacgagtgcgtcatgccgccgccggatcagtacccttcgctgcccaatgcggcctgggacgtgcgtgtctcggcggtgcagcgctggctggtcgccggctcttgtctgctctcgttgtctatgttgtttctcgtgtaaagggtacctgactagccctgaatacaggggtttgagtaaaaaaaaa

SEQ ID NO: 34482 - DNA, 708 bp, Triticum aestivum
  Clone ID: PAT_TA_34482
cttcgttctctccttctcctcgatgcttgcccactacaccagatcgaaggggagagggaagagagttacgcctcccaccagacagactggcggcggtggcggccgatccaccgcgaggccgtcccctcctgacggcgcgcttcaccagacagggaggcaggggagtctgaaccctcgcgccacctccctgccgcccctggtcgacgaccgccgctgatcttctccaactccgacgaccgccgttgatcttctccaaccccaacgaccgctgcgacctctcctcgataccaacatcggggcccttcaccaagttcttcaccacgctgatcttccccaaggatcctctactgcttctcttcttcaaggattacgcagaagacctcaagcttttcctgctacggatcatctccaactcgttcctgctgctcttctttgcctgcaacatctacagcttaggagacaactctgaatctctcttttcttactgtagttctctgaactttgtcctgattgctatgcatttgtagtctgaatctcagttaactgttgatgtacccatgagaaaactaggtagtcaacttgtgatattgatctgctataagtgatgtttgccggcattccctcatctactttatgctactgtttgttggactgtttaagattacacacaaagccacccgggaaagacatctctccaaaaaaaaaaaa

SEQ ID NO: 34483 - DNA, 1714 bp, Triticum aestivum
  Clone ID: PAT_TA_34483
gtagcatcagcgagaaaacatgagcaattcggctgctttggcaccatcatcgcgcgcggctgtgtcccttgccttctcccttatctgtttctccacgccgtgtcctcgccgcgggaacacccgaacgacgccgctgctttcgcgacgtcattaggcttactcgcggggctgtcggtccgcctgccccccgtcgtcccgttctcgtgcagtgtccacgcctctgcacccgcgtactcggccgacgggctcgacaagtcgggcctctacttccagggccagaagaccgcccggctcacgttccacctggccttcaccgcgacgttcatctccgccatgccccatcgcgccaccgccgaccgttgcggccggccggcgggacgaagcgacgccgcggcggcgacgttcgggggcagatggcactacccgttgaaagtcagcctgatggatcgcggcccgggtcaacgctcgggcgcggggagtggggagggcccacgacgcgcgcgcctcggtgcggtgggcggggggccatcgccacgcggcggggcaggcaggccgggcgggcgtccgtccctggatccggcgtcgccggagacccaccggcggcgctgggcgggggccgggtggtctgcagggccgccgcccgtgcctcgtacgcgggtgtcggcgtcgcggccccggagccggtaccgtcccccggggagcccctggtagggtgccgcgcccacgtcgccggcggcgtgggcaactactaaccccatcccactgccggctacaatggacgaggctcctgtggggtatgtgcatggctgctgtgggcgacaaagaacagctcctacctcaacgacctcatctccctgggcgccaacgacgacctcgacgtgttcagctgggacaacaagctcgccggggcgcgcgtgcttctctcacggagggctctgctggacggggacgagaggctggagccgttcacgcgccaagcggaggagttcatctgccacatcctgcccaactccagctccccgtcgtcgacgacggcgtacacgcccggcgggctcatgcaccggccgggcaacgtcaacatgcagtacgtcgcctcggccagcttcctgctcaccacctacgccaagtacatggccgcctcccgccgccgcgccttctcctgccagaacagccgcccagtcacccacaggaacctgagggccctggccaagcggcaggtggactacgtgctgggcgacaacccgctggggatgtcctacatggtgggctacggcgcgcgctacccgcagaggatccaccacagggcgtcgtcgatgccgtccgtggccgcgcacccggcgcacatcggctgccaggagggctaccggagctacctcaacgcccccgggcctaaccccaacgtgcataccggcgccgtcgtcggcgggccggatgagaacgacgcgttcccggacgaccgcgtcgactacgcgcggtcggagcccgtcacctacaccaacgcgcccctcgtcggttgcctcgcctacttcgccggcagctacaagaactgaccaccgcagctaccatgtggatctttattgtgtgatacatacagttttttcaaagaaaacttccaataaactacatcattaatcatggtagtacaaccatgattaatgatgaataaaccgaattccaataaaataaaataaaatctgctggttgaaaaaaaaaa

SEQ ID NO: 34484 - DNA, 743 bp, Triticum aestivum
  Clone ID: PAT_TA_34484
agaaatggtcgaggccatgggtggcacagaaagccaatactacacaagattcaagtcctactgctgtgaagcatacaacattttaaggaataacagcagccttatattgaatctcttcacgttgatggaaagatcaagtattccagatatctctgccgaggaaaatgcaacgcttaaggttcaggagaaattccggctggatctggacgatgaggaggctatacatttcttccagggtcttatcaacgatagtgtcagcgcattgttccctcaaatggttgagaccatccatagatgggctcaatattggcgatgaccacttcttgtttgtatagggtgagtttggtcttaggacgatagtgtgttgacatgattccatcgcataataacatgctcttgcaatggggcttgctgacctccattcccacttcttgtttgtataggccgcagcagactattaacaacagatgtcaagcagagactgaatggtaagaggagacgaatgcgatagatttacagcataacgtggaaataatgggacaaatgcccacacgtactttatttccccgttggatactttctaacttacgaacgcaaatttgtgaatatgtcttctttatgtaaatcgtcctgtgtgtgatgtaattaacaagactctgaagtgcaaatctgtgaacatgctagcatttataactttgtctatgtgtgatgtactcaaaaaaaaaaaaaaaaaaaaggggggg

SEQ ID NO: 34485 - DNA, 1755 bp, Triticum aestivum
  Clone ID: PAT_TA_34485
gagctgcgcttgcacttgcgctcggccggcctccgctccgcgtataagttccttccttgctttggccacttccgccacgatcccttctccctcttccagatccattcctctcccagccccaggcctcgctcgcctcccccgttgggacggagagagctcggaagggcagggagccatgggttcctgggtccttcttgctgtggttctcgggtccttggtgggagctgcgcgcggctccgagccgtggtcgaacggcacgcaggtctactccaccaatgccaactccggcagcggcagcaacggcgccttcgtcgccctcactctcatccagtccgcggccgccaagggagccgtatgcttggatggaagtttaccgggttaccacctacaccggggatctggatcagggtcaaacaattggcttgtcaatctggagggtggaggatggtgcaatgatgttaaaagctgcgtgttccgcaagggcagtcggcgtgggtcatcgaaccacatggagaggcaactccagtttacaggcataatgagtaacaggcctgaagaaaatcctgatttctacaactggaacagagtgaaggttcggtattgtgatggtggatccttcaccggtgatggggctgacgcggcttcaggcctttatttccgaggtcagcgtatttggcaggctgctatggatgacttgatggcccaaggaatgcattctgctagtcaggcccttctttctggatgctctgctgggggtgcttctgccatacttcactgtgatgagttccgtggaatgtttccatcaaataccagagtcaagtgcctcgctgatgctggaatgttccttgactctgtcgatattgctggtcgtcgagaaatgagagacctattcaatggcattgtgagattgcagggttctggaagaagcttgcctcggtcctgtacctctcacatggataaaacctcatgctttttcccgcagaacgtgttgccaaacattcaaactccaacttttattttgaacactgcttatgatgtgtggcagcttcaagaaagtctggctcccagaacggctgatccccggggtctatggcaaagttgcaagcagaattacgcctcttgcaatagcaatcaacttcagtttttaaatggctttaggaatgaaatgcttaacgccgtgaagggtttctcagggtcagggcagaatggggtttttatcaactcatgttttgctcattgccagagcgagagacaggatacatggtactcgagcaactctcctcgtcttggcaacaagagaatcgcagaagcggtcggtgactggttcttcgagaggggcaacgccaagtacaccgactgcgcgtacccttgcgacggcacatgccatcaccttgtgttcaaggggaggcatctctaatacgatcatatcctttgataccagcagctgaagtgctgaaaacccagtgagtgggcacaaccgaaaaaaggaaggtatagatagaagaagatgggtgcaagttggtggcttgcccggcgtccatcgcctgagataagatatgatagggcagggcctcgcatgcaaacgcgacgaggccctctgcgttattttagtttcacatagtcgattctttccattgccaattgctattcgctcgatgtatctgaatatttggaccacactggtgtataaccttacatgttcatgtattgaatgtggtaatatgaatgtatgatgtgcttagttcaaaaaaaaaa

SEQ ID NO: 34486 - DNA, 721 bp, Triticum aestivum
  unsure (1)..(721): unsure at all n locations
  Clone ID: PAT_TA_34486
gctctcagctaggcgccagcaccgccgccgcttccaggttcggagcgcgcttgaccggcagcaggcctccattgccccggccaggtcgcaggtgtagctccaagaacatgtgttctgtggcgtgtattgatggccaatagcgagtacgagtatgtgaagagggaattcgagttcgaccatcacctcccggcctccaactggatcattgtctgcttagatggctgtcatttccaccgttttgttttcagagagggaacagaattctgtcaaagacttctctaccaataattgcagcaaaattctctctttgtgtgtttcttacatcacacctgtgtatgtgatgaagttgaaagatttctttccaaataaagagttgagagaggctccatattttgatgggcgagttgtatgctatccaaatatgaagaccattcgtgattatttggcatggaggcaactggactgtagaaacaacactgaaaattgacgattatgggaatcttataaaaagaacccggttggcaattacagtgtcaatttttgatatcataggacatgagtttcgaggaaaacatcaaaacattcttcgagaaggtttggacattntttattgatgcaacttctttttgttttagctcttctgctttcaggtaaccgctgcagtacatttccccttttatcattggagctgctcatgagtcatgaccctgctcgatagtcg

SEQ ID NO: 34487 - DNA, 1283 bp, Triticum aestivum
  Clone ID: PAT_TA_34487
tgcctctcctgcctctgggtgatgaggaacccagccaagctaccactctctcactcgcggtgatggtacctacgtgtcaacgccccatcgcgataaaggcatcccgatcacaggggttgtttgctgcagtgcgacgcagccgcctggtctagtaggcgacgccctcggcgggcgtcccgagaaggaagccggcggggagcacgtcaccgtaggcgtcaagggagccatggacaagccgccaggaggagaaagctcccagtttgtggaggagactatgtgacaggtggtgttttggaatctagattgatttggtactgtatgttgtgtgatgtgcccttgccaagaatatttgatgtgtgtgatgacactagcaattgcagaggagtgaacaccattctcgtttgttggactgccgcttgagaagaagcttgtaatttgtctcttccagccgcggcggataggggccttcgaagaacttggggtttgacatatccattgaggaagtgcaggatacaaaccacgtgtagtcaaagaggatatggattcactacggtcatgagtgagggaatgttactccaatttggatcttggagaatgttttctcagttcgattcattttaaattgatgtcctacaggcaggggaggacgaggcgaagggggatggagaagtggtcgagctagaggcgtacaggcagggcacccagaagacagagctgtgcaacaagtgggagggcggcgcctgctcctacgggggccggtgccggttcgcgcatggcctgcaggatgatggtttcttaatttcgttgactaaccagggagttcaaggatgatgactgaaagttttgtcattactggttaacacttggcgacgatgtgtccatcagaaatgatccggttatcctctgttgtattatatttcctacttttttgtaaatatgtatggatgtacatgcacgctctttcgatgtctgaaaatgaccgtcatccctctagtgggcaaagatgattttgtggaacagtttcagtatatgttataaatcatattcattccaaaatctgtacggcataagctcacaaaacggcaaacacaaaacgaggtaaatcagttgcaaccaaataatcgtgatgtacttgttctgttgaaagtctgctggtacattggttatattcgctttctgtagccagcatatgaaaaaatgtactaaaaacatttgagggcggtcgatcccatcaggcggaagagcaactatgctcgaaatagcagggaggctgtccaagcttg

SEQ ID NO: 34488 - DNA, 566 bp, Triticum aestivum
  unsure (1)..(566): unsure at all n locations
  Clone ID: PAT_TA_34488
gaaatgttcgccggcggccgncgggcaaggncgggtgcgtgatcgaccccgggcacgccgctgacggtgctggcccgggaggcgtaccgcgtcgtggaggacgccgtctggagtgacctgcggcggaatagggccgagcgcatccagcggcagggctacgggttgtgcgtccgcaagaccgcggagatcaagcggcacctccagtcgctgtccttccacttcgcggaggagacggcgaggctggtcgtcaagccggaggagctgttcacggcggtggagggcaggctccacggtcccgccctgtgctttgccatgagcccgggcgagcggacggtcatcggcgcgctgcagcaggtggacacaaggttcgtgtacgacctaaaagacgctaaactgtcctttgcgtcggagccgtgttctcaggacaccgccggtgtggattgaactgaatgaaccagcaggcaccggtgcttcccatggacattcgacatgggtacccgctagccagttgcttgtaaattccattgaataaagggaaacgctcacaatccaaaattccattgaat

SEQ ID NO: 34489 - DNA, 1018 bp, Triticum aestivum
  unsure (1)..(1018): unsure at all n locations
  Clone ID: PAT_TA_34489
gctcgacgaaatgcctgtggcgcgcttcatcacattgcctaaggtgatggttggcaacatggacaacgcgaaatcgtccgcgtggccgcttcggaatgttgcatacagaaacggtatgatcaagtttgtcgagatagaaaaacatgaaagaccagatgtcgacaaaaggttggatgatgacttggatacgctctatgagtcacactgcttgatgaaccccaaagaaataggttggagggccatgacttggtacaagatgacttcttgggaccactggagcaagggatacatggcttatgacaaggnaaatctcggttgattacccaagntcattctaagttgttgcctgacctgactctgggtgacaactatgtaagagagttgacattgaaggacctgctagcatctcaccctgtcctgagcttgagctgtgattgtgatgatattgcccacgcgtccgtgtaaatccaaattttgcaacataaaagacatggatgatcgctgttgacctaaaaaagaagatgttggttgatttggcaccattttctctcaaaggatattttaccccagcccacccttctggattgtccaaatatctgaatataactccagcaatggaaggtagttcaggaggacactgaggagcttgtagcaaagacatttttctcttgagcgccatcgtcatcatctcaaaaaccaactcaggcttccctgaaatgcaaacatggagattttttatggtggacctaccttctgttggtcgtcctctacaagactctactattcccattttattcatcggactgttttgtgttttgttttatctatgagtgctacctaccattccagtattattagtttacattatgtgtagttctatagagtatgttggtatggttaactagtttctccaatttgtggaccttgtttgtctgctttgctttcttgaaagccaagtagtgaaaagtcatatcgttggtctaaaatatctaagtgttggcaagagaatttgttctct

SEQ ID NO: 34490 - DNA, 1628 bp, Triticum aestivum
  Clone ID: PAT_TA_34490
gcagacttgagcagtgcctttttcccacgcctcgcccccggtgggaagtatcttgtgttcatctcagcaaagagtgctgtggatagtggagcacacaatgccacaaattcaatgcataaaattgactggcctaccgacggcaaactagaggggagcctcagtgtttctgatgtggtacccactgtaatgagccctcaagatgggtgtttccctgggatgtactgctctggcttacttcggtttccatggctttctgatggacggactatgattttatcttctgcttgggggaagcaaggaagtaatactttctatcaacgttgcgagcggcgaagtctcaagagttagtccgcaggattcagattattcctggaacgttctcgcacttgacaataataacattcttgcagtttccagcagcctcgtaccgctgcctcaaatgtactatggatttgaagattctcacacagacaagccctgccagtgggactggcaggaaattccgtctccatttccgaagccatctgataaggtcagctccttgttagccgatcataagttcagtgtaatcaaaatcccagtcagcaatccttctgacaaacttccagatggtgctaatctcccctttgaggctatttttgtgtctggcaaggattcagcaagtagtccaacgattgttgttcttcatggtggccctcactcagtctacccatcaagctattcgagatcattggcctttctatatgcacagggatataacctgcttgttgtaaattgcaggggctcgttggggtttggagaagaagcattgcaatctcttcctggaaatattggttctcaggatgtgaatgatgtattgacggctttggactttgttaaaaagagaggacttatagatgcatctagagtagctgtagttggaggttcacatggaggtttcttgacaacacatttgatcggccaggctccagaaacatttgttgctgcagctgctagaaatccagtgtgtaacttacaattgatggtcggtaccactgatatccctgattggtgctttctggaggtttatggaaaagaagggaaaaactgctttacagagtctcctttagcagacagtcttacaaagttttaccagaaatcaccgatatcacacatttccaaggttaagacaccaacactctttcttctcggagcaaaagatctccgtgttcctgtttctaatggcctacagtatgcaagggctttgaaggagaggggagtcgacaccaaaattattgtcttcccagaagatattcatggacttgacaaaccacagtccgactttgagagcttcctcaacataggggtttggttcaagaagtacatgagcaaataagcattgggcttcttaaacaccatgatctccttgtatttttcattctggtggataaatgattgtaatttaggtcataggaacctgtgccgtgaaaatagtgttcgactggcaactcttgtaaatagtaatatctgccgtggacttgtggtgctactttaatggtactggtatggattagaacttgtgattccaaaaataaagctgatgcattttagagctcaaaaaaaaaaaaaaaaaaaaaaaaaaaaaaaaa

SEQ ID NO: 34491 - DNA, 1017 bp, Triticum aestivum
  Clone ID: PAT_TA_34491
gttgttgattaatgattccactagattctgctatgtgtatttgttaaatactaaggatgaggatctacactactttaaaatctataaggcagaagttgagaaccaacttgaaaagaaaattaaacgagtttggtctgatcgtggtggagagtacttttctaatgagtttgatttattcagtgtggaacagggtattattcatgagaggacgcctccctactcaccccagtcaaacggggttgccgagcggaaaaaccgtactctaactgatttggttaacgccatgttagatacatcgggtttatccaaggcatggtggggggaggctataatgacatcatgtcatgtcctgaataaagttccaacaaaggataacgagatcactccttatgagaagtggacgaagagaaggacaacactctcgtacttacgtacctggggatgcttggcgaaagttaatgtgccgatccccaaaaagcgtaagcttggaccaaagactgtggactgtgttaatttgggctatgctatgaatagtgttggctatagatttctagtagtgaaatctgaggtacctgacatgaaggtcggtacaattatggagtctaaggatgctacattctttgaggacattttccccatgagatatgtacaaagcacttctagacaggaatctgaggagactcctgaacctgccatttcgatggaatattatgaccaaacacatgatgaaaatcccgaggaggataacgaggaaacccttggtaggggcaagagacaaaggactgcaaagacctttggtgatgatttcttcgtgcacctcgtggatgatactcccacctgcattgtcttagcgtatgcctctccagaagctgactactggaaatatgcgtcccggttccagttcagaaccatcagcatctccggaacatgagagctggctgactgtccctagtagcaagatgaattccatcttggctaatgggacatgcatgggagatcactgatcgtccttatggt

SEQ ID NO: 34492 - DNA, 724 bp, Triticum aestivum
  Clone ID: PAT_TA_34492
tctagagatcatgtcagttgatggtgacatgcctactgaggttgttggctccagctggtctttatgtcccggatcgacaagagaacttcaaaagcggcgtaatgaggtggcaattaacgggtggctgcaccagtatttcgagtcagttgtttcaatgtacgaggacaggtttgagttatatgttctatgcagaagatcatgcaagaacacagcagataatcgacctgataaaactaattggttgactaatgcatttcgaaagccttcgacatctactcgcctggattatgtttgcataagcccattttctcttccagtgagaaggacaaaggagctaagagctctgactggatggaggtattactacagccttttcttggagttgtcggatattgcaatgccttttgcacgggcagtcgtggctagagtcagcgctgcggtgtcctacttctgggtgtccatgatagggagatctttggggctcattttttctggtataaggcaatcgctgggctggaaatgaagtagtgtttcttcagctttcattttgacaatatctctattcagtcttgtcacctgttactctcaaagatgatttgtcttgtgctctttgttgtagtgtttcattgcgggttatgtatatcgtgctcgccccgtcgcatcgcccccacaatacaacacacgtgataatcagccgtcctgtgccgtgactccctcatacacc

SEQ ID NO: 34493 - DNA, 1575 bp, Triticum aestivum
  Clone ID: PAT_TA_34493
gaattcagcaataaataaagataacccacccagacaagcaaccaagaaaatccccccaatggatcatcgcctcgtggccgctctcctcgtcctcctgggcctcctcctctccccggcgccggcagcggcggccgcgggggacgaggagcccctgatccggcaggtcgtcggcggcgccgaccccctcgacaacgacctggagctcgactcgcagttcctcggcttcgtgcagcggttcgggaagacctacagggacgcggaggagcacgcgcaccggctctccgtcttcaaggccaacctccgccgcgcgcgccggcaccagatgctcgacccgtccgccgagcacggggtcaccaagttctccgacctcaccccggccgagttccgccggaccttcctgggcctcaagaccacccggcggtcgttcctgcgggagatggccgggtcggcgcacgacgcgcccgtcctccccaccgacggcctccccgaggacttcgactggagggaccacggcgccgtcggccccgtcaagaaccagggttcgtgcgggtcgtgctggtcgttcagcgcgtccggggcgttggagggggccaactacctggccacgggcaagatggaggtgctctccgagcagcagctggtcgactgcgaccatgagtgcgacccagcagaacctgattcatgcgatgctggatgcaatggtgggttgatgacttcagcctttagctatctgttgaaatctggtggccttgagagagaaaaggattacccttacacccgggaaggacggtacctgcaaatttgagaagtccaagattgctgcttcagttcaaaacttcagcgttgtcgctgttgatgaagaacagattgctgctaaccttgtgaaatatggaccgctggccatcggtatcaacgccgcatacatgcagacatacatcggcggagtgtcatgcccatacatctgcggcaggcacctcgaccacggtgtccttctcgtcggctacggggcgtccggcttcgcgccttcccgcttcaaggagaagccctactggatcatcaagaactcatggggcgagaactggggggacaagggttactacaagatctgcaggggctcgaacgtgcgcaacaagtgtggcgtcgactccatggtctccacggtgtccgccactcacgcctccaaggacgagtaggctctggtctgatctgatctgatcggcggccctcctggtgtcgatcttggtttcggtgtgtgtatcgctagaaagaaactttaatacgtagtagtcggctaggctccatcgtcgttgtggtatcagcagcgaagatgcgaagtcgcaatagaatgcttgctgtataacttatgcatttgctaaatttgctacgccatgcatgtctgccacacgctatttggatgtggctaaagaactcctgaataattctgtacataatttgtattgcttccatcagaatggtgttccgtctttgttggctttgcttgcgaggtacttcctatgtaaagaaattggaaaatagtgccagctgcttctcatttcttcaaccagtaattgtact

SEQ ID NO: 34494 - DNA, 817 bp, Triticum aestivum
  unsure (1)..(817): unsure at all n locations
  Clone ID: PAT_TA_34494
ntccgcccaagcacccacacaaagaacacaacagcacatacacacagcaagcggaagaagcttttttctcgaggagcggcgaggatgcagacggccaaggtgaaggtgaaggacgcggtgagctcggccaaggagaaggcgaaggagggcacggccaaggcgcagggcaagacgggcaaggccacggcgaccacgcacggcgagaaggagatggccaaggaggagacgcgcgccaacaaggcccaggccaaggccgagatgcaccaggagaaggccgagcaccgcgccgaggccgccgcggggcgccacggtgccacgcacgtgcccctcaccgggccgcatggccaccaccgtcccgtcggcgcggctcctgccgccgccgaccctgcgtacccgggcaccggcgcgtacccgaccacggacaagtacgtgtagacgcgagatgatcgggggatcaggagctggcagctagtgttttttatgtgtggctagtgatcctgcccgtgtgtcgtaggtggcgcgcgcgtgtatgctgtgcccacatgcgtgtgcccgaataaaatgtatcggtcagttgtaaaatgcacctttgatgtactagtaatttgtgacttgagcgctaaaaaaaaaaaaaaaaaaaaaaaaaaaaaaaaaaaaaaaaaaaaaaaaaaaaaaaaagggaaggcctctaaaaaaaaaaaaatctaaaataacccgaacaagaaaagaaaatagctttttttttgtaaaacctaaattaaattcagtgccctgggggtttacatctttttgactggaaaaaccatagcgttaccca

SEQ ID NO: 34495 - DNA, 678 bp, Triticum aestivum
  Clone ID: PAT_TA_34495
gcacaccccaagcacccacacaaagaacgcatacacacagcaagcagaagaagcctttttccgaggagcggcgaagatgcagacggcaagggtgaaggtgaaggacgcggtgagctcggccaaggagaaggcgaaggagggcacggccaaggcgcagggcaagaccggcaaggccacggcgaccacgcacggcgagaaggagatgaccaaggaggagacgcgcgccaacaaggcccagcccaaggccgagatgcaccaggagaaggcggagcaccgcgccggaggccgcggccgggcgccacggcgccacgcacgtgcccctcaccgggccgcacggccaccaccgccccgtgggtgcaggtgcaggtgcagcgcctgccgccgccgaccctgcgtacccgggcaccggcgcgtacccgaccacggacaagtacgtctaggtgtgtgatgaccgggatcaggagctggcacctgttttctttgtgtggctagtgatcttgcccgtctgtcctagttggctcgcgcgtgtatgctgcgcgcacatgcgtgtgcccgaataaaatgtatcggtcagttgtaaaatgcacctttgatgtactacttttaatgtactagtaatttgtgagtccagtgttctagcaaaaaatcataaaaaaaaaaaaaaaaaaaagtacttga

SEQ ID NO: 34496 - DNA, 622 bp, Triticum aestivum
  unsure (1)..(622): unsure at all n locations
  Clone ID: PAT_TA_34496
cgccagtggngngttaancgcnncttagggaattgggnccgccccctttttttgngcaaaaaggggttcatgatggatgggcccaaaaantaacgggncaanccagtgtataggcttttgcttttgtttagaccaatcatcaacatcattgtctagttgtactgtatatactgcacgaataatccttctgatgaaccgtctgctgtagctacacacaagacagccctcacgacgcaccagccttaactgacctactcgctccttacactagctaatagcactagcacagagacccgaccttggtacagctggtgctggatatgcgcgccttcacttcacatccacacacctcgcctcgcttgccccaccccacacacaacaaaagcatacacatgtacatgcatggttttctccgtttcgcccgcttcttattctgtttcaactttcaaaacatacagctctagcacggctgggctgtgccgccgtgccgtgctccggcgcggcggccgcgatcagtggccgcccgcgctgacggcgcggaactgggcgcttggagatcttgggcagcaggaacacgcccacgacgccgccgaatgaagggcgaaccccgaacgccacgccg

SEQ ID NO: 34497 - DNA, 725 bp, Triticum aestivum
  unsure (1)..(725): unsure at all n locations
  Clone ID: PAT_TA_34497
cgccccggcggcagcaagtaaaccaggtccggcgcagtcgcagaggggaggaaaggaagcagggggaaagaaagcaatcgagggcaggagctaggggctgcgatggcgtcggcggcgagcaggaaggcgccgtcgctggtggtggcggcgagcgtgggcgccgtggaggcgctcaaggaccaggcgggcctgtgccgctggggctacccgctccgctcgctctaccgccgcgccgccgccgcgcccagggtccgcgccctgtccgcctcgctctccgatgccgccgccgctccccggccggcgcctttgtccgcggaggacgcgaagctgcgcaaggcgcaccacctcgtctgctgggggcccaactgagctcctcttctccgcttcatgtctccatcggcacatgagcatacctgatgaatgcctgtgtcaatggtgattgtttcgccagagaaagcagagacgtcattgcgtgcagcgccggtgaaccgctccggcctcggtggaggaggacggttcatcaacgctatggcgcctttgcgtctcttcctcctcttcgtcttgcccactagtagtatctcgttgcatctggctagcctagcttccgtagacgcaagcttttgtcggaagggagatcacccgtcttggtttttgtactagtagtatgatgaggtgtgcgaggggnggtcgatgggttgtactgcggggggagaggtgaccagcgt

SEQ ID NO: 34498 - DNA, 846 bp, Triticum aestivum
  unsure (1)..(846): unsure at all n locations
  Clone ID: PAT_TA_34498
gtnnnnggctcagttttacacttacaagcggccacggcagtggctgtcttcgtccggtttgggtgcaatgggatttgggttgccagctgcagctggcgctgctgtggccaacccaggtgttacagttgttgacattgatggggatggtagtttcctcatgaacattcaggagttggcgttgatccgtattgagaacctcccagtgaaggtgatgatattgaacaaccagcatctgggaatggtggtgcagtgggaggataggttttacaaggccaaccgggcgcacacataccttggcaacccagaaaatgagagtgagatatatccagattttgtgacgattgctaaaggattcaacgttccggcagttcgtgtgacgaagaagagcgaagtcactgcagcaatcaagaagatgcttgagaccccagggccatacttgttggatatcattgtcccgcatcaggagcacgtgctgcctatgatcccaagcggtggtgcttttaaggacatgatcatggagggtgatggcaggacctcgtactgaaatttcgacctacaagacctacaagtgtgacatgcgcaatcagcatgatacctgcgtgttgtatcaactactgggggttcaactgtgaaccatgcgttttctagtttgcttgtttcattcatataagcttgtgttacttagttccgaaccgtgtagttttgtagtctctgttctcttttgtagggatgtgctgtcataagatatcatgcaagtttcttgtcctacatatcaataataagcacttccatggaataattctcagttcanaaaaaaaaaanaaaatataaagatattatataaat

SEQ ID NO: 34499 - DNA, 588 bp, Triticum aestivum
  Clone ID: PAT_TA_34499
agtgtcggcttccgacgattagttggctatggtgaggataatttcattgcaacgtacatcgacagtcataaggacactgttcctgggcttgcagatgcttatgcagcggctcgtgctggggaaatgcttctgagtccagccttgaatgcagacattgaagcctggagaagcggatgaaacgccggtattatgtcgcaaagatcctgcaggctaagggactgatgaagaaaagtgccggcttccggcgattagttggctatggtgaggataatttcaccgtgacatacatcgacagtcacaaggacactgttcttgggcttgcagatgcttatgcagcagctcatgctggggaaatgcttctgatgtccagctttgaatgcagacattgaaggttcatcctgcctcatggctagctggaacattgtgctctgatacacatgagtgagtgctcgttcatggtaatgccttgtcgaagcatgattgtagctcaagaaatcatgattttagccgcagaactatagcaatctgattgctcgtgatgcgatccatgtttcagttgtgaaaaaattctggggaaggaactttgat

SEQ ID NO: 34500 - DNA, 1605 bp, Triticum aestivum
  unsure (1)..(1605): unsure at all n locations
  Clone ID: PAT_TA_34500
ngatgctnttcccnacganacnttgtttcntcccntcncacatcagnactcaangtangcgctggntcatantcaaagctcaaggggttctgctaggnttggngatcantcattantccctccantgcctgngtcaagtaacatnggttctgcntcaacacaacggcgcctgcaaagtcttgctaacaacacacttgcatcaaggctgcaacaacgtagtaagggctccgtgaaggtactatattctgctcagtctcaaacaggtgaaaatcctgagatagtacctcatgtttccacttccacccagacatggcctacacctgaccaaggggctacatctctctgggttcttctcaacttcggattgtaactcaatcaacaatgagataatgggctcatgccatctgcctccagcggttcagcatgggattccagagcttcaaacaagatgaagcactccatttcgacccctaattttgttcctggtgggtcccctgcccaggcatcatcaagtacagcttacggcaattacaagcaactgccaccacattccagccaacctttgcctgttgtggaggatgtccgaccagcaaacccttcccttgtggaaagaatgcgtgttgcattaggaatggatgaggataggttctccgcgttcaaagaaattgctagtgaataccgtcaaggcgtcattgatacttcagagtatctctcgtatgtggagcagtttggtatatcacatcttgttcctgaaatggctaagttgttgcctgatcctctgaagcagatggaacttgctgatgcctattacaccaacatgcgttttagaagtctccaagaaaacgacggttgtggaaccattactgtgaaagagaacaagcgtagaaataaggggaagggaaaaacacctgatgcagaaacagctcctgctaaggatgcaagtgaatcgctagctgatagctttatggacactgtaaggaagcttcagttgaacaacaaggctcaagaaggagaggctgcagtgctttcgaaggatgggtatcgatcttccaaggaaaaaatcccactatcagctggagggtcatcctgtggtacaaatatgggtctagacggtgatccagttgccatttcaaaggcgtctggcactagtaggtatgtgggcaagggtagcagcagcagtaacaacaaacaatcgaagaagacgtcaaagtttctcagagctcggttgggtgacaactcattggctacacttgattttagtcatcctgatgtgagccctgaacgacctgttagggagacacaagtccctgcaaaactggggttgcctgtgccaagtgtgtggtgggatggtgcagctccgaacctcttctccagcaatggaaagaaatagcatcattttgtgcagacgtaatttgatccattgagctggttggcaggaaatgtgcacattttgtgatgtgtgttttggctgcttggagaaggcgccgtctatttagaaggtcgcttcgtttgagtgaatttgctggttgaaaacctcaaaagtgaggatggaacttgaatagcttggctagctatacctttgtcaaagtgtagactgtatnnnnn

SEQ ID NO: 34501 - DNA, 1331 bp, Triticum aestivum
  Clone ID: PAT_TA_34501
ttcgaaaaacccatttaagcttctaccaaaagccacggcgtccctctaacgcttcttctttgtcaagcccttctttggggggggttttgttccagctctttctttggggcgggctttgcccctcccttggggctcccttctctgcgccgttcgctctttgggccagcccaggctccgggggctactctgtttcggacccatcgactgccgcccccggcgctgcgcaatgggattcagcgcctgggtgctcagggtcaactcgatccacagcagggtgccaatccttctggagtcgtgcaacgggcaactcctactggcgtggtgcaaggtgcaaaccctgctggaatggtgcaacgtgcaaatcctgcttgaatggtgcaaggtgcaaatcaagctggaatggtggaaggtccaaacccgtctggaatggtgcaaggtgcaaatcgttctcgaagggcgttcacctgggatccatgtctgcctttctccggttctggacatactaatggacctccagttcatgcattttttccaggtcacgtttacaatgggagtctaagacttcttcagcaagctgctatggcgactatgtcaacattttatgatgcaatacatcttattgacgaacaatgggatatggggctagatatagacggcatgacctatgaggagcttctagcattgcaagaacagattggagatgtcaataccggtttgccagaaaggtacatctgtcaaaatctgagggtacattggtatgttgttcccagggcagctcgcgggtccgatcagtctgtggagaaggatgcttgcattatatgccaggaggagtttgaggcgagagaccttgtaggagccctcgactgcggtcacaagtaccatgaggtgtgcatcaggcagtggctgatggtgaagaacttatgccccatctgcaaggcaacagctctgccagcagagtgaagcagcgggtgtccgccgcgccaataaatcatttgccgcagcagtgactgagatgattcagctcagtttcttgtacataagagatgttggatgatttgtgttatttacctgtaatttcctgttcggtttgttgtggacatagcctgccccaaaactgtatagccagaatgcatggtttcatttcctagactgctcttagaccccccatggtgcctgaacttctctcatcatggctttcctagattgtctgccccttttatctatttgtacattgtaattaaacctatatatttccctttgccaaaaatcagagttgagaactcaaatggttctttcttctggatgttcaataaaaaaaaaaaaaaaaaaaa

SEQ ID NO: 34502 - DNA, 871 bp, Triticum aestivum
  Clone ID: PAT_TA_34502
cccacgcgtccgaggctcttgaaatgggtgctgttgagactctgatagtgtgggagaatcttgacatcaacagatattcgctgaagcacagtgtctctggggaaattattgtcaaacatttgaacaaggagcaggaagcggatcagagcaatttccgcgatagtgagaccaatgccgagttggaagttcaggaaaaaatatctctgttggagtggtttgctaatgaatacaagaagttcggctgtgcgcttgagtttgtcactaacaagtcacaagagggatcgcagttctgcagaggattcggtgggattggtggtctgctgcgctatcagctagatatgcggtcttttgacgaggtttcagacgatgaaggtttgtatgaagactctgattagcaatcagctaatcaaatgattgtgctggcccatggaaggacgccacagctcggttttgctctacttacgcaagaacacttcaaagacagctatccagagattgatgggcatgggccagcctcaaactttgccgaaggagttcaagacctgatgattgagatgccgtcatcatcatcatcatcgaagtaacgtgttgagacgataaccggactaaaagctcgttatgtttagtcgtcttattgtgcttctgttaagtcagttgtgtagtgtcgtatgtctattgtcgtgtctctagggttctgagttagtgtctgcttttaatattcagcgtggtgaatgaagtcgtataaatattgtgtactactgaagtagttcttactcccgctgtttttgcaacgaagacattgttttgctacaaatattctactgtcttagtcttactgtgtgatctcgtgccgaattcggctcgagctatc

SEQ ID NO: 34503 - DNA, 1451 bp, Triticum aestivum
  Clone ID: PAT_TA_34503
gaggaattcggcacgagggaaggtaaagaggaagtttctagtccccttgctgacgaggagacacttgagaaggcaacaacagagaatgtttctagtgccactgccgacgaggagacacttgagacggcagcagcagagaaagtttctagtgctcctgccgacgaggagacatctgagacggcagcaacagagaaagtttctaatgcccctgccggtgaggagacacttgagaaggtaaaagaggaagtttctagcccgcatgctgatgaggcgatacctgagaaggcggcagagaaagtgtctagtccccatgctgatgaggcgacacctgagaaggcagcagatgaggtttctagcccccctgccgatgtggagacacctgagaaggcaacagagaaagtttgttgcccccctgccgacgaggagatagctgagaagccatcagacaaagtgtctagtcctcatgctgaagcagagatgtctgagaaggcagcaaagagctcacctgctccatcagagccgccggtggtgtgtgatgatatgaaggacaattactggtctgacattctcataaacgtggaggaaccgctgtctagtctggcaaagaagaaggacaagggcaagatgagatcaagcaagaagcagcggcgtgacgacgagatgaagcaagatgagatgctgctggcagaggcagagaacgggaaggcgaacggggccgaggaggacgtgtcgctgacgggcctggtgctgcacttcagcaagccgggcgcggtgccctcgcgtggcgacctcatcgagatcttcagccagtacgggcccgttagcgaggcgaggacggagacagacgagcactccagctcggcccaggtggtgttcaggcggcgcgcggacgcagaggcggcgttcggcggtgcgggcaagatcgtcgccctcaggcccggcctcgacagcttccgcctcaccgacttcccgtgcgccacggccgcgttccgggttgaggacgggccgaagcaggggtgaacagggctgctggaggtgaaggagagaggtgaagaggaggaggtgtttgttatttaggtggtggtagctttctggttgtgttaaaaggaggagtaagaagagtaagagtaagaaagcaaggctttgtggtggtctctttttggagatggtggcatggcatgctccctggatgctgatgctgatgctgagaggtgtttgttattaagtactccagtagtaagatgtaaaaagactatggcatggttgcatgtgaggattggatgcatgttggtgttggtgtaaaaacctggtgactttgttggtaccttacctgaaagtctgtctgtgttgtgttgtgtgtctggttgagttgtgtggtgaatgagagtgctattggttgggggtcactagttgttattgttggtgttgtggttatgtttgtagcaaaaaaa

SEQ ID NO: 34504 - DNA, 1308 bp, Triticum aestivum
  Clone ID: PAT_TA_34504
caacatggagagatttgtgatgttcatggacaacctactactgcgccgtggtttggtacctctagatagcttttccctcatgggctggagcgatgatttttcccttaaccatcccagagctaacctgtgggtctgccacgcccttaggagcaatgtccgtgtgcttcagatcttcagccgtaaattatttaatcttgagtactctcccttcatttcgtcgcatctgaaaatactcaatctccgtgatgtttccatcgctgccctcttcattgagaagctcttttctggctgtccgcagctggaagaactatcattggtagactgtcgtgttcctgccaccaagttctcctctaggaccctgaagaaattaacatttatcgcacataccccctatggtgctgatgatgtccatactgattttgaagaccttgtcatagatacccctagtcttgtttcgctgcatctggaggacattccgttgttaactccttgccttgtgaatgtctcatctgttgtcaaggcttcatttcgcctggatgaagaatgtttctcgagtccttatgtaagctgcaatattatcagtgccctgtcaaatgttacgaagttgaagttgttctttggacttgacaatgaaactgcaagcaaggttctaagaagagatctctggaggtgccaggcattcaacaacctgaaaactttgtctgtcagtggctggtgcatagatgttgacctccgtgcactggtctactttcttcgacgctcacctgccttagagaaacttactctgtgtctcagccaggctagagcttcagacaggcttcgccgaagggacaacacagagtccgaggaaacaagcacatcgtttaattgtaaacatctgaagaaggtcaagatcagatgccctcagggtgacaaaagggtgggcaatattctgaatgtcatacttgctagcgcctctctcccggaaattgtcatcaatccgtacgagcgctgggatcctttggagtagggagatgtgcacggcccatgcgttattaccgtggattagagcttctgatggttggcaagtgttgcttccgatttgatgtggaagggctttttaatgtttgtgtgctcttctttttgcggggaatgtttgtgtgatcatgaggccaacaaattaatattcctgtaactgaatctggatatgtgtttcactttccagaggcatatgcagagaaatttgatattagagttgtgtttgacattattcgggattactgtaatccccgcgtttgaaaaaaaaaaaaaaaaaaaaaaaaactcgag

SEQ ID NO: 34505 - DNA, 1320 bp, Triticum aestivum
  Clone ID: PAT_TA_34505
gtgattctttccatcttcagtcccttgggaggactgttactaagaataatagcttgaagcatgcgcctggtattggacctgttgttcctcaagaatgcagcgactgtggaaagaaatttaatgtgggtggtccaatatggtctgctcctattcatgatcaagattgggtactttctacgctgacagatgttaggcaaatgaaggatagatatcccgcatacaacaaaattacttcagttctaactactgtatcagaggaattgcatgacattccattattttttagtctccacaacatatctgggactgtgaagtgcacatcaccatctgcagttatgttccggtcagcggttataaatgcaggatatcagatctcaagcagtcactgtaatccgcttgggttgaagtctgatgccccctgggatgttatttgggacatcatgcgctgctgggtgaaaaaccatccaatcaaggaacagccgcgtgactctccgggcactgcaatcctttctaaatctccacagctagaagcaaatttctctagagcagttgctgccctcagcaaggctcaggttaagaaggtgaatcggttccttccaaacccagaaagtcactggggtccgaaggtcagagcaggtcggagaattactagcaagcatatctctctgttgggcgcagaggctctcaatggagctatcagccaccaagatggaaatggagcggtgacagataagccagcttcatgatactggagcgactgtcacgaatgaagaagagaatgagccttcaaccaaacgccagaaaactggcgatggtgaacaggccagcgaaccttgatcgacatggtcatctaaacttttgttcgttaatcttgatatcactagttgtttctttcttgtgacccaacagattattgatattacctacggtgacatgttttgggcagtgaattttcatcagggcgataaggtcagagcaggtcaggagaattactagcaagcatatctctctgttaggcgcagaggctctccatggagctatgagccaccaagatggaaatggagcggtgacagatgagccagcttcaagatactgggagcgactgtcacgaatgaagaagagaatgagccttcaaaacaaacggcagaaaactgggcgatggtgaacaggccagcgaaccttgatcgacatgggtcatctaaactctaaacttttgttccgttaaccttggatatcactagttgtttccttccttatggagccaacagactattgatattacctacggtgacatgtttgggcagtgtggtggttgaggga

SEQ ID NO: 34506 - DNA, 869 bp, Triticum aestivum
  Clone ID: PAT_TA_34506
cggacgcgtgggcggggatctcatccatcacacaacacacaacctagctagctactggaaggtacttgtacttgctgctgatcaatcttgcacacccagttgaaggtcgacgagggtgccaagcatggcgtccaagggtctcattgtggtttctgtcctgcttgctgcggctttcctcgtggccacagctgaacaaactcaggccaagaaggaggagacccaggcccgtgttcagggtggctaccccggcggcggtggcaggggcggtggctaccatggcggaggcggaggcggcgggtaccctggacacggcgggggcggcagcggcggcggctgcagtcaccgatgctgcgggcacggtggctgccactgctgtgccggccccgacgagatccccaagcccaagtatcgggcggaggtccgcaactaagtgccggatgcagcagcgtgcatgggtagtatagacttgctcgttgcacgcacgtagtaatacatggtgaataagaaggtagtgcatgtgtatgtatgtacgtatacgtacacattgcactgttatcatgatccaataccaggactccgttctggtcgtgtttttgtttaccctgtaagagttgtctttgttgctcaatatgcaggcaactcccgtgcatgcatgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaagaaccaaagtttacttccgggggctgggaaggtaatagtttttttttggggccc

SEQ ID NO: 34507 - DNA, 1819 bp, Triticum aestivum
  Clone ID: PAT_TA_34507
gcagcaagtacaacacacaacctagctagctactgatcaatcttgcacacccagttgaaggtcgaccagacgagggtgccaagcatggcgtccaagggtctcattgtggttgctttcctgcttgctgcggctttcctcgtggccacagctgaacaaactcaggccaacaaggaagagacccaacccggtgttcagggcggctaccctggacacaacggaggcggtggcggcggttatcctggacacggaggaggcggtggcggcgggtaccctggacacggtgggggcggtggcggcggcggctgcagtcaccgatgctgcgggcacggtggctgtcactgctgcgccggccccgacgagatcccggagtccaagtatcgggcggacgtccgcaactaagtgccggatgcagcagcgggttctgccgctgctcgatcttgcacacccacccctcggtcgacgcctggcatcccaggggctcgtagcgcttcctgtcctgcttgctgcggccctccgcctggccacacctgaaccaactcagggccacgaggtagagacccatgccggtggggcacggtggcgaccccgtcggcaggggcggttcccagttggcgcggcacccgcaccagcggctcgtgccggagggctactagccgccccggccgcagctccggcttcaacggcttcggcggccgacacgtgccgctaccctgtgccgctatatatgggggggtggctttttgtttcgtgctggagtctgttgggtgattgtggagtgtggcctgtactatgcttggttgtcccgctcgtatagtcagaggtcgtattggctgcgtaatgtgtaggtactgcccggggcaatcatatgtcttcacctgcacacgtcagccttcatccaaataccggcacctccgccgctggcccaggggtggttcaccgtctacccccgtcagacgtgcccgcccggccgcactgcctccagcagcccctgcgtgccagtcgcccgaggcgccgacgcccggggagaaaccgggcggaccggatgccgccggtggtgaggcggaggcggagggaggcgaggatggcacccgaggagctcccagcgatccaggtacaagaggggcgccgcacgagggctcatcgcgtgccgccgagcagcgcgcccgaaggtgagggccgggttgacgtgacccccggagactgttcacggctagcggacaccgccccggccagcgccagcgggtgtgccagcgccacggccaccagcccgcccgccgtgctcatgtcatggtagagcttcccgagggagaggatggagccctcggcggcgaagacgatgatggccgtggcgcggaacacggagatggcggcggggtcgtgtccccgtgactcgcgtcgcgctgcgccccatgctgaacccccccagcccgtcggccgcgccgcctgctcttctcctgaccgacgtactaggttcccaaagcaagcaatcgggcggaccgctggatcttggcactgaactcctctgcttgcctgcgtaggatagacttactgccgttgctcgttgcacgcacgtagtaatacatggtcaataagaggtagtggatgtgtatgtatgtacatatacgtacacattgcacagttatcctgatccaaaacacatatggtcgtgtttttgtttaccctgtaagagttgtctttgttgctcaatatgcaggcaactctcgtgcgtgcatgttataacaaaatcttgggggaggctctctgggaaattggaactagggtggcgctcagggcttcttatctttagctcgatcgaagg

SEQ ID NO: 34508 - DNA, 1032 bp, Triticum aestivum
  unsure (1)..(1032): unsure at all n locations
  Clone ID: PAT_TA_34508
attttattgggnttttttttttttcaaaattaaataaagtagtttattgcacataggtttaatacaggcatgatgtacacactgctaggtagtttggaacacatgcaaatgtagctaggtatacaccggtgggtggcatatacaagccagtacacatacacacagtactagcacaagaaagaggcaaagccaagccaatcaatgcatacaagctctcttctcacgcacaaaaataaaatgcggtgcaaaccaatatatataggtggtggtatgtatcgatcgatcttctgatggtatatatatattagtgcttggatcatttgtttatcagtacttccatatgccatccgtacccatgttcactgacgagatctcatcagcagttgttgcaacgtcgttgctgctgaacctggccaaagtgtcctcctgcgacactatggatgacggcccgctcccaggctcgaccccgatcatgaggccctcatctgcacctatctgcatctgcatcggcatttgaatcatgtgttgttgttgttgttgctgctggtggtgggtcatggtggtagaacgacaccaacggtcgtggtggggtagccatattctggtagtggtggttcccgaagtagtggtcgttcatcatcgggagcaccgcactacccatcattgacgatctggccccaacgtcatgcagctggtacgaagaagatgtaggtagggacgatgggggcaccagggatgatgatgcaccatagcccatgaaaggaggtaatgtaccggattcaaggaaggcatgttgctcctctgctcccatgggcattgacatgggaatggcgtacgacgacacaactaccttcttgagtccagtgctcttatggaatatcctgcaaaccacatactcctccttggaagatgcattaatggctgtggcggtggtgatgtcggtgggtagaccaggtgttccttgttttccacactcgagcctatactcgtgcatgacccagttggtcttctccccccttgcccacgcgtccg

SEQ ID NO: 34509 - DNA, 754 bp, Triticum aestivum
  Clone ID: PAT_TA_34509
tcttgaaggctcaactgaaggaatatacaagataattcgacctgctattggtgaagcattaagggagatgcctttgagtgaactgaagggcaagtacaggaaggtgtcatcaatagacaaagttagcaaaggttggcaggatgaatatgatgtttcatcgaaacagtgtatgcatggatccaaatgcaaagttgggagctactgtacagtaggaagaaggctgcaggagtttaacattttgggtggtctgatacttccagtgtggggcacaattgagaaggccctagctaaacaggtttatcaaaatcacaaaagaatacgtgttgtccgtttagtgacaacgaatgacaatcagcggattgttggactattcattccgaatgcagcagtggagtcagtactaacaggcttgcaatgggtccaagatattaatgattgacatggaaatacttttatttctgacattcatattggtggtgttgatcacatggctgatgttaagaagcagcaggtttcagaggcttggcacatttaattttgtttctagggagctgcctagccaatctgtttaatttatgggagttcttagcttagtaattaggcgagtaaatactagcaatatctgtgtgtaacatatgcagtgtaccatcagtggtggtctcttgtttgcacttggtttatatcttgtatattgctatgtaaagcaaccaaaagctcaggtaatctcaaaagagctgcctacccaatctgtccc

SEQ ID NO: 34510 - DNA, 830 bp, Triticum aestivum
  Clone ID: PAT_TA_34510
attgaaatggaacgatgctgtgagaatacttataatattcagtcaggtgatctgaatgatacaatgagtttattgacaagctccgtaaggtgctctctgagcacaatgatgctaagaccattaaagaccgtcctgttctggagaagcaaaggcctggagcacagccatcaagatgggtgctaatccatctcgtactaggggaggatttagtgttgattcttgctgtcagaggagacaatgtatatttcgtgggtttccagaataaacatgggaagtggtatgagctaggttatagcaagcagccggatagctacaacattggtagtgttcaactcatcccagattcaaccttcttagaagccggcaccagctatgccaacatggtgtgtggcactaaattcagtgatcccagacctgacaatgaagtggtaaaaatagccatgtgccaactgaacctgtcgccagaaaatatgaaggatgatgcatctttgctccttgactaccctgatgtgcgttggcttactgaccacacacatgatacatacttggcgtctgtcctacgtgcgtgtgctggaattgcactgagattatgcgagccaacaaggctctttcataatcatgatcctatgaatatcaactgggcccgccaacaacggtttaacttgattggaaagttagtggattatatatggaactggaagcatatttcaaatggaatgcatagctggtcccgtgatacgagctttaactggtcagaaaagagattcttggtggcactcggaatcactaatatagagttagctgccgctgctgtagcgcttattttaaac

SEQ ID NO: 34511 - DNA, 755 bp, Triticum aestivum
  unsure (1)..(755): unsure at all n locations
  Clone ID: PAT_TA_34511
caaaaggagaagcaaaagccatgtttctgcgtcatgagggttttctaggagcacttggcgcgtttatgagttacgagaagcatggtcttgatgacttgagtgcacatcacttggttgagcgttttccaatgggtgctccatatgttggtgggaagattcacgggcctcctctgggggatctcaacgagaagatatcatggatggagaagtttgtgcagaagggtactcagattacagcacctgtacccatgggagctcctgctacgacaggcatgggaggttttgaaaggcctacttccaagggtgacattttgcggtctgatgcaagtgcggctctaaatgttggtgttctccatcttgtaccctcattggatgtcttcccattgttggaagacccaaagacgtatgaaccaaacacaatcgatctcgaccatgacgaattcaagtactggttcaccattttgtcagaccatctgccagatcttgtggagaaggcggttgccagtgaaggtgggactgatgacgcgaagcggcggggagatgcgtttgcgcttgccttttctgctcttttggcgaggttgtcgtatgggccttcggtaaccacctttgggttgnaaaaaagttgnaaaattnantttnnnnctttttntnnaacaagggaaaagaacttcctggtgttacnnacaccnnngacttnntttgngngaaaaaaatnttnctaattagggttttttgnanaaatttntgggggtaaa

SEQ ID NO: 34512 - DNA, 710 bp, Triticum aestivum
  Clone ID: PAT_TA_34512
ccaccaccaccatgcctctgtcgccttcgacaggagcacacttcagcccaacaccgtctcgacgcctcagtggccgccgtcccagcacccgtttctgatgcagaggttctctgctgctccagccgagccttcgcctatgtttcccttctttcttggaggcaacagcgcttctgctgctgctcctgccgcggccaatgcgccggagcggaggctgcagctctgggacttcaaggaggaaaggaagacataatttcttcttgtagagattcggcggtgtatcaacctaccaagtcatgatccattcagcacagaaaaacccagaacgagagaagatgcaaggcaacgaaggagtcggcgccatggagccgcgtggaatgcaatcgctttgctggatctccgaatcttctccgcgcggttttcgttttgccgttgtcatcctctgacctatgtttttgtgattggaaaccaaatgtttttgagctgcactctgttgctgtgccctctatctttctccttactaaaaagatgtttttttttttaactttttggcgaggaacagaattttccgcttgcatggatgctgggggcgtgtttcgagtggcattagaattttacgtgtacctgggggcattagcagatggtaatccaaacatgaatgattctttcatctgatgattatcagtcttatcacaaaaaaaaaaaaaaaaaaa

SEQ ID NO: 34513 - DNA, 893 bp, Triticum aestivum
  Clone ID: PAT_TA_34513
ctggatgcatttattgtctcgtgtcataaggatttacaagttctgcgagaatgcgcgaatagagtgtattacaataaccttcgaattattgtgtatgatttcactagacagcgattgatcattccagatggttcacttcctacaacagagcaccctacagtactatcagttattcagtcagagaaccacactgtgctgaatgtattggtagatcagggtcacgctgaaaggcaggtcctggttcgagattatgaagtcggaaaatctgttgcatttgatcacaggatgcggaatataaaggaagtctatacctctgatgggttcagaatgttttctagaggttctgttcagactattcttcctccaaacaaaaggccaagacctgagcgttggtgcagttcacctgcagaaaaaatagctgaactgaagaatgaagttgacggtattcaaagaataatctcggaaaagaatgctcagagaaggaagttggttaatgaccgaagtaaccttgaacagaaaatagcaaatttgaagagaaaacgagaacctgaggagcgccatttaatgaataaaaaagtgcaacttgaagacggaaggagagctactgctgaaaataataggcatgctgctgtggacaccactgaactagaggaggacataaaggaagagaagaataacattgagcagaaagaactatcactgcagaagactaatgtgaagttaacagcagctttacgagaagtgaatgatagaagaacggcattcaagacctttatggattctgtgaatgaggagagattacattttagcagcgcaaatgatgaactagatcttgttaagcgtaaaatagatgcagctcagcaggagaagactcactatgaaggtgtcatgac

SEQ ID NO: 34514 - DNA, 511 bp, Triticum aestivum
  unsure (1)..(511): unsure at all n locations
  Clone ID: PAT_TA_34514
tatacgatcatataggcgattggtacgggccccccttgttcgctgtctgtnttcantgatttttccaagagtgcngacgtcagcaaccgttctactggcgttaagggtcnagtctgtcattgcaagttagcagcagnccaaagcttgctcagttatgtgtgttcctgtacagaacgtgatgccgtaggtaaatattcgtgagctctgccttgcgagacagtccaaggtggcaaaggcttgagctgtgtctagtttcgtgaagttgttagatgttgccctatcntaatgggtgtaagatggaagggcctgggaatatctttgttcatacagggcagtaactggaaatggcaccacaggtgggcaacaaacgaaatctcctttttgttttaatttcctttggcaatggacttttggaatctctagtgggattgtaactgggatcgagaaagtggccatagtggcggcagtgctgtacaaaggcttgtctgctatatagtgatatatttgaaca

SEQ ID NO: 34515 - DNA, 1187 bp, Triticum aestivum
  Clone ID: PAT_TA_34515
acctcacgtcgatccctaaaaaaataacctcacctcgcctcgccgccgccgccgcgcacccaaagcctcgccggcggggacgggagcacctcaaacgggcttcctcgccgtcactcgcttctcgtctgattgagtgcctcctctccccacggcgatggcggacggatccagggacattagcaggcggcggaatccggcggacaagctcaccgaagacctcctcgtcgagatcctgtcgcgcgtgccgtacaggtcgctgtgccgcttcaagtgcgtctccaagcggtggcgcggcatcatctcccaccccgaccaccgcaaggcgctgccgcagcaccatctccatgacctcgccggcttcctctactcgagccgcggccccagcactggctatttctcgactcgcaatttcacccatgtctccgcgggaggccgccctcctatccgcccttcgctccccttcctgcctgactgtcatcaggttccacctcctggacagctgcaacggcctactcctctgccgccgcttcaagacctttggtgcgggggcattttattacgtggtgtgcaatcctgccacggagaaatgggtcgccttgcccggcatcttcagcaagatgcagacagctcgcttggggttcgacccggccgtctcctcgcacttccatgtgttccagttcgtggaggatggggctgcagatgcaaatgccaacgatgatgacgatggttacgagttcgtcagaggggttgatatctactcctccaaaaccggggcctggagtcacaaggacaccggttgggacttcctacctaggatagtgagtgattctagaagtgtctttgtcaatggttttctgcatttgctcgccgtcgagtctgcggtggtggcagtggatgtggagggaactacttggagggctattcctatgccggacgatgaggacgcccccataatagatgttgatgacgggttcattgacctgtctcgagggcgtttgtatctggcaaatagtgatcagcacgatctttataaactctcgatctgggttctcgaggactacggcagtgaagtgtgggtcttggaacacagcgtcaggtatctgaatctatttggagtgaaaaatgtccggctaggacacgagtaccatattggcgccctccacccacaaagaaacacaattttcctg

SEQ ID NO: 34516 - DNA, 1126 bp, Triticum aestivum
  Clone ID: PAT_TA_34516
cggccttgggttgggggctaggctggaagccgaagttcatggagttgaggtttctgaacataaaactgagagtgttgtcggagatgtggaaccagttcccgagcttactgaaaccatggggcatactggtgagtcagctcctggacctggaatgatggatgagtttgtccctggagatgctggtcgagaagagcctcagggtgatagccacgatatggcatctcggttagtgggtcgagttgacagtggttcaactaaagctgattcggtcgagagtggagagaagatgagccatgccagaggccaggagagtaacatacaacattccctttcttgcaatgcaagagtttattctgggattgatttatctaaagatgaagtgactcagactggtaaaatgctgaccaaggacgagtatgacccaggaaatgatcttggagcaacggatggagagaatgattatgaaacgggtcttccagaatttgatccaattaagcatcacaacaactattgtccatgggtaaatggatatgttgccattgcttgcactatgaatactggttccagcacaaatagtgcagcattttgtggctggcagcttacagtagatgcacttgagactgtccagtctcttggccagaaccaatatcaagccatgaggtctgattctgcggcgtcactgtataaggatgaccatgctgcacctagccacaagctgctgaaaaggccaaaacacagcaagtgctaactgaagcgctgctggtacatgcgtacattcgctaaacttggatacagctcaaaaatagtttgactgatgcaaatctgaagagatctagtttgctatttgcaagactaggcttggagctcgacatagcagaagagctcagaaggcgcaagcaggcggcagaagacgaataagttaagcattgtagattgtagatggacttgttgccaagctgttggttcttcttttattgtgtttatatatataatataattgctattctggaagatttggtgagtctaaaattctggatctaccgtctataagactaagatttgtgccagtgagcaaagcatttggctgagttaaccgtaatttaaattgttgaaaaaaaaaaaaaaa

SEQ ID NO: 34517 - DNA, 736 bp, Triticum aestivum
  Clone ID: PAT_TA_34517
ccggcccgccggctgcccccgccacgcctcgctgccaccactcttcctcctcctcctcctagtcccggtcccagcctccttccatggcggatcggcacggcgagggcggcgtggcctcggcgcggcggccggggcgcacggacctggacgacccgtcgacgacgctgctgcagcgcgtgcaggcgcacctcccgaacgcgacgcaggtggtgggcctgctgaccctgctgctcgccggcgcggcgctgctggtgctggcggggctgacgttcacgggcgccgtggtggcgctcgtcttcctcggcccgctggcgctgctgaccagccccatctgggtgccgttctccttcgcgctcctcgtggtcgtcgtggcggcgctctccttcgtcgggttcgccgtggccgcgctcgccgcggtcacctgggcgtaccggtccttcacggggcgccacccggtgggcgcccaccgccgcgtccgcgcccgcaaccgcctcgccgacaccgccacccaccgcgaggactacgcccgccgcgagtacggcggctacctcggcaaccggaccaaggacgccgcccccggcgcctagtcgccgcgcgtgcgtgcgtgcacgtcgtggctagatcgttattacgatatgctcttctctctttgcgtctctgtactctcccaggtgttggtgatcacgtcgtcttcacgtgtatgatctactattagtttcgtttgttaaaaaaaaaa

SEQ ID NO: 34518 - DNA, 813 bp, Triticum aestivum
  Clone ID: PAT_TA_34518
gctttacttacgatttctacatctaccatacatacatgttagctacactttcgtggtctacgaatggccgatatcgcccatatagttgctggctcattgtggggaaccatacgtgaaacccttcttgcaatttataggttggcacctgttccacatttcgccttttgacggtagccacacctacttggggggggtattgaatccattccgcctatagactcatgaataacttgactgctgtcacccaagctggtatcctactgaattgtaatgatgatgcacacctataccttctgctaccataactgtctttacacatccttcatgagtttcttccaatgctgaacctgctttgtgagttcaactttactcatggagggtgaaaatcatgtcggcacctttcttcattgctaatcttgtatgcgaccagtctagatctagagattcaggcagaacatgcttccgtcgtacaagtccctattttccacctgggctcttggccaacagtgtgagtgtgacgccgtgtgtaccagggggggggatcaccatcacaagggcatgggcaccggcgccgccacagccagggtctgagttgagcttgctctgcttaatttggggctccgtggatgaacaagctgtatgtaactagcacgtatcaatgtatgtttgtgcgcgcgtgtgtgcgctgtaacatgtatgcatacatagtcgtcggtgtttgtgtttttttgaaggactgtaggtacatgtactagttctggtcctgtttaatttccatcaagtaagtatctattagctaccatgtttaatttt

SEQ ID NO: 34519 - DNA, 949 bp, Triticum aestivum
  Clone ID: PAT_TA_34519
ccacctgccaacacccccattcttccatcaagtaacatactacgtgcagacaagtccgactaaaccagcgacgcaatggcgggcgtgatccggagcatggtggcgccgctgctggtgctgaacctcggtgatgtacaccgtcgtcatcggcctcgccagctggaacctcaccccctccaccacaacggcaccaccaactacgccggcgtggccggcaacggcgccaccttctacttcctcctcttcgccatcctcgccggcgtggtgggcgccgcctccaagctcgccggcgtgcaccacgtccggacctggcgcggggacagcctcgccaccagcgcctcctcggccctcgtcgcctgggccatcacggcgctcgccttcgggctcgcgtgcaaagagatccacgtcggcgggcaccgcggctggcggctccgggtgctcgaggccttcatcatcatactcgccttcacccagctgctctacgtcatggcgctccacgccgggctcttcggcaaccagttcggcgacgggtacggcggcgcggagcaccagtatggcgaccaccaccatcacaagggcatgggcaccgccgccgccacagccagggtctgaccgtcttgagctttaattactctgcttaatttcgtgatgggcgcagatgaacaagatgtatgtacgtatcaatgtatgcgtgtgtgtgtgtgtgtggtgtgagtgtgatgtagctagcatgtatgcatacatggtgcttgtgcatgtactgcagttgttttttcaaggactgtagtgtaggtacacgtactagttctggtcctgtttaatttccatctacgttctttctatttccctctgtacttcctgtgcatgtgctgccgtttgcctttggaaagactgtacgtacatgtacttctggccccaaaaaaaaaaaaaaaaaaaaaaaaaaaaaaaa

SEQ ID NO: 34520 - DNA, 546 bp, Triticum aestivum
  Clone ID: PAT_TA_34520
tttcggcacctaacgcacccacattgagtaagtgtgtaagtaagtgacagattgacaggtgcgcccgcgcggcgtcaagagtggtgctgccgcgaagcagggccgcgacgactgcggggccgagttcgcgtccggccggggggcgcggctgcctgcgcggccggtcgtgcccccggccgtgcgggcgccgccgtcagtattcaccgtcgcggagctggagttcctccagtcgctaattcccgcggcgccgggcgtatattagcggtgcgggcgccctcctgcgcggccggcgatgcaggcggccgtgtcgcctggcgcgccctagttatgcaacgctgcgctggagttcctccaatcccgatgtcctccgccgccgggcggatattaccggcgcggcgggcaagctggtcggccacaggcggaggcgctgccacctgcggggcatggctataaatgttgtgttgttttgcttgaagaaaaatcccggtgtatccaataagacaataatatatacaccgtccgtttcaaaaaaaaaaaaaaaaaaaa

SEQ ID NO: 34521 - DNA, 575 bp, Triticum aestivum
  Clone ID: PAT_TA_34521
tcggcaggcctttcaagcggctcggtcgccgggtttacagtgccgagcacatccatgggtgggacgtaaagccggtgcgcttccagctatcgacttcggatgggcagcaggcccagtccaagtgttacctaactgatccaggcgtctggatctatcatcatgtcggcgatttcgtcgtgaaggactcgaacgggccactgaatatcaagtttgcaatcgtccggatagactgcacacacacaaaaggaggcctgtgtatggattcagtggttataaaacccaaatgccttgcgcggaaaaagggacctgggagttatgagtagttttagtgagcacattaacctgatatctatagaaacaatatggttttgcttacttcctccgtcgtgtgcgcttgcggctgtcgatgttttttcagtcctgtaatgtgaatgtaattggaggggtgagtgatcttttatttcctcttgtccctatataggagcatcaagcatgtcacaccttgtaaattgcgagttcagtgacagatatacatgtttgcctttgctatgttcaaaaaaaaaaaaaaaaaaaaa

SEQ ID NO: 34522 - DNA, 922 bp, Triticum aestivum
  Clone ID: PAT_TA_34522
ccccgacccaccccgtcgactcagagcgcccgcaccaccccaaacgaaccccgccgtctccgggcttctactccccgcgcctcgacctcgacctcgccggcggcggcggcgccggatggcgccgacgaggttccggcgctccagcgtggcggcgggggccgccgcgttcatcgccctcgcggccgtcggatccgcctccgcgtccaacacggccttcgtcaagttccccgtcaaagcccacgaacgtcgtcatcttctccaagtcctactgcccgcattgtaaaagcgcgaaggctgtgtttaaggaacttgaactgaagaaggacgcatatgtcgtcgagcttggtcagcgagaggatggtggggaattcccggaggccatatccgacaaggttcggcaggcgtactcggacctcattgttacgtgtcgaggaaagcacttggtaggcctctgatgatacagttgacgcatatgaaatgtggcgagctggctaaacttctgaacatcagtgtgaagggacgatctttgaatatcattttagcgcaaatctcgtacttactgttgaggttaccaaggccttgcaatgcaaccctagattgtcattttcgcagaacctgtcactggtattcgtgttgaagtataaactgttttaaccgtactttgtggaaaaaactataaaatcacttttatcgatcattgcatactgattgactgcaatccaacaataagattaattggcccttgcccctttactcgcgggggcgtttattactatttctccgggggggggcgcccgcccccatttctccctatttggggttccttttccaattcccggcgccgctcgttttcacacctgcgggatcgtggaaactcctgtcggtcctcccacttattcgccctgcgagtcacaccgcccct

SEQ ID NO: 34523 - DNA, 419 bp, Triticum aestivum
  Clone ID: PAT_TA_34523
gggccgacatgccgcggattcagagcagtgtgcggggtgtccgggaggagagctgtttcagggctggctcttcttggcgccgctgcctcttgcgcgaatctcctcgccgtgcccatgccggtgcaggcagcaatgctggagcccgatgtcatcaggtacagaaagctggacagtggagtaaagcttgaagatgtagtcgatggcgaagggccggaggctcgggaaggcgatttagtgcaattcaactacgtgtgccgccgtgcaaatggttatttcgtgcatagcacggtgaatcagttcagcggcgagagtaagccggtgacacttcgactcgacgtgcaagagatgattcgacgcctcttctccgtcatattgacctttctgcagatgattcaagaggagggctctgataccccctg

SEQ ID NO: 34524 - DNA, 867 bp, Triticum aestivum
  Clone ID: PAT_TA_34524
tgcggcacgagtaaagcttgaagtacttgccattagtgagatctttttacataaatactccagttgctgagatgagagcttataaatggaagaactctgtttcttgatctgaagatgtagtcgaaggtgaagggccggaagctcgggaaggcaatctagtgcagttcaactatgtgtgccgccgtgcaaatggttatttcgtgcataggtcaagagaacattgccattgattgaatccttgattgtgttgttcatttagtactagtagtagcttgtaaagtgcatatatgtgttgcattttcagtactaccaatactgctcttctttgactctcattatgcttttgtctgtctgttttctctgatgcagcacggtgaatcagttcagcggcgagagtaagccggtgacacttcgactcgacgtgcaagaggttccaggacaggatttctcttggcaattgacctttctacagatgatttaaaggtttcccatagcaatttcacatccttatggcttctcttgacagatgaatcatttttcttgtagatgatgcgaggccccgaggacgtcttggtccgccgccgggagcctgctgtcgcatgcctaaggaaccgctggtgtttgaggttcagctgctcaaagtcctgtgatcattgtctcatgatcatcacatgccaatgcagatagaagctctcctgtcctgttctacaagtgaagagaaccacagtgattcttttttggacttttttcttcaaatttctttctgatttttttcttttcaaaccatgtgtttgttcgttcttccgaaaaagcattcagccagttggatgaaggtatagaagagaagagagcacaaggatttccttc

SEQ ID NO: 34525 - DNA, 809 bp, Triticum aestivum
  unsure (1)..(809): unsure at all n locations
  Clone ID: PAT_TA_34525
atcaattttctttgattcagttatttgactaaatgataatatatgccccagggttaattagtacctaaaatgctacctttggtttgtcaaaaagatctatagtggcttctgcagctcctgttatgtttcattgattcagtcatgtagtaggatagttccactggattttactaaatggttttgtagctttacttattgaaaatgcctcaattggtttctgcaacattgcttgtctattggcagctggagcatacttggtacatgagccttgccgtgagtggtggtgcaacggtgacctcgacgagcagggcattggccagacacgagtaaggcaccaaagatgactggaagcactcaaaaaagtttaccacgctggtggtcgctgccgaggtacgagggcagttaatgaatatacttgcgacccttttactctcagactctcctccttttctcgctgctgaacccctgccaccatcatgtccagactggctgtctccatggttgtggcgccaaggtcaccgcatcttacatcctgatgcatgttgaagcatgaggctggaatacaaggtgtgttaggttgaagcatgaggctggaatgggtcttgtgcgaggactagcgtttgctttagtcaaaccaaaatacttctaaaattgcagctgcacttgttggtctgatgtacctgcccgggcggccgctcgagggaatanagcatggttccccagtattaaaaaattaatttttaccaatgtatggaatcanggnctgagtcttccgtgtacggnaggtccatgttggtgttttacttcaa

SEQ ID NO: 34526 - DNA, 548 bp, Triticum aestivum
  Clone ID: PAT_TA_34526
gcccaccgccgcccctctcccatcctcccaagaatccgccaccgcagtcccccggcgacccacgcgcggcaccgatggcccgcacgaagcagacggcgcgcaagtcgacgggcggcaaggcgccgcggaagcagctggccaccaaggcggcgcgcaagtcggcgccggccactggcggcgtgaagaagccgcaccggttccgcccgggcaccgtcgcgctgcgcgagatccgcaagtaccagaagagcacggagctgctcatccgcaagctccccttccagcgcctggtgcgggagatcgcgcaggacttcaagacggacctccggttccagagctccgccgtgtcggcgctccaggaggcctccgaggcgtacctggtgggcctgttcgaggacaccaacctctgcgccatccacgccaagcgcgtcaccatcatgcccaagggacatccaagctcgcccgccgcatccgtggggagcgcgcctaggcctctctgcctccgcgtcacgcctgccggcggttttccttctcgggtgaccccgccgagg

SEQ ID NO: 34527 - DNA, 1571 bp, Triticum aestivum
  Clone ID: PAT_TA_34527
gcacgaggagggagctgactaggatcttgagtgttcagaagtctcccgtgatccatttgtttagcgagtcaatcgctggtgctgctactatcagaggatttggtcaggagaaaagattcatgaaaagaaatctttacctccttgattgttttgctcggcccttgttttccagccttgcagctattgaatggctctgcctgcgaatggaactgctctcgacttttgtgtttgctttctgcatggcaatacttgtgagctttcctcctggaacgattgaaccaagtatggctggccttgctgttacatatggactcaacttaaatgctcggatgtcaaggtggatattgagtttctgtaaattagagaacagaatcatctctgttgagcgtatttatcagtattgcaagattcctagtgaagcaccactgattattgagaattgccgtcccccggcctcatggcctgagaatggaaacattcaattgattgatctcaaggtccgctacaaggacgaccttcccttcgttctacatggagtcagttgtatttttcctggcgggaaaaagattgggattgtagggagaactggaagtggtaaatctactctcattcaggctcttttccgtctaattgaacccacaggagggaaaattatcattgacgacatcgatgtttctgcgattggccttcacgatctgcggtcacggttgagcatcatccctcaggaccctacattgttcgagggtactatcagaatgaatcttgaccctcttgaagagcgttctgatcaagaaatttgggaggcactagagaagtgccagctaggagaggtcattcgttcgaaggaagaaaaactggacagtccagtactggagaatggggataactggagtgtgggacagcgccagcttattgcattgggtagggcgctgcttaagcaggcaagaattttggtgcttgatgaggcgacggcatcagttgacacagctacagataatcttatccagaagattattcgcagcgaattcagggattgcactgtctgtacaattgcacacaggatcccaacggtcatcgacagtgacctagtcatggtgcttagcgacggtaaaatagcggagttcgacacaccccagaggcttgtggaaggacaagtcctccatgttcatgcagctagtatccgagtactccaccagggcgagctgtatatagagagagaggcttattagcttaaatcccccaaccgagaatagaggctgggaggtaaggtacccgaatctgccagtctacccacaccacacaagttagttcccaccccggccgggaggataggagaggtatatgaacggaaagaagcgccgggcgcgttccctgacctgaatagccatggattcttcttcgaggggacgccgcacgcggttcgactccccgggaggagttggcggcattaaccgaagctctgatgcttttgtatgtgtaacactctgtactgcttctccccttgcatcatgggaaaatgaacagaaataacgcgggtaataaagggggaaattttgctttcaaaaaaaaaa

SEQ ID NO: 34528 - DNA, 1224 bp, Triticum aestivum
  Clone ID: PAT_TA_34528
gcaacctttttatgcccgagacagtaggaggacaagagagcgagggcgaccaataaattcctaatttttcccacttttccaccccgggattccccgcctcttgttccaatcgattggtgggcgtcctcgttcttggcttcccgattgaatccgtgggaagccagagataattctctctccgctgcgaatttttttttggtggtttgagttcttgatttgtttgcgaggaagccaccatgagcgccggaagcgccagtttcctcgagatccagccctcggagctggcatttccctttgaattgatgaagcagagctcgtgctccatgcaactcgcaaataagaccgaccgttatgtagcattcaaggtcaaaactaccaacccaaagcagtactgtgtgcgccctaatatcggcgttgtacttcctgggtcgacttgtgatgttacagttacaatgcaagcgcagagggaagcacctcctgatctgcagtgtaaggacaagttcctagttcaaagtgttgcagctgagaatggcgcagcaactcaagatattagtgcagcaatgttcaacaaagagccagggaaggttgttgatgaatgcaagctgcgtgtaatttatgtgccaacatcttcacctagcccgttctctgaagattcagaacaagggagttctgctcgttcattggaaaatgggacccctaattctacattgccacaatctgtatttagatcatctggtgaagcatcaaaggataagtcctcggaggcaacgtccatgatttccaagctaactgaggagaaaatgtctgctgttcagcaaaaccagaagttgagacaagagctggatgtcctacgcaaagagagcagcaaaagcaacggcggtttctcaatcaccttcttgattgtggtgggtattctgggcatcatcgctggtttcatcctcaagaagacataggagaagagtagtccccaacaaagttacattcccaggaaaggatggataccaacaacatcccttgtgtttttactcctaaaaggagcgcctgttctattctaacttgtaacggcttagaagctttggtttgtgtacattacatggtggttttcatgattttaatcacatcgagtagacttgttttaattataattcttaacagctgcaagttatgtcacgttcaccataaccttttatctcctttaattcaaaaaaaaaaaaaaaaaaaaaa

SEQ ID NO: 34529 - DNA, 796 bp, Triticum aestivum
  Clone ID: PAT_TA_34529
ccacgcgtccgggaaggaggcgaggaaggagaagcaaccccacccccgcccccggctgccgccgccgcagccgccgacggtccggtggcccaccatctcctccgcggccaccaccaccatcaaccagccatgttcggcgctagcaatccatttgggcagtcgtccgccagccctttcgggcagacctcaaccaaccccttcgggacccaacagggctttggccagcccagcaccaccaccaacaatcccttcgcgcccaaacccttcggcagcccgacccccgcattcggggcgccaacagggaccacctcgcccttcggcgctacctccacctttggccagccatccgctccggcctttggcgccacgtccactggcgcctttggccagcagtctgccccggcctttggcgctacgtccactggcgccttcggccagcaatccacccctgcgtttggctctacatccactggcgccttcggccagcaacccgcgtttggtgctacatcgaccggcgcctttggccagccatccacacctgcatttggcaccccgtcctcctctccgtttgggagctccacgccagcttttggttcttcgcccgcccccgcgcctggcgccgctgcctctggatcatctcctagccagtctagtccatttggtagcacatttcagcaaacacagccaacatttggcaacagcacttttggcaccacaactacgccggcctttggttccacaacaacggcagcatttggctccacaacgactccagcatttggctcaacatcaacat

SEQ ID NO: 34530 - DNA, 1230 bp, Triticum aestivum
  Clone ID: PAT_TA_34530
cccacgcgtccgctaacttgcacttctacagatagaagagctcatgtttgagctctcgatgtggcgatgcaacgatgaactccgtgtccgtgctgaggaactacaccgcgcttcaaggaaagctgaaaaacattacatagagttctggaagcaagttcccccaactgaaccttaccgtgtgatactgggctatgtacgggacaaactgtactacacacgcgaacgttcccgccatcttctcaccagtgggtcttctgacatccccgtggactccaccttcaccgatgtcgaacagtttctggagcccctcgagctgtgctaccgatcactgtgcgattgcggcgacaagaccgtcgccgacgggagcctcctcgacttcctccgtcaggtgtccaccttcaggcctcgctcgtgggcgcccccgcccccaagcgggccgccggctagaacttctcgatcttcccgaagcccaaggagatgtcgaccgcgtcgccatccttcaggggccccttggagccgatgcgccggggttccgcggggagcagctgaggagcaactccgcgggccccaggaagctgcgccaccaggtccctcgacatcgggaggagctcgccaacgggcaggaatccgagcacacaccgccgcagcctaccgcgcaccccaccctccacctgacgtggcagcgctccctgcccgaggaggtggctgcccccacccaccccgtgccgcagcacccgctgcgcgccgcgggcctccacgctgagccgcagggggggccgctgctgcaagccgacgccggaggcgactctgcgccgggagggggcgggcggggtcaattcagctgggcaggggtggcggcacccgttgacacaggatttcccggtgctgtcgggaaggctcgtccttgcgctttcttttttcgctgccggcatgcagcagagcgactaagccgcttcttcgtgactgaggtgtaaacggttgaaattctctaatgatgctagtgtcacgttagtgcagtataaacagttttgtatggagattctggaaactgacacatattcaaataaatataagcatatctatgaaagacactcggcttcggcctctttatatttttcactcttgttgtgaagtccaagtggaaaatcttggcatcttaaatatattgtaataatgaacatcatataatctacaaatttactattatgtattaaaaaaaaaaaaaaaaaa

SEQ ID NO: 34531 - DNA, 1266 bp, Triticum aestivum
  Clone ID: PAT_TA_34531
gtgttttctgtcttagcagaagctttaaaaatacaagcaacgtggcaaaatacaatttgccaacagtgtatctatccactcatgtacatagcgagcacactcacacccctggcaaaactactattcgccatcagtgtataaatcgcccaggtacaccgcgtccacgcacaaaccccggtgctgccctcgctttgtaaaaagtaaaaaaaagcggtatcactcatgtacataacgagcacacacaaagccccgcgcagctctcgctgtgtagaacgtctcaagataggcccgtgccccccgccctgcacgcttcggtacatgcctcctgctgccggtcgcccccgccagcgtcttcctcctctccgtcccccgctgccatgtttcctccccctgactccgccgcacgcctctgtcgcagggctcgtcccctggagacgggtccggtttgcatttttcaaagaagtcagccatcaacgtggcagcctgatcaggatggtaagggttcaatgtggaaaccagagatcccgtgctctatgatctcggcaggccctccatggcagtgttgcaaaagtagggagtccgcaggtcatggcttccacaacagtgagaccaaatgcttcatacaaagctggctgcacaaaggcaccgtgagtatcagcaatgtagcgatacagctcaccgttgcgagcccttgttcgtctgggcagagatccagcggaactgcccaaacaagttatatgtcttaataagttcatgcatcttctctatctctgcgatctcttctctatcctttgatttcttgacattgttgtagccagcgaccacaacaaggtttaccagcgaccttagcttagcatttttactataagcttccactagtcctgtcatgtttttaacacggtcaagtcttgccatggagaagagaattggttttgatcggtcatccagatgtccaatgtgtacatcgttttgctctgggtcataaatcaagctctcaattgaaccatgaagggcagtgagccgcttgtccttttcagtgaatggaaaatatatagacatgtctgctccaggagatactatgttgccccgcggcccaaaaacatcaatcccatggacaacgcggtacaggccaggaagagtaaaagcagtatggctctcgtactgtccaactgtgtttttgctgcataccatggaaatgtaagaattaagtacaagtgtcttgtcaataatactgatgtacgatcgaaaccaatgcaagatactcgc

SEQ ID NO: 34532 - DNA, 1495 bp, Triticum aestivum
  Clone ID: PAT_TA_34532
ccggtccagcggtggttcgcgccggttgtgatttggggccccggccgaggaggctggactcagcaacaaatgaaccacttttcacaaattgcacaagagatttcactggtactgttgattacatattttacacagcggattcattgtcagtggagtctttattggagcttctggatgaggagaacttaagaaaagacactgctctcccttcacctgaatggtcatcagatcacatagcactcttagcagaattccgttgcaagcctagaatcagacgatgatgccttaggtcgcatacagatggtcacatcagcgtccatgttggaggtttaacttccattgtggaaggtggaagttgacgccgcgcgggcgccttccgatcgccggggttgcactcttgcagcctgagctggccaccgtccccctgggaggctcacgccctgtgggctagctccctcttcaccttcctccgccctgtgctttttcctcccccgctgggatggtaggcgtcggttaggagggggagcccctgcggaggaggatggactctggaacaaatgaaccacgtttcacaaattgcacaagagatttcactggtactgttgattacatattttacacagcggattcgttgtcagtggagtctttattggagcttctggatgaggagagcttaagaaaagacactgctctcccttcacctgaatggtcatcagatcacatagcacttttagcagaattccgttgcaagcctagaatcagacgatgatgccttaggtcgcatacagatggtcacatcagcgtccatgctggaggtttaacttccatggtggaaggtggatgttgaggaggggcagacgcgatcatatcgccggggaagcagtcaatcagtcttaggaaacaaccttgggaaaagagagcctcgtgtagtgttgattattaccctttttacatttcaacttcatgatatttaagctgccccttgtaatattatactttatatagaagagaaatccttttgagagaaatattgataatagattctgacagccatggctagattttttaagatctttttttctcagcttgtcatttttattttgttagtgatttttcgcttgttgtggactcgcatttattcctacaagctgcggcgactgcggcgtcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaataaaaaaaaaaaaaaaaaaaaaaaaaaaaaaaaaggggggggccgctttaagggatcaaggtttacgtccggggggtgggaagggattatcctttttttgggggccctaaatttaatttccggggcgggggtttaaaacggggggggggggaaaaaccggggggggcccaattttattggcttgggagaaattccccttttcccaagggggggtattacggaaagggc

SEQ ID NO: 34533 - DNA, 1183 bp, Triticum aestivum
  Clone ID: PAT_TA_34533
ccccctgccccccgcggcccctccccttccccactgccgctccggcgccgtgcccctcccgtgcgccggccggcccgggctccgcccggccccggcccctcccgtgttgccgcgcttcggccgcgctgcgcccccttggggcaccgtcgtcgcgggccggtggcctcctgccgcgctccggcgtcctgcccgtgcggacggtcctgcgcggttccctcggcgcggttccctcggcaaggtcacctcggcgagatgacaatggcgagttctctacgtaccgacgatcgccggcgatgccatgtggcgtggtagcggccgtgttggcatcgatgacgcagattcttgccggcgtggcgatctgctgctttggggcgtggcgggtaactaagggggccaagcgcatcgccgcggtggtcttcttcatcacctcatgggtcctcgcgatcatagcagtgctactatttctggcaggggccatgttaggatttgaaggctctgcaaagaaaactgttgggaatgctaggattgtcggaggtgtcgcaattttcgtgatcgcgacatttttgtttcttgtagtcgccgcccttgatgttgcctcataccgcctagttcggaagaaggaccactaccaagcatatgttggcagtaatcctccttttgtgccatctaaagacgctccctacggttctgctcctccaccgccaaatcaagtctaaggttagctctgccaccatggcatggttgtctttcccttccaaaggaggagcgcgctgtatgaactgcggtaggtggaaggcgtaggcttcgacccatgctaccatcttgcgtgttttgtgtgtttgttatggctccactcaagtcgtgagaaagaattcaaaagtttatctgcattgcttgcttcatatgtcctggtgaagcttttttggggggcccgacagccaccatacgggcctgccccccgggcgtccgtaatcattgatgggaataagtgtcgtcactcatgtgcgtctcttatcgccatcagagagtttagttgggtttgttctcacgggagaaggatggtttgtgtgttcgtgttttttcttaatgtatccgattataaaatggaatatctattgaaccgagtgtccaaattatggcccatttaaaaaaaaaaaaaaaaaaaaaaaaaaccgagactagt

SEQ ID NO: 34534 - DNA, 757 bp, Triticum aestivum
  Clone ID: PAT_TA_34534
atcgcacgcaccccggagcgacaagcgagcgatggcgcgcgtctccaattccaagaagcgcatgctccacaccaacagcagcagcaacaagaaggaggaggcgaccaccgccaacgccaacgccaacgccgctgggaacgacggccgccccatccgcgtctacgccgacggcatcttcgacctcttccacttcggccacgcccgcgccctcgagcaggccaagctgctgttccccaacacgtacctgctggtgggatgctgcaacgacgacctcacgcggcgctacaagggcaagaccgtcatgaaccaggaggagcgatacgagtccctgcgccactgcaagtgggttgatgaggtcattcctgatgctccctgggttctcacgccagaattcattgagaagcatcagattgactatgtcgcacatgatgctttgccttatgctgatacaagcggtgctgcaaatgacgtctatgagtttgtcaagaagattggaaaattcaaggaaacaaaaaggaccgatggagtatcgacatcggaccttataatgaggatagtgaaggactacaaccagtatgtgatgaggaatctagcacgaggttactcaaggaaagatattgggcgtgagctatgttaaggagaaacactgcaggtgaatatgaagatcaataaactgcgggagactgtgaaggcacagcaagaatagttgcaaacgtgggcgaagacggctgggataaaccacgaagagtggctggcg

SEQ ID NO: 34535 - DNA, 764 bp, Triticum aestivum
  Clone ID: PAT_TA_34535
acaagagacaagatgaagctggcttgcaaaaatccattttagcaccgagtgctaataaatttgatgataaaagagattattttggctttatcagccatgaagaggtcgcaagccaatggatggtacctgcttgctttgctgtcactacttgcattttggtgtacctcagttgcagagcgcaacaaaggcgccgtcgaccaaggaaagggtccgcaaccggtcgtctgtcaagttcggtataacatggaaacttgtgtggggccaaagaaggttttggctccagcgtgtctggccatctgccatggtacatgatataaccgaagctacatcggtccactgactggacataaaaagctcgcaatggatgtcaatcgaggtccaagtcgtggtggctcatgtttagagtgtgcgaagagagcccagtcaaacacctctgcaactgcgtggctatgttccaacattttgtgtcatgcgccatcgccatcgccatccatccagttgtacaaactctgtgtctataataataatagactgctttaggacataataggcgagagctaattcagtaggaagaggctagggttgacgtctttctgtctttccttccttctttttcatctcttcttattctttgtttttatcttttgcaaaaggatgagttgcttcttgtaggtcagcaagcctttcgagttttcagggtcgctatgcttcagcttgtaagtactggacgagcccatctaaaacagaggaagtcctcaacagtt

SEQ ID NO: 34536 - DNA, 224 bp, Triticum aestivum
  Clone ID: PAT_TA_34536
accaactggtggatatgctgcaaggtcgacaccactccggaggatgctgcatctaatggcaaggagggttgcggccaacgccgttcgaacgccggaagttgcaaccgtgtacgctggagctacaaccggcgactaggggagctgcaagaggggtggctattttttgctgaacagttttctttttttgctggaaccaatgtattgtttccagcaaaaaaaaaaaa

SEQ ID NO: 34537 - DNA, 1101 bp, Triticum aestivum
  Clone ID: PAT_TA_34537
cggcacgaggttctttcctattcttacaaatgaacctccacttctgttctgtttgaacttacttggcataaaaattagtatttgttctactgtaaaaaaacataaaatgaaatgtcttggtgcatgatcgaaggtgcatatggaagcatccccatgccaattgcaatggtttccaggacgtgacatccatacttttggttatgaactaatgatgtattagtgcatgaactaatgcatcacatatgttgtttctttccaggctactctagattagaacaagttaaaagtacttagtttctcaatagtctggtcctcctcaccagatgttatgtagtacacatctttttaatacaaatgttttaaaagtttctttttgaacttctcccaattaatatacctgaacttgattatctttctaacatgtacatataccaacttcattagattttgtgtcagtgcttgtaacacaatcagttcagatctcgatagaccacaagttcaagttcactagtatttgtaaatgttggtagcagtactagtatttagaaatttgtaacctaagaactaagcttgcatcttgttacttctatggaagcattgacctcgtaattttattggaccaaccactaacataagaattagacatggtgctcagtgtattctctcaatcttggttcttcttatagtgcttataatcttgacatctttgatgaatccagcccgaactgaagcatgtcggcgagccgggcctcaaaaggcccttctcccgccactgtctcgatcttgaactgatgttgttgtcatctgtctacctccttcctcggttgatgaagatgctgattttacaaaaggatcagtgaagcattgggcaatggacacactatcttcatgggatggtgtagacatacttccattagtagaagatgatacatggagcagtgaccgctcaacacttctttttgtgataaatgttattatgatctattctatgtattatattgtatgatcgggagaactcagaagttcatgtgttgtcagtgaaaaatttcaaaacattttgtttagtaagaactttttttatcaaaaaaagaaaaaaaaaaa

SEQ ID NO: 34538 - DNA, 633 bp, Triticum aestivum
  Clone ID: PAT_TA_34538
gagccacgcggctagctaccacaccacgccaaggcccaagacgttcccaaaggtacttgatcagcaaaacgcagcaatggcgaagcgtctggccgtcgcgctcgtgctgctgctgctggtgctcgcgtcctgcgacgggagggagctgaaagggaagggcggcgccggtggcgccgtggacgaggtgaaggacctgctgcccggcttgccggtgccggtgccgcctctggtgcccaacctgccgctgccacccgtggtccccgggatccctcccgctgcccacggctccgccgacaaccacaagtctccatgatcatatcatgccgatcgagttcacgcgcctctgcataatgtttacaggctgcgtccgtagatcagcttgtcgttttagactcttattataactagctagcaccggccggaaaagcagcacatcggcgtcgcatcgctcttgtccgtgtgccttgatctgcgccaactatccctatccgccatgtttcctcttagttcatgtgtttagttatgtccctacttcgtcgtcaatgtactacagtaatacttaatcagtgtgactgtctttatgagtagacatatatcaaaatatttcatcaaaaaaaaaaaggaaaaaaaaaa

SEQ ID NO: 34539 - DNA, 712 bp, Triticum aestivum
  unsure (1)..(712): unsure at all n locations
  Clone ID: PAT_TA_34539
gccctctcttctcctgcccttccccccgccgccgccggctggcggcgccgggctaggcccgcgtggctctggcggcggcggggcctgtctctcccctttgctcggtctggcggcgcgggggcggcgagatccggcggaggcccggtcggcgtggcgcgcggcggccgtggggcggagtggtggtggatctggtgggtcccacgcgtgcggtgccgcctgggggctcctcccctctccgcggtcgtgtgggggcgggcgcgcgggccacgcgtggcaagcgcggatctgatgcggcggactctttcggtgagcgcgcctcccttccggcggtgggtggttggcgcggatgctgcggggcgccttctttggctgctcgggcagcaaggtggcggcgaacgtggggctcgaggctggggtttccccgctggccccgagcttcgagctgaagacggcgtcctcctctgctcctaggtgcacctcgtccttcttgcctgctgttgggtgggacgatgggggcgtgggttctggactgggggaagctcctggccggcgtcggcggccacgatatcggcaatgctccgggcattgctacccttcctgaaagcgacatcgtgatcctctccctcgccctccacctccgtgacccatgtgaaagcccaaaatctcctggtttgggcggcggcggcgttccagcgccganttcttcctgaag

SEQ ID NO: 34540 - DNA, 1199 bp, Triticum aestivum
  unsure (1)..(1199): unsure at all n locations
  Clone ID: PAT_TA_34540
attcggcacgaggcgcgctcccagnatgctcgaccgcaccggggccgcgccccagaccggggagcggcccggcggggaggatggggagggtgatggcggggaggtgctcgcggatgtggacgccgccgaggtcgacgagctgctcgcctgcttcaagagatatcggctgcggagcaaggttgagatagataatgtaagtgaggagtttttgtgctggcaaagatttggaaacgatgtggcacatgctggaccttccactcaagaacccgaggctcaatccattggatggggacaaggtagtgaccatgctgctgagtcatctgcacaagggaacggtcatggttggcagtggctcaaagatcctcggcttgacattcttggctacagaggaatatttccagctgatacaataccaccacttgttgaggctgacaaagaagcagatgaacgccattatttgctttggcgtatagaaaatggggttgcagaaggctcaactgaaataccaaaaggtgaagcaattccgctcgagtacaatcttgcaggcctgaatgctatttcatttgacaaggggtgctatattggtcaggagctgatcgcgcgcacacaccaccgtggtgtcatcaggaagcgcctgatacccttgaagtttgtagatgaaaatgacaaagaacttgagcaggctgttgctccgggctcagatgtcgtggacgacgcctctggtaagaaagtgggtacggtaagcaccgctctcggcagccgtgggatgggcctgttgcggctcgatgcagcactgaaggaaaacgcaaccctcgccatcagcgacaagagagatgtgagggtcaaggcaatcaagccagactggtggccggctgagtggacacaggtcctagaacagcagagcgcagtcgcttgatccaggacctgaccaaaacctccagtgaagtgaagtaatgaagttctttttggagtttagaggggcaaacgtgaaggctttaggcaccaggtctttcatagaggcgccgttaggggaagccgttcgagaccgtttagcaaaggttatctgaccgttttatgtggtgtcatttgctggacctaatttcttatttactctactcccttgtaccagtgatagatcaagaataagcttctgtgacactgtacaaagtataaacaaaaataagtaccccttttagggt

SEQ ID NO: 34541 - DNA, 498 bp, Triticum aestivum
  unsure (1)..(498): unsure at all n locations
  Clone ID: PAT_TA_34541
cccactcggccactccactgccctcgctcccacgccgacactcgccatgatgcgccgcctccacctcgccgccgccgtcctcgccgtcttcctccccctcgccgtctccgcggccgggggcaaggcagcggcagcggcagctaaggcgcccgttggcccgccggccccgccgaacatcacggcggcgatggccaagggcgggtgcaaggcgttcgcggccctggtggcggcctcgccggacgcgcactccacgttccagtcggccggggacggcggcgtgacggccttctgccccagcgacgacgccgtgaggtccttcatgcccaggtacaagaacctcaagcgccgacggcaaggcgtcgctgctgctgttccacgccgtgcccgtgttactacgcgccgcggagcctcaagtccaaacaacgggtcatgaacacctcgccaacgacgntcgggcaacacttcaacttcacggtgcaagaacgagggcgacaagtn

SEQ ID NO: 34542 - DNA, 659 bp, Triticum aestivum
  Clone ID: PAT_TA_34542
caatcatttgtctctcgtctctctcgtttaagatctactccgttattagcatgctcccggcggagcgatccaatcggcttcacacgagcaatagcacccctcgtctcgcatccgcttagatcggcggcgctcccgtcgctatccccggcgaggcctctcccacgagcggctcttgcgtcggtggcgcccagccgtggcgacggccgcgcacggcgatctcatccgtgcaagaaattgagttgtagaaaccaacttggttgtcttttgtgattattatcatagatctaatcatgtgtcttctgttcatcttatgcacatatgaatcgtccgttccggatcgcgaatgaattcatggagatgaggacattgaaacaccgattgctagcacccctcgtctcgcatccgcttagatcggcggcgctcccgtcgctatccccggcgaggcctctcccacgagcggctcttgcgtcggtggtacccagccgtggcgacggccgctcacggcgatctcatccgtaactgccttcttcacggcaagagcggcgcaccaggccgcgacgagaatgcatccgtgcaagaaattgagttgtagaaacccaacttggttgtcttttgtgattattatcatagatctaaaaaaaaaaaaaaaaaaaaaaaac

SEQ ID NO: 34543 - DNA, 729 bp, Triticum aestivum
  Clone ID: PAT_TA_34543
ctcgacccttctttatatttttttaacgtcagctctacattttccattgatacagaaggggatgaaagaacagatatccaggcgaacaaagggagaagatctcccaatcagcagcaaaactaggcttcagaaggggaacacgcagtgctattggacctctaatcattccgctcctcgcagagtccaccaagccagcagataaactgtcgaccatactctgcagatcacttctgacttgcatattgaaatgatggatgagctgcggcctccatctgtggtccagaagctccatggacagtccatgttgttcagagaaatctcttcttctgccatgagaagtcatgtaatcaacaatgcacattatgcgcgcaatttctccgtgacaaaataccatcagacgaatggaagtattgggcgtttgcctcgcaatacaccatccccgatccgtgcccccgcgcccgaggagaagggtttttctggattcatgatcgattttctaatgggtggagtttctgctgccgtctccaaaacggcggctgctccgattgagcgtgttaagctcttgattcagaaccaggatgaaatgatcaagagtggtaggctttctcatccttacaaaagtatcggccattgcttcacccgcacaataaaagatgagggtgtggttgcactctggaggggaaacacagccaatgttatccgttacttcccgactcaggccttaaactt

SEQ ID NO: 34544 - DNA, 647 bp, Triticum aestivum
  unsure (1)..(647): unsure at all n locations
  Clone ID: PAT_TA_34544
ggtcgacccacgcgtccgcgcagcctcgagggtcggtcgccgcatccccttcctctccaagtccccgccgcaaaccctagccccccgatcgagccgagccccattccggcaggccggtagggcggcgcagggatgttcttctccggcgacccgacgtcgaggaagcgggtggacctgggcgggcggagcaacaaggagcgcgaccgccaggtgctgctcgagcagacgcgcgaggagcggcgccgccgcctcgcactgcgcctccagaactcctccgccaccaagatccagaaatgcttcagagggaggaaggcattcgaattggcacgcttggaagttcgaaagaacttttgttctacttttggggaacactgccagagggtagataggaactgctttggcaataatactgattttcttcgccaattgctgttcttcttcaatgcaagtaaagacagtgatattgctatactttctcaagtctgcagcttacttctgcagtatgttaagcatggggatgttgtaagtctctttgcgggtgtagattactcctcagtggagccagttgtaattcatagggttaaaagacttgcactcatctgtgtgcatgctgttcatcagaagnnnngtgattggaataatcaact

SEQ ID NO: 34545 - DNA, 824 bp, Triticum aestivum
  Clone ID: PAT_TA_34545
tgatggtgttatcttctacttttatttgttcatgttgtctaacaaattgacttgtgtttatggcgacttttttatgtgtccatggatcagagaggatggatgatgcagtggccacatcaagcgccctatgctcgacgacaatggaaatgcagtttctcagagctagcaggaaggaggctgatggcttcccgttgtagtaacgcgatggagaagagacaagacaccaggcttgtaaacaactacaatgatattacacatcactttctgtactacatttatgtgcattcggatctcgccaaggctaagaaatctgcctcgtagccccaactaatgcatcaacttggaaccaaggtccaccctctaataatcagcatatatgccgcatgtgtcagactcatgggggtcaaacagatgaggagaaggaagcagcaaggaagaaggtagaggagatggatacctgatctgcaagttcctgaatttccacgcgtccgccctggcgtccggttaatattgggtgcagcaatttcacaactctgggaaaagcttctgctggaggacatcacctgcggcatcacctgcatcgacctctcgctgattaccatcccaaggatgcgcgaccgactggcggagcagggcaccagtgataagttcaccgatttggtcgactcaccgttcccttcctctgtccacgcaatgccgctcgttgttgttaggttgttaattcatcaagccccttattgcgctacatagtttgttcatctcgcatgccttcttaggagaaatcatgtaatgaagataagctattcttgatttacattttattt

SEQ ID NO: 34546 - DNA, 662 bp, Triticum aestivum
  Clone ID: PAT_TA_34546
aaagaaattgtcatgggttgatattttcgaggagataccgattaaagtgtccaactcggcgcttgtcagtgccttcatgaaggagctggaacctgagtcacctgtttcacagtgtgactttgaccgtcttaaattgtcgactgcgccctttatggaaaggaacctagaatttatgattgggtgcatggatggtctttcatcagagcaaaacaagttccaatattactatcgcaacctaggaaggcaacagtcacagcaacaggcatggcttcaaaagagaaggcaagagaacatgtccagaaaggctgctggcgaggagccgttgccagaagaagatccatccaaccctatcttcaagccgcttcctgagccatcccgcttagagggttatctcgtaaccaatcagatctcgagttactgcaaccatatcaatggggttgctggccagagtttcaacaggctatacttgatgaaggcgttgcaggaagattaggtgccgggtggcagctgctgtgagattttaacttaacactgtaccgcacctcaattttgcaatgtactccatgtgcacccgcacattgcctattttgttttgcccaaatcaaatagttaagatgcattgggtggataccatttgttttgatggctctgttaccgctgtc

SEQ ID NO: 34547 - DNA, 1450 bp, Triticum aestivum
  Clone ID: PAT_TA_34547
cgtccgccgactcgaccgaatagccttgccacaccaacaaccctagccggcacgtcctcccctccccttcctcctcctcgcgccgtccctccaatctctcttcgtgcccccgcgccgccgaccaccgagcagccatggcgaatccagcaccggcgacgggagggaagtcgttcctgcaggccatgtcgacggtcaccgaagaggcggcggtgcagctccgcgtcgtccagatggagggactggctgtcctgaagatcattaagcactgtgaggagtttgcgcctgctctggttacaggtcaactgcttggtttggatgttggtagtgttctggaagtgaccaactgttttcctttccctataagagaggatgacgaggaagcagatgcagatggtgcgaactatcagcttgagatgatgaggtgcttgagggaggttaatgtcgacaataacactgttggatggtatcagtcctgcttgcttggatcttttcaaaccgttgagctgattgaaacatttatgaactatcaggagaacatccggagatgcgtgtgtatcgtgtatgacccatctaggtctagtcaaggagtgctagctcttaaagccctgaagctcacagactcttttatggatctgtaccgcaacaatggtttaactggagagaagctaagggaaaagaaattgtcatgggttgatattttcgaggagataccgattaaagtgtccaactcagcgcttgtcagtgccttcatgaaggagctggaacctgaatcacctgtttctcagtgtgacttcgaccgtcttaaattgtcgactgcgccctttatggaaaggaacctagaatttatgattgggtgcatggatggtctttcatcagagcaaaacaagttccaatattactatcgcaaccttggaaggcaacagtcacagcaacaggcatggattcaaaagagaaggcaagagaacatgtccagaaaggctgctggcgaggagccgttgccagaagaagatccatcaaaccctctgttcaaaccgcttccttcgtaacccaatcagagctcgagatactgcaaccatatcaatggggttgctggccagactatatcaatggggttgttgatgaaagtttcaccaggctatacttggtcggggcgttgcaggtgggtgaggtgcagggtgccaggtgctgtgagattttaacttaacaatgtaccgcacctcaattttgcaatgtactccatgtgcacacgcacattgcctattttgttttgcccaaatcagatagttaagatgcattgggtggatatcatttgttttgagctaaatttggtctgtttcgtttgctaaagtggcacactttgtttggtttggttgcgggtgagatggttcttgaatcttcaattcttgatacatgaaaagcgggaacacgggtacttcagggcaaaaaaaaa

SEQ ID NO: 34548 - DNA, 658 bp, Triticum aestivum
  Clone ID: PAT_TA_34548
ggcccgccggtgctcgtgcctccacaacaggcgtctctccccatgacctgtgcccaaactggatccacaacctaggacatgccctagcaagggacttggagatggcgttggatgaggaaaatgagatccggacgaaatcggagtgtattggcagcggctagagcgatgtgggtttctatacgtaaccttgcctgtttagatgacctggtttgttcttgtggtaagagaactagcatcaattagtacagactttgctgtttatgcaagaacttgttaaggtaaatattccatattctatccatgtttcggaagtaacattgtgcaataatttactgtaatacatatcttcggatgaattggtagtcacacacccacgacactttacctttgaagattgtatatatttgtgagtgtacaagtataattagttataggggagaaagatgttggtcttttctcgaagaccacaaaggttcatgccttttggaattgattttgatttattgtattgatcaactttgccaagtcattttgtggtatttagcattcccaaatttttatatttagctaaatttaatcttgacctgatttgctctgcccaatcacgcatgatgccttttcttttctatcaactggatgcaggtttagtttacctttt

SEQ ID NO: 34549 - DNA, 743 bp, Triticum aestivum
  unsure (1)..(743): unsure at all n locations
  Clone ID: PAT_TA_34549
ttcggcacgaggggacaccaggcgagcggcggcggcggcggcgtggttagccatgtcttctcttctcagcccaccaaagccagaaatcgagttcaaagaggcggaggggaaggaggaaagaagatggaaagcgagtccggtatggggacggagggggaatccggcaaggagcaggatttgctgttggatctggggaggaaactcgggaagatggaaatcgagttagggaagtggacggagcaggcttccggcaaggagcaggagacggtgcgggatctgaagaagaggcacaggaaactcagtaagaatcgtaggtacctcttgcaagatatcgtctcagggaagtttaaggaattgtattccgattccggccgcaacagggtaatggggattttcagggaagccgaggagctggacaaggagttgatgattattaaggagaaggagaaggagaaggagaagcaggagacggtggtggattccggcgaggaggagatgggcagggattcggcgcagcaccagtccctgatggaggggatcaactccgtggagagggagcgcaaagacctgcttggctcacttactcctaccttttctctctggaaagagattgattctcaaacaacctggacgatcgccacaacggagtctgctactttntctagggacaacantgagaatncacttgcagactactttaacctgatcctccaagtatggaggacctgggtcatcggatgctt

SEQ ID NO: 34550 - DNA, 689 bp, Triticum aestivum
  unsure (1)..(689): unsure at all n locations
  Clone ID: PAT_TA_34550
angaanntcaacatctnttaggaatatttntgtctgcagnacattgggccttactggagagccnacttccgttcccgggttttctaggaagtgatatgcggttgnccctgttatggttggccttgaccatgcaacgtctccactcatcgcttagagtcggatatcagaagtattagtaaattcaacaaatttgtggaggacaacgggttcaagttaaatacagaaggaggaattttgaaagtgagtcctgacggtctcctccagcaaagctcaactgtagctgattcatcattatttacttttgcggatggaatcactgaatctattccacgttcctatattgaatttgctgaacggctgccacttccacagttcagagatttgcaagatgaagaggtcaaggaacaccacaggcgcgatggttttgaggtgggcaacgcagacaagatatttgagagcacttcaaaggatcagcttaccagaagatctgcataagcggcgtactcttgatcgaacattctgcaggcgggccaacgagcctcttggaagtgtgttgaatgcgtgtgttgtgtaatcattgtatgccttgaagtgggttgaaaacagatgctcaataaagatatatttcctaacgaaaaaaaaaaaaaaaaaaaaaaaaaaacccaaaaaaaaaaaaaaaaaggccccta

SEQ ID NO: 34551 - DNA, 986 bp, Triticum aestivum
  Clone ID: PAT_TA_34551
gcaagcgagtaagcggtagcacatgggacttacaacacaaccgtgaccagtcaggtatagatcacaaagagactagtacagccatagctcgtcatctatcactgcctggaaacaatatgaatccacaagagaaatccccagtagatggaccattgccgcagtggttccgtgaaggaatggcagggcctatcctaaattctggaatgtgcagcgaggtatttcagtttgacgtttccgctgccaccaattccggtggcataatacctgcttctccagctgtgaactcctcgagtgttaatgctactcgaaaggttccaacaccagctcctgcttattacggcaagctgaagaataggaggatcatgtacaatgaggcgattccactcactgggaaaacggcgaacaacacagggccttttaacagaacttctgaaagcagcaagttacctgataagaagccagcatcgtcggtagttgtttctgtgctagctgatcccagggaggccggtgacggcgacagcgatccaaggatgactcccaagtccctctccaggatatttgttgttgttctccttgatggtgtcagatatgtcacatactcctgcactcttcctttcaagggtgccagtcctcatcttgtaaactaacaaataatcatgggggttgacgcgttgtcatggttctcaagcagctttgctggccccgacgaaatgtgatggccgatagattaaaacgacctgatgctgttgtctaaccaaggaatgaactttctattcactcggcctgaggtaattcaagtttgtcgaaggtttgaagtggtgtgagctaaatgtggttctgcaggtttaggctatgagtgcagcttttgtgctgctgtaatataaccaggatcttatgctgtactactaaccttgttgttataatgtaatactgtttgaggaacttttaagacaaaatatacatgtagttttatcattcctgaacat

SEQ ID NO: 34552 - DNA, 683 bp, Triticum aestivum
  unsure (1)..(683): unsure at all n locations
  Clone ID: PAT_TA_34552
gatggggttgacggacaagaagaggaaccagaaggggtgtgctcttgcggtgcttggcttgttccaagaccatgaggggaaggacttgctggtgcgtgctatgaattgtttttggtatatctgtctttgaacaggtgaagcaaacctttcatcacgtgtaatcccacttcctgctacattttctatgagatgcaccaagcgttgtaatgaatcttgacgttttgtattgagccatcactactttgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggttgtttgttttttaagttttattgtggggagatggtttcagaatctttttaacctgggttgacaaaataaaaaaaaccgataggggttttaaaagtggaataggggaaaaaccttggggtattgtaatgtattatcggacgcaaaattgccattttgtaaaaggggggaaaaagaaaaaaggcccgaacgaatggcctttccaaaaagtggggaaccctaaaggggaaagggaacgccccctgaaggggggaaaaaaggggggggggggggggggttacccnaaggggaaccgttaaattggaagggcc

SEQ ID NO: 34553 - DNA, 1014 bp, Triticum aestivum
  Clone ID: PAT_TA_34553
ggcggccagcccccggcgttttccccaaatcaattcccccccttccttccaccctccctcctcgggagctcgccgcaccgccgctcctcctcctcgctgctgggagggcaggggaggcgagggcaggggaggggaggaatcatatattcctcctccggccgacgctcctggtggcatccgacgttcattccacaccgccacgcccagcacatcccttctttcttttggtgccgtccactgcaactccttcaagcgattcgccttcttcgcgcaggtagcaagctcaaatggagaacagtttcgagaaaaataacatgctgaaagaattctacattccgacctatattttcatgccagagtcctcggtggagcaagtttctcacataccctgctgtccagtgattgttttcatcaacacccgaagtggtggccaacttggacataatttacttatcacataccgcaagcttctcaatcatgctcaggtgtttgatctacttgatgaaactccagacaaagtcttacacaaactctacaacaacgtggaaaggctcaagcgtgatggggatactcttgcttctgaaatccataggaggttgaggctaatagttgctggaggcgatggaacagccggttggttgcttggagttgtatctgatctcaagctagttcatccacctcccgttgctacagttcccctgggaactggaaataacctgccatattcttttggatggggcaagagaaatcctggcacagatcgtgagtctgtcatatccttcctaaagttggtaaaagaagcaagagagataaacattgatagctggcatactgtcatgagaatgaaatgcccaaaacgttctccttgcgatccaattgctccttctgatttgccgcatcctctgcatgcatttcaccgtgtgcatttcacagatccagaagatatggaatattcttacacatatcgtggagggttttggaattatttcagtatgggaatggatgcacaagtgt

SEQ ID NO: 34554 - DNA, 735 bp, Triticum aestivum
  Clone ID: PAT_TA_34554
gatatcgctccttccgttcctaacaaaagattgacaccaagtgttagcaatatcgataacctgaaaaataaagtatctgaaaatgggaagtcatttaatacacgtggaattaaggacaagaaaaagagtgaagaacgtaagaagaagcgtactgttcaggaagaggagagggagcgaggaagagttagcttaaatgtttatttaacatacatgggggaagcctacaaaggttcactgattccactcattgtcttggcgcaaaccctgttccaagttcttcagattgccagtaactggtggatggcatgggcaaacccacaaacagaaggagatgcacctaagacaagtagtgtggtccttcttgttgtttatatgtgccttgctttcgggagttcattgtttgtgtttgtgagaagccttcttgtagctacatttggtttagcagctgctcagaaactatttataaaaatgctaaggtgtgtgtttcgagcgccaatgtcattcttcgatactacaccatctggacggattctgaatcgagtttctgtagatcaaagtgttgtggaccttgatatagcattcaggctaggggggtttgcatcaacaacaattcaactccttggaatcgttgctgtcatgagcaaagtcacatggcaagttctgtttcttatagttcctatggctatggcatgcatgtggatgcagagatattacattgcttcatcgagggagctg

SEQ ID NO: 34555 - DNA, 708 bp, Triticum aestivum
  unsure (1)..(708): unsure at all n locations
  Clone ID: PAT_TA_34555
ccacgcgtccgcggagagagagccgagggagagggaaaaaaaatgctgcgggtggaggaggcgctggcggcggtgctgtccgccgcggcggcctgccgcgccgcgccgtcggccgtgccgctgctcgacgcgctcggcctcgtcctcgcggaggacgtccgcgcgcccgaccccctgccccccttccgcgcctccgtcaaggacgggtacgccgtggtggccgccgacgggcccggggagtacccggtcatcgcggaggctagggccggcgacgacgcgctcggcgtggtcgtgacacccggcaccgtcgcgtacgtcacgaccggagggccgattcccgacggcgcggatgccgtcgtgcaggtggaggacacggagcaggtcgccgccgcgccggatgggtcgaagagggtcaggatctcggtgcgggtacccgaggggcacgatatacgcagcgtgggatgtgacatagagaaagattatatagtgctgaaatctggtgagaacataggtcctgcagaaattgggctacttgcaacagtgggagtaactactgtcaaggcataccgtcgaccaaccattgctgtattttctacaggggatgagttagttcagccagccactgcaactctcaatcgtggtcagattcgtgattctaaccgggccctggttcttgctgctgctannngcagaaagtgtnaagnnnnn

SEQ ID NO: 34556 - DNA, 734 bp, Triticum aestivum
  Clone ID: PAT_TA_34556
gctggaggtacagcgaggagacgtgtacaacttggagcagggcagcatcctgtacatccagagctaccccaacgccaccagagagcgtctccggatctacgccatcttcaccagcaacgccatcaactccgacgacccatcgcaccccaattcagaagcatactcgagcgtcagcaatctactgagaggatttgaagtaaagattcttcgacagggatttggggtttccgctgaagtggtggaggcaatccgatcggccaagagcccacagtcgattataacgtacaatccagaccaggagaaggaagagaagtcgaattggacggaagaaatcttcaacgcgctgtggggcgacgagtccccactgaacaagaagaagaagaaggataagcacaagaagaaggacaagaaggacgacaaatccaagagcgagacgtttaacttctactccggcaagccggacgtcaagaactgcttcggatggagcaaaaccatgaccaacaaggacctgcagaacctcaaggggtccaacattggcatgttcatggtgaacctgaccacgggggcgatgatggggcctcactggaacccgaaagccacggagatcgccatcgtcacccacggatcagggatcgtgcaggtggtatgcccgagcatcccgtcgggcaccggaggcggtcacggccaccacgacgagggtggccgcgggggcggcgatcacggtcaccacgatg

SEQ ID NO: 34557 - DNA, 743 bp, Triticum aestivum
  Clone ID: PAT_TA_34557
tgagctcactaagccatcgtcctgttttgcttctccctacacatccttactaagacaaaggggcctgcccagctagcagcaacttcctagctggaagatgcatagccataacgcacgcatcgataaggagcagtttatcacgcagcttgtacgcatgccgccgacgcctttccgcctcatgcctatatcgtggcgggtgagcaagggaatctcgttggaggcccgtattggaagggatctcggtaggcgcaccgccgttgccgtgtcgttcgtcgatctacaagagatcaagaagggtgatgttctggatgctgatctcgactaatagttgccggatgaactatgcaatggcagcatggatgagcttcgtgtgcggttcacatttacctggtggaccatcaccaaccggatggaggtgaagcaagtgggcaagtcagggaaatgctcggaaggctatcgagaagatcaacgatcttaaccccacgatcctaatttcagtttgtacctcgttgttgggctgtcagaaaagtttggagcaggagcaatgatatgacaattgtggctaactttcttgtcattagtcatatatgtgctaatggaccttccgggttctccaccattatgttaccggccggtttctcatctgaaaaataccccatagcatagtggacaatgctttttttggtcagaagtagtatttctacatgaaactaagttatatatgcgtaaaaaaaaaaaaaaaa

SEQ ID NO: 34558 - DNA, 876 bp, Triticum aestivum
  Clone ID: PAT_TA_34558
tgaaaaattcagaagagaacatcctgagttgtacaaaggtcaagattcacaagctaatgaaactggaggcaaaccaacagatggtaacaatccaggtggtccacctcctggacgtagagaagctgctaccgatgaattgttgctcgagcgtttccgcaagcgagaaaaattccgtgtcatgcgaagatagcaatagctgaccaagcaggctgctggtttggcactgttgccctttaagcagaaaacatgttagtggcaacacacgatagtcctgtatgttgggttattcactgaaaacccacactaaagcaggtaggctcccttggttggttactctgcttctgcagctcctgttatgtagaaagaagcgcacagacttattacagaggagctatgaaacagatttgagtgggtctgtttccttcattgtgctgcatcgatctgggggcttcatacagttcgaggacttcacagtggatgtcaaattgcaggagccactctaattgtagggatgtatgactcttatttgtagtgtccgccggcactctgttcactttactttgctggaagaaactctgttctcagctgtgctcttctcctatgctatgcatgagcggcgtcttgagccaaggggtggtcgcaggttgtagtgcattttcttatgttcactttagcctaagtgcactttggcgcggaatttacgttcatcaatctggcctgcaagtgcaatctgcttgtgtgaattgctcgcagcttttttgcagttttactgcagtatcttcatcaatttgtacttctgttcaagcgcttacagtttcttcagtttacaataacacttgattattcatggactacagtaaaaaaaaaaaaaaaaaa

SEQ ID NO: 34559 - DNA, 1204 bp, Triticum aestivum
  unsure (1)..(1204): unsure at all n locations
  Clone ID: PAT_TA_34559
cagtatagcatacgatggtacacttcctgacctgtatttgccaaacattgagcatggaattgtcaatgcggctaaagatgagcctgccagtacaacttcctcagcccaacttactaagaggccatggaaactgttcattccaaatgcataccatccactattgctccagcagcaccaggaaaatttgcgtcgtacaaaaaaggatgttgcaagtgccacagcggagattcgtaggaggaggatatacggacaagatatcacagaggaagatcaactggcttcagaacttgatttcatgaaaattagggtttctgagctggagaggaaccatccgatcccagtagattttatgatcgcggaagagactactgttttggtcataactggcccaaatactgggggaaaaacaatcagcttgaagacggttgggctggcatcgttaatggccaagataggtctatacattctagcttctgaaccagttaaaattccatggttcgatgctgtttatgctgacattggagatgagcaatctttgacccaatcactctcaacattctctgggcatctgaagcagattgggtaaatccttaactatccgtacagcatctgaaccttcgttttattaggccattcgcgctcagtcaacttcacaatccttggtccttttggatgaggttggtgccgggacaaatccactcgaaggagctgctttggggatgtctctcttggagtcttttgctgaagctggttcctttctgactctagctacaactcatcatggagaactgaaaacactgaaatacagcaatgattcatttgagaatgcatgcgtggaatttgatgaagagaatctaaagcctacgttcaggatactttggggaataccagggcgttcaaatgcaatcaatattgctgaaaggctaggtttgcccttggatattatagaaagttctcggcagttacttggaacagctggtgcagagataaatgcggtaagttcgacaggatcatgacaatcctttatttctgagattaatattggcctttntgtattgtgaagtggcaatttggttttataacatcgagttgctcagatgctataatatttcgcgtgttactgatagaaatggtgtcttccctggcactggaaattctgttatttgcttgaggaatatgtgttcttatgttagagactcatccg

SEQ ID NO: 34560 - DNA, 866 bp, Triticum aestivum
  Clone ID: PAT_TA_34560
aagctcgtttcaacctggtgactgcgctttcaaacattgaggctaagaaaagatttgaatttttggaggctgttagtgggacaatggatgcacatcttcgttatttcaaacaaggatatgaattactccatcagatggaaccgtatatcaatcaagttcttgcttatgcacagcaatcaagagaaaggtccaactacgagcaagctgctcttgtagagaggatgcaagagttcaaaaggcagattgaccgggaaagtcggtggtcgccaaacgggatgactgattcccctaatggtgatggaatacaagcaattggtcgaagttcacataagatgattgaagccgtcatgcaatcagcttcaaagggaaaggttcagactattcggcaaggctatctctcaaagcgttcttcgaatttgagaggcgactggaaaaggaggttctttgtccttgataatctatgaatgttgtattattaccgcaagcaaaatagtagaccatccagtggttattctaaccaacgaagtagcactcccactgagcatggctctgggctgcttagcagatggttctcatctcattaccatggcggtgtgcatgatgagaaatctgtagcacgacatacagtaaacctgctaacatcaaccattaaagttgacgcagatcaatcagatctaaggttctgtttcagaataatttcgcccacaaaaaactacacactgcaggcagagagtgcgatggatcagatggattggattgaaaagatcactggtgtcattgcttctttgttaagctcccaatcccctgaacggcgtctactgttgagccctaaaggcagtggccatcatcgaacaaacagcgaaagt

SEQ ID NO: 34561 - DNA, 1008 bp, Triticum aestivum
  unsure (1)..(1008): unsure at all n locations
  Clone ID: PAT_TA_34561
ctgaatggccggttcccatgcctgatggctccatgggagggccatgggattaccaaatgctgcctctttcatccactacaccgtcagcaagggatatgatatctatggctgggagcttggaaacgaactcagcggcagtggagttgggactcgggtcggtgcagatcagtatgccgcggatgtgatcaacctgaaccaaatcgttgacaaagcctaccaaggatcgaaaccgctggtgatcgcgccgggaggcttcttcgacgcgggttggttcaccgagctcgtagccaaaacaaagccgaaccagatggatgtgatcactcaccatatctacaatttaggccccggtgttgacacgcatctcgttgagaaaattctcaacccctcttaccttgataatatggtaagcacgttcagtaaccttcaggggatactgaagtccgcagggacatccaccaccgcgtgggtcggcgaagctggaggggcttacaacagtggccaccaccttgtaactgatgcatttgtgttcagtttctggtacctggatcaactcgggatgtccgccaagtacgacacaaagagttattgcaggcaaatcttggttggagggaattacggcctgctcaacacaacaacatttgaaccaaatcctgattactacagtgctctgctatggcatcgcctcatgggaaccaaggttctctccacgacattcaacggcacaaacaagatccgtgcttatacacattgcgcaaaagattcgcaagggatcaccctactcctgatcaacctcagtggcaacaacacaaaccatatctatgtgaccagcgagggtgcacaagaggtcacgcatccccacgtcgcaaaggagcacacaaggtccattcccaagctcggcgaaacaactgggctcacaaagacangaataccanctcacaancaaagattggaacctgcagagccaacatatgctgctcaatggnaatgtncttgggcaacggggncaat

SEQ ID NO: 34562 - DNA, 664 bp, Triticum aestivum
  unsure (1)..(664): unsure at all n locations
  Clone ID: PAT_TA_34562
gtggtggcgctggtaggctgaactgcggcgagagacagcggcaagagacatcacccactgggcctgcgcaaactactgacagtgttaacacagaagcacctgggtggatgaaaaggttactcctgggtagcactccaccagactggtcggccatttccttctcggatgagtgcactagagcagacagtctgcaaatatgcagaagaacctaaaagaatgtaatcagatcagaactcaggggtgagtatttttaggtggaaagggtccttccattaaccaataacagttgccagattgctggctacaaggtcatgcacgaacgctcaagccttacccagccaaataacatgggtatttgctccagccgtgccccaaaggctgcaagtctgtcagccaaaatattacaagttctaggacaaaatgtaacagagtagctagcaaagttcagaggtaagaactccttgatttcttgtagcagatggtatgataagaacatggatggatcgtttgcgtaaaaaaaaaaaaaaaaaaaaaaaaaaaaaaaaaaaaaaaaaaaaaaaaaaaaaaaaaaaaaagaaaaaaaaaaaaaaaaaaaaaaaaattacnncctctttaaaacaaccaaatttatttttttattgcggcccccaaattaaattttctg

SEQ ID NO: 34563 - DNA, 1064 bp, Triticum aestivum
  unsure (1)..(1064): unsure at all n locations
  Clone ID: PAT_TA_34563
tgctgcccacgcggcccccggctttcttcgcgtctcacgtcagtcggccgaatagagcccatgcccaagccaggaacccacgctgttctgaatctgtccatcagtctccgcttcgactggttcgttcagccgggaaggagaagagctgcagaagatgagcaagccctggaccctcctcacccacctccacaccctcgcggggccggccccgctgttcccgtccctgtgttccacggagggtcaggccaaggtggaccaggggaagtgggcggcctacgggcgcctctcctccttcaccaccccctcgcagggcctggcgtgacgctcctgtacccgctgtatgcgtcggtgcacgcgatggagagcccgtcgaaggtggacgacgagcagtggctggcctactggatcctctactccttcatcacgctcctcgagatggtcctcgagtccctcatctactggataccgatctggtacccgctgaagctgctgttcctggcgtggctggcgctgcccaagttcaagggcgcggccttcatctacgacaggttcgtcagggagcagctcaggaagctcggcctcaccagccaccccgacagcggcatcagcagcggcagcaaggaggagaagggcgccaaggtcgacaagtcgtcctcgccgtcgacgtctcccaaggagaaggagaacgccaagagcaggttcctctccttcgtcgctcccaagaaagaccactgaaggagattggagcagcaaccagagatcccagcagctagcttcttggcttgtggtgttttcttggtttgtttgagattttagattgtggtgttgagagtatttacatatcttgtcagaaacgaccacaaggtgcacatactcaaggccgaggctgaccatggtcatgtgcactgaggagctgacaaggacctgngcacactgngagatccaggagcataacctactgttgtgcaggactgcggaatcttaactattaggtgtatcttgnatctgttgtaagcccatcgtgaagtattaacacgaccacccatgcgctcgcctaataaatt

SEQ ID NO: 34564 - DNA, 404 bp, Triticum aestivum
  Clone ID: PAT_TA_34564
ctgacagtgaagcgatatcaagttgcagagaagaaaagagaaggaccgaagtgagagcggcagcttaattagccatggctcaagcacaggcgacacgaggctcaggcgaccccatgaaggcccagcaggagcagccggagcccatccagtacggccacgtcttcgccgtcacgggcgacctagccgtccaggccatcgcgccgcgggacgcggaggccatgcgcaccgccgaggagagcgtgcagggcgtgcaggtcccgcaggccagcggcggcggcttcagcgcggcggtggccatggagacggccgccacgtacaaccaggccgtcggcgccgtccgcccgggccaggccagcgacgcggccaccaagcagggcatcaccgtcacccagacggccgtgccc

SEQ ID NO: 34565 - DNA, 1130 bp, Triticum aestivum
  Clone ID: PAT_TA_34565
cgggtttgcagaacagagaagaaagagacagtgaagtgagaacagctgagaaggaaacggtgaagtaataagcagctgctagccctcactcaagcccaggcgacggcagccgaaccgatgccggcccggcaggggcagcgccagcccagccagtccggccatgccttcgcccgcgcgaccgaccttgccggccaggcgctccgccggcgggagggggcaggcatgcccaccgccgaagaaagcgggcagggcgtgcagcgccgacaggccagcggcggcggcttccgtgcggcgccaggccatggggacggcccgcgcgtacaagccggccgtcgcggccgcccggccgggccaggccagcgagccggcaaccaagccgggcatcaccgtcacccagccgtccgtggcgggcggccggatcgtgacctagtccgtggccggccaggtggtgagacagcagtcgccggccgagcgggcgtggaggcaccggaggcagcggaggatgggggagggcgcgcgctcggcgacgctctgcgcgggccggccgcccccgggggcgaccgacgccgcggggatccgcgcggcggcagacgcagccgcagggagcgcccgaggtcatgcccggcggcctggccgaccaggcgtgggccgcggcgagcgccaacgcctgggccgagcgcgacgaggacaagatcacggtcggcgatgtcctctcggacgcgacgacgaagctggcggacgacaagccggcggcgagggaggacgcggccagggtggtgcaggcggagacgtacagcgacgccggggcgcgcaccaaggccggcggggtgggcgccgcggtcaccacggcggcgaggctcaaccaagaggacgacgacgacgacgcttgaattttcgcgtcgtgccacgtctcgtgtgtgcgctgtaccctcggatcagacgggaacacgcagaacaagatcgtgtgtgtaacctttacaggagagcatcctgttgagtgaggcgaatcaaggcagtagtagattcagccagccttgcgtgtaataaacgaatgacagtgttggcccgtcggtgaatctgtacatgtttttcttttctctgcgggtgtagcagtatgtcgtgtgcttttt

SEQ ID NO: 34566 - DNA, 389 bp, Triticum aestivum
  Clone ID: PAT_TA_34566
ctcgctggtcgacatgacacactatattatgtacgatgatctgctgaacgtggtcaccgacgacgacgaggatgccgagtttgatgacatggaggattatatcgacgacgcggactgggacgccgacatgtatgatgatgtgctcgatgtctgaaggagctgtgactaggaccgggtcgggttctcacgtggaaggaaggacgggaacttggtgctgaaacaatgtggtccttacctgtgtttagattcttgaagctgggttctcttacgtttgttaactagtctgctactctcttgctgtgaaactgggttcgctttctctccgcgactgtaattttatgccgcacctgtgatttggtcatgcaataaaaccctgtaaattaagtatc

SEQ ID NO: 34567 - DNA, 1569 bp, Triticum aestivum
  unsure (1)..(1569): unsure at all n locations
  Clone ID: PAT_TA_34567
gcaaaccccaccctctccccgccccccccctcccccacccccgcgccggcccccctccccgcccccgccggcccgcccggcagaccctagcctagggccaccgcatcgccggccctggatgacgacgccggcgagggcgagggcgaggtccacattcccgactgggcggggatgcgggcggaggcgctgtccgcgggggtccgggggcggggcgtcgccgatgtcccgacgggccccgggcgggcgtggcgcgcgtggcgccgcctcgccgaccgagaccccgggccgtggcgccgcctcgacatgacccgccacggggacatcctcgagaccgaggaggccgaggccatggcccgtcctgccgtcgagccccccgcgggcaccctccactccttctgcgccgacaccttcgtcaacccgactctctcatcatgctaccatctccggcaggggcagccctcgcctgaagagccgttcaactcagcttgtgtgatgaagtatccaacgaggcgctggcagaggcagtcaagggctttcctcaacttgaggagctggagatcacattctgctcactgaacagcaacgtgtgcgagttagtcggcagagcctgcccacaactgaaatcatttcggctgaacgagcgctggacgatcctccaaagggggttcgcggcctttgagggcatggatgatgacacgggagcgctcgggagggaaaacagcatgcctgagccccgcggcctccagctgatgggcaacaacgtgcccagcctcgagactggtccgcgatcctcgcccactgaccccccctcgagtccactcgacgtgcgccgctgctgcaacctccaggtagacgacgccctgaggtgcaagcgcccccgaatcgggaacctgaggcttcctcgggatcccagctccgtcccccggcggttccgacatcgaggtcgacatgtacgatgatctgctggacgtggtcaccgacgaggaggatgccgagttcgatgacatggctgattatatcgacggtgtgggctcggacgctgacatgtatgatgacgtgttcgacgatgtctgaaggagctgtgaccaggacccgggttctcacgtgcaaggacgggaacttggtgctgaagcaatgtggtgtctactgtgttgggattcttgaaggaccgggttcacgcactttgttatcggagattgattctcgtattatgtttgtgcctcctgtttgttaactcgtatactttcttgctgcccgcctccggtctcttgctacgaaactgggttcgctttctctcccgtgattgtaatttatgccgcacctgtgatttggtcatgcaataaaatcctgtaatttgtgtatgacaccaaaatcaggggggccgtaccaatcgccatatgatcgataccgcctacngcgtcnttaaagtctacggaaacctgggtacactatgcttagaatcccttcaactgntanacaaagcccacnttcctcaattcaactaagnaangaccccntnggataccgggntggacactcctaatncagcagcgncttcttctctncatg

SEQ ID NO: 34568 - DNA, 743 bp, Triticum aestivum
  unsure (1)..(743): unsure at all n locations
  Clone ID: PAT_TA_34568
gcaggctagcggagacagacttcaaagacttgttaccgagcagagaccgcgagcaatggcacagcaggagaagaaggcgccggagctgcagcaggacccggagatccaggactcggagaaccggacacagcaggtgaagaaggcgccggagctgcaggacccggagatccgggcagagctggaccgccgcgcccgcgaggagggcgagaccgtcatcaagagcggcgccggcggcaagaccctcgaggcgcaggagcgcctggcggaagggcgtaagaagggcgggctgagccgtgcgaccggctccggcaacgagcgcgcagagggcgagggcggggtggtgatcgagccggacgagaagaagctcaaggaggtcaagaaggatctcgggcgcgaatgatcgagcgaggtagacgatgtacggcctcacaggccggccctcctatatatatatatatatcgtacgtgtggatgtactgtaagttagtacgtagtgctatgggtgtacgtggtagtaggctaggttgaaggatgcagcttacgtagtagcgttgatgcatgcatgtcttcgtgctcgcacggacatggcgtacgtacggctggctacaaaattttggtccctggattgtagccgccgtagcccctctatatatgtagctcgatcgtaatccatgtaccctggctgcaaaattttggcatgtatgtacgttnctgtagccaatgatnccccggatatatgagtt

SEQ ID NO: 34569 - DNA, 2380 bp, Triticum aestivum
  Clone ID: PAT_TA_34569
ccacgcgtccgactttctcaagacagatattggatgcattgattgtcatgaaaggtgctggaattattcattgtgatctaaaaccggaaaatatcctcataacaccgaaagtaaactcagcagctggagttaaagtaattgattttggatcagcgtgcatggagggtaaaacgatttactcgtatatccagagccgttattacaggtcacctgaagtgcttcttggctatccatacactaccgccattgatatgtggtcatttggctgcatagttgctgaactttatataggtctacctttatttcccggagcatcagaatacgatgtccttagccgtatgattgagattgtcggtgggcaaccaccagatgatcttcttagggaggctaaaaacaccaggaagttttttaaacatgttggaagcatttatcctggtaatgaagcacatgatggtctttgcagttcatacagagtactaacagaagacgaggttgaagcaagggattccaaaaagccaaaaatagggaaatggtatttccctcgtgggaggcttgacagactcatattcgcgtacccttggaagaatttaaatgagggtaatctgccagagactgaaaaggaagattgcttagcattggttgattttttgagaggacttgttgagtttgatcctaataagcgatggtcaccattgcaggcttcatatcatccattcataactggtgaagccttcactggtccttatgagcctttccgtgagaccccagtaattcctgttggtcgtgctgcaacagttgatcacaatcctggaggaggtcactggctagctgctggcctttcccctcaggttggaagttgggagcattaacagatccctaccgttcaataacgtttttccgccaaagatgcccttttcatatggaagcagctgcggcagcttcagtagccgtggtagctttaatgataacgtaggtcctgcaagcagctacggaagctatgatgtcaataatgttaacatgtatcattcaccactaggcccttctgggttcaatttacagtcacaagccggaggaacatttctaggatttagtccagatattagaagaaggcctcatctctctcatggtgttggcattcggctaagtcctggtggtccaggtcctatgtctcttggggccagtccatcacaatttactcctccaaattcccaaacacaaatgccagctagcgctactgctaagtatgttgccacttctcctgcaaggggcagtcatggctcctcattaggaaaagccgctgtggtaggccaatacaataggagaaggaatcttggtcaccctcctatgtcaatgccaccacatgagtacacatctcagctaatccagggacctcatggagatagtgtcagttcagcatttgttcgaggacattctggctattcatatggtgcacttcctaattctggtcattataattggaggccgcagataggcgttagcactggtttatccacaaactcttcttccaatcatggttatgttcaaccatctggttacaatgatttccgtcctttgcactcatccaatgtgcgagctgatacatcaacctcttcatcagtaccagatccagctgattgggatcccaactatagcgatgagtcactcctgcaagaagataattcactatcagctgagttaggcagtgttcacctgagagatgcaagtggtcgaacaatccagtctggcagattgcccaatatccaaagccatgatattgcaggctcgaatcaaagaaatgacttcctatttcatgcaccgtctctcagagagagtggtcattcaacaggccacgtcaactatgatagttacaaccatgccaattattcccagcgaaattttcctggtcgtcacggacaaccatttcagcggcacaaccatatgaattccacctctatacgcccgacggggaatctccagaatgttcaatctgcctggtccaaatatggcatgccagattctacttcgccccctcggatggttgaagggatgccttggggaggaagcgctggtcactcccttgcaacaagcgggctgccgccgtcctttgggagaaaggatttcgggaggatcttctagcccttgccttggatctggaggaatgccgtccaattgatggcgtaaattgtttgtgtttgcaattctttgttgcgctggttacgtgctgttgattttgcgactcatagcgttcctccgactgttgtcctgttgtggtacttggattcatgaagcataggctataattacagcagttgtttggtggtggttgttgcttcagtttctttaacggttctttgtcaaaaaaaaaaaaaaaaaaaaaaaa

SEQ ID NO: 34570 - DNA, 1189 bp, Triticum aestivum
  unsure (1)..(1189): unsure at all n locations
  Clone ID: PAT_TA_34570
gggcaaactaagctgaaagttcttaaggatatagcaaaggagcatcaaatcgattgggacccgagcgaggctgagcaggatctccttaaacctgctgaagagctgattcaaggacctagttcatttggtgaagcttccaaaatgcccgtgaagactacgctatcagcaaattttgtgcaacccagtccatctaattacagttctggatacgctgatgagcatgatgataataatgttgggggtgccatgcaattcaaggatgcagcttcagctgctcgagcagctgcggagtctgctgcgcaagcagcgtttgccgccaaggctgcagccaaccttgccaacgagaacaaccattcatctgacgaagacgatgacgatgacgaggacgaggactggaagaccactcttcacgaatccactcattctagcaggcgccaatcgatgatgagcaactcaagcagaatctccaggaaagaaaatgcatccaccttcgacgaaatgaggctccgaggaagcacaggggggaggaggttaagtgggtcgaatcacatggaagaaaaagactcggacctgcttcaggatctgggtactggcaggacgcgcagaaggaacagccgtgctgctagcaaggtgcactcggagataaagtttgatgattcggaggtggaggatggcagcgacgccgagatacagtcctcccttgagaggcggcctccacagaaggaccgttaccaaggaaacggtcaccacgaagagaaggaagcagaagacgacgatgatgacttccctgagccgccgaaggcgaaccccggctcccgcgttcatccgaacatgcccctggacttcgagaccctgacggcacgcttcgaggcgctgaggtcatccggggggaagctcccttagctcgcgcagtggaatcatgatgttgaatcctttgctgcgcctatacaatgccagaactacatactcctaagttatatataggctatctgaatcctttgctcgtgcgtttggttttgcaagtgctggcttgcccccaaactattacagtattacatctgtgttgctcccaggtatataggctatctgaagttgtgaggtgaatgagagcggaaacttttgtgatcttcagtcagtgtgctggactgcaccacctgcaaccggctttatncactaagaaacgttacat

SEQ ID NO: 34571 - DNA, 799 bp, Triticum aestivum
  unsure (1)..(799): unsure at all n locations
  Clone ID: PAT_TA_34571
gctgcctgctgctctgcctctgctgctgtagccgtagctgcacggcggcaatggcgatctgaaggccgtcctccgccgccgcccgccggaagctcgacgagaatggagcggatcctcaagtccgccagggagtccggctccctcaacctctccaaccgctccctcagcgaggtgcccggggaggtgtacaacaacttggacacgggcagcctggatgacaaatggtgggagggagtggacctccagaagctcatactggctcataacaacctggaagtgttgagagaagaccttaggaatctgtcttctcttgtcgtgttaaacataagccacaatcagctatcttccgttcctgcagccattggagaccttccgttgttaaaatcattggatgtctcgttcaatcaaataaaacttatacccgaagaagttggcttggctactgctttagtcaaggttgacttctcaaataattgcctcactgagctgccagctagccttggcagatgcttgaacttgtcagaactcaaggcatcaaacaacaacatatccagattaccagatgaacttgctggttgctgcaagctgagaatttgattggagggaacaagcttggctacttcaaaaaantgttacatatggccttgttacaaactgatnttgnaaaataatacacattcgnttgatggacntttaaaatattnaaggnccgcncaaaaaanacttnatcttttcataaggagtttttactggttactggaaaantntgncatccaagaatgntcttnaatngacctgt

SEQ ID NO: 34572 - DNA, 968 bp, Triticum aestivum
  Clone ID: PAT_TA_34572
tgatgttccttcgctacaggaagttaatcgtatgattgctcggactgaagaggaagtcgagctctttgatcagatggatgaagaatttgattggacaggagatatgatgaaacataaccaggttccaaagtggctccgcgttggctctacagatgttgactgtgttgtggcgagcttaaccaaaaagcctgccagaaatgcacttggcagtgctcctgacaatggtgacaaactcgagaaaagaagggggcgacccacggggtctggtaagtactctatctacagggagtatgaagatgaagacgatgaggagtccgaagaagatgatgaagagaggaatacaccatctcaccctgaagaagaagcaggagaatctgaagaggaagaggaaaatgatgattcagtacctgatgatgataacaaagatcaatcggaggaagaagagcctaacaatgatgacaggtacgatcttcaacaagggacaggaagtggaaaaggtcacaagtctgaagaagctggctcgacaggatcttcatctggaagccggagattaccaccacccgccccttcctcatctttgaagaagttgcggtctctatctgcattagattcccgcccaggcactttttcaaaaagaacttcagatgacttggaggacggagagattgcattatcaggggactcacatatggatctacagcaatcaggaagctggaaccatgaccgggatgatggtgaggatgaacaggtcctgcagccaaaaataaaacgcaaaaggagtctccgaactcgtccaagacctagcaccgataaacaggaagatagatctggtgcagatggtaccttcccccaacgtggtgctcgccttttattcccaggagatggtgattatgattcacagcaagatgcccatgctcttgcagatcctacttccaggcagcaagacacagttcatccgatagtgaagc

SEQ ID NO: 34573 - DNA, 776 bp, Triticum aestivum
  Clone ID: PAT_TA_34573
gttgaatgatagcattcgctaaaatctgcaaagcgcacacagccgaagctcgagcacctactgtactagacatgcaggccgggaggagcgccatggaggccaccaaggaggcggcggcgaacgtgggcgcctccgcctgctccggcatggagaagacgcgggccaccctgcaggggcaggtggacaaggccacggcgcacagcgccgccgacagggaggcggccgagacgagggcgcctccgcctgctccggcatggagaagacgcgggccaccctgcaggggcaggtggacaaggccacggcgcacagcgccgccgacagggaggcggccgagacgaggacgcgggagcgcgtgcacggcgccgaggaggtcaagcgggacgccatgctcgccaacgccgccgccaaggagcgggccaccgccggggcgtaccacccgtcgcagggcgcgcccgggatcgtccccggcggcgcccccacgggcggccgcgtcgaggccggcgtggccgagagccggccgatcgggaccgccacgggcaccgggaggcccagcgccgcacataacccgcgcgtcggcggcggcgctgcgccggcgactggcaccggcgggcagtaccagtgagacctccctaggactacggccgtgtatgcgcgcgtatcagtgttgcagtctatccggttcaggtgtatcagtatcagtgtagctgcagagcaataattatctcccgaccgtgacaaactatgttgatcagaccgttttcacgaccaaaaaaaaa

SEQ ID NO: 34574 - DNA, 685 bp, Triticum aestivum
  unsure (1)..(685): unsure at all n locations
  Clone ID: PAT_TA_34574
cactcgtgatgatcttggagttaaattttggaatcattcagattggaaaccctgcaaagaagtggctgaaaaaatgctggatattatgcataaagcaaatctgatgaagcgtcatgctgatgcaaagctttgtacattaaggtccttcataacatttctatctgtctacactggaacaagttccagtaatgaacccaccttacctgatggagggatttctgctacagctatggaatcagcaattagatgtgcatgcaaatatttgcagtcaactgtagattctctatttcctgaagtcgatacgaatgaggttttgtttcccctgttgtctgggcaagtggacttactgcttactcttaccaggttcttatttcaccaagctaagcaaaccaagagctatgttcatctctatccagttattgtacttcttatgagaacctcaggtgccagcacatcatttttagttgatctcgtgccatcaagtcctgctcttaagaaaccagtgaagtccctccttgttctgattctgtctttatttgaattcatttatggcaaggatgacatgaaagatggatcaggtgatgctaatctgtttggtgaatcatccattataagtacgaggttgntacctgtactctgcanattggctgagaatagggaatattctgatcttgctgttggatca

SEQ ID NO: 34575 - DNA, 1130 bp, Triticum aestivum
  unsure (1)..(1130): unsure at all n locations
  Clone ID: PAT_TA_34575
ctcgccgtcccccccccgctgcccccccccggctcccggcctatcttcttccgagtctcttcttcctccccccgctgcccttccccgtttctcagccccgactccggccggcgcccgccggcagccatggcttgctccgcccatcttctctcgcagagcctgtaccagtcccaccgctcctgcccggtcccgtccaagcacctccggttccaggcccgacccgcggcggcgttttccgccggcgtcagctccagcttcagcaccaggagccgacggtctccaagcgtaagagtcgccgcgtcggccgagcaagggaggaagaaaatcgagcttacgtatgacgcacaagccaagtttaaccagctagccgaccagattgacaaggatgtggggattacacggctcaacctgttctcaccttgcaaaattaatgtcttcttgaggataaccgggaagagaccagatgggttccatgacctggcttctctgtttcacgtggttagtttgggtgatactatcaaattctcactgtcgccaagtaagagcaaagatcggctatcaaccaatgttgcaggtgtcccagttgatgagagtaacttgatcatcagggcacttgatctttaccgcaagaaaactggcactgataagcacttttggatacaccttgataagaaggtcccaactggtgctggtcttggtggaggaagcagtaatgctgcaactgcactatgggctgctaaccagtttagtggtggcattgcttcagaaaaagatcttcaagaatggtctggtgagattggatcagatatccccttcttcttttcacgaggagcagcatattgtaccggtaggggagagattgtccaagatattccgaacctgttgccagagaatctgccaatggttctgataaagccactgaagcatgctcaactgctgaagtttacaagcgacccggttagacagactataaacgctgatcggttgcctatgctataccagacggatacacaagagtcgtgtaatgtcaaacnccacttnagggtgctcacaanaatgagaacattatcacaacggganataaccgnttagcagatgaancanattgatgtccattacgnttgttncna

SEQ ID NO: 34576 - DNA, 534 bp, Triticum aestivum
  unsure (1)..(534): unsure at all n locations
  Clone ID: PAT_TA_34576
gaattcggcacgaggccccctgcctggcgccggccctgctccggcctatcccccgcccccgcctctgcccatctccgatctttctcctggacgcacgggccgcctcggctctccacgcgcgcagtgggccgcctcgatcctgccccggacgcgtaggcgtacgccgcccattctcgacctctgttcctcgccgaccgacaacttcctctccccgtgagctgcacctgtatctaaaaaattctacatggggaagaagccgggcaacgctggcccttcctcggcatccaggcccatgaaccaggccgtgtcgctccgggaggagacctctgggaagacgcaggccgacccgccctccctgctgagggtccagcacctgcagcggttgggggcgtgggcgagcggggaggtgggagttggctcgatcggggccctgctaggccgccgcctcgccacgaatgccgaggcggccgggatccctataggcgcctccacctttctttgccagaggtgtgaatnantcttgctgccaggctt

SEQ ID NO: 34577 - DNA, 1179 bp, Triticum aestivum
  unsure (1)..(1179): unsure at all n locations
  Clone ID: PAT_TA_34577
gcactccgtcccccctgccgccaaccgacctgccgcgccgccgggaccccagcctcgccgtctccggcggcgtactcccacatctcgactccccggtctgtctcggctccgcgcggaatcgtctgacggaggcgggtggccagcggcgtccgccgctgatgcggcatggccggcagcagcaccagcaccttcgtcatcaggtggttcaacttcctcaccatgatactggcgatacttgtggtgggttttgggttttggatgagcacccacaatgacgagtgccggcggtcactcacgatccctgtcatgggtcttggaggagtcatttttctcatgtcgctggcgggatttgtgggtgcttggaagaacatttcttgcttgctttggacatatctaataatgctgttcgtggtcctggtggcaatcatggtcttcacagtgcttgcgtttatcattacaaatactggaactggtattgctgttcctgggtccttatataacgggtatcgacttcaggactatagttcttgcttcgtcaaagatcttcaaaacactctttgatggatgcatctgagactctgccttgtgcagtcgtatgagcgaaaggtcgtttcacaaagctttgagactctaaaataataccagctcgctgagctgactcccagtgtgtctggtttttccctctgcttttcggagttttgatatccagctttgggtgcttggggctatgatccgagcttctatgctctgagaaccaacgtcgagctgcaaactgtacaaaaatgatccggttcctcagctggctatgactgtaattcttgcaaagctggtgttgcgcatgacatgaagacagagtggcgagtggttgccatcttcaatgtgatattgtttatcattttgtcactcgtgtactttgttggctgctgcgcacgtcgacatgctggaggtancgattctaaagttcctggaagatgacggtgtcacagcaggcgttagctntgccgtcccttgtaataagagtgtnccagtaaagttgatgaaatggaatgcccaaggcttctgtactgtgggtgacttnctntgttccagntgtattatgaacatctgtgaaaaagaacgnccgacaatcttctgaaatacatccngatgatcttgcaannaaaaaaaggggggnccgta

SEQ ID NO: 34578 - DNA, 686 bp, Triticum aestivum
  unsure (1)..(686): unsure at all n locations
  Clone ID: PAT_TA_34578
ccaaaaactgacagatgtcggcaattcatgggcatcacttcctccgtcacttgccaaattaggaaaggagcttctgaagtatagagaatcggcgcaggtggctgctgttgaagccatgcaggaagcttcagctgcagaaagcttgctgagatgtttgagctcgtacgccgaggtgagctcgacggctgaggagcagaacccgcagccgaccgttgagcagttcctcgccctccacagctcgctctcccgcgccacggtgatcactgacaccctcaccaagtcagcagccccgccggaatgctcagcggccagcgacgccgggacggtggcctctgctacggacgatgaggcggctgctgcagtcgcagcggagcggcagcgccgggccaagtcctgggttaacgccgcgctcgccactgacctctctggcttcgggctctacaacctcaagccggtcccggccacggtatcgtcgccgctggcggtggtcgtcgttgacgagtcggcgaagccggttgcggcgccccccaatgccgtgaagtcgttgtctccggcggcgaagtcacggatgtnccctgcgaaggggaagccgaggacgggcccgggcgctacggcagctgcggtgacgcccgccccgccggagtgggagaggggagtaggcgcggaggagaggggccagctggctc

SEQ ID NO: 34579 - DNA, 970 bp, Triticum aestivum
  Clone ID: PAT_TA_34579
tcgacccacgcgtccgcaacagcaatctttgcagtacatggatgacaaggtgacgtatgctggtgcaggaaatattaaggacggtcggtcaaaattaatcctccgtgatgtttttgttgcgcatgtaccggttaacaatgggaactttcaaccaaagtgcatatacactgctgtaatgttaaggcgaatgttggatgcgatcttgaattctgacaccttcgatgacaaggattatgtgggaaacaagaggcttgagctgtctggtcaattagtatccctgctttttgaggatttgttcaaaacgatgaatacctatgctgtagaccgtatgaacaaaaacagtgacatggcccgttccagtcctttggattttagccagttgataatgcagcaggatgtaataacctctggtttggagagagctatttccacgggaaattgggacattaaacgatttaagatgcatagaaaaggtgtttcacaggttctgtctaggttatcctatatggcgtctttaggctatatgacacgcataacaccacagtttgagaagacccggaaaacaagcggtccacgtgctttgcagcccagtcagtggggtatgctttgtccttgtgatacacctgaaggggaagcttgtggcttgacgaaaaatctagctttaatgactcatgttacaacagatcaagaggagggcccactgaggaatctgtgttttagcctaggtgtggaagatttgtcacttctgtccggagaagaaatccatgcaccgggttcatttctggtcatgttcaatggattaatactagggaagcacaggcagcctcagagatttgctaataatatgagaacattccgccgatcaggcaaaattggagagtttgtaagcgtttttgtaaatgagaagcagcattgcattcatattgcctctgatggtggccgcgtttgtcgccccttataatgctgacaa

SEQ ID NO: 34580 - DNA, 893 bp, Triticum aestivum
  unsure (1)..(893): unsure at all n locations
  Clone ID: PAT_TA_34580
gcgccggcacgtacaggtccggctgctccaggtccggctgctcctcatctccgcctcgccgcggccggcagcgcagcgcagctcccgccgcctcctcccncgctctcccgtcagcacggtccacggctcccggatctgaagcagccgcaccgtgttgccgcacagcacagcacaacaacagccctcattcgcaggtcgcagctagctaggcatcagcggcaccggtcaccggcggcagcgtacatcaccgcgcgcgtcaacggatgcaatccctgtaggagcaatcatgagatgtgtgacgctcagcataggtgcggctggaccatggttctatgcaatatttctgatgatgaacctttgagagaaactatcaaaggaccattgggatttcaggataagaaatgagcaagtagctttgtatatgtaagattcttggagcagtatagaacagaagacgacagaaggggggcaaccttcaaagcctgtacagaagttcaatgacatgaatatttcctctatgcatgattttataatttgctatatgcgtttgagattaggcttttgtattttcttttgagaaaaaagggaaaagagaagtagctaataaatggtatattagaaaggagtggccagagcacatatttgttattgttatggaaatacaagtgtttccactgtaaatacaaaaggagtgggcagagcacctattctgcatgtgaattatgttaattcccagtttgtaagtttgcatgtggattatgtttgatcccaattttcactttattgcagccggttccctcgtgatgcaacaacaatgttccttgctaccagcaaatcatatccaaatggataganccggagtggagggccaacacgaatggcctcgaagcggg

SEQ ID NO: 34581 - DNA, 959 bp, Triticum aestivum
  unsure (1)..(959): unsure at all n locations
  Clone ID: PAT_TA_34581
ccacgcgtccgccagggttcgatctctttcccctcgcccttccagccccgctaggattctccccgcacccgatcgcctctccccatctggactagaacatagccgcgccgctgacctgggacggggagggggagcaccaccggccaccgtaacgacctgcccgcagggatctggcgtcggcgtaagttgtcatctccccctcgcggttcttgcatcgcgcagccaggggccaccccctggcggtcctgccctgctccctccaccccaagcaatcggcgacgactgcccgcgcggccgtgccgttgtgttgccggccgactatcctgcgtctcctctccccaaggctccagcactccttcgctgaccaccctgcctgccgggttgccggacagaattttattgaggccagccacatcacacatagcacgcaggagctggccctatgtcatggcaaaaggtattcagccctgtcaaggtccagtggtgatacatatgcttctcatggatgagctggccctatgtcatggcaaaatgtattcagccttgtcgtggtgatgcatatgcttctgcatgcacaagagccggccctatgccatggcaaaaggtgaaggacttctcttctcatgtcactattcagagcatggtaagcatggcatcaaactcttcctagaggtctgccaactgtatgcaggtggtggcgaaggggatcactttgtttcttgtggtagtgaccactcatcaccttcgtctcatgtttacgaagagacagtcgtcaaagcttatttgagatgggccctaggctgtcgcacttcttgcctgctgcttggttcgcccatgctctggtgacctgcaatgtaatatgcccttttatgccatatacccgctgaatccatccatgatgtttgcccattcttgtcaaaagaacaagagatgtaataaactccatattnagcccacta

SEQ ID NO: 34582 - DNA, 592 bp, Triticum aestivum
  Clone ID: PAT_TA_34582
ggacacagctaccatagcgcataccaaagggccaataatatctccggttcttgattagcaaagcgtagcaatggcgaagcgtctggatgtcgcgctcctgctgctgctggtggtgatggtgctcgcgtcctgcgacgggagggagctgaaagggaatggcggcgccggtggcggcgtcgacgaggtgaaggatgtggtgcccaggttgccgacgctgccgcctctggtaccactacccaaactgccgctgccgctgccgcccgtggtccctgggatccctccggctgctcgcggctctgccgacagcaataagtctccatgatgatgcacctgcagctgatcaacttgtcgtcgtcgtagacttctagcaagctagcaccggccggaagcagaacatcggtcggcgttccgctgacgtccgtgcgccttgatctgtagcaattatatgtccgccatgtttcctttcagttcatgttcaggttcttgttcctactctgtcatcaatgtaaaccttgtcaatgtgcctttatgaataaacatatgaataatgtacaataaagcacatagtttgttctgccaaataaaaaaaaaa

SEQ ID NO: 34583 - DNA, 485 bp, Triticum aestivum
  Clone ID: PAT_TA_34583
ttcaggtttattctgttctctcacgagatgcaactcgaagcacaatgtatcttaagcaatggagttgaagttctctggctgcctattttactccagcctgcacctacctgagagactcggacaagtagttactaatgtatgaatgtggagaaaagctgtgtgcatccttcaggcccgttcggaacctctcaactcatcaatgttggagctgctagacaagtcatcgttgagcctgctggcagccgtccctccagggaagcccttgcctatgtcggatgtggcggtattacgggtagatcttcgttgtatgtatggatccttgtgaagctggtgctaacaccatgtcgatttttcgcttcggattgtagctctttttggaaaggaagtttgcagcgttctgtagcacgagatgtacatgagtatcggcaggttcgtttctagtctgaacgtgcaaaaaaaaaaaaaaaaaaaaaaaaaaaaaaaaa

SEQ ID NO: 34584 - DNA, 675 bp, Triticum aestivum
  Clone ID: PAT_TA_34584
tgggtctacctcggcagtttatatccgggcggtgctccatacccgccaggtgagcccggctcttcctgctgtcgacgcgtaccccaagggggggacggatcgtctacttccttctgacgatccacggcttgtgaatgttgcccgtgttttggacaacctgcaactccggttgggcccgaggagaaattttcagtaacacacggtcaaactgctctagtctccctgtaccaatgcagaaattccttcggacgatcaacggcttgtgaatgttccccgtgttttggacaacctgcaaatccggcttgggccgaggagaaattttcagtaacacggtcaaactgctctagtctccctgaaccaatgcaggttgaaacttgttttttggtaaggaggttgctggatgcagccagatgtttagtctccagaaaaccgaataactacttttaggacgacacaaagcaaggagaaaccatcaagaatatctagccgtggataacggttagggaagaatggcagggaccagtgtatacatcccgagacagaaatgtattgttttgtcgcctcatatgcctaagtctttttcgtatggtccagtcgtctgtgtggactggttgccgtgcaggcgttctttccttcgtggggggtggtgcctgttcctcgcaaacaagggggttt

SEQ ID NO: 34585 - DNA, 748 bp, Triticum aestivum
  unsure (1)..(748): unsure at all n locations
  Clone ID: PAT_TA_34585
cccacgcgtccgcccacgcgtccgcctacgcgtccgcggacgcgtgggtaaggttcgtcagcacaaaatcggccgcaggtggagggcaagctgctcggcggcgataaccgcgcgcgacggcgacgacgagtggagggcaagctgctgcgagggagagccgtgcggcgaggaacttcagtcgctgttgcgtcgatagctcgtgcgaccgcggcggggaagagacacgtccgcgcgacgagggagcctagccgctcactgctgacagctcgcgcgactgcggcctgtgcagcagaggcgcgtccgcacgactacggagctaagctgctagctgaaggttacgtccagcacaacaatggatgcaacctgtccgttggactgtccgagacttagaattcattcaacaaagctgccaacatctttccgtgcaaacgtacaaaaactcaaaccctcaccccatctcgttttgttgtcctttcttcgatagctgaaggcttacgtccagcacaacaatggatgcaacctgttcgtggggctgccggagacttagaagttcaattcaacaaagctgccaacatctttccgtgcaaacgacaaaaactcaaaccctcacccccatctcgatggaggtgtcctttctttaaagcatggcaaaaaaaatgtgtcngcctttgttttatatagaccaatttttcactgggatagaaatattgcctacaacggcaaactaaagtagcctgtaatagtaaac

SEQ ID NO: 34586 - DNA, 724 bp, Triticum aestivum
  unsure (1)..(724): unsure at all n locations
  Clone ID: PAT_TA_34586
cgcaccacccaaatcccctgttcccacggccggacatgaacaggacggtggcggcgatacccgcggtcaggaagacggaggcggaggctcaggtggcggcgcccgcacccaagaggctcgcttccgccggaaccgccgggcgcaggccccggaagcggatccgcgaggataagcttgtcagcgacggggatctcatcagccatggcgatctcatcagcaaactccccgatgacatcctcggcaccatcatctccctcctccccaccaaagacggcgcccgcacgcaggccatcgctcgcagatggcgccctctctggcgcttagcgcctctcaacctccacgcctcctaccacctctgctccaaacagttcaagagcctctccgtcgtctccaggatcctctccgaccaccctggacctgcccgccgtttcgtcttcagcctcgtccgcctccacaaagcgaaaaaaaggcacgccgaggaatccgctcagatcgagaactggttccactcccgagccctcagaaaccttaaggagctcgacatcagcttcgacctcttggactatgtacatgagaagctntatccgctgccctcatcagtgttctgcttagcaccaactctcctcgtggccacaatcggcttctgcaaattcccaaaggagatcactcattcgcttagttntccgttgctcaagcagctcaacctgcggcgcgtttccatctg

SEQ ID NO: 34587 - DNA, 765 bp, Triticum aestivum
  unsure (1)..(765): unsure at all n locations
  Clone ID: PAT_TA_34587
gacgcctttgttcgctttcgtcgtcctcgccgaaattcccattgcggctactgacatttgtccccccatcccaccgacctctcttctcttgcatccatccatccatccctctcggcgtcactcaagctttggtttaggagcaatctattccgccttgggctcctgattggtttgggagcttgagaggattccttaatctctctactatcacttttcatcttgcaattgatttccagtttagcattttttctgaggaaatcttgagcatctttgctgcctttcccctccacccctgattggtttggaagcgaaaagatccttcatcctgagcagaggttcgattgagaaatggcagaagtgaaaccggaagagatggtccaccatccgcccatggatcagctgcaggggtttgagtactgcatagactcaaatccttcctggggagaggcaattggtttgggctttcagcattacatactgtccctgggaactgctgtgatgatccccacaatgttggttcctcttatgggtggaaatgatcatgacaaggcgaaagtggttcagacactgctatttgaaactgggataaaagacactgctccagacgcttttttggaacttcgccttccaactgtcattggcggcttcatatgcgtatgttggttccngccctctccataatccatgatcgatcactcgcacaaatagccgtggccataccaggttcctacagacaatgagagcgacacagggtgcgttgatagt

SEQ ID NO: 34588 - DNA, 1067 bp, Triticum aestivum
  unsure (1)..(1067): unsure at all n locations
  Clone ID: PAT_TA_34588
gcagttcccatccgacatcgccaccgttcttctcgctgccggctccacggtcaccatccaaacggcttccaaaatgctgtgcctgacgttggaggaatttctggagcagcctccctgtgatgccaagaccatactgctcagcatatttgtccctgactggggttcagacaatgtcatcttcgagacatctcgtgcagcccccagaccattcggcaatgctgtgtcctatgtgaattctgcattcctggcaaggacttcaggggatgcagcaacaggggagctcatcgtcgacgaaatctgcctcgcgttcggcgcctacggtgtcgatcacgcggcacgggctcggaaggtggaggaattcttgaaggggaaatcaatgagtgcatctgtgatacttgaagcggttcggttgctgaaagatgttatctcgccgtcagaaggcaccacacaccctgagtacagagtcagcctggctgtcagtttcttgttcagtttcctgtcttcacttgctaccgacctggatgaaccggcgaaggctattactcccaatggtttatctactaatggaaccatgaatggaaatggcgcatcctcgctgggagaagcaaagtaaggttggcagcgatgatttgccgatccgttcaaggcaagaactggttttcaccgaagaatataaacctgtcggcaagccaaccacgaaagcgggtgctgagctacaagcttctgggggaagctgtgtatgttgatgacatcccatctcccaaggattgcctcctacggagcattatctacagcacacacctcaagcccatatcaaagngtcaacttcaancactctggatcaaaaangcacacggcactccgcaaangaatcctgccgtgggaaggatattggtcagtcccggggtaggagacaacgtctccgtatcggttctgaatcctggcaaatatgggtgtgatgcnaaccagagtacctanaggngggaacagctcacagtaanacnaaatccagcgcatcgaaaaaggtgcacaatcntattcaccccatttgccacattggatnnang

SEQ ID NO: 34589 - DNA, 859 bp, Triticum aestivum
  Clone ID: PAT_TA_34589
gcgctccgaggacgattccggccgggagctcgagcacctgtgccgcagggtcaagaccatcgccaccctgctggcctacctcaaatccaaggccaggatcatggcgataccgcacctcgcgcacacgtcctgcgggatcaggaaccaggacggcgtggggttcgtcgaccggcacgggttgcccctggccgattggtccaaggccgctgagcccgcctcctgtgggggaggttcggatgacagggcgtcggcagagggtagcggcgttcacaaaaattgtgatgccgttgagggggatggagatgtcgatgatattcttaagtccatccgtgtggtgacagacgtcatggagtctcttgtgaagagagtgattgtggctgagtctgaaactgctaatgagaaggaaaaggtgaggattggcttggaagagatcaggaggaagaccatacaggtcgagtccatgtcggtcaaagtcgaggagatggagaaatttgcggtcggtacgaatggtatgctgaatgagatgaggcagcgggttgaagatatggtgctggagaccactcggcagaggcagcgcgctgctgaaaatgagcaggagcttagtcgtgtgaagaacgactttgagtcgctcagaacttatgtcagcacactcgttagtgtcagagaaactcttctttcatcggagaagcaattcgagacaatggagaagctttttgacaggctagtcgcaaggaccaaccagctcgagactgagaaggcacagaaagaagctgaagtccagaaagtgatggaggaaaatgtgaggctacgtgccatggtcgacaagaaggatgcacagctccaggcgatgagtgagcag

SEQ ID NO: 34590 - DNA, 1689 bp, Triticum aestivum
  Clone ID: PAT_TA_34590
ccacgcgtccgaatcgattggtcgcggaagggaaggaaaaggggaaaggcgagggaagtagagaagagaaagcaaacccgccccccggcgaagacggggagcagaaaactccaccccgacggaggccatccggttcgctgccggcccgctcctcctcctcctcgccggcgttcccaagaggtcccatggaggaggacggccctagccggagcggcctgccgccggtcggggagtgcgaatggagggaggagctgaggcagcagcagtcccaggtcgaggcgctgcgcgaccggctcgtggaggtcaaggtcgggatgcggcgctccgaggacgattccggccgggagctcgagcacctgtgccgcagggtcaagaccatcgccaccctgctggcgtacctcaaatccaaggccaggatcatggcgataccgcacctcgcgcacacgtcctgcgggatcaggaaccaggacggcgtggggttcgtggaccggcacggggtgcccctggccgattggtccaaggccgccgagcccgcttcctgtggggcaggttcggatgaccgggcggctgcagagggtagcggcgttcacaagcatggggacgccgttgagggggatggagatgtcgatgatattctcaagtccatccgcgtggtgaccgacgtcatggagtctcttgtcaagagagtgattgtggccgagtccgaaactgcgaatgagaaagaaaaggtgaggattgggttggaagagatcaggaggaaggaccattcaggtcgagtccatgtcggtcaaagtcgaggagatggagaagtttgcggtgggtacgaacggtatgctgaagaggacaaggcggtgagattcggagagatggataagtttccggtgggtacgactgggagccgctacgaaatgaggcagcgggttgaaggtatggtgctggagactacacggcagaggcagcgcgccgctgaaaatgagcaggagcttagtcgtgtgaagaacgactttgagtcgctcagaacttatgtcagcacacttggttagtgtcagagaaactcttctttcatcggaagaagcaattcgagacaatggaaaagctttttgacagggctagtcgcaaggaccaaccagctcggagactgagaaagcacagaaagaagctgaagtccagaaggtgatggaggaaaatgtgaggctacgtgccatggtcgacaagaaggatgcacagctccaggcgatgagtgagcagtgcaagttcatggctctgaaccgtccaaactagcggaagacagatacaccagataagaaacctgctcttgtccaactgatgtcacttacagttacattgccgcggcagtgaaaagaaaaagaagttatatccctgggggtccagaataaccgacgatgatgccctgttcccgggtccgtgattcgtggtgcaaacccaatcgtgaattgttgttaccttagatgtggtgtgtcgaaattgcaaccatgacagacatttgttgtatcttgattgtgtgtgtaaaggctgggcgcatttgcccggttttcgtaaatcatagagatgtataaccgcagttccattcatccttctgcctgaaccatatagttcagccgctgttttaactgtggtgctgttaaaaataactgaaatgttttgcttataaaaaaaaaaaaaaaaaaa

SEQ ID NO: 34591 - DNA, 1604 bp, Triticum aestivum
  Clone ID: PAT_TA_34591
cgactcgacgcaccgctcggccgtggacgcgatcgtggatttctttcaccgcaagatttggtagcgcgggaaggcaataggttagttctatcattaggtaggccgccagccctgcagcccttgtaagatctgcctgtccctgagtgaactgttcacgctcgagtattgatgcggcgtgtacggataactcggcaggctactatgccctttttacgtcgccagtgttatttcagcattcgtagtcttgaggtgtgctttcctatatacgcgtccattgcccaagttccctataccccgcgctccgcagcccacacccagctttgctgtggctgagagggagactgggatgaggcatgttcctgagtggctaccggcctttccggacccacacacctacgtcaggacagaggtgtggagtgagcaggcggccaaggacagggtggacatggtcgaacaggtgcggcagcggaggaaggccgagaagtcgctgctcagtttgcagcaacgattggcccttgcgggcgctgatgggtttcggccagcggtttctgaggatagtgcagccaaagggaaggagatacaaccggctgggagcaagagaaatccttttcttgagcctgctttgccgcatggagacaaggaggtgtcagaggttgatatcccttctgagcggaagaaactttctgtccttgatgcatttgcaccagcaattcagggtgcaaatgctatggagcttgattctgggacaggttgggaccagaatcagaaccaaaagagcattgttccaaaggtgagggcaccagtgcacctgaagattggagtaaacaagaagcccctggcagtggccctcaattcaaattccatggatctgagggaggacccgtcgtttttgaaggaggaacaaaaggatgaccggaagcggagggctgggatgatattgagggcatcaatggataacccacaggaactgccccagatttaatatggttggtagaagtgcagtgcccagcatggagttgcattatggcgagctgtagtgtgggagaagggatctatgatcatttcagtttgacggtggatctccaatttgtggaatcttgaggccaggtatcctacgatgcaaccttcggcgtactggcaagctcgaacctttgtaacctgcacccagtctctcctgtcagcatcagcattgggatccccggagattattaggtttgtagttcctgcttgttccgacatatcactggaatgaagcaagcctttttcgtagggagctgattttggagaccatccaaaggcatgatgctcctcctttgtagctaggaagacagagaggagatgattgtacaaaaactgacttgatttttctgaccaacgctcctctcaacacagaggaagggatttacgtgttgatttggttggctaatccagctgcatccgtgtaatggtgatcacccattcgttgtattgctttctgtgattggagcgtgttgattagtgcgcccctgctgaggctgtaacggcattgtactatacaacattcttttggcctgtttcattcaactgtgtatccaacccgagctgggcaccctttggctcttcag

SEQ ID NO: 34592 - DNA, 456 bp, Triticum aestivum
  Clone ID: PAT_TA_34592
ttcacgggtccactcacgaggttttagtattccctacatgattagcataaaaatatatttcaaccaacagagtcaccgctcatattacgttgccatgccataccagacataaccgtcccgacggagaccggcgacaaactcatgcctacccaaggcagaggttttcctgggttcctgccggtatgcatgtaaggcacatgaggatgattataatcacaagtatgatcatttccaacagcatggaaatcactaacatgcacccatgcatatgatcatatcacatgaaataacaagattctccaaagtgaggtgatgttataaatgtgtcaacgaacacacaaaaatattatgccggggttcagaatgcttgccttcaatgcatggaaaggcacggtgcactccaaactcttgaaatactcctcctctcttcaaaatatcctatttttgaaaatataa

SEQ ID NO: 34593 - DNA, 753 bp, Triticum aestivum
  Clone ID: PAT_TA_34593
gtttctcctccctaatcctgcgcgaggcggagagggagaggaatcattccccgccggaaagcctcgtcgcgcgcccacacgtttttattccgcgattgtgacggcggcgcgcggagcgggaaaggagtggcggggctgagcgctcggccgtgtggtcccttggctgtggcgcaagtggattcacccacaggagccccgagcgaacggcttaggttcttggccggactgttcttgccggagcttggcggtttctgaagtcgcggctgaggcgctctgatctgattctgtcggagaaaggaggcgagcggtcgcccagaagtttcaggcaattttcttaaactaaactcatgtcaggtggtgcttccaaaagatttggtgctgagcaaaagtgatatcagagaatcatcttaccgcaagcactccctgtggatggcacactggacaagagatggccacagtgcagaacctcaaaatagcaagagctgtagtccgtttgaggaaatcgatgatgtcggatattcaaaagattgtgggaatttaccttttgagctcatgaaagctaggatggctgaaaggttgatggttggagttagccatggaggtgcatcttccgggaatcacagcaattcagttctaatatgtgggggtgtagcacatgatgtttgccaagaagttcaatgcaagaatactggatcagtttaatagacctttccgaagatctatggtacagaaaaatctgaatggatatgctgc

SEQ ID NO: 34594 - DNA, 1221 bp, Triticum aestivum
  Clone ID: PAT_TA_34594
actgacgcacaccgaagccgagatccaggccaggccaagcacgccgccgccggcagtcgaaaataacacattccctagccacgccgtgacatggccactccaacggcagccgccgacaccgccgccgccccgctgactccagttgccccggagcccgcggcgaagttctctcttgcctcttctgatatggctgctccgaccgcagcagccgacacctccgccccgccgccgcctgctccagtccctccgaccgcagccgccgacacctccgcgccgccgccgccagctccatcccctccgaccgcaggagccgacaccgccgctccgccaccacctcctcctccaacaacgacggagcctgcggccaaggtctctcatagtccttaccacatggccgccccgacggcaaccgccgagaccgtcggtcggccaattcctcctcctccagccccggaaatcgcggccaaggtctcccatttcccccctccttttcctcctcagcccgatgcgccggcgcccaagaggcggaagctggaggaggcggggttccacacctccgcctactacaagatccgggccactgttgccgacctccgcctccgcttcgtccaggttcacgaagctactgattttcggaagagcgatgctgctcgcgagattctgagagagataaagacagttatggaactctccaagaaaatgaggcttgatctcggcgtctcttctgaaccatgaaaccgtcagagaagcctttagctggagctgtgaaggatgagtccgcagagccaattccttctggagaaagaaatcaagttcctccgacaggtcagcctgcagttcctcctaatattgcaaatgatggtgcaccggccacccaagcctgacaagtgataactcagcgagtgcagcagagaaaatatcagaggggaagggaaccctaagcagtgagatggcaaatcacccaaagcacctcgtgaaaacagtgcaagggtcttatgtggttggtggatctcctgttggctggaattttcttgtttggcttggtggtgaaataatgtattgtggggttgccaaagaggtgtttcggacgcgccaagctgcaaattgagatgttcccttcaaattgaaactttctgatttgtaatgtactctttaaattgatgcgggttatgactttgttttaacatccttgtccttaacaaaaaaaaaaaaaaaaaaaaa

SEQ ID NO: 34595 - DNA, 1082 bp, Triticum aestivum
  Clone ID: PAT_TA_34595
ggcgatcctccgtcggtcgccatgtctcgcacggggagccgcctcgcgtcctccgtggtgcgcctccccggccgctcccgcgtctccgcttcgccctcccctcgccgccgctccctgtccccgtcgccctccccgcgccgccagcgccgccgcgaccggtcccccatcccctcccgcgaccgccgcggcgagaggtcccccgtcccctctcgcgaccgccgccgcgaccgatcccctagcccctatcgcgaccggcgccgcgaccggtcccctagccccttccgtgaccgccgccgccagtggtctccctaccacaatgagcgtggccgggacatggaccgggttcgggacgtggagccgccggcgcgccgtggcggcggtggaggaggcgaatggtccgcctccgacgacgacgacgaggatctcaagggcctcacctactttgagtaccgccgcgtcaagcgccagaagctccgcaaaagcctgaagaagtgcatctggaaagtcacgcccagccctcctcgccgtgacgacgaggccgacgagtaccagtacagcgaggaggaggaggagaagaaggaatcgcccaagaaggagtcatctgagaagagcgatgaggaggagaacaaggattcgtcggaatctgagtccgatgagtctggtagcttatctgattccagtgaatcagattattgtaggaagaaaaagaaagggcgtaagggcagacgttctagcagcaagcgcaacaagcgtgcccatcgtcgccacaggaagtctgatatggagagtgagagtgatagcaaggtcgatgaggattcagagggttccgatgactctgaagattctagggataagagaaggagcaagagatcgcggaggcacaagaagtctaagaggaggggacggagctctaggaggaagaagagtaagagtctggatgtaccgtctgatgttagctccgaggaggtggaggtgttagtctctagccctatctcaacggacagcaagaaaatgggcaagagctccaggaagaagagtagcagtcagtctgattctgaagattcgatcccttctgatgccat

SEQ ID NO: 34596 - DNA, 896 bp, Triticum aestivum
  Clone ID: PAT_TA_34596
ccgccagctcggactccgctgaaatcgccactggctccaagcgcccgttcgatccctcccttgccgacccgtcgccgccttccaaactccagcggttctcccagtcagacatctcgccggcggacgcagacagcggcggagaggcgggcgccgaaagcgaggcgatggccggcgcacggctctcccggacgcagcgatacctggtcgccgtggagtacgatggcacccgcttctccggttcccagcagcagccgaaccagcgcaccgtcgtaggcgtcctcaaggaggcatttcacaaattcattgggcagccagtctcaatcttctgttctagtcgaacggatgcaggtgttcatgctttgtcaaatgtttgtcatgttgatgtggagcgcataagtaaaaggaagcctggtgaagtggtttgtatgcatacacttttctctcttaactggcttacattgaggatatgcataaactattaattgtatgctttgtctatatcaaaacacattttggcccgctgcatgttaattatgtccttcatgggtttgatgtcagatatagaatctccatgaatactacctaaaacaagtgtatgcactttagagctcttataccacttctaattctaagttttgatgtactttgcaacgtttgcagttggcaccacatgactttgccatcatgaattcagtgcatatccagcagttggatgtcagccatgctctccgatgcgaactctggatgaacttagcgttacagaagtattccctttcatgttttttccttcaagtgtagaaagatcacagttggaatcatcaaatggttctcttgtttattcaaggacaccagacatagaatcttctgggaaaggatctgatctttgctgtaccagc

SEQ ID NO: 34597 - DNA, 765 bp, Triticum aestivum
  Clone ID: PAT_TA_34597
gggatcaccactcagacagaggagaaacagttcgtcgcgaactcggggatcatgctgccaactcgtttccctagccgcggtgccgacaacgctgcggggctggagaccctgctgccggcagcttcccgcgccgtgctgtcggagttcatagccaccgccgtgttcgtcttcgccgccgaaggctccgtctacggcctctggaagatgtacaaggacacggggacgctgggtggcctgctcgtggtggcggtggcgcacgcgctcgctctggccgcggcggtggcgctggcgagcggcgcctcgggcgggcacgtcaacccggccgtcacgttcggcgtgctcgtcggcaggcgcatctcctttgcgcgcgccgtgctctactgggcggcgcagcttctcggcgccgtgctcgccgccgctctcctcaggatcatctccggcggcgtgcgccccatggggttcacgctcggccacggcatccacgagcggcacgccctgctgctcgaggtcgtcatgacgttcgggctcatgtacaccgtgtacgccaccgccgttgaccggaaccgcggcggcaacgtcggcaccatcgcgcccatcgccatcggcttcgtcctgggcgccaacatcctcgccggcggcccgttcgacggcgccgccatgaacccggcgcgggcgttcggcccggcgctcggcggctggacctggcgccaccactgggtctactgggtcggcccgctgatcggcgcccgggctggccggcgcgct

SEQ ID NO: 34598 - DNA, 988 bp, Triticum aestivum
  Clone ID: PAT_TA_34598
cccaccgttgagcggcagaaacggacgggcagacacaggccccggcgcctcgcgccgcgcggagaagcggggcggctacgctatgaagcttccctccaccttccgtttctctcgcccggatgcccgcgcgaagatatcttgctagctaccacccccgccttaaaaccacaggtcgagctcacacgccttcttcacgcagcacaacctagaactctagttcaccatgcagcaaccacgcggtggctgctgggccgctcgccgcctcctggccgcgccggcgcccccgccggatcccgcccatccgatggacgcgcagccgatggcgcgcctggagacggtgttcagcggcaccaccatcgtgctcttcgtcgccaccgtctcctacgtcgtcttcagcgcggtctacgcctgcatccgcgccacccgctacgacgcccgccaacaaggacacggctgggtcgatggcgacggcctgggagcggcggcgccgcgggaggagaccaagcgcgcgctcgagacgatccccgtgcgggtggtcgtcctgcagcagcagcagcagcagcccggcgatgtcatcggaggccggaagaacaagaaggacgccgacgcggacgccggcgactgcgcggtgtgcctggcggagtacgcggccggggacgaggtgcggtgctcccggcgtgccgccacgggttccaccgggagtgtgtcgaccgctggctgctcacgcgcgcgcccacctgccctgtctgccgcgccacggtcggtgcgcacgtcgagggcgccgacgccaaggaggactacgcggccggacacggcggtggcattggtttcgccgccgggtcccatgcgcttccggagccggtgtgaccgatcgacagtgagtgtggatcggcagatggcggtcacggttcactatagctatagtttagctgaactttgatgtctgaaacaggttgttgttttcagtgatcacccagcttataataac

SEQ ID NO: 34599 - DNA, 659 bp, Triticum aestivum
  Clone ID: PAT_TA_34599
aaagatcgaggtcgacaccatgttcatcgccaacacctccaacggcctcctcatcaagacctggcaggatggctgcggctacgcgcgcaaggtgaagttcgccaacgtggtgatgaagaacgtctccgaccccatcatcatcgaccagtaccgctccgagcaccccataccctgcgggtcaaccgcggcgacgaggacggtggcggtggagaagatcgactacgtgaacatcgccggcacgtcggcgtcgaagcgggcggtgaccttctcctgcagcgacgtcgtgccgtgcaggcaggtgtcgctcaaggacgttaacctgaagcggctcagcgggcgcggcgcctctgcctactgccgcagcgcgtccgggaaggccgccggcgtcgtcgtccccgagtcctgcctcgccggagccagggccgctggcgtcgaggagcagtgagccgtgaggtctcgaccgggttcttggtctcactgtgatgctccggcatgaataatccggccgtgtattgtactttgtattacatattgtgatgtactgtactcccgtaccgccgtacgtattcgggactgactataggtcagtcgactgaaaaagtaaatttgggtcagtcaactgacccgaactcgtttcagctaaaaaaaaaaaaaaaaaa

SEQ ID NO: 34600 - DNA, 768 bp, Triticum aestivum
  Clone ID: PAT_TA_34600
gtggccggcggtggagggcacgacccgtacccgtgcacggggcagaaatcgcgggcagggcaagggacgaatccgtgcaccaggcaaaaggccatgcctgcgtccatgccattgccgaagaagatcccgggcggtggcggggcctgggcggcgtcgaagaactcctcctcgcccaggaacggggctgcagcctcggcaggagcccagtccattggcggagcgacgaaggccggcatcaggggtgcctggtaggcgtggtggacggcggcagatgggttgcttggtcctgcctactctgcggcagcggggccagggtgatcatgacgaccatggcgaccacggcgatcacggcggccgttgcctgggccccaatggcgaggaacaccagcactgtggcgtctggcagatcgacggatctcccgtccaatgcatcgaacaagggcagaggcgattctgtgcaggttcacccctgccatcttacgttctctctcgtcctgttcatgctctgtttttcttgtcggaattgctctcgccggggagcagtgctgataacgtgtaagaattcgtgagaaacttgtgttctattgattctgggcaaagccctatttatacaaggatttggggcgcctccggagaggcgtccgtttacaacgggcgcccgtggcgcgagaagacgcccgtacggacgttcgcatccatacggcgctttagacacacgtgacgactcttagcgactttgctttattcttaacatggatgtaacctccc

SEQ ID NO: 34601 - DNA, 1053 bp, Triticum aestivum
  Clone ID: PAT_TA_34601
ccacgcgtccgtgtatttcctgctggaggtgatggcttatacctggtcgttgatgaaaatggtaagttcagagaggacagttttcagaaatctctgaatgtccttgcccctgctactggcagtgacaagaagagggaaaacgggaagcggcaaaagggccttgtctcggcaggcaaaactaatgaagaaagcgacatattcaagatggtgaaaatgataattcagcgtcaatatgaccctgtgatacttttcagctttagcaaaagagagtgtgaatttcttgctatgcagatggccaagatggacttgaatggggatgatgagaaagtgaacattgaaaccattttttggagtgccatggatttgctttcagatgatgacaaaaagcttccccaggtttcgaatatgcttcccttattgaaacgcggcattggagtacatcattctggtctgttgcccattttaaaggaagtgattgagatacttttccaagagggcctcatcaagtgtctgtttgccacagagacattcagtattggattgaacatgcctgcaaagactgttgtgtttaccaatgtacgtaagtttgacggagatcggttcagatggttgtcaagtggagagtacattcagatgagcggccgtgctggtcgtcgaggtattgatcagcgtggtatctgtatactgatggtagatgagaaaatggaaccctcaactgccaaaatgatgctgaaaggaggtgctgatagtttgaacagtgcctttcatttgagctacaacatgttgttgaatcaactgcgctccgaggatggtgatccagaaaagcttcttcggcattcattctaccaatttcaagcagatagagctctccctgatctcgagaagcaagtcagggaactggaaatagaaagaagttccatggttatcgaagatgaggagagcgtgaaggactactatgatctcttacagcagtacagaactttaaagaaagatgtccgtgatattgtactttcaccaaaatatattctgcctttcttgcaatccgaaggcttg

SEQ ID NO: 34602 - DNA, 1224 bp, Triticum aestivum
  unsure (1)..(1224): unsure at all n locations
  Clone ID: PAT_TA_34602
gaattcggcacgagccagggtttagctagggttcttctacccaccaccgtccccgcccgccccgccgccgcagccatggccggcgccggcgccggagaggacgacgcggcgtgggagcgcgccatcagcgcggccgtcaagagcgcgcccctctcccccttctccgcgcccaaaaccctaaccctcgacggcgccgtcaagtcctccaccggccgcctcccctcgccggccctcttcgaccgcttcccctcgctcgaggagctctccgtcgcgggcgcccgcctctcctcgctcgcgggcctgccccgcctcccggccctccgccgcctctccctccccgacaaccgcctcgccggggccgactccctcgccgccgtcgccgattcctgcggcgggaccatccgccacctcgacctcggcaacaaccgcttcgccgcggtcgaggagctcgccccgctcgcgccgctcggggtcgagtcgctggacctgtaccagtgccccgtcacaaagctcaaggggtacagggagaaggtgtttgcgctggttcccagcttaaaatacttggacggcgtcgatgccgagggcaatgaccgtctggagtctgatgaagacgaggaggaggatgaggatgaggacgaggaggaggaggaagagggggcggaggacggcgaaggggaaggggacgaagaggacggagaggaagaggatggagatgaagaagaagatggcgaggaagaggagggagatgaagaggaagaggaaggcgacgaggctgaagacgaagaggatgaggctgaggacgacgaaccggagtcaggcgcggccgagaaaagcgaggtggtcaacggaaacaagtccgcaggatctgccctgccaagcaagaggaaaagggacaatgaagatggggccaacggcgacaactgaatttgatctcgatttaaggtttgttggttcgtctttgcacgcttttcagagggttccgtgcgggaggtgtagtagaagcaagcaacctttgtactagttttgtgcaaggattttctgagaggttttcaaattttattcaagacgcgcggtggatcctcggacctgctccttcatgtgaaatttctggtactataaaccgaggcgctggctcggatcacgagaaccgtctgtcttcatcatcgcgggactggaaaggaggtactccgtttttcatngtagctatagggcgcgcgccgcagc

SEQ ID NO: 34603 - DNA, 953 bp, Triticum aestivum
  unsure (1)..(953): unsure at all n locations
  Clone ID: PAT_TA_34603
gatattttgggatttgaaaatgcagaattctatataaaaagatggccagaattggatggcatgcggtttggggatgtgttaatctcattccctgatgctgtgccctgcggagtgaagcttgcgtcaagatttggaagtatattaatgaatccggatgatgattatgttttaagagaaggcgatgaaatccttgttatagcagaagatgatgatacttatgcacctgctcctctaccagaggtgcataagggttttctacctaacgttcccaccccgcctaaatatccagagaaaattttgttctgtggttggcgacgtgacatccatgatatgataatggttctagaagcatttcttgctccaggttctgaattgtggatgttcaatgaggtgccagagaaggcgagggagacaaaactgactgacggtggtatggatattcttggactaacaaacattaaacttgtacacaaagaagggaatgctgtcatcaggcggcacttagaaagcttgcctcttgagacctttgattctattttaattcttgcagatgagtcggtggaggaattccttttacaatctcattcacgatccttagtgacttcacttctaattaatgatgtccagtctacctgccttctcccggccggctaaacctgtcctcaacatccctacgccgcaataccccctcgctaacgtcgatgccactcggttggtgctccggccgttcgtccgtggaggactctctggtcagccgctcgcctccctgacctcgctccccgtttcgggcccctaatccaacctctccgccctgtccaatgcactcgcacaaatggctctccaatcccggctcggaacagcatcccgccaatctcctacctgcttcccncaggacggcctcgtcgccatacggccgccgcgttgactgacagcatacggantaattccngaaa

SEQ ID NO: 34604 - DNA, 650 bp, Triticum aestivum
  Clone ID: PAT_TA_34604
cgtccgcgtgcgcgggctcgagccgtctacgatttcctctcttcgccttcctcccctgccggcccctccaaaccctaggcgccgccggccaggaagtccatttaccagccatgtttggacgcatgccaaggaagaccagcaacaacaccaagtactatgaggtgcttggtgtatccaagacagcaaccccggatgagttgaagaaagcttaccggaaagctgctataaaaaaccatcctgataagggcggagaccctgagaagtttaaagaattggcacaagcttatgatgttctcaatgaccctgaaaagagggagatttatgaccaatatggagaagatgcaatcaaagaagggatgggaggcagcggcggcgctgatatgcatagcccctttgacatattcgaacagctatttgggggtggcggtggcggctttggagggggtagctcgagaggacgcagacaaaagcgtggtgaagatgtggtgcataccatgaaggtttcgttagaagacttgtacaatggtgctaccaagaagctatctttatcacggaatgttctttgtggaaaatgcaagggaaagggatccaagagcggggcaacggctacttgcagtggttgtcgtggtgcaggaatgaggatgataaca

SEQ ID NO: 34605 - DNA, 1280 bp, Triticum aestivum
  unsure (1)..(1280): unsure at all n locations
  Clone ID: PAT_TA_34605
gnatagttctagcgtcgctggctcgagccggttacgatttcctctcttcgccttcctcccctgccggcccctccaaaccctaggcgccgccggccaggaagtccatttaccagccatgtttggacgcatgccaaggaagaccagcaacaacaccaagtactatgaggtgcttggtgtatccaagacagcaaccccggatgagttgaagaaagcttaccggaaagctgctataaaaaaccatcctgataagggcggagaccctgagaagtttaaagaattggcacaagcttatgatgttctcaatgaccctgaaaagagggatagggacaaagtatcccaggagaagaaggtcttggaggttcatgtggagaagggaatgcaacatggccaaaagattgtattccagggtgaagctgatgaagctcctgatacagtgacaggagacattgtttttgtcttgcaacttaaagagcacccaaaattcaagaggaagtcggatgacctatttgttgagcacacgatctctctgactgaggctctctgtggctttcagtttgttctgacccatcttgatggtcggcagcttctgatcaaatccaatcctggggagatcatcaagcctggccagcacaaggccataaatgatgagggcatgcctcagcatggccggcctttcatgaagggtcgcctgtttgttgagttcagcgtggagttccctgagcccggagtactgacccctagccaatgcaagtcacttgagaagatcctgccgccaaggccagggagccagtcgtcggacatggacgtggatcagtgcgaggagaccaccatgcacgatgtgaacatcgaagaggagatgaggcgcaggcagcatcagaggcggcaagaagcatatgatgaagaagacgacgacgaaggtggtgcaccaaggggtgtgcagtgcgcccagcagtaaggaggcgccggcaacggcagtaatcgactgcattctattgttcctttgtcgtttaattaaagtagctgctgatctgatgcgcggtattattattcttggctcttaagattatgaggttgttagccataagtatcattcatccttttgttggcctattgcctactgtgtcgtgtactagcagtattattttggagcccagactttgatatttcagacttggttgggtgagttggtcgtgtgtgtgctggtgcattttcccatgacgaaaccatcgtagcattattattcatttatttaatctttgtgctgctcagcaacttgaggc

SEQ ID NO: 34606 - DNA, 1459 bp, Triticum aestivum
  Clone ID: PAT_TA_34606
atttcagttggcccacgggaggacggaggggaggaaggtcgacgggggccgagagatggacgcggcggtgcaggaggcgaagctgctgcggcaggtgaacgccctcatcgtggcgcacctccgcgaccagaacctcacgcacgtgggggtggcggcggctttggaggtggtagctcgagaggacgcagacaaaagcgtggtgaagatgtggtgcataccatgaaggtttcgttagaagacttgtacaatggtgctaccaagaagctatctttatcacggaatgttctttgtggaaaatgcaagggaaagggatccaagagcggggcaacggctacttgcagtggttgtcgtggtgcaggaatgaggatgataacaagacagattggacctggcatgatccaacagatgaatactgtttgccctgaatgcagaggatcaggcgagatgataaatgacaaggatagatgcccaagctgcagagggaacaaagtatcccaggagaagaaggtcttggaggttcatgtggagaagggaatgcaacatggccaaaagattgtattccagggtgaagctgacgaagctcctgatacagtgacaggagacattgtttttgtcttgcaacttaaagagcacccaaaattcaagaggaagtcggatgacctatttgttgagcacacgatctctctgactgaggctctctgtggctttcagtttgttctgacccatcttgatggtcggcagcttctgatcaagtccaatcctggggagatcatcaagcctggccagcacaaggccataaatgatgagggcatgccccagcacggccggcctttcatgaagggtcgcctgtttgtcgagttcagcgtggagttccctgagcccggagtactgacccctagccaatgcaagtcacttgagaagatcctgccgcctaggccagggagccagtcgtcggacatggacgtggaccagtgcgaggagaccaccatgcacgacgtgaacatcgaagaggagatgaggcgcaggcagcatcagaggcggcaagaagcatatgacgaggaagacgatgacgaaggcggtgcaccaaggggtgtgcagtgcgcccagcagtaaggaggcgccggcagcggtgttaagggcgcacagtcggcagtagtcgactgcattctattgttcctttctcgtttaattaaagtagctgatctgatgcgcggtattattattcttggcgtcttaagattatgaggttgttagccataagtatcattcgtccttttgttggcctattgcctactctgtcgtgtaccagcagtattattttggagcccagacttgatatttcagacttggttgggtgaattggtcgtgtgtgtgctggtgcattttccataaatcatcataattattgtttatttaatctttgtaccgctcagcaacttgaggcattcctatttgtatc

SEQ ID NO: 34607 - DNA, 2235 bp, Triticum aestivum
  Clone ID: PAT_TA_34607
ccgccccccccggctcgggccgtctacgatggcccctggccgtcccgacccgcctagcttctccttcctccccgggccgcccccccaaacccccggcgacccccgccaggtagggcccatgaccaggaaatccagcagacgcatgcagtgctacgaagtacgtggtgtaaccaaagacagtaacccgggatgagttgaagaaagcagacagccaaagctgatatgaagaaccatcctgacaagggcgctagaacaaaagaactttataaaattggacacaagcttatgatgttctcaatgaccctgaaaagatggtgatttcatgaacaatatggagaaggatgaaatctaagaagggatgggaggcagcggcggcgctgatatgcatagcccctttgacggagttcgaagcagctatttgggggtggcggcggcggctttggaggtggtagctcgaggaggacgcagacaaaagcgtggtgaagatgtggtgcataccatgaaggtttcgttagaagacttgtacaatggtgcgaccaagaagctatctttatcacggaatgttactttgtggaaaatgcaagggaaagggatccaagagcggtgcaacggctacttgcagaggttgtcgtggtggaggaatgagcatgataacaagacagattggacctgggatgataccaagagatgaataccgtgtgctctgaatacagaggaacaggcgagatcataaatgacaaggatagatgcccaagctgaacagggaagaaagaagcccaggagacgaagggatatggaggtccacgggaggaagggaattcaacatggcctaaggagtgtgttaaggggagaggcggatgaagtgtcttctaaggtggcagcagacgtagatcctggtaaactgcaaaaaagactgcccacaaggccagggacagagtggtcggacataaagttgaacaagcgagcaggataacagcatgcagttatgggaaactgtatgcactagactgtggcgctggccgtatcagagtcgaccagttatcatgcgcggtagtagacgtctaggcaggttatgaacaaaagggtgtttcggtggcaactagcactaaaccgaggcgccggcaatcgcccagtaatgcggagtgcattcctattttttccttttcccgttcatttaaagtagctgctgagctggatgcgcggtattgttattccttggctcttaagattatgaggttgttagccataagtatcattcatccttttgttggcctattgcctactgtgtcgtgtactagcagtattattttggagcacccgacatctgatatttcggacttgattgggtgaatgaggaagacgattactaatggcgttgcacctgaagggatgtgcagtgcgcccaatctacttaaggtaggcgccggcagcggtgttaagggcgcacagtcggcagtaatcgactgcattctattgttcctttctcgtttaattaaagtagctgatctgatgcgcggtattattattcttggcgtcttaagattatgaggttgttagccataagtatcattcgtccttttgttggcctattgcctactctgtcgtgtaccagcagtattattttggagcccagacttgatatttcagacttggttgggtgaattggtcgtgtgtgtgctggtgcattttccattattgtttatttaatctttgtaccgctcagcaacttgaggcattcctatttgtatcagatctgtcagtcagggtcgttgtatgactggaacgtgttaatggaacttactcttgttaatggctcgatggcatctcggcaccaatagtaaagcgaagactttgaggaaattgccaggcgcacgacgcaccaccgttcctcacgggctcttgcttccgggtcttgctcaccacggccggtgcggcattgccgttcgaatatcgttgttcccgaaatccttgagttgtaccggcaagcagctcagtcccgcgcaagtgggcacacgaaacagtaaccaccaccttcctgcaggaaggtgtagaaccaagcagcccgattgattgaaggagtcttgctctcgatgacatctacttaacagctagttgttgaggtgtagtcctcgtctctgaggaggacggctgcctcctccaaactcgcgtggccgtgtgtatgttgtgttgtaaaataaaacaacaacaagaagaagaaaattatcatttggccgg

SEQ ID NO: 34608 - DNA, 584 bp, Triticum aestivum
  unsure (1)..(584): unsure at all n locations
  Clone ID: PAT_TA_34608
gtgaatttggtcaagtttttgttttgttttgtcatctgaatttagccgtacacctgaaaaattcattgggcagatgaggttatctcagctgaatttgaagtgtgtggcaaaacattcaaattaagttcatcttactcaaatgacgaccatgcaaatttggggggcgagggattgaggcaggtctgattttgtatgtactcgtacaacattatattttgtagtcgtttctctgaaagtttcatttttatttgtacaaacagatattaggtgagagtgtgggagaagtaaaggttgtatctgacatgcatgggaggaaagcagagatggctcgacgatccgaggcattcatcgctcttcctggggggtacggaaccatggaggagctgttggagatgataacatggtctcaattcggaattcacaacaaacctgttgggttgctgaatgtggatggttactatgataccctgcttgccctatttgacaaaggcgcgcnanaaggcttcaacaanccaaactgtncacacatactttcccaacgccnaccggcnacgggaantnccgncaaanattggggaaaaacc

SEQ ID NO: 34609 - DNA, 1200 bp, Triticum aestivum
  unsure (1)..(1200): unsure at all n locations
  Clone ID: PAT_TA_34609
ctccctcgctcgcttccactcctcccgcagccgccacctcctccctcccacgcagccgcctccctccctcactcgctcctcatccggcgacggcggctcccacacccgcgttcttcctcccccaacacgccccgctcggccccgcacgcctaggcggcttccaccaaccacggcgacggcgcagcggccacggaggagggcggcggatcagcggcgccggcgatggcgtccgtggcagcggtggagggcgcggcttcgttcggtgctgttgcgcgcgcagcaggcggcggcgcggccggggcgcgcgtcagagtcgatgcgcgtggtggcggtgaacaagacgaagcccgtgggcgtcatccacggcgcggacgacgccggccaccgctgcttcggctagaactacgtccaggagctcatcgacaaggccccccaggttgtacccccagctgagatgaatgaaatttttatcccctttcaccgcgtgaaagaactgctgattggaacgtgaatggaaaacaagtctctctctctctctctctctctctctctctctctcgtgcttctgctcgcccgggatgcagctcttcagtgagctcgacaagatgtgcttgaagaaaagggccattggattgtacagggaaaaatgggatgttgttctttgctgcttcacctagccttgctgctcaaccacgttgcccctggtattgttgttgtgggttggtgctgctgctgttgcaggggcagcagtgtctctaagcaaacaggttgttgtgtacctacgacataggttaaactgtgggcttacttttcttaggtcaaggctctgctagatgccatctttaagttggtgtgtacctacaaaataggtcattcgtacctagctcaatgctcttgaagttatctctaagtaaacattgtttacccattacattgttaattccagttgcttggttgattatcgtcgtacaatataattcagagaacactattgtgtttgtttattcatagaaaacacttcaaagtctgctgatagatcataatggacttcctacttggatagatgccctcactcataattnttctatctctatttattttctaccaacttcactaagattagagatatgacgtttcctacctctaattacttctctactggcttcacttaaattagagatatgatggtagataatcttg

SEQ ID NO: 34610 - DNA, 315 bp, Triticum aestivum
  unsure (1)..(315): unsure at all n locations
  Clone ID: PAT_TA_34610
cctgccgttacggtgccaaattcncgggacgacttgtatctactctacatctacactcttataaaatacataaaatacactcttataaaaaacagagttggtgatgatggtgtgcctgccatcctgcaatataggccgtccgatttatatctgacggataggaaagaaactatggcaattttgcaaaaaggtacccacacacctctccacatttgcaaataaggccttccctcgttcatccttttctctcacaagataaacaagtcataaaaatgcatctagatgttacgtgcaacgcacgggcatcttgctagt

SEQ ID NO: 34611 - DNA, 928 bp, Triticum aestivum
  unsure (1)..(928): unsure at all n locations
  Clone ID: PAT_TA_34611
aacagatgacacagcacaatgtgggagctttggtggttgttaaacccggggaagataaatcaattgctggcatcgtcacagagagaggtaaactggtctataaactctctgtgatggaaacagaccaaatcacgtgctaaagagtaaaagttagatactattgctaacatccattgttatgtgtttatatgtgacatgcgttttcttggtttatgtccttgccttctttattctacatctctactcttataaaaaatagagttggtgatgatggtgtgcctgccatcctgccatgcacgccgtccggtttttttctgccgctttggatccattccatcgcacgggcccgcacagtggccctcgccccgcccccctcttgctctagaggccttccctcgttcatccttttctctcacaagataaactactcatacaaatgcatcttgatggcccctgcgaacgcacgaggatgtttccttggggggtctctccancgcggcgtggttgtagttgcaagttgacgccccttggagatgccgacgttggaggggcactccgggattcctccgatgagcangtaagatganttgatcacgttcgtaaatgcattctaaagactacttccgtgtcaattcctaatctncccctggccacgtttcgcagttangtccgtgccaatggaattggttgcatagtacngganggtacaacacatttgcacaacatttacaacggtgacacgttcccgtagnacttggccaacatggggattagcatgcaacggcaacgcatgaacggtacaaggaacacggtgagatgataantacacaacttganaggnggcaaggaaacatgtttcgcgccgttgtgccacatagaaaccgtgcccttcacgatcttcggaaacanggantactgctttagttaa

SEQ ID NO: 34612 - DNA, 633 bp, Triticum aestivum
  Clone ID: PAT_TA_34612
cggtgatattggaggaatcaatctagccgaccatcctttgaatgacacagttttgctacctcccactgataacctttaggagctatggagaggagggttaggagggtggcgagccagcggcgtgaagagaaaatgttagggtcacaatagcaaacgagttcatcttgcctgggttgcgctgataagaaagaagatagagcttcaggtgaggcatatcgtccctaggaatttgttggtatcgaggattgttccaggaagcacttctgatgacaacatgatgttgggcctcggggacatggtaaccaacagaaacttattgaagcacattgttgtcatcatccacttagtgcccgccgggtcacgctcagcagcaacggtgcacggcgatgggaaagacgcaggggtggcgggatcatcaccagtggggccgtcggggagaagatggaggcagataagaaaggaacgggctcggttgggtgtgaaaaggagaatgagagagatagcgatgatgtggtgctgcaccactgctctcctactgctagctgaattttggtattgttgctgctatctgaatttcgcacacacacggcgaggtgtgctggccgacgccgtgcttgtcgtgagggggggggg

SEQ ID NO: 34613 - DNA, 999 bp, Triticum aestivum
  Clone ID: PAT_TA_34613
tgggtatcagccgcttgagaacgccaagcatccacctgaggaaccacctgtgcttattgagaatgttgctaaaactgctccatcgaaagttgggaatacctctgaaccagtggaagccgagaaaagttcggtcccactggttaagcaagaagtaactattggaaaactgccagttttgaagcatgtctactctggaaagaaacgtggaaggacacccaagacagaagatatgggctctgaagctgcatccaagaaccacaataaagaggcctctgaaacaccttctgcaaagcagaaagctgagacaacaccctgcgctgaaaacgagaacgctggctcaaagatgcaggaaatcgtggacattcggtctccttcaaagaagtcgaactctgggaattcttgttcagctgcagagaagctgaaaattggaaactcatcctcagctgcaaaggcgcagaaatctggaaactcttcctcagccgcaaaggctcccaaaacaggaaactcatcctcagatggaaataagcaggcagctggaaactcatcatcagctgcaaagaagccaaaaatggggaactcatcctcggatggaaagaagcaggcagctggaaactcattcacagctgcgaagccgaaaacaggaaagtcatccccagatggaaagaagcaggcagctggaaactcgtccgcacctgcaaggacggaaatgagtgaaaacatccacaccaatcttaggattgagaaggctatcttggtggaggtgaacagcaggaggagtcaaagggtacggaaagcctaaggtttactgaagcaaaaccaagactgctcaaattcagggcagtgtaattatgagaaacaggtcttgtttatcaatctatccatttcgtcttgctgaagttcgtagctatattgacagcggcttcgtcgcaaagtaatttagtgtagatattcctaaccttttcgtttggtcaccaaactaaaaatatgcttcttatgtat

SEQ ID NO: 34614 - DNA, 1044 bp, Triticum aestivum
  unsure (1)..(1044): unsure at all n locations
  Clone ID: PAT_TA_34614
gttctacttcgattttttttgttagactctgcattcttatctttttgattctaaaaaggacaataagcagcagtaaaaatttatcattatcatccgttacaacaaacctgacacagccagagtaccatcggctatcaatcagcaggagaaagaaaccgcggctcgagcggggaagaaccaagtggctcggcgaagatgccggcggcgaaggagaaggtgaaggacggcgtgagcgcggtgaaggccaaggccaagatcacgcaggccaaggccgtcggagaaggcgcgaggcggccacggcgaggtcgcacgcggagcgggagctggcgcacgagcgcggcaaggccaaggtggccgcggccaagatggagctgcaccaggacaaggcgctccaccgggaggaggccatggagcaccgcatccacaagcaccggtcggcggccacgggccgccaccaccgacaagcacggcgtcggcatcgtggccgcgcccccgccggcgaccggatcctgcgcttggcaataccaccctcctcccagccgcccggtggccactactactcaataccagctacgcagctagctcacccccgacaataacacatgcgtcgcgtttgagtggggtattctaggtagctattagttccatcgtcagtacttagtatagtgtaaccaggcctgccagcagttttagttgccactagacttggataaacgcccggttccttttcattttgcactgacgaatccacccgcccctatagccgaggatagaatgccaggaagcgccatctgtggcacacgcgggcggtgtcatacctatcggggatcgggccgaggatgctgaagatgtgcatgaggcagccgtcgtccaggccgttcaccggccaccccggcgcctcctcccaaggcgccgcctcgcgcagccgcttcgccatctcctttcctcccccgcgggctgccgcgccccgccgcccacggcgccgcctcgcgcagccgcttcgccatctcctctccggatacccctcctnccacgggatgcggc

SEQ ID NO: 34615 - DNA, 685 bp, Triticum aestivum
  Clone ID: PAT_TA_34615
ccactcagctcgcgagaccggagacggactgggggaagaagaagcggcagcgccaaaaccctactgccccctcgcgctgccgcctcagatctccgatcctacccggtccagatctggtgtcgcagatggcgagcacggggcggtcgatgctgctgtcgctgctgctgttcgcggtgacgctgtcgctgctggagatgtaccggggctggttcgccgcgtccgagctcaagaccatcgccggcggattcgtcagctccctcctcttcctcctcctcctcgcctttatcggtaattaccaagaagctagtggtgttagaactgggtgggtgcagttgttgtagcagaacttgttgctcttattgtagctggcactgtccaccgcgtttgcatcacaacatgcttcctgttctctgccgggatcctttacgaggtcgacaagctctccgggatgatcctcgcgaggagcgagtccaaggcgaggcggtactgagggcacaacacatgttttatgtaaggttgacctgttttgtagatggaatcagaaactaatgtgcacaccctcctccatcagactcctcaacccaatcagcgttttcttttcttgcgaggcatatatagaactggaaccctgggcactcgcccgccgtgtttgctagctgagacgtcacattttgattttagtctg

SEQ ID NO: 34616 - DNA, 812 bp, Triticum aestivum
  Clone ID: PAT_TA_34616
attctcacccagacgcactcagctcgcgagaccggagacggactgggggaagaagaagcggcagcgccaaaaccctactgcccccgcgcgctgccgcctcagatctccgatcctaggcgccggtccagatggcgggcacggggcggtccatgctgctgtcgctgctgctgttcgcggtgacgctgtcgctgctggagatgtaccggggctggttcgccgcgtccgagctcaagaccatcgccggcggattcgtcagctccctcctcttcctcctcctcctcacctttatcggtaattaccaagaagctagtggtgttagaactgggtggggtgcagttgttgtagcacaacttgttgctcttattgtagctggcactgtccaccgcgtttgcatcacaacatgcttcctgttctctgccgggatcctttacgaggtcgacaagctctccgggatgatcctcgcgaggagcgagtccaaggcgaggcggtactgaggacgcaacacatgttttatgtaaggttgacctgttttgtagatcgaatcagaaactaatgtccacaccctccgtcagacttctcaacccaatcagctttctttttttcccgcgaggcatatagaattggaactctgggcactcgcccgctgtgtttgctagctgagacgtcacattttgattttagtctgaaatcacagccttgttgaccaggtaattatccctgttaaccgtctgccccggttggcgatttgggatgattttcgcgtggccgccgccgtgttgcgcgtatcgaaaacgttgcttgcttggttaaca

SEQ ID NO: 34617 - DNA, 626 bp, Triticum aestivum
  Clone ID: PAT_TA_34617
accacaagcaccgcacaagctgaagcagtagagcgcacacgttcccttccagttgaggtccgaagtagcgaggcagaaagagagcgagcgaagagcgatggcctccggtcagcaggagaggtcgcagctggaccgcaaggcccgagagggcgagaccgtcgtccccggcggcaccggcggcaccaacctgcaggcgcaggagaacctcgccgaagggcgcagccgcggcgggaaaccccgcaaggagcagatgggggaggaagagcaccaacgacgagttcggcggcgagcgcgccgccagggagggcatcgacgtcgacgagtccaagttcaagaccaagtcctagatgttcactcagcgcgtgcgatagcttagcatgcatgacgactgcttatctagttggtttaccttgccggatgaataatgtaggtcaggaatcctgacgtgtgcacgcatgtaggagatcgtacgtactagtatgatcacgtgtgcttggtagtcgctgctagtccgtaggtactgatggtcagtattcatgtgtccgtgtcggtcggcagtgtggtggtggctcctgtggcttgtacgggctctcttaccaaaccatctcccgctgtatccttgtatt

SEQ ID NO: 34618 - DNA, 780 bp, Triticum aestivum
  unsure (1)..(780): unsure at all n locations
  Clone ID: PAT_TA_34618
nngngnnnttnanncccttnnntttatgattccgnctgcgcgagagtgaccctcactgagggggacagaggctgggcgcgcacccgtctcgcgttttttttttttttttttttttttccggcctgtattagctgcaacaggtggctcacgtagtcttcacatattattaccatggcaaggcaaagtgcgtaaacataagggctcgcgatataagtgcccaactctgcagattcatcaggctactaaccagcagaacgtaaatccataacactagcagtccagtaataacagcgcgcgccaccgacagaaaaggattatccagtctcgtatgagccatacatagcagcagagcaaaaacttccggcgcctcgtttcagagcaccagattacctcttgaggttgaggagaaccacagcgatggctgcagtggctgcggctccagcggctgcggcggcggccaccttcccgtgaggcgccgccaggccttccttggccgagggagcggcagcagcctcctcctccgcccctccttgtctgcggcagcggcggcggcggaggccttgagggccttgatctcctcctcgagtgcgagcttctcctggtgcgcggtggccaggtccccgccggcgccccgggggcggtcggcgtcgcggtcggagctgtcgaggaggccctggaggcgcttgacctcggcgcggagcccccggcctcgccctcggccttggcggcggcgcggtcggcggcggcgatgtcctcgcgggccccggncaccagcgcctc

SEQ ID NO: 34619 - DNA, 1343 bp, Triticum aestivum
  unsure (1)..(1343): unsure at all n locations
  Clone ID: PAT_TA_34619
gggagagagcgtgcgacagtgcgagggcgagcctcaccgagcgcgacagggagcgccaggctctggccgaggcactgcgtgagcgtgagaccgtgaccggatcccaggtcttgaacggggtggccctggttgtgatcatccagccgcaggggcatgctgttgaagccccacagaagacgccagcttcacccccatctccagccgcagcggccgcagccgtggccgcggcggcagcacaacaagcggcagcgcaagccaagggagttgctggctatcgggtcttagcatccatgggtctgcgttgtgtatattaattcaccaaattgagcaggttgttccgtcaaactgtcacgctgatgagtatcccccaacggaagaatacgctacactgctgcatcaaaacacgaggacacatcgatgttgctgggggggtggctcagctccctgacaaagatgagactagcgtgtcaaggaaacagatgctagcaagattggatgtgtgcatgggaggacgggtggcagaggagcttatatttggggatagcgaggtgacatccggtgcttcatccgactttgagcaagcgactttgatggcaagagcaatggttactcagtatggtatgagcaagcaggtgggtcttgtttcatacaactatgaagaggacggaaagactatgagctcagaaacgaggcttctaattgaggaggaggtgaagaatttcttggagaaagcatacaacaatgcaaaggctatcctcaccaaacacaacaaggagctccatgctctagccaatgcacttcttgagcatgagaccatgagcggaacccaaataaagaacttgttggcccaagtagataacaaacagccgcaggggcatgctgttgaagccccacagaagacgccagcttcacccccatctccagccgccgcggcggctgctgctgcggcggcggcggcacaacaagcggcagcgcaggccaagggagttgtcggtatcgggtcttagcatccacaggtttgcattcaccaaattagcaggttgttctgccaaaccgtcagctgatgagtatcccccaggaagaatatgctacactgctgcatcaaacacgaggacacatcgatgttgcttggggtgtggatagagaaagaaacacatggaggaaaattcacacatagtagcaggcacatgtagctagtgtttgaagtgacttctctagttgtgctgttgacaacttcacatctgaataattgttatcgttaaattctgctgtattttnccanncaactntttggncataaaattgcaataanggggggcccgtancaaattccctatatgatt

SEQ ID NO: 34620 - DNA, 884 bp, Triticum aestivum
  unsure (1)..(884): unsure at all n locations
  Clone ID: PAT_TA_34620
cactttcccatcgtcttcacatccgcctcgcccatatccagnatattcgtgtgtctcccgaggagcccgacccgggcggcctctccgtggactccctccaccatagctagggcagcgccactgcgtccagaacatggttcaacctccagagcgcttgtggcaagcaccagattgtgagttcgagtaggtcgaccgcgagctgcatcgacatcgaccgattctcttcttctttggcggtctgcaccttccgtgcgggctgtggaggacggatgacgcggtgctgttagggcgctgacaggcagcggttctacgtcccctctccgagcagctctttcatgggacaggcaattgaaggtatggactacaacagtacagactgttatatatctggaaggcgaaattttggggcggtacctggttattgaatgacagacagttatataagagagaagattcctaggtttgccatgacagacaagatggtggcaaggccttgctcgttttagaggacatgggatacatacaggaagcagctgaaattgatgttggcaagtctggtatttagaagaaatctcatgaagtcattcaacaaacgtttgcgaacaagcaatttgtcttcctggacatggcttcagctgtgcatcaaagctcaaaccatttgtttagcttagtttgaagaaaaaaaagtcttattgtcttgggtaaattctgtttattgatgtggccagatgctactgaacgcatgtatgtcttttgtcacttctgatgttactgaacgcatgtatgtcttgtgtaaattctgtttatcgatgcagctggatgctactgaacgcatgtatgatttcttgaagtactgatatatacgaagtcattatgtgtttgag

SEQ ID NO: 34621 - DNA, 945 bp, Triticum aestivum
  unsure (1)..(945): unsure at all n locations
  Clone ID: PAT_TA_34621
gctgaagctgccgtcaaacggggagaggaggagcgccgccgcggcgggacccgtcgccgacaggcgtcgcggtgtctccggaggtcgaggccgcgctcgcgagcggcggggcggtcgtcgccctcgagtccaccatcatctcgcacggcttgccctacccgaagaacctcacggtatgccttatccgaagaatctccagacggcaatggaggtggaggccagccaccatagccattctgaacggcgtgccacatgttgggttctaacagttaagccacatgttgggcttaacagtgaacagctgaagaacttggcaataagcggaagtcagtttcagaagacagctagaagagatatcgcacaagttgttgcttcgggtggcaatggtgctacgacagtctctgccaccatgttttttgctcataaggttgtgtataccaatttttgtgactgggggaattggaggcgtacacagatacggtgcaaaaaaccatggaacatctctatctgacttaacctgtgactgtggtaacacccctgtggctgtcatttctagccagcgcacggtcccttttggggatagcgcacggaacactcgaagtactttggtaactcaaggggtaactgttgcctgctttacaagaaccaacccgattttccagctttccttccaacaaggaaccattgggatgtgaaggtgcctatgccgtgttcacccccacctaaaaaaagcgacaataaatatacaacaacaaaattccaagctaggctccccacggcatagggataccgccctacatacaccaaccgctgctccaacggaaaagaaacaacttcaggagaagagctaaaacctccaggcaacacaccccccccccaaggggganacaatatnaataanaagaattaangggaaactnnatcaccccctttaaccctccaaaa

SEQ ID NO: 34622 - DNA, 448 bp, Triticum aestivum
  Clone ID: PAT_TA_34622
ggaggactatactatctttcttaccttgactgtgacatgctcctggggcgttcagttggcagtggtggtgtttttattttcacaagagcccagcctctattatgaaggttttctaatttccatgggtgtgttgtataataaaattatggttatagatgggcttacctgcatacattaggtatgtgaaatctgattactgtccagttctacttatagcaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaacaaaaaaaaaaaaaaaaaaaaaaaaaaaaaaaaagggggggggggcttaaaaaaggaccaaaggaaaatttcgggggcttgcaaaatatattttttttttagggggcccc

SEQ ID NO: 34623 - DNA, 1546 bp, Triticum aestivum
  Clone ID: PAT_TA_34623
ggcctgtggtttcgttgcatgggcatcttatgcttaactctgagaagatgtccagtcccagggaacttcctaactcttaaggaggctattataagatattcctcggatgccactaggtttgcccttgctgatgctggcgatggtatggacgatgcaaactttgttactgaaactgcaaatgctgctattttgaggcttacaaaggaaatcgcatggatggaagaagttatagctgctgaatcttctttgagaggcggtcctccctctacttatgctgaccatgtgtttgctaatgagatcaatattgctgtaaaagaaactgagaagagctacaatgccttcatgttcagagatgccctgaagtctggtttctatgacctacaactggctagagatgagtacagactctcttgtggagcggcgggcatgaaccgtgagttgttggggcggtttatggaaatccagaccaagcttatcaccccgatctgtccccactatgctgagcatgtgtggcaaaagattctgaagaaggaaggctttgcaataaaagctggctggccagttgcaggcaccccggatcctactctaagaagtgcgaacaaatacttacaggattccattgttttgatgaggaagttgcttcagaagcaagagtctggttccaagaaacccaagaagggagctgcacctcctccatcagcagaaaacaagctcactgttggtctgatatacgtcaacgagcactatgatggatggaaagagcaatgtttaagggtgcttcagtcaaattttgatagccaagcacgctcctttgcccctgacgaggagattaacgaagcattgaggaattgcttcatcgatcgcgaaacaaacttcaaacaagtccagaagctctgcatgcctttcatcaggttcaagaaagatgaagcaaggaatgttggtccccaggctctaaatttgaagcttccttttggtgaaataaatgtgcttgaagagaacctggagctgatcagaaggcagttgggtcttgagcatgttgaggtcctgccggtatttgatggagctgctcgtgccaaagctggaaagcatgcttctgtgctggacaagaatccgccttcccctggtgagccagttgcaatattcatgagcaagcaggagtttgaagcccagaattaagctcagattaatcttctcacagaactttgttgaggattgcctgttgatagatgggggagctgcaacttcgaaaatcagctggccagttccatgctccagcaccggttcttctgtacaaggaatgaccaaagttcaggtgaaactcacctattttgggacttccctctccgttggtgatcaaactaaatgcctgaattgctgattgcaatcatgagtcatgaagaatggagtactgttgaggcagcagtttagctataatagagtacttttttgtgatgtgttatgacatagttaaattgtcgtgaatattcattttgttcagtcatttaagtatctcaggtattcattccgcagtcttcactttcaattt

SEQ ID NO: 34624 - DNA, 429 bp, Triticum aestivum
  Clone ID: PAT_TA_34624
atccagaaggagtggagggtgcccgaggcaaccaagccgttggactccctcggggacgtctccggcatgctcatcgacgactactacaacaacatgaagaagaagatcaccaacgatgagcacaagcactggaccaccctgcctctgaccatgaggcacatcgagtacgcggcaaaggacgcctacgcagcgtacgagatatggaaccgcatcaccctcacccaggacgacattcgccgtgcgaagctggagaaggaggagccccccaagaagcgcgccaggagcagctggggaagactctaactggtgaagaagaagacggtgccggccaggagccaacattgctcgcgttattttagatttatcatcaaatttgtttttttgtttgcttatatatcgttagtttgcttgtgtgctgaacctagtttg

SEQ ID NO: 34625 - DNA, 866 bp, Triticum aestivum
  unsure (1)..(866): unsure at all n locations
  Clone ID: PAT_TA_34625
tcattgtttccagttcctgctatgttttccctagctccttgttttcttcaaaaaatctgaaaaaagaacttgattaaattgaatgatcgaccttcctgcgaggagtattgtcgctgaatccaatgcccttccttttggtggggaagatggtgaatacaaaggtggacagaaacgccatgcncagcggcaggttcttgaggagctcctgggtgttcctatttgcgtcggggaagaagcagttctgcagccccacgtcgctgaacaccaccgtgaggaaaaccacggcggcgaagaaggagtgcacgaagtccagcggccggaggcggagactccggagctcgtccctgtcccactcccggttctcgtcctcgccggggaagttgaacacgttgaagccacggggcgtggcgacgccgtagtagagctttccgtcgcggcccacgaggctgtcggtgaaggagaagaagaggcacatgacgacgaggatggcgacgagcaccacggtgagccactggttggaggcctcgcacttgccgtggttggtgaaggacggggccagcgcctggtacgccagcaccgtgcccgtcggcaggagctgcgcaaggttcgtgacgctcgacatcaccctgtccattgtgggggttgctgttggcggtgccgtgccggcggctgttatctcgccgtggtcgtcgacttccttggtcgcggtcggtgcaggcatctggatcgccgtagccgagggagaagaagttgccattgtaggtactgtgctcgatgtgggtgcgctcgaatttgtaagtcccagctaggaatattacgaaaaagggccccgctttataaagaaacaaccgagcatacaaccaacg

SEQ ID NO: 34626 - DNA, 905 bp, Triticum aestivum
  Clone ID: PAT_TA_34626
gaaaaaaagtgatctaaacattacaatctaaaatttatctaactgttcataaacaatgttccgactctatcctcatggtataatactacatagcgtaattacggtataactaaaatccatctaactgttcagaaacaagattgatctaaacatcaagtgagcttttggcgaggagtggtgtcgctgtagccgatgcctttcctctttgtggggaagatcatgaacacaaaactggacagaaacgcgatgcccagtggcaggttcttcagcagctcctcggtgttcctgccagcgccagggaagaagcaattctgcagccccacgtcgctgaaagccacggtgaggaacaccagggccgtgaagacggcgcgcatgaagtcgagcggccggatgcggagcctccggaactcagcgggagtccactgcagcttctcctcttcgtccgagaagttgaagacgttgaaaccgcgcggcgtggcgatgccatagtagagcttctggtcgcggccgagtacgctgtcggtgaaggagaagaggacgcacgagatggtgaggacgatgaccagcgccgcggtgagccaccggttggaggagaagcacttgccatggttggtgaaggacggggacagcgcttggtacgccagcaccgtgcccgtcggtaggagctgtgcgaggttcgctgcgctcgacatgaccttgtccgtcgccgtggctgctggtccggcagttgctgcgggcgccatggtcgggacgtcgccggcgtccttgggcgtcgtcggagccatcggcacgccggcgttggtgtgtggagttggaggcatctcgatcacggtggaagatggaggagacgccattgtgcggtcgactaggaatatcctaagtgttccattcccaacccggccggc

SEQ ID NO: 34627 - DNA, 1085 bp, Triticum aestivum
  Clone ID: PAT_TA_34627
taggggccttttttttttttttttttagcaagaaggtacatacatgccttttctctctaattaaaagataaacattacaactgcagcgaacattggcatctgcccacacaaatggtttcattaaattttgcatgaataaattaagcaatacacaagtatttccacaaaaaaatgtaatcacaagtgatactactcctatatacggcgattacactacattttaagttaaaaaataagtgatctaaacaataaagttatagtactatatatggtgatttgttataatctaatctatctaactgtttagaaacaagattgatctaaacatcaagtgagcttttggcgaggagtggtgtcgctgtagccgatgcccttcctttttgtggggaagatcatgaacacaaaactggacagaaacgcgatgcccagaggcaggttcttgagaagctcctgggtgttcatgccagcgttggggaagaagcagttctgcagccccacgtcgctgaaagctacggtgaggaacaccagggccgtgaagatggcgcgcacgaagtccagcggccggatgcggagcctgcggaactcagcgggagtccactgctgcctctcctcttcgtccgagaagttgaacacgttgaaaccgcgcggcgtggcgatgccgtagtagagcttctggtcgcggccaagtacactgtcggtgaaggtgaagaggatgcacgagatggtgaggatgatcaccagcgccgcggtgagccactggttggaggagaagcacttgccgtggttggtgaaggacggggacagcgcctggtacgccagcaccgtgcccgtcggtagcagctgcgcgaggttcgcggcactcgacatgaccttgtcggtcgggctggctgctggtccagcagctgctgcgggcgctgtggttggcacgtcgccggcgtcctcgggcgtggccggagccaagcccgctgtcccgccgttggtgtgtggacttggaggcatctggatcactgtggaagacggagaaggtgacgccatcgtgtggtcgattagagatatcctaagctgttcccccgaaacggcccggc

SEQ ID NO: 34628 - DNA, 699 bp, Triticum aestivum
  Clone ID: PAT_TA_34628
gcgcggcgcggagtacgggaccaccaatttctagcgcatcgaccattcaataaactttgacacaaacattctatctgacagcactagcacggactggttcagcgacaacaatggcgttcgtgccgatctgcgtgcagtgcgggacgaaggagccacccgtgccggtgcaaggtggttcggcccgacgctgggattcgtggcgctcgtcggtggccggagtggtgagtgtggccgctgggcgctgccgtgtaccttttccgccaccgcaagggccgccgcatcatgggtcacccggccagggccgtgtacccccgcgtcatccccatctaatcgaccgcagcatcttcctcttcggtggtgatctgtcacgaggtaccgccgttggcttgtcaagctgtgtcatgtaatctgggaggttcgtctctccgactctcagcgtgtgtttaataaagcggggtttttgttgtcgcagtatttgcaaggcttcgccgtggctgtacctactatttgttcgtcgatgtgaagtagagtagctgttttggtcaccccgagtgctgtgtaatagtatcgatcaacttgactcctcttttcggaaaatgctctttatgtaaagctccctcagataaactcttttctgaaaaatgcttcttatgtaatgtttcctcctatccaaaataaaataagtgtcattgtcttttt

SEQ ID NO: 34629 - DNA, 1171 bp, Triticum aestivum
  Clone ID: PAT_TA_34629
ggccgccgaccgaccgtcgcccttgtgcgctgcttgcgccctacgctccccggcgtcttgccgcgccccgcccccgcgctgcggcgccgctggcggccgtcgggcggccgccgctgcgccgcgtgccggcggggcgcccttgcctggagggcaggcctgcgaccgcgggctggccgtggccggtggcccggctgcgtgccggcgacgcgccgactggtgcgggacgccgccggcgccaaacccgggccaccgtgtccccggggtcctggcccgcgaggggggtggtggatcgaatcggcagcgatcggaactctcctatgctgagcccgggcgcgctcgttgcagtcgtcatcgtgagtaggggggcaggtcgctgcgccgccttgctttggatcacattaaaaacaatgccctgatgcttagtataacgaaatcggaattgaatcacctcattgatgtatgatgcagggttggtctttgcattattgtcattttgttggagatgtgtcccagggatcttgtatgttttttttctgatccccttgccgttctaatgttcttgacctttctctgaattttgtgctttctttctctatgcatctggtttcttccctgatcgagagactcgcagcgcctgcgcctatgctgcgaacgcctcgggttgatgcgggaggtcgaggccacgcaaccacacgccgtctggatgttttgctgatggtagttgcgatggacgacgagactgtcaggatggacgatggagaagggggaaaataagcatgtccatcgattcttgccatggaagggttatggttgattgaatcccgctggatggagtcgtcatcgcgagtacagaggcagacgctggcgctgccgtgactaatgtcgccatccgtgccaagactcgttgctgcagtccgccgcgcgagataaagccggcagtgctgggaatcgcccgaggcgtcaagtaggtctggcctaatcgttgtgttagggcaaggtgctgataacgtgtgaaagtaaaaacgagatagggagcaaatgatggaacagttactttcattgatgaagtttgtggtatatatacccggatacaaagacggttgccaagagcggttgccaatagcggaaccgacataagcagggattatccctttaattaaattaattaatc

SEQ ID NO: 34630 - DNA, 952 bp, Triticum aestivum
  Clone ID: PAT_TA_34630
ggctgtacaaaacttttcctgctcccgagtttgtttacaagcatttgaggctcaagcatcctgagattgtgttagaagttacttcaaacctccgggaggatatttattcccaaaattacatgagtgaccctaatgcaccaggtggaacaccagttatgcagcaatctgcagcagacaaatcaaggcgcggggctgacaatggtatggatagtcgtctgagatatgaccgtggcaatcgcagagaatatgacagggcagatagagatggaggcagacatggtagaggtgatggctctccaagccgtgatggacctgacaatcagatgtttgattccttccgtggaagaggctccaatgctcctttttcggctgaattccctgctccgccgatattgatgcctgttcccggtgccggtccattgggaccatttgttcctgcacctccagaaatagccatgcatatgctgagagagcaaggaccttccccattcgaaccaaatggcggacctcatggcaactcaggagtgcttggatcgatgatgggtgggggcccagcaccaattatagccatgccaccatctttccatcatgatcctcgtcgtttgcgaagctataatgatctcgatgcccccgacgaggaagttactgttcttgactacagaagtttgtaggctgtgtcctgccatacaggcaatcttgccaatgcccaacactcgctagcatctccatttgcgttgaggtttttggacctcccattagaatgaggacgtatttttatttcctgcgaagaggcataggaggaagatatgttattttttgaggacgcctgtaatgtgttgtgagttttagcttaaatggctggaacttgatattttctactattatgcagtcacagaaaaggattgaatctatttaaacaacatttttttgtctttgagactgtatttaataa

SEQ ID NO: 34631 - DNA, 1351 bp, Triticum aestivum
  unsure (1)..(1351): unsure at all n locations
  Clone ID: PAT_TA_34631
cggtccttgattatttggatatttggtgagtatagctctattggaaatctaatcccaaagatagctccagttgttcttaagtatctggcatggtccttcgccgccgaagtgctcgagacaaagcttcagatcctaaatgcttctgcaaaggttatcatacattctgcagaagaacagctagaagaattcaaaaggatagtggcatatgtcattcagttggctgcatgtgacatgaattatgatgtccgtgatcgtgcacgtttcttgtcaggacttctaccatgctgtgctactgaaaatgacccctcatgtcgatcacagaatgtagatgttattaaagagctagctgatcatatctttggtgggaagatacctcctgcatctaattcagacagcaactaccggatttatcttccgggttccctgtcacaagttgttcttcatgcagcgcctggctatgcaccacttccgaagcctcaaagtatgatcttaattcataagaccgtagaaccaaccagaggtgtagctgattcctccgaaggtactaattctgacgctgaatctggatcttcaaggggtgagagtggctctgtgtatgattcagaaagtgaagctggtagtgattcgaatgatgatggccataaccttcatcgtcaagaggagaatcaggaagctccgctgattcatatgtatgatggtaatgtagatcaagcctatgcaggtcgagctgtcgatgaaaatttggcatctctcatctctactgatttgacagaattaatgtctaagtcagccttggagtcatggcttgatgaggctcctgctgcaccacttgttcaggattcggtacagacatcgtgtgcaagggtttcttttaccactcgcagctttgagagaaaacctaaattgcataggttgctagatccatcggatagtgatggcttgagtgttctatatgccttctcgtctgaggtttcacccaaatcacgcttgctagtatgtgtagacttgtttgtcgagaatatcacaacagaccaattagcggatataaccattaaatctgaagaggcttctggtagcaagggtggcatggcccaaacatcagaaggatccgcaagcattccaactctggttcctgtggaagagatncagtcactggctcctgaccagacagctaagatccttcttcaggttcactttcatcaccatctcttggcccttgaaccggctggcctttgcaatgggaaaagtcatccagcccaacttcacccggacattgcttatttggcgaccactacccatggcctaaatgcttttctatgcagggaaaaccagctgangggaatgttnattc

SEQ ID NO: 34632 - DNA, 899 bp, Triticum aestivum
  Clone ID: PAT_TA_34632
ggcacgagggttgaggttatttttccaagtatgactgtttaaatctaagcaatgtgaaggatttacattgccgtcaaagttttacttggggtggcacagagataaaagtatggtttggaaaggttgaaggcatctctgtttatttcttggaaccgcagaatgggatgttttgggttggatgtgtctatggaaagaacgatgaaagtagatttggcttcttttgtcattctgccctggagtttcttctccagagtggctcttctccagatatcatacactgtcatgattggtcaagtgctccagttgcttggctgtacaagcaacagtatgttcataatgggctgccaaatggtcgggttgtatttaccatccacaatcttgaatttggggtacatcacattgacaaagcaatggcacattgtgataaggctacaactgtttcgtacacatattcgaaggaagtgtctggacatgcttctattgctcctcattatttcaaattccatggcattcgtaatggaattgattctgatatttgggatccctataatgacaacttcattccggtccattatacttctgagaatgttgttgagggtaagagttctgcaaaaagggcattgcaggagaagcttggattacatcaaactgattcccctatagtcggaatcatcagtcggcttacagcccagaaaggaattcaccttatcaaacatgcaatttatcgaactcttgaacgcaatggacagggtggttttactaggctcagctccagatcatcgcatacaaggtgactttagcaacttagcagctaaactgcatggtgaatttgatggtcgcgtgaagctttgtttaacttatgacgagccactatcacatttaatatatgctggcgccga

SEQ ID NO: 34633 - DNA, 829 bp, Triticum aestivum
  Clone ID: PAT_TA_34633
tcttccgtgtcctttctccacgcctcccgacttcttatagcgcaaatggcggctcgtgaatcctgatcacatcgtcacatcccccatccctatcgcctagctactacttcgggcccgagcacgaagccatttttgcatctctgcgagcgacttgcgaggccgggatcgactttgcagcgtaggaaaatgaagaggctgctcgttcatggccggaggggaatcagctgcccctccaggagcgcggcgggagatccctccgccctgcccgcgcttggcaacagcgttctactgcccaggtaccactcgacagagaaacacgacgacagtgacacgctgggcgaaatcggagagaaggcaagaacgacggcggaggagttcctgacgatggacaaggagaagaccgacgacgtcgacgagggcgcaaaggagacggtgcgcgcgaccgagaaagcggtgctcgccgagtcgggcgacgaggaaggagaagttcgagcagagggtcgagcaggggaggtaccatcaggaaataagtggcggctgctccgctgcactgcctctatacttgcacgcaaacagacatggcctgtcgaggtcgttagctctgcagtttgtatgtcgtcaaccactagttttggtatcgagttgctgtgtgtaatgtctcttcccccttcagttctgcggccttcagttcaacaacgtgatcttgttgctagacaacttggtacttcccacattacaactcccgccaggccactgaatttaaaaaatacaatctaatcttggtactactatacaagttgccactacccgcagaataaataataggctt

SEQ ID NO: 34634 - DNA, 794 bp, Triticum aestivum
  Clone ID: PAT_TA_34634
ccacgcgtccgaggacaggtactacagagcgctaagcgttctggactggggatggccagcgtccgaggctgaagttggggggaccagctgatgccgcatcagactaatgttggttttcggttgatcgcgtctaccagtgcaccagggcaactgcatactttcgccccaaggccgagcaaatttacaattcgctttgctccttacccacatgctatgacctgagctgaccccgtggattctgaatgagaaagctgatggttaggcagtctcgctgccagatcggcctcggtcaggacaggttaaacgggacattatcggcagtaggtcggatctggccagcttctgagtgcctcggggctcgaaccagaacactccgcatttcatggatgttggtcttcgggtggtggcggaaaaagtcaaaccaaggcgatgggcgactttggccgctgaagctcctcctgggtcagttttgcagcagcgctgcatgctggcttcacctgttgtagcagtctccatcctggtcgtgtgtgtatgtgtatgtcatgtaatatttttcttcataatttgcaattttccataacttattattcaatcgagtcttctaagttatcgatttaggtcaaggctccatttttatgtatctgtgtacgtacgattgtcggtcccgcggtgagccatgtaactttagaatgttgagttgtgtaacaaacgggaacgggccaattttttaacagaggctgtgtgttatgatttccctccccaaaaaaaaaaaaaaaaaaaaaaaaaaaaaaaaa

SEQ ID NO: 34635 - DNA, 950 bp, Triticum aestivum
  Clone ID: PAT_TA_34635
gagctccggccttgctcgtcatcccttcctcttgagaaagagtacgggcccatcgttgcgcctcagtcgccacaaggacatcgggtggaggggatccggtgcgaacgacgcacatctcggccccgtagcaggagcgggaggtgtcggcggcggagatggtcgatgtggagcctctttttcccgcgatctggtcctccccattcatggccattggcaggagggtcccctcggatttattccatcctcggaggtggcaaccgccctaggaggggcggtgcacgggcacggctatcttggtggtcgtgatgttgttccgcaactggttcgccttcgggtcggcgccacagatgaggcctgctgttgcgaccttgccctcgttcccgcggcgacggactaccccccaagatgaatggctcttcaagtcgaagccctcggaggaggcaagcgccagctcgtcatctatgtccgggcacggtcagcatgacggtcgtgagacgcttagcgggctgagaagccttcgggtcggcgccacacataaagcctgctgttacgacgttgccctcgtttccgcggtgacggactacccccaaagatgaatggccccttcaattcgaagccaccgactatgccatgcgcgagctcgtcatctatgtcgacctccactctggctcacgtggcgccgacgccaagcgggaggagaagaggataatgcccaactcatttgatgggtcacttgacttctttacggttatgccacctaatctgttggatatatccaaggatgaggagcactgcttattgtcccttttagttgagtatttagagcaatgtgagggacattgggacccagagagagttccaagaatcaatgtacaagcatttgcaactactgcttcatatcatgttgcatttacaagttaatatcatctgtgagcaagcgtacactttgg

SEQ ID NO: 34636 - DNA, 746 bp, Triticum aestivum
  unsure (1)..(746): unsure at all n locations
  Clone ID: PAT_TA_34636
ncnngtccggactangttttctagtaatnncgcgattttttttttttttttttttttttttaaagaatagatcgagcattactttcactatgttgtatgagcacaatagttggcctaaagcagtttaaaggtttagtttcttcgtgataaactttcttataggttgccaaagtacagtgtcagtatttcttatgcactcatatgctcatctagattctaaaaatatcacatcttatgggtattattgaatatctccaacgtggcgctgtgacagagaaccacacattctggacacctatacacacgcgtggcgcatatagcatagagatcaccacgtggttgactgttggtcttggttccatcgaccagttcattggattcgttcccctctccccactgtactcgtactggagagaaagtacggctccatcttcacggacgctcacgctgcagcttggcggcggagcagctctcgctgcagctcagaggggccgcgactacatctgcatctcggtggcccggtagcttggaggcgcaacggctcgggggctccatctgcatctcggcggaccagcagctcggagctgcggaagggggtatggcgccaccgttgctcgtatcggcgagccaaatcctcgcagttgctgctgttgctccccactgaaggtggcgtctattctggctgtgccgacactccctgaagctgatgactttcgactgcaagcgaggctccagcaagaccatgg

SEQ ID NO: 34637 - DNA, 904 bp, Triticum aestivum
  Clone ID: PAT_TA_34637
cgtggcagcggtggccggcggctgcttgaaggggccgcgtggatctgccgccggggcttcggatcggcgttgtcgtctgagccccgagttttcgacgccgtctggcggggccatctgtaaccgaacggccgcgcagacgtcatctgtgtgccccactcaggatcgctccgggtgcacttcgcctcttctccctgccccagcgagacacacacccacgcgaccgtgctccaggcgccgcgttccccttctctcttccctcctctctacaatcctccaagctttcgtcggtcacttgcggggcggctgcgtatgggctccaggtggccggggctgcgcgccggggcaggctggggctgtggcggaggcgcggcagcggtggccggcggctgcttgaaggggccgcgtggatctgcctcctgggcttcggtgaattgttgtcgtctgcgctcatcttttggtctgaacagagcttggcgatccagagggtgctggtctccgtcggtggacattcgatgacaaatgaaaaaaacagaggcaaccaattcagcgaggccgcccacccagcaaaacgcaccaaagaaccaattctttctttaccagagaagaagaaggcgaggcccaatctcaaccgccgtccgtccttacctgcctacgcccggcgggccgatggggggcccgacctgaggcgacatggccctcccaagagagaagcaggcgtcggcgctgtgcaggccgtccatggcgatggagacgcccgggcaggaagggctcaatccggatgaaccagcccgcaccaagcccggccgcctcaacaggagctcgtctctctgcctgcctgcggcttaaccggagctgccaatcgccggcgaccgcctccctcaccttgtgccccttcttcttcgct

SEQ ID NO: 34638 - DNA, 709 bp, Triticum aestivum
  Clone ID: PAT_TA_34638
gttcctcttcagatgcagacgcagagcgtgtgcaaatgacggaggaggcgaagaaggagcataagaagatgctcgacaagctctcccaccaagcggacgatatgaagggatcgtacatgaagttaatgacagaggtgcagtcgtattcatctcatggtactacggcgatggagcagagacatctatcttctgaattgtacttcatttcagtcctcaattcaagatactatgagttaacgatggtttggtatatgagttcgtatcacatctttaaaatgacatgtcaaacttagtttttgaggctatgttgcatttgtagttcttgctctgttaaatttgaggctacgttgcatttatagttcttgctttgttaaatctgagattgatgaaaatggtatatagaatgcaaaaaaaattgtagccacataatgatgttgtatggtacccccagcaagtaatatgcttgaatcaatgtgacttttcctgattataattatcttatagtatcgtgatgttggcaggtatatgcgagtccggcagggcggtggcgtacctttgcaagcacgaatggagcgaagacttgctgtgggctgagctgctgtctggtcaaggaagaaagttgatgtctttactggcgaaacaaattgctgcggcagcaatgcttgtgagcttatgatgtgcctctagtttagtttgtcggtttctgtga

SEQ ID NO: 34639 - DNA, 835 bp, Triticum aestivum
  Clone ID: PAT_TA_34639
gccggccgggctgggccctcttgttctattccccttcccctctcttccgcggcggcttgagaccgagcgagcgagctagggtttggcgcggcggcggaaggaaggaagtcggaagggaagatgagccgcagccttgggatcccggtgaagctgctgcacgaggcggcggggcacgtggtgacggtggagctcaagaccggcgaggtctaccggggctccatgatcgagtgcgaggacaactggaactgccagatcgagaacatcaccttcaccgccaaggacggcaaggtgtcgcagctggagcacgtcttcatcaggggcagcagggtccgcttcatgatcatccccgacatgctcaagaacgcccccatgttcaagcgcctcgaggccaggataaggggcaaggggtcggccatcggcgtcgggcgcggccgtgctgtcgcaatgcgtgcccgggctgctggtggtcgtggtggtggccccccagttggaggaggacgaggtggcgcgcctccggtgaggaggtagatgatgtgagctgagccgctgcctggtcgaggaaggaaggaagtcgctgctgtcttctttactggcgaaacaaactgctgcagtagccatgcttgtgagcttgttatgatgtgcctctagtttagttttgtcggtttctgcgaaccgattttctctatgtatgatgatgatgatgtattgctgttgttagctgtaaacatgagactttgatgcttcgttggaggctgtcattggaatggattatctcttgtgaagcttactgctactagtttatatgagtaaaaaaaaaaaaattggccccttggaa

SEQ ID NO: 34640 - DNA, 1793 bp, Triticum aestivum
  unsure (1)..(1793): unsure at all n locations
  Clone ID: PAT_TA_34640
gacatggatcnttaactcctccgtcccgcgcccaacgaatcctaggtagggttcgttcgccgccgggagaggacggccggccggccggtcgaatcccagcctcccccaccccgcccgcggatccggcctccgccatgagctccgcgcaggaccccttctacatcgtccgggaggagatccagggctcgattggtaagctacagactactttccatcggtgggagcaagtttcttcaaacactggagaatatattcatttaacaaaagagcttctcgccagctgtgaaagcattgagtggcaggtggatgagttggaaaagacaatttcagttgcatcaagggatccagcgtattatggactcgatgaagttgaactctccagacgacggaactggaccggctctgctcgtaatcagattggtactgtaaaaagagctgttgaaaaggggaagagcaatcctgcaatggcaagacatcaggacaatggcacaagcagaactaactactattcttcccaagacaatgatgactatattgcttcagaatcagatagacagcttctactcatgaggcagcaggatgatgaactcgatgagctcagtgcgagcgttcagaggattggaggtgtagggcttaccatacacgaagaactatctggacaggaaaggatcctcaacaacctaagcctggagatggaaactacttccaacaggctcgactttgtgcagaaacgagtggcgatggtgatgaagaaggccggccgcgaccggcccggtagcgagcgagctagggtttggcgcggcggcggcaaggaagggagtcggaaaggggagtcgggaagatgagccgcagccgcgggagcccggtgaagcggctggacgaggcggcgcggcacgtggatcccggggaggccacgaccggcgaggtcgggccgggcgccgtgggcgagggtgaggaccagcggaacttcccggggctgcatgttccagtgcccgcaaagctagggcaaggtttatcggcaacagcacgtctacatcacaagcagtcggggctgcgtgtcgcaggtggccgcacttctaaagcacgtgccgcagggccagcggcttgagcatcccataagatgcaaaagatccgcaaccacgttcaggcgtcccggggccgtggcgaagggtgcacgggctgggggtgggccgtcgggtggggccgcggctgtggggaggcgaggcggggcggctcctgtggggaggtggatgatgtcccctaggaggaggacgaggaggcgaagcaccgctatgcgaggttgaagagcgtgagaacaggctcgccatcttaggatgggaggaaagtagctgctgtcgttgtttgtgcaagccgatactgactatggcggctgagggtgttttggacttgttaccagttaactttagttgactttatgctccgtttgcgtatctctttgatgatgattaatttgttgatgtaagcttgatgcttgatgttaacatgacgagtcgaggttggcattataatagaatagccggtatcaaggggcagatcatgctcatcctcttcctggtggtcctcttcatcatactcttcgttctagtgtttttgacatagcaatgtacactacttgtatgccgtatagtgtactgcctacgtgtacctgcttcctgtaagttgtgttccacattaagcatttaacctggcggctgtgttccacgtttctgaacgaaaagtttgaatgaaaaatctctcgcagttgtgcttgttctatcaagcttgagattatt

SEQ ID NO: 34641 - DNA, 1628 bp, Triticum aestivum
  Clone ID: PAT_TA_34641
ggaagccgggtggagagatgcctgagcgtgatccccgcgattccgacgcggaggggggggagccatggtgccgctcacgccggcgcgggcggcgcccggggcggcccccgcccgctgcctcgcctcctgccgccacctctcccgcccctccttcacccgcgtttcctgcctggggagcttcaagaacctggagcgcctcgacctcggccacaactgcctcgtcacgctcgagggtttgtccgcgtgcaccaatctcaagtggctctcggttatcgaaaacaagcttgtgagcctgaaaggtgccgaagtcctctcgaagctacaggtactgaatgctggcaaaaataaattgacaagaatcgatgaggtcaaatcgatgacaagcctgggaggagcccgtgtcgaaggacaagacccaggcaactgctgtggatggaaaatttgtcggcggttgaatactcttgttctctctaagaatccagttattacttttggtgatgctttggtcaatgcaaagtctatcaaaaagatatccatgtctcactgtgaaatagaaagcattggatcttcccttgctgcatgtgtggaactgaaggaacttcggcttgctcacaataagatcactacgattccatcagacttggccaaaaataccaaaatcttgaaccttgacttgggaaataacttgattgagagggagtcagatctgaaggtcctttctgaactgcgctacttgaggaacctaaatttgcagggaaatcctattgctgagaaaggcaccctagctaaaaaggtcatgaaaattgtgccgaacttgcgcattttcaatgcaaagcccatagaagccatttcccagaatgagaactctgggaaagggagtaagctgaagaaggatgaagagatgcctgatcgtgaccccatcgattctaatacgaaaaaggagaaaaggaaacggtcaaagcaacaagtgcaaagccctgaagaacctgctgccaaagatactcctccagctgccaccattgctgccccagttaaatccgcattgtcggatagtaagaaaaagaaaaaggagaaggtagtcacggagcaggacaagagcagcaaaacgaaaatcaaggattataaagcttctttcgatgataccgaattaaaggccaagaaggaatccaagaagaagaaatctgccaacaaagaagataaggatgcgggaggaatcgatgacacggaggtgtcgtttgcagagttgatgttttctggagacggcgccgtcccagagcccacggcgaaggacaaggcccaggcaactgctgtggatgggaaatttgtcgggggcctggtgattgatcactccaagaagaggaagaaggcgaagggcacccctatcgacgcgtcggatcttaagcagttgtgctctgcgcccgaggtgggtgcgggtggactgtcgggatgggattagtggtgcctggtgggctttgagagacgatgtgtatgcccagtgagtagtgttagtaaactcctgttctaggatctctgttgcgatgagagcctttgtaggcagcatctgaatttctttcgacagttcttttgcacctgaaatatgtgacctgacttaaaaaaaaaaaaaaaaa

SEQ ID NO: 34642 - DNA, 629 bp, Triticum aestivum
  Clone ID: PAT_TA_34642
gccggtccgggctctttgatgctcttcgtcccgcgccaggtagcactcgcctccctaccctccgcccccgccgccgccgccgccatggccaaggaggaggccaagaaggagaagaagagcaagagcaagggggccgccgccaaggcctcccccggccccgacgcgcgggtcctggccgccgtcgccgccttcctcgaggccagcggcctcccccgcacgctcgccgccctcctgtccgaggccaacctcgagggagatgcttggaggtcgtcgccggtgaacctggaggacgcggtctccaagttgttggaatcaagcacttctgctccaggagctgacattgctgcgggcaatgagcaagatgatgccgtagcagaagagaaaggcgcgggcaagaaaaagaagaacaagaaaggcggtgccgaagctcatgagtcggagagtaagccaagtgagccctctgcccctgaaaagcccagcgagaaggcggatgatgagacgaaagaaaagaaacggaagaagaagaaggatagctcatcagcgggggatgatggcgaggcaaatgcagtagtgaagactgatgatcagaaggctgatggcaagaaaaaaaaaaaaaaaaaaggccccta

SEQ ID NO: 34643 - DNA, 784 bp, Triticum aestivum
  Clone ID: PAT_TA_34643
gcgcttctcggcacggcgcgctgacggacatgggcggcgccgccgtagccttgttcgccgccactagacgacgctccaccccgctcgttacctcctcgctccctcgtgctgcgcgcggtctccacgaggctgcagcggcggctggggaggacaaggcgaggactcgccggcggaggagtagtagcagcagctttcttggaccggacatcaccgacacctgggatccacccccgcgccccgcggcgaggccgcttcccccacgagctgccggagttgattacgagtccacggcaaccactatcgatggcaagtccattgcagaggacataaggttacagattgctgaggaggttctccaaatgaaaaatgcagtcggacatgttcctggccttgctgtcgtactggtaggcgatagaaaggactctcagtcctacgtgagattcaaagtaaagggttgtgaggaagtcggaataaaatctttgttggcggagttgcctaggaactgcacagaagatgaggtggtggattcggtgtcaagattcaatgaagacccatccgttcatggcgtccttgttcagctaccactaccacaacatatggatgaagaaaagattctcaacgccattagcctagacaaggatgttgatggtttccaccccttaaacgtggcctatcttgcccttagaagccccgtccctttggttgtttcctgtgctgcaaaggcctgccttgagttattgctccaatctggtattgatctcatgggaaagcatgtcactattat

SEQ ID NO: 34644 - DNA, 485 bp, Triticum aestivum
  Clone ID: PAT_TA_34644
tcatcatcatcagggagagtgataacaacattggatggagcaggttttaactccagcgccaaccagagataaagttcacacaaaacaagaagacttaagcaacatgattaccctgatatggtggggatggacaccttcatcttcggcaggtgcttggtcggctttgacggggccgccctgggctgcttcgacgccttttcagtcggtgccggagaggtggtccgagggcgcttggtcgactgtgtagcagtcgcaaccccctcgccacgttcggtcacaggatcatggacaagtttcgaccgcctttctgagcgcggtggtgcgacctcctcctcctcctcctcttcctcatcctcatcgtcatcatcatcatcgtcatcgtcatcatcatcggcctcagcggcatccgagtcgcactcctcctcctggctctcgcccccgctcgcttctcactcctcagtcggagcctgcgctccgttggacat

SEQ ID NO: 34645 - DNA, 561 bp, Triticum aestivum
  Clone ID: PAT_TA_34645
ggtggggacctacggtcatatctgcccgttgcgtcatgcgcctgacgcccacttgcatctccaaaccatcgctgcgtctgacattgacaagtggtttggatcagagggaggtccgccgtccccgtcctcccctccaagagagcagagctcccgacgcatcatatacaagcatttgtatctaatatgctagtgacaggaaaataaatacatttattttatgggagagtgttcagctaacttaccaccggtgaccacactgcatgtagagtgtgacttcttatgatgcatggtgcgatgtcatgctcgactgtgtgtgagacctatcgtgcttgctgaaagaggccctggcaggcaatctttgggtctgctaacagggatgattaacctgattaacactgtttcgtgggtaaacgttttttattcctcatcactgttaggggatgtctggtcatatggactataggtaggctgctggccacgcggacataattcattttttcgaagtctgcaaaatttcaaatttgtacagatctaacaagtaagtgacagtggctcttcacc

SEQ ID NO: 34646 - DNA, 565 bp, Triticum aestivum
  Clone ID: PAT_TA_34646
ttcggcacgagtgcatcgactgcttgttcactatccccctcggtatccaaaacaatctggtatccatattctaggaaatagccaagaaacccagctatgtgtgctcagcatccagcaaatcctagctatcttcatctaaatagagagccagcgatcaaacttcagttcttacaagaacaaatgctccattgtgttcatgtcatttaagtacagattgacaggaataggttgtttctaacatgatctattatcatttatagtttgtgtggctatttacatctttgtagatgatattttgtgtgtactcatatatggatatatgtccatacctgttactacttgagctgcttatgttttccttccaatatcagtccttgttatttatctttgtagtttggttggatattacttgaaaattagttcacttattgtcatcatgaatgtatatccctttgttgcacctactggcttccctgcacctttcgctattttgattgcatattccattgttcatatctaggtgcaccatgcacgtgtacttggtcatttttccctctatgctact

SEQ ID NO: 34647 - DNA, 657 bp, Triticum aestivum
  Clone ID: PAT_TA_34647
gttcgcggtgtcatcgacctctcgccgccgccaccgccttccgtgggttcttgaggaggaggaggaggaggagcgtcatcggcgatgccggacgctaacctaggcgatctgctcctccaggccgcgggtcggaccgtggggaagggcggccagtcccggcagtcgaaccagcactggcagcagcatgggcgccgtgctgggggctcctactccggcgggagcggctccgatggctccgacgacggcgactccgactcggctctcgcgccgagccacccggcgactaggctgccgccgggctcgcaggtgccgctcaagaagaggcaccagacggggaagggcggcagtcggggaggaggatatgacgacgaggaccccgatgacgaggggaggcggagcgggggtgaggactccgacagcgcgccgtccgtcgggagcgacctgtacaaggacgaggacgacaaggagcagctggagaacatgacggagctgcagagggagatgatcctggcggagcggagcaccaggatcgacgactacaagctcaagaagctggcacgggcgtcctcgtccaagacggacaaggcccggaaggacagccctcccccaccgcccagccggttgcgggcctcggcccggactgacaggtctgccacc

SEQ ID NO: 34648 - DNA, 1035 bp, Triticum aestivum
  unsure (1)..(1035): unsure at all n locations
  Clone ID: PAT_TA_34648
gattccttcggcttggggcagctaagcacccgtgtttcaacgagcttggtgctgggcgacctgaagctgcccgtctggctactcgtgtgaccatggttctgggtctcgtgacaggtgtgtcgttaggacttattatgatctcggtgcgcaatctatgggggtatgcgtacagcaacgagaaggaggtggtggagtacattgcgagaatgatgccgcttctttccgtgtcgatcattttcgacgatatgcaatgtgttctttcaggtgttgttaggggctgtggcctgcaaaggattggagcttgtgtcaatctcagcgcatactaccttgtcggcatcccagcggcgctatgctttgcctttgttttccatcttggcggaatggggctgtggttcggtataatctgtggattaatcgtgcagatgctgctgctgctggccatcaccatgcgcacgaactgggacaaagaggctctcaaggcaaaggatagggttttcagttcgtccctacctctggacgtgtcgacatgaagatggaacaagatgcacagttgctcttggccaggaccagggcgctgactgggcaaaggagacgaggaactcgtcaagaattaattggtcatcgcttagtctccatgtcaacagcatggcgcttcctcgaaggaaacgtcacccgatgaatgatctgttttggtgacttttggtcgaagacgtgagatagaattatagaaatagaatggatgttttcacaggcaaaggcatggcactcagtcgatacggtatggatgcaacattttctttttgagaatttagtagagtagattattattttcttgattatacaaaatattaggttgttttgtctcggtggacgctgatgtggaaaaactgaattactacactgcccaacgagaaggaagtggtggaatataccggcgaacgggcgaaagtcaatttcatcgtctagatttgccaaggatcagttgatcaagtacaggagaatttgtaacacgttttggggaaatcaaattaaana

SEQ ID NO: 34649 - DNA, 1277 bp, Triticum aestivum
  unsure (1)..(1277): unsure at all n locations
  Clone ID: PAT_TA_34649
gcaacttagctgaagccaacccaggaaccttcatggaaggaacctctctgtatgctgataactctttggattaaacttgttgacgacataccaaggcagccaactgatgctagctcatatgaaaggacaggctacttggattcgaaccggttaactcactgcatgagtgctttcagacagctgttaataaataatgagataacagtgcaccaaggttgggatgccatctctatgtttgtacaagttggctttaacagtgaaataataatggacacatcacacttttgccgagctatgattctttctagatgtggtttcaaaactgtagttgaagtgtaccatggaggacaggaaaatttggaaagtgtaaatgcagactcgaggaatccgttggatctcttagagctttatggtgcttctacagatggctgtttgtccgatctgatcgaaggctcttgtgagtctcaggcattgcttcataagctactgtcttcattgagccagtcagtaggggagcatgctgactctcttgaaatgatccgatctggtgtctggggaaagttgatagctttttctgagaacatgcagctaggcagccaactacgtgtctatgccctgcagctgatgcagtgtattacgggaagaaacctcaaaagccttccaaatgagattgtttcccaggttgagccatgggaatcatggtatgagcctggaacaagtgattccttagctgatgagggcagtactccctcttgcagcatcacagcgagtctagtggcactcagatctaatcagatggtcactgcagttctgccagatgctagtatcacgcccgaaaacttgtcgagtcttgactctgcagtatcttgcttcttacatttgtcgggacgtgcttcttccgttgagagtgttgctgttctggaagcggtgctagaagagtgggagcaactcttctcttcatcttcaccataagaagaatatgttcagcctcaggattcgccaanaagaagcacgcgactggagtgatggatgggatgatggctgggaggccctacnagaagagttggagaatcnagcgcaaaagcaagatggtgcgtcgacattatctgtccatcctctccacagntgttggatggagatcatcaaganaacttgctggggcttggcngaagcttcaagaanatnaattgagcttccnagatcgaagcatcctcaagggcataanaaggttgctaagaggacgaatnaagnanaccgcnttgccttgaactcccttc

SEQ ID NO: 34650 - DNA, 2223 bp, Triticum aestivum
  Clone ID: PAT_TA_34650
acccttccctgcgcagcgccagcctccgctgtgtcttttctcccagcctagccgacacgggcttcgcaggtcggcgcgagcgaggaaggcaaggatccgcgccctttgcttgagtcggcagaatttggtggtggagggcccatcagcttaaagggagcacgtcaggatccgatcccgtcgcacatgttccttgatctaccgctgctacagtatgttgaccttgcttggtgcatcatgtcttaaggagcccaggactggttgtaccgtctgaagagtcctgctgaataaattgtcggtctgttgtaaggtggcctctggagatgacagttgaggaagagattcaacctccccgggaaacccatctgctgctctcacctctatatgacggactgattccagtggttttgctgctgcgaatgctctcttgtgcgggaggcaaggaccgctgattactatgacattgcggaggagaggacatacagggggcaggtaaacggggagagtcagcgtgtgatgtccccattggctcgtgaagacggtctgccgcttttcaagtcaactccagcttcgccgtacaggagtagcacaggcacggctggtcagtccattttcatcatggagagcccatcagctccgcggaggtcgtccggtgcgacccctctcggtgcttcgccgacgaacggcggcgacagggcgatgaaggcgcctgctccatctgtcttgcacagagaaggtgaagatgaatcgtagtagcatgtggcggcccagcaattcgcttatcatgaggtgaggtgactagtcttgctcagtccatggagatggacatgcattgcggttctatagctttgtgccctcgcctcgctgcgtccgcggccacgttctttggctttggggggtatactgcaaaaatgggacatataagcctaatgagtggatgcacatgatggtggttgtggtctttcttaatctgaactgcttcgcccagtatgccttgtgtggtctcaacatagggtaccgcagatctgaaaggcctccccttggtgtcgccgtgactatttcttttgcatttggggctgcgttattcgctagtgtgtataacattgtgagtcctcttgggaaggattatgatgcagagctgagagaaggtgttccagaagcacaagccggggtcacatcaactgaaggcgccaggccagcatcttcagggaggtcacttgagagaagatactcttttcttcaaagcgacgagcgccgtttcgtggagagcaggcctgagtgggtcggcgggctatcagatttctgggacagcataaccattgcatacttgtcaattttctgcagctgctgtgttttcgggtggaatgttcagaggcttgggttcggcaacatgtacgtccacattgcaacattcctgctcttttgcctggctccgttcttcatcttcaacctggcagcagtcaacatcaacaacgaaaccctgcgagaggcgctggggctcaccggcatcgcgctgtgcttcttcggtttgctgtacggcggcttctggagaatacagatgaggaagagattcaacctccctgggaaccccttctgctgccgtaaccccgacgtcacggactgcttccagtggctgtgctgctgctcgtgctctctcgctcaggaggtgaggaccgctgattactatgacattgcagaggagaggtcgtacagagggcaggtaaatggggagagtcagcgtgtgatgtccccattggctcgtgaagacggtctgccgcttttcaagtcaactccagcctcgccgtacaggagcagcacaggcacggctagtcagtccattttcatcatggagagcccatcagctccgcggaggtcgtccggtgcgacccctcccggttcttctccggcaaacggcggcgacagggcgatgaaggcgcctgctccatctgtcttacacagagaaggtgaagatgaatcgtagcatgtggcggcccaacaattggcttgtcatgaggggtcacgaatcttgctcagtccatggaggtggacctgtatatttgttgtaaagaaaatttaccacgcctctcttcatccgtggctgagcttttctttttcttttcgggtgccgatcgctcttccgtgagatgcatagagtattcagttctgtcctgttctgttgtgtaattctgtagattccgcagtgcaaactccctttgagaaaaaaaa

SEQ ID NO: 34651 - DNA, 1055 bp, Triticum aestivum
  unsure (1)..(1055): unsure at all n locations
  Clone ID: PAT_TA_34651
acaccatgatggacccttcctcttcctccaccgcctccgctccggctgcctccacccacagcagcgatagcggggggcccgccgccgccctgtcggcagcggtggccacggcatcccggcggtttcagcacctgctggaccggtcaactccgcacgtgggccgccgttggctgggcctcgctggggtagtgttggtgtacgcgctgcgcgcgtggttcgtcggcggctactacatcgtgacctatgccctcggcatctacctcctcaacctcctcatcgccttcctgtcgcctcaggtcgaccccgagctcgccgaggtgctcggcgaggggcccgcgctccccacgcgctcctcggacgagttccgtccgttcgtccgccgcctgcccgagttcaagttctggtattctatagttaaagcattctgcattgcttttggcatgacattcttcagtgtgttcgatgtgccagtgttttggcctatccttcttttctattgggtggtgttgtttactgtcacaatgaagcgtcagatccttcatatggtgaaatacagatatgttccattcacctttgggaaacagcgttataatgggaaaagggcagcttctgcagatgatctcacacttcccaaggattaaatatatgggaatttggaatggtgaaatgctgaaatgcttttgttagttatgaaaacgtaagagagaaattgcttatagtggctgcaccctaccggtagctcctcacaaagatctgaacgttgcaatgctaacatcaagcattatgacctcactaaaccctgatatcttcacagtgctgagaataggccttggtggcctaacctggatttctgtattcccatggtgtttccccgtagtggggcacggagctaaatgactgtacacatttgttgctccgtatttcattgtatgtcatatataacgtggagaagatggcccagaatcatgtatactcccgtcaaatgctttattcaaccatcgttccttgcccgngtaanaanaccnacacanactccaggggggcccggnaccaat

SEQ ID NO: 34652 - DNA, 778 bp, Triticum aestivum
  unsure (1)..(778): unsure at all n locations
  Clone ID: PAT_TA_34652
tgatgctctgttttctctatttttgttgggttggaacagagtgggttaccgatcccatatgccagtatataggaagaacaaaaaaacttaggtgatttaccttttaacctaaatttatataggaaacttatactaacctttatctcagttagttgcaccagtttgcatgtatttcagttgtggctcctttattctaagttagctgcatcatcttgcagttattagtgttcttccatgcctacttacatgagtgtgtcacttatattgttcatggtgtatgccacctgatcattgtacaaccattgttgcctatcaataaattttggggtaatggagacattgatcgtctttctcggacaatatatggtttgacttcttgttgttacatttttgtttgcgtcagaattataacatgtatttggttattgcaacaggtagcttatttaccccctaatcccctttacttttgtttgatactgtgtacatatcaatgtttagtcacttgaattcagaacaaagatatggtacaccggacacgaaagaaagcagtagatagatatacagattcagatgatatagtttctgtagatgcgaagcacggaagttctaggtaaaagtgaatctgttaggggggaaaacgaaggcttgtgcgcctattagtnattttttttgttttatcattgtcggcacctnatctatctgtaacatgtgtgacctgtgcaactgcaaaagtattgggcaataanaattctgngtaacacatgttttgtatgcactc

SEQ ID NO: 34653 - DNA, 621 bp, Triticum aestivum
  Clone ID: PAT_TA_34653
ggtaatgcaagcttgggtcttggtagtgggataaatggaaaatcatatcgattaataactaaatacaaaactaaatttgcaggttggccggcgagcgctggcaccaaccagaggatgcattggcgcacagagaagtgccagttcatgccgatgagcgatgattgtcaatggagattacatgtggctgcggaagcataaaaagcatggtgataagaaacgattgatcaggtttgtattgtctgacgcatttgtgcaagaaccaagtaattgctacagtgccagttaggttgctctgggaggacttctttctgccataaggattaaagcaccttgattgattcatggaggacgcaccaaacaaggattatttactactggatctaccggccagaaaaacagagcacacgcccgtgattgcccaagtccggaagggacaaggccactatgtaatatatatcccagttagctccaacacttaatttcctgtgcctcctgatgttatttactaactagacttaggaatgtgagaaacgtcattttgtaatatgccttgctggagcaagattgaattgctggaccaaggtctacatctatattcccttatgtttttcacttataaaa

SEQ ID NO: 34654 - DNA, 1888 bp, Triticum aestivum
  unsure (1)..(1888): unsure at all n locations
  Clone ID: PAT_TA_34654
gcttgcccattgctgctgcatgatgctgactagtcattacccggttcaggtcaccgttcctgtccgtgcttggtccgctctcccgcggcgacccccccgtccggatggatcattgcagaagtcgttcccttcaactacttccttgcaccaagagcttatttgttttgagcttccatcattgcattcatctttcttggatttgctccatgcaactattaaaggaatgcgaagccaacttttaccgcatgctgctaatattgtacggcttgtaactgattacttcaaaattgcgaagctgcctactacgaggacaaaagtttacagcattgttcagctgttgctgacctccatgggtgttggaatgtctctccatttgttagaggtaatagtcagcaatgcagttggtgatctggatgataattgtgtaaaagaaatgactctattcagcacaaatccatcaaaagggaatagtgaatctttgtcaaaaagttactccaagaagaggaagcaagagccacaaatgcaaaattcacatgcctcgggtttggagaaagcagcaatcagcccaaagaaaatgaaaacctcttccatgccaacttcatcgaagggaatgacccctgaaactccaggagatgttagaatgttcacaccactctgtgttaaaatagctgcactagaaaccttggaaattcttctgaatgtggggggttcattgaggacagatcactggagggcaaaagtggacttgctcctaattaacatagctacaagtgcttgtgactcaggagcagggtatgagccatcaacaaccaaagtcggggagacaagcatatcagactttcgacttgcttcatataaggcattgctggcatcttttctttcatctcctcatgcccggccactttatttagcccaaggaactgaactcttcagaaaagggaagctagagataggcactacgctcgcagagttttgttcacatgctttgctggctttggatgttcttacgcaccctcgagccctttctctagaaaaggcaggtcctttagtccctggactcaaccgcagtgaaccagaaaaggcaatttttggtgctggcacatttaacttttcaccatcccaagggcagcgccaggttattgcggatgaagatacttatgatgattggttgccatccatcaaggataatgaaccgtcagaaaagtccactcttgtaaaagaagttccgcaaattgattcacatacaattgctgaggcagtagaagatgttcctgcatgcaacaggagtgatgccattatggtggttgcggccacagaaaaaacctccgagccaatgacagtggataatccttctagctccaatgctgcttcaaatccaatctactcaaggccacctgaagcacagaaagccgcagctaccccctttcgagaggaaaagcgtgcggatcatgttgattctcttcttcagaataaaagctcagctgcggtcaacctaccattccgcaatctggcaacctcaggtgaaaaaccatctgacccaggtgttgctgctccgagcagctataaagatgtctcttcgacccgcttcattcagcccatcaaggcagacttgtctgatacagagtcaggagactcgatgccagaaatacaagacggcgacccggattctgactattgagcttccttcaatcaaggataaacatatacccttgccttttttcgtccatctttatcagcatatccctgggggcgagccatttttgctatatatatggctctgtttatctaggaatgaccatcggcttaacgttcgtgtatcctgttgctttccgtacctctgacacttgcaggtttgccagcgcctttgtgcccagtgcaaggnaagatg

SEQ ID NO: 34655 - DNA, 1009 bp, Triticum aestivum
  Clone ID: PAT_TA_34655
ggggggagggcgacgaggagacgcccgccgcgaagccgcccagcgggaagacggaggaggagaagctggcggaggcgaacgagatcgggtacaaggtggtcggcccgctcggcgccgacgagaagcccttcaagccctacgagcccgtcttcgccgtcgtccagattggttcgcaccagttcaaggtgagcaacggcgactccatcttcacggagaggctcaagttctgcgatgtgaatgacaagttagttttaaatcgagttctcatgcttggctcacaagctcaaacaataattgggaggccaattcttactgatgctactgttcatgctgtcgtcgaagagcatgctctagatgcaaaagttattatattcaagaagaaaaggaggaaaaattaccgccgaacaaggggacaccgtcaggaattgacaaagctgaggataaccaacatcgaaggaatagacaagtcctttattcaacaagaaggaacagataagccagagagtgccgctgttgctgcttaaattaagatgatgaatcaaggaaggttgctgttttgtgttcatgtcgacaataccaagcgatccttgatgctggtgttggacattcctcgatcaattctcgatacgtgtctgttgcttttgttctcattaactaattcaaagattgagtcgaagctgaaggccctgtctctgtatcgtcatcttaacgcacaagcctctcgagctatgcctctcatgtaatcagctccagtgtcttgataagtttagaatctggataccctggtgtggatcagctcctgtagtttatagagctacactgattttccaattttttttgtttccttcaccatatgctgttgaatgtgttctgatacacatccctgccatgtccactgtctgctcttcaatgcataaataatgaaactgaaatgtttagtttccacctggtccgagatctcgcgccgtctgggcttctgcagatgtaactgaaatgttgtgttgtagtc

SEQ ID NO: 34656 - DNA, 598 bp, Triticum aestivum
  Clone ID: PAT_TA_34656
gatccggctcggcgccccgcaggaaccctagctatcctcttgtccgaggaggccatccgatatggaggaggtcgccggcggcggttcatcctggccgtacgccaagaagccgcagccgcaccagctggggcggtcgctgacgtaccaccacccctaccagggccaggggcgccgcctgcagcctgcgcagcgccaccagctccctgacgtgcgtgccccgcggccggcggtggtgctctacacgacgtcgctccgcggcgtgcggcgcaccttcaccgactgctccgcggtgcgcgccgtgctgcgcggcttccgcgtggccgtggacgagcgcgacttgtccatggacgccgcgctccggcgggagctccaggggctgctcgcggcgcggggccgcgccttctccctccctcagctcttcgtcgggggccggctcgtcggcggcgccgaagaggcgaggcagctgcacgaggccggcgagctgcggcgcctcctcgaaggcgccgcggggcaggacccggccttcgtttgcgacgcctgcgggggtgtccgttttgtgccctgccccgcctgcgctggctcccgcaaggttttcgtg

SEQ ID NO: 34657 - DNA, 685 bp, Triticum aestivum
  Clone ID: PAT_TA_34657
cgcgaatcgtgcccgcacggaagcgagcgagccaatccgatccgggcggcggaggcggcgcgatgagcttccgggacgagagcggcggggaggacggcagcgggggccggtcgtcctcggcgtccgacctgcgcaagccgttcctgcacacgggcagctggtacaggatgtccgccgccggcggcggcgccatggaccgcctcggctcctccgcctacggcctccgcgacagctccatctccgccctgctctgcaccctcatcgtcgcgctcggccccatccagttcggcttcacctgcggctactcctcgcccacccaggacgccatcatggccgacctcggcctcaccctctccgagttctctttattcggatccctgtccaacgtcggggccatggtgggcgccattgccagtggccagatcgccgagtacatcggccgtaaagggtctctgatgatcgccgcaatcccgaacatcattgggtggcttgcaatatcgtttgcaaatgactcctcatttgtgttcatgggccgattgctggaaggatttggggtcggtgtcatatcctacacggtgccagtttatatagcagaaattgctccacagaacatgagaggagctcttgggtcagtcaatcagctctctgtaacaatcggtatactgcttgcctacacattaggcat

SEQ ID NO: 34658 - DNA, 1120 bp, Triticum aestivum
  Clone ID: PAT_TA_34658
ggagacaggaacacgcgcgcctgcgctgccagccaacgcaatggcgatgccgccgaagcccggcgagccgcccaagccctcgccggggcgcagccccagcctcaatcccaacccctgcccgctcccgcccattcccggcggcccccagccggggggaccccccgcggcggcggcgccgccgcggtcccaccaccgccgcgccagatctgaggtgcccttccgcttcccggacgccgacggcgggggcttcgacgagatcggctccgaggacgacctcttctccacgttcatggacatggacaagatcgccggggccggccgcgaccgcgccgcggagacgtcctcctcgccgccgcgccccaccaagcaccggagctcaagatccttcgacgggttcgccatgggctgcggcgggcccgggaggcaggatggcggcggcgggggcggaggggtgttcgccgacgtgctcgtacaggtgaggtccatgtcctccgagcagctgtctgagctggaatgcatcgaccccaagcctgccaatctttctctagcctttccgagctctgcagcccgcagcaccattcaagtgttcatcagcataacagaattagagcgccagctcctccctctgccccaagccactactaccttttcgacccaaatgacgcccctgatatgatgcagcacgactcccttgggcggttccaggggctggacattggcaaaggttcagtggctgtgaagttggaggcagatgctgctgcgaagtcagagggtagctccatatctgcaggtgaaatgtaatagcaccttcctaattatggacccaccctgcaaacaagcactcctgtcatttagatttatatgttcatagtcttacatcctcaaactgctttcctcaccccgctaggcataatttttgtatccaattctttctatttatctggcgttgtttgattgtagggacctaggtagtttgtttgggttcatttcccatgtgttgtctgttgtttcgaagttagggcgactggtgatcagcctgtcttctttgtttaccttgtagacaattaatcatgattttcccatttggaatttacgaatgtttggttgggacactgttaaa

SEQ ID NO: 34659 - DNA, 734 bp, Triticum aestivum
  Clone ID: PAT_TA_34659
cagtgagactccagaaactcaaagaacgaattcctgcatgccaagaaagaattgaccgaaatacagtcgttatagatgacctgaagaaagagcttactgaaaaggaagaacttgtaagatctttaggcgataagactcatgaagtgaacagcatgaagaaaagtatggaagataacattgctgaggttgtgaagttgaagattgagctagaggcagagcatgagcgtgggacacgtacactggagaaaatgaatggccggttgaaacaaatgcaggcacaactccgtgatttccaaatgcagcatatgcaatttactcaagctgaggcatctcaaattgaggaagacatgcagaacatacaacgggagattgattatcttgattcaaatgttacaaggttaagagaggaagaaaaagaattttctgaagagttatcaggcatccaaaagtctatcagtgacatagcaaaagagatagctgaaagtgataaaaggatactccaattgaaatctcacatggatggtcttcaacagcgtcaaagtaatacggtaacggcattcgggggacaaaaagttctgaaactcctgcaattaatagaatcaaaccacggaagattcaggagcccgcctattggtccgataggggctcatctgcaacttgctagtgagtcctggtctgtcgcggttgattgcgcatgtggagggcttctggatgcatttattgtctcatgtcat

SEQ ID NO: 34660 - DNA, 1105 bp, Triticum aestivum
  Clone ID: PAT_TA_34660
acaacatccgtacatgttatgaatgtggcactcctggccatctctcttttgcttgccctaataagaaggtttctgaagtcatatccagtgaaaataaggataatactgattcagctgaagcattgtcgaagaagagacgcacgtgttatgaatgtggcgttcctggccatatatcgtcagcttgccccaacaaaaaggcttctgaagtcatagctgatgaaactaaggccaatattgactcagccacaacatcatcgaagaagagacggacatgctatgaatgtggcattcctggtcatctatcatctgcttgcccaaataaaagtgctcctgaagtcatagctgatgaaactaaggccaataccgaatctgccacaacagcgtcgaagaagagacggacatgctatgaatgtggcattcctggtcatctatcatctgcttgcccaaataaaagtgctcctgaagtcatagctgatgaaaataaggccaatactgaatctgcctcgacagcgtcgaagaagagacggacatgctatgaatgtggcgtctccggtcatctctcgtcagcttgccccaacaaaaaggccactgagattaatcccgaggaagcagttaaacctgttggtggctcaagtacggaaccttcagctgtttctggtgaaaataaacctagtgacgacacaagctcggcgcctccaaagaaaaagaagagacggacgtgctatgaatgcggcatagctggtcatctctcatcagaatgccccaacaaggccaaatgatcacggtggaccagttactttttgattggtagtgccccttcgttcgagccgcaccaagaattttctcctctaaaggagaggaaatgattcctcaataggatgatcacgagacattttacagagcaatcttgtatgtcagtagacacatgttgtatcttccatttacccttatcattttttgactgcgtcatattcttttttgcgtggaaaagtttggctgcgtgatgaattaggcagtccagtactcaatctatgtgcactgtatttgctattacagcttattaataccaggaacaaattgcagtatccaaaaaaaaaaaaaaaaa

SEQ ID NO: 34661 - DNA, 1576 bp, Triticum aestivum
  unsure (1)..(1576): unsure at all n locations
  Clone ID: PAT_TA_34661
tgagttctccttatgcctggctgtataggtttgaatgctttgcaaaaacaaacttatacaaattgatgaagtcccgcacccagttaggtgtgttcttgtggatttcagaatatgctattggtattttgctcaaagtatttcttgtgcatttctccaaatattgatatttttgcactaccctatgtatatcatgaaatgcattgtgaaaccaaagatcatttaacaaaaataaaataattttatttgtccgcacctacatgcgagttcgtagaggaatacgtgctatccttcaatctggaacttgtagtgaaatcataggtgcactatggtgctgtcttttttgtgtgtgtctgatgtgtgtcctctcaggttgggaagaggacgcacttggaccaaggactaaacattgtgacctgcactgctggactttctcttgcttaccggtcggcgcggggtccaatggacactctgctatggaggaggaagaggaatggatgatgagaaatttcatcactacacattatatgtaataaacatgctcattattagatttttattgcatcattattaaattttcattagcgggagagacaattgcatactgctcagcctatttgttagagaggattgtagtgtctggcttggacaagcgaaaatgtacatctgcccagctgtggtatctcatgtttgacttccctgaaatctgaaatgtccggaactgctcaaatttataggtcggcatcttaaattttctttcttagatagatgcttctttattacgagttgattttgtggtgttgacagagtttgctgaataattagattcttagatgcagttcttaaatatggatgagataccggaaaggagacttgtggttccactttcttttatatcctcttcctcgacctgatttacttttctgataatgcaacaagctggacaataattagagggcagcagatgagactgggtattgtcgtgggatgtgtcagcacatgcgtgtctctcccattatgacgacatggctgcctatcttcccagaatgcaggccttgatcaagaggaatgactcccctcagtttgttcattgtagaaccatcactgagcatgacttttgtaattgaaaggtatgaactccgagttatttctcttcctaaaacagtagatattgcaatcagtcgatcatgtaaagtgggtcttaagaacctctgttcataaaaaaaagtttactatagtgttttgcaagatatatccagcagaactttactgaatcttctaagcttgatggcagtgtgtatcagatattgcatatatgatcactttctggcaatgatcggccatgtagaaaaactttaaaagacaggcaaataaaaacgacaagcagcagctaaaacagaaataagtaaaaatacaactttttccaagcaagtttcatttgtgctctccacagggatggctcanacgataagacatgttattcacgataacccttttttcgaattatattccttcttttatacagcttagcattgatgactcacagntgtacaacactaggntctgcagtcatgtaagt

SEQ ID NO: 34662 - DNA, 1486 bp, Triticum aestivum
  Clone ID: PAT_TA_34662
gtgacgactatgaattttttgaccggacaaagaagaaatcatctaatcctcaatctagcgggcaacaatcagttgagactgctgatagtctccttgataaaaaggatttcatcaacaatgatattgaaggtaaaaagaagttgcttgaagaagagaagattaagctggctcagagagataatgcagatcttggggatgaccttgatgcttacatgagtggattgtcatctcaattagtacacgataatattgccacaattcaaaaggagctttctgatcttcaagctgaactggacaaagtagtttacctactgaaggtagctgatcctatgggagaagcagctcgcaagagggatttaaagccaagagaaggaaaccctcaagcatctaatgataatcctagaccagaatccaaaaaacaggacaaaattgcccaagacaaaacctcaacggaggagaacttgaaggattctttttctaccaaaacagaagcggataaacctgctgaggtagaaacagatgtccccccaaaccaagaaaatgccagcaaacctgcattcaccataccaaaacctcagtggcttggcgacaagagaatcatagaacctgaagaaaaatgtataaaagaaggaaacacgaatgctgaggagcctgatgattttgtggactacaaagaccggaaaactattctttctaattcagccaatgaaaaggatattgaaggggctgctcctgggcttatcatacggaagagaaagtctgctgatcagtcagctggcgttgaagcagaatcgtcttcggttgaatccgaagcatcagcagctgatgctgtggcccttctgctgaagcacacacgtggtttacaacctgcagaagacattgagaacgagaatgaaccacaggctagcaagagaaaagggaaaaagtcgaaacaaaaacgtgtactgggtcctgcaagaccagattttcttgaagctggtccagatcatgaaacatgggtgccacctcaaggtcaaactggtgatgggcgcacttcattgaacgatcgtttgggttattgatgttttctcatcctagacttcacctgttgcataacgaagagaagcgcaatagtgatcacctgtgctactgtaattggattgtgaaaacgtgttcagaattgtcagatggtatcaagcctcttgggtaggtgcttgcggtatactgggacgacactggagtagaggctgactgacatatattatcaaattgtggttactggtcagagcatcaaaggcacatagacgacaatcattttgttgagtttccaggacttttgtttgtcgtcactaggattgtagaagagaatgtatatcaccctgtcaaggtttcagaaatggatgtatatcatcaggtctcactatgagggtgttgtaaggttttggtgcttttctggcagcagcctttgttttgaagtgtggattaatctccgaacttcattacttcc

SEQ ID NO: 34663 - DNA, 439 bp, Triticum aestivum
  Clone ID: PAT_TA_34663
cacagatttactaagaatgctcacttcattcctttgaaacatcctttttctgctcctgtagtggccaaggctttcctccacacattggtcaatctgcatggacccccacacaccattgtgtctgatagagacaagatattcactagtcatttttggagagatttgttcaaactgcgggacactaagttgctcatgagtactgcttatcatcctcaaaccgatggacggagtgagcgggtgaaccggtgtttggagatgttcctcaggtgtgcagttcatgatacgcctactaagtggcatgcttggctgcccttggcagaattctggtacaatacaaattatcactcatctctggagtgctctcccttcaaggccctatatggatatgaaccaacttatggagtctttcctagtctgctacagtctgacaacatagatg

SEQ ID NO: 34664 - DNA, 1398 bp, Triticum aestivum
  Clone ID: PAT_TA_34664
ccaccctcgccctcggttactcgctcggcggtcccgggccgtcccgcccgcccgcattccccgtcttctcgccgatggcctgctgcatcctctccctatttgtgaagtgtgttgcacacatcggagcattgttcactgccttcctgtctgtggcgagcgccttgggcacccctccacttttcgctgccatggttatgtcattcctttcaaacatcatccctgccctgaccccttacggcatagggtcagcccccgtcttctatggagccggctatgttcccgctggccgagtggtggggctatggatttgtcatctccgttgttaacatcataatctggcttggtgccggaggtttctaggtggaagatgattggtttgtggtgagcaaccctgatgcaccacgcttgggtatggagaggctggcaaagatgggacccaagagcactgaggagaagatcatggccggcacgcttctgctcacggttggactttggatctttggaggaatgctgagtgtagatgcagtgtctgcagcgattcttggcctatctgtcctcctaatttacaggagttgtcacatggaaagagtgtttggcggagtctgtagcatgggatacccttacttggtttgctgcgctgattgcgatggctggctatctcaacaaatatggcttgatttcttggttcagtgagactgttgttaagtttgttggaggtcttggtctgtcctggcaactctcattcggtgtcttggtgctgatgtacttctactcccactacttctttgctagtggtgctgcacacatcggtgcaatgttcactgcgttcctgtctgtggcgagtgccttgggcacccctccgcttttcgctgccatggttatgtcattcctttcaaacctcatgggtggcctgacccattatggcatagggtcagcccccgtcttctatggagctggctatgttccgcttgctgagtggtggggctacggatttgtcatctccgttgttaacatcattatctggcttggtgccggaggcttctggtggaagatgattggtttgtggtgagcaacacggttgcgggacttcctatttcaatgagggcgaacgaaactagcaaaacatttgcaagtggcacaggttgagctgaccacaagttttgtcgacatgatccattcttttagtttgtacccgtacatttgttttttctggcagttacttccaatgccaggatgcagttactggcaagtggcatcttaaaaaatgaaaaaaaaacttcttctgtttatcttatgccttagtttgtgcttggtgcccctgataagcctacatgattgttgcatggacctttccccccccatacttttgagtaaaattttctggctcaaaaatagcaa

SEQ ID NO: 34665 - DNA, 740 bp, Triticum aestivum
  unsure (1)..(740): unsure at all n locations
  Clone ID: PAT_TA_34665
gcacgagggtgggataagagagtcataatggaccttctcccacagtttggtggagagactcacttcatcataacaacacgccttccacgggtgatgaacttggagccatgaagctttcttatttatctggtgctgaggcaatgactttgatgaagggtgctgtcaaggaatacccgctaatggaaattgatgcgctcaaggtcattgaagaaaagcttgggaggctcactcttggcctaggtattgttggagctatactctcggagcttccaattactccaagtaggcttcttgacacgttgaatcggccatcgcccataagagatttttcttggaatgacagagaagtaatcagcttgaaaaatcatgaaatccttgttagactcctggatgtctgcctatcgatatttgagcacgcagatggccccaggagtctggcaattcgtatggttcaagtgagtggttggtttgcaccatctgcagttccaattcatatgttggctctggctgcacataaaatcccaaagaagcatcggaggggtccaaggtggaggaagtggtggcgaacactaacttgtggccttgcaacttctaggatgcagagatctgaagctgaagcagctgcaatgttgatgagatttggaatttgccagtgcagcgcanagtctgagtatatccagttccatgatatgatcaggctatatgctcgcaagcgagggagcacaagaacggctcaagct

SEQ ID NO: 34666 - DNA, 1142 bp, Triticum aestivum
  Clone ID: PAT_TA_34666
ctcttcgttactccctctctcttcccgccgccgccgcgccgccgccgcttcgccaaaatccggcgtcaactgatcggcggcagccatgagtaagctccaaagtgacgctgtcaaggatgccatcacccagattgttggggaggccagagaaaagaagcgcaagttcactgagactgtggagcttcagatcggtctcaaaaactacgacccacaaaaggacaaacgcttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttgggcctggtcttaacaaggcaggcaagtttcccactctggttagtcaccaggaatctcttgaagccaaagtcaacgagacaaaagctaccgtcaagttccagctaaagaaggttctttgcatgggtggtgctgggggcaacttgtcgatggacgagaagcagatccaacaaaacatccaaatgagcgtcaacttccgtgtgtccctcctgaagaagaattggcagaatgtgaggtgcctgtacgtgaagagcaccatgggtaagcgtgtacgtgtgttctaagtgtgtgcgctccagtgaagttgataagatactgggctgtcctgccgacccctgcttgtctttggattagatctgtttcactgataccaattttctgtttgcctaagcgaatatcaacaagtattttatcgtactagtcttatcttgaacagaaatcatgggagcaatggaactgcattttctgtcatgattttgcgttgtgcctgttatcacagatctatatgcgatcttgattgtcatctgaatgtagattttacttggaagtgtttcctataagtgtgtttaaatggataacttatttggttagcctagcaaatctcaggaaaatagaagtttgttatctgtaaaaccggaaaagtgggattttgtaaaaacgactgtcagtactatatgtttttggattttc

SEQ ID NO: 34667 - DNA, 1479 bp, Triticum aestivum
  unsure (1)..(1479): unsure at all n locations
  Clone ID: PAT_TA_34667
gccggccggtctcggctcttcgttacgccctctctggcccgccgccgccgccgccccccgggccggtgtcaactgatcggcggcagccatgagtaagctccaaagtgacgctgttaaggatgccatcacccagattgttggggaggcgagagaaaagaagcgcaagttcactgagactgtggagcttcagatcggtctcaaaaactacgacccacaaaaggacaaacgtttcagcggctcagtgaagctgccccatatcccccgcccaaagatgagggtgtgcatgcttggttgatgcccatcatgtcgaccaaggctgtagaaaatgggaacttgtacgacattggtatgttcgaaacgcttgaaggccgccgccgccgccacgccaaaatccggcgtcaactgatcggcggcagccatgagtaagctccaaagtgacgctgttaaggatgctatcacccagattgttggggaggccagagaaaagaagcgcaagttcactgagactgtggagcttcagatcggtctcaaaaactatgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgtcaacttccttgtgtccctcctgaagaagaattggcagaatgtgaggtgcctgtacgtgaagagcaccatggggaagcgtgtacgggtgttctaagtgtgtgcgctccagtgaagttgataagataccgggctttcctgccgacccctgcttgtctttggattagatctgtttcactgataccaattttgtgtttgcctaagcgaatatcaacaagtatttaatcgtactagtcttatcttgaacagaaatcatgggagcaatggaactgcattttctgttaaaaaaaaaaaaaaaaaaaaaaaaaaaaaatcaatatgagacccggccgcgcccccgatcactaatttactattcacctcccatcgcggcggagaaacaccgactggtcccccgggtgaccgtctatctcctgctagagncccttccactcggtatacaaaggcccacgatnccttcaanttccaccnatgcaatggaaccccgtncggcatancggggggtgg

SEQ ID NO: 34668 - DNA, 628 bp, Triticum aestivum
  Clone ID: PAT_TA_34668
atgcgacctctctcccgctccgccgccgcccctactgctcagccgccgccccctcgatctgtttcctgtggccagatccggccggggagccgccgtagagcctccacgtcgtcggagcagagcagcccgaggtgggtgccgatctcgtcccgcagatcaccggcggggccacgaccacctcattcactgtcgcggtggtgtttctccccgcgtcgccgtcgttggttcgcctcaccctcctcaccctgtcggctgcaaccgctcctaccctccacggtgctcctctttggcatccaccgcaggccagtgagcggccacgaccagaagtcagggaggcctctattcctcatgaaccgggatgcggttctggcttgtgggcacatgagagcctgacgatttgaacactagcctgttttcttctgtaggaaagtggcatccttgacctgatggaaagtgctagacagacatcaaattggctgcggatcattctgaatgctggatttcatgccatcactctgacgaaagcatctgtgcatctgttctgttctgtatgttgccagcttggcctgctgctataaatatagcaccaaatctaccaggttcaaaccattcattgcctcattagaag

SEQ ID NO: 34669 - DNA, 817 bp, Triticum aestivum
  Clone ID: PAT_TA_34669
tcgaggacgacgcgggcgaggctagtgctgtccgtgctcatcaaccttctctgctcggtggtgtactacgggctgagcctcaacgtggtcaacctcaagaccaacctttacgtcagcgtcgccgtgaactcgatcgccgagatgcccgcctacctgctcaccgcgctgctcctcgaccacttcggcaggaagccactcggcatcggtaccatgcttctcagcggcgtcttctgcatcgccggcagcctcatcgctggcgtcggcgccatgaggatagtgaggatggtatgcggtgtggtgggcatctttggcatggcggcgacgtacaacttgttgttcatatacacggcggagctgttcccgacggtagtgcggaatgcggcactaggttgcacgtcgcaggcatcacagatgggtgccatactggcgcccatggtggtcgtgctcggggaacgggtgccgttcgcagtgttcggcgtgtcggggatcatcggcgggctgttggtgttctacctcccggagacgatgaacaagcccttgtacgacaccatggccggcctggaggaaggagagaagacccccttgaagtaagagtaaggtgcagcgcccagcgcgggtgactctgaactgcatcagttttcgtgtgtaccttcatactgaaacatgttgccggtggaaaatgttgctggtggggtgaatcgctcaagtagctttgtttgtagatttattttcttgttgtgtggagtttgtacatttttgttttggaatatactgtagattatttcacctgttaataaatcaaaggaatgttgttctc

SEQ ID NO: 34670 - DNA, 763 bp, Triticum aestivum
  unsure (1)..(763): unsure at all n locations
  Clone ID: PAT_TA_34670
gcttgatgttttgctagctgagagaagagtggatgaagcactggatgccctggatgaagcagaaagaattgctgttgatgcagaaaagcaacagactcttgccacagctgacattgttgctttgaaggagattatctctgataatcgtcaaaagttgtcagatcagcttgctgaagctgcctgccagtcttctacttgtggcattgaacttcgtgctgcagcttctgctctcaagcgacttggtgatggacctcgtgctcatagtttgttgctcagtgcacataaccaaaggcttcagtccaaaatacaaacaacacgtccgtctagcacaggacatagtgtggcttacactgcgtctcttgcaaagcaagttttctctgtcatagctaatgctctcagtgactctatggaagtgtttggtaatgaaccatcttatacctctgaactagttacttgggctactaagcaggcaatggagtttaccttgcttgtaaagaggcatgctttaggctcttgtgcagctgctgggggcttaagagctgctgccgagtgcgttcagatagcacttggttatacctccttgttagaagctcgtggtctgtcactttcagcagttctgttgaaacagttcagacctgtgttgagcaagcattagattccaatttgaggagaatcnaanagactacttctgcattancggcattgatgactgggctctaatcnacctccaactggtataangncattgctaaacatctgctgg

SEQ ID NO: 34671 - DNA, 851 bp, Triticum aestivum
  unsure (1)..(851): unsure at all n locations
  Clone ID: PAT_TA_34671
gggtcacccacccgtttccttcaatcggggaggatagctataggggaaaagaagccgccagggagaagagacacaacggaggagcgaggagcgatcgccgccaggttatttcttcgaccgatcccgcaagagggaggaagcgctggcgtccgagagactgtcttgttttgtgggaaggggaagaacgtcgctagtactgtggttgcggttcccaggttgcctcgttggttgctcgctcgtgtccttccttggaacctaagctacatccgcaccaagccctcatcatatcggcatccctgtatcgatggcttcttcagcacgctagatacaaccaccctacgaaaaaaaaccatacgtacgcgaactggagacagatagaccagtcgacttggatccacgggttggaccataaatccaaggactgatacagaaatccgcaggctgaatgcgacatcgcgtcaaactccccgtcatgttgacatccatggcatggtgatgcacgtttcatacgtccgattttcagtttgcaggcattattttgtacctaaccttgcaatgtaaaagactaaagagagttggtgcctgctagggcaggtggaccccgtttgctcccaattggaagtggaataaaagatgggatgcttagttaaaacaattaatgtgatgtccgtttacttcagttctgttcagttaaaaatattaactgacgtcatttccaaaataattggtctggatcgcaaanaaaggtattcaacanttggacacaacaattgaaattaacccatgcagtcaaanacaanaggtncggaaaatggccnntcggtaaataaaaanccnttgntacaggttgg

SEQ ID NO: 34672 - DNA, 1234 bp, Triticum aestivum
  Clone ID: PAT_TA_34672
accggtccggaattcccgggtcgacccacgcgtccgagctcaggctatactgaaccatgcctggatttctgctagatacgcaaggggcaatgcttctgaatctagttcaaacactaccatgaagatatatgtaccaacaaaccccaggggcgcagagatgctagcacctggcatcattgcatcagagtctgatttcaatgctcacagactatggggagacccggctgaggacctacccttcaagccaaagtaccttgttactttcactgttggaattgcacagaaggacaacataaatagagcagtccagaagttttctgatgactttgctatcctgttatttcactatgatggccatgtgactgaatgggaggaatttgagtggtcaaaacgagcgattcatgttagtgttctgaaacaagcgaaatggtggtatgctaaaagattcttgcatcctgatatcgtggcaccttatgagtacatatttatctgggatgaagaccttggagtcgatcatttcaatggagaggagtatatcaaacttgtcaagaaatatcagctggaaatctcacaacctggtttggagccagataagggattgacatggcagatgaccaaaagaagaggggatcgcgaggtccacaaggatactgaggagaggccaggctggtgcacggatcctcatcttccaccatgcgctgcttttgttgaaattatggctccggtcttctccagagatgcatggagatgtgtatggcatatgattcagaatgacttggttcatggatggggtctggattttgctctgaggaaatgtgtggagcctgctcacgagaaaatcggtgtcgtcgactcccagtggatcgtacaccaagtggttccttctcttgggagccagggacaggtggagaacgggaaggcgccatgggaaggggtgcgggagcgctgccggaaagagtgggggatcttccagacgaggatcgcggaggccgacaaggcgtattacgagatgatgggcgtcacccctcccaacgtaacatctgtccactaggccgtcgtatacatcgccgctgttaatcctccctccccccttttttgtcatctctagagcccttattgtagtgagcttaggtgaatggtgatgatattgatgatacgtgtagagcatacacacatatcataccatatcaggttaattctgttacctaaaaaaaaagaagcaggagaacaaaaa

SEQ ID NO: 34673 - DNA, 677 bp, Triticum aestivum
  unsure (1)..(677): unsure at all n locations
  Clone ID: PAT_TA_34673
catcaccgttgccctctcctcctcatctgcctccgctctccccagtgctcgcctcctcctccgccgtcgccgtcgccgttgcggtctcctcctgcgcctccgcccttcctcgtgtgcttgcccgctcctccgctgtcgccgttatcgtcgccgtcgcgctctcccccgcagctccacctccgcctccgctcttcctcgtgctcgcttcttcctccccttccccctctttaccgcagagggaaagaaagagagggccagagggggcgcgtcttctcagatcaacaatggtggactggactagcgataacgatgatagtgataagtttgagtgggaaagtgatggtgaggctgaaccctcatcagctccggccttcaggaacttggatgccgctggtccttccacgctggattctaatgggtgggccaacgaggaagctccacccacttcgttagtcgagggatatgtgttaatgggtttcccgaaagagatggtcttgaagggaattaaggagattgggcacagtgatgcaaatgcgttgctggaactacttctcacgtataagacactgngtgatgacgctgcagtgggtaattgctctacttctggctgcttcccccagagtgttgaagatgatgatgattttgattttgaaactgggatggagacgatgatgctg

SEQ ID NO: 34674 - DNA, 1545 bp, Triticum aestivum
  Clone ID: PAT_TA_34674
cgcgcccgcggccgctgctccgtgtgcgttcaggccgcgcctcgtctacctgcccccgcgggcggcggctctcctcctccccgatcccggtcgagtgcgcctccgccccctggccgctccctccttccccacggtgctgccttgtggtcacgccgcgtggtccccgtcttcgcgtcgtccggtttcccctctggcgtcccccagctggctgctgccgccgccctgttctggcatcgacaagcggtttcctccctccttctgctctgcttcgctccgcaccccctccgcacgccgttacatataagcatatttctgtaagtttgagagagatcataaacaagcgatcgccacatgttgacagggctgctcgaccggcagagcagtccagcagccgcagcggacgactgaacgtgtcgcaccccaccgcaccatacaactataataattcttccacttcatgagccattggactattgggaaatatgtttagataataaacaagccttcagatgagaaggcagatcataataggtgagcaataatatctttttttttcctttcaaactagcaccttttgtaaccccacaacccatagcattgagcaagcacaaccaatcattgtttgctctatttgattattactaacccaaatactagctatagtaatgatggctaatggtacacctccagatttcttcaaaatagctctcgctacttactccatttttcatgcggacatatgttctcgctctaaaatattcttatatagagaattattggagagtcttattttaaatatgttcagttctattaattatgtcatcataggaagagtgacattatttgtagacactaatttgcgtgttattacgattatctgactacagagattggtttttgacacaccatacttaataaatcttcacatgttgttttgcatgacgcgtgttgtttttcttctccgatgaggcctgcccttcgctcacatctcaaaagtcccgaggaacacgaagatcagcgcaccagcagtcagcagctcaagttcaccgacccaggaaagatatataggaactagtagtatatcataggggcaccagtgcaaatcaaaatagtgtttctggcttttgctatcatgatattgtgatcaagaacacgctgtgtactccccattccgatatggttgaatcgctggagagggcaactttgtttgtaggtgccaatattcatgtgtccctttgctgagagcctgagagcccgtccttgtcatctgtcgcctcgggcatctgcttcgttgcatttttccccgcttccatgacgccgttttcctccccccctccatttacatggctttgcttcctcctctccgtttacatgttgctgctgtagatgtgctcttcagtgacgccaaatatctccggaagtcaatttacatggctttgcttcctcctctccttttacatgttgctgctgtacatgtgcttgcatatttggttcaatgtcttaccatttttccatgaccaattgcacgtgcttacaaagggagtc

SEQ ID NO: 34675 - DNA, 972 bp, Triticum aestivum
  Clone ID: PAT_TA_34675
gcctcaagccggtgcatcatctgtccaatcattgcctctttctcctcttgctgacgcttgttccagaaaggatctgacagcaatacatgaaattctagaaaagacggggtacaaggatgatgagggaacagcaaatgagctctcatttcagatgtggaccaatcaaatgcaagatacattaacctcaaagaagaagggtgacagtgcatttcggcaaaaggattttactactgctattgactgttactcccagttcattgaagtcggtacgatggtgtcccccaccatttatgctcggcgttgcctatcatatctgatgaatgacatggcagaacaggctctcagtgatgcaatgcaagcgctagtaatatctccgacatggccgactgcattttaccttcaagctgcagcgttgctttctttagacatggagaatgaagctcaagatgctctcaaggatggttgtgcccaagagacaagtagcagcagcggacgctgaatatgaactgatttcttgtctaggaaatgcacataattccaggtgctcgcttgaacaaaatcatttggaatggacgaagcagctgtttttcatctgtcaactttggcgtgcaagtgttctttgagcttcttatgatttgcgtgcatgagacaacgtcgtccctcctccgtatgtaaatatggaacaaagcgacaacagagaccaggaaagagatgccattgaaagtgtagggtggctaccccccgtagacaggttttgttgagggggagcgataagtccgtgtcgcttcctcccaccgagggaagggcgaaaagaagaaagattgttgttgatcattatttgtcaagctgtgctgttctttctcgtcggaggaggatcgtcgttggctgagtggccaccaatatttcgcagtttctattacgacggtccgcttctgctcgtgccgaattctgtagtcgtctcctttgtaagct

SEQ ID NO: 34676 - DNA, 2039 bp, Triticum aestivum
  unsure (1)..(2039): unsure at all n locations
  Clone ID: PAT_TA_34676
gcggggctcttcccagcctccggccggcacctctcctggccttgctctcacgtgttgccgcaacttttggtggggaggagtcggtggtcggggcgcggctgtcggttgagttcgcgtttgggaggcttgttgattacccttcattccttcgcgtcatctcagctagccggccgcataggttcttccttgcggtgctactgttttcgttgcttcccacccgtcctcccctcccgactatgtggctcggagcggagggcggtccccggttgctgggggcgcccggccgtggcggtgcgcggcgtcctcccccgccgcccccgcatccacctccgctcccgctccctcgccttccaggccggcttccaggtggtccctcttgcaaacggaggaagtgatccccatttatcactgacagaaatggacttcttttctcaacatcttcggagctcgcagatgaacttatgatgctcttcaagggatttccagaggaatgcgataccctgaaatccctgaaggatggtgccttgagtacgggtccttcgcccaaagggtccgcgccctggggtccttgtgcacttcctttggtgaatcaggtcataagctgaatctctcaatagtaatactaatccagatgtggtaaaaggatggttttagttgcttgccttgaatatctgctgattccataggttatagggctattgtcctcttgagtgcccagtcgttcactggttcgtggagctcgtggggagggcaggtgcatatttcagtttgcttgcacctgctgctgctaggatcagccgctaccaagggcattggtgttgggtctttgacagaacctaccgccaatgccctcgggggcctcacaaagtctgtaaaactacctaaatgcccagttacatgacagtagaggacacaaaaaaacatactatgacactggcattgaggccgaatgtgagagacatatgtacatgactactgttcatactagcaagattgatggtggagttttgttgaaacccaataggcctgcacttgttgtgagcagcacaagctggacaccagatgaggatttcagcatacttttggaagcagcactgatgtacgatagacgcgttgctgctacattaggtgaagaggattcaatggatgaggggcagctttggattgatatcaagaatggaaagcaatttgattacccaagattacttttcattatcacaggtaaagggcctgatagaaataaatatgaggagcaaataaaaaggttaaaactcagacgtgttgccttccggactatgtggcttgcatcggaggactatcctctattgctaggatcagctgatctaggcgtttcgctgcatacatcctcgtcggggcttgatctacctatgaaggtggttgatatgtttggatgtggattaccagtttgcgccgcttcattctcctgcatcgaggagcttgtgaaagtaaacaaaaatggacttcttttctcaacatcttcggagctcgcagatgaacttatgatgctcttcaagggattcccagaggaatgtgataccttgaaatccctcaaggacggcgccttgagtacagggtcctcttctaaatggtcaaatgaatgggaaactaatgcacttcctttggtgaaccaggtcataggctaaaatactaatcagatgtgtaaaaggatggttttgttactggcctgagtatgtactgattccatagtttataggtgtattgtacacttgagtgaccagatgtacattagaaggttgaggagagggcatgtgcatatttcagtctgtttgcacctgttgctgctaggatcagctgctaccaagggcattggcgtcggtctttgacagaacgtaccgccgatgccctcgggggcctcaccaagtcatcaactgtaaaactacctaaatgcccagttacataacagtagaggacacaaataaacatactatgacactggcattgagaccaactgtcagagagacatatgtacatgggccattcaaaattgtancagggac

SEQ ID NO: 34677 - DNA, 457 bp, Triticum aestivum
  Clone ID: PAT_TA_34677
ttcccgggtccacaagaaccaagatgtgcttgattccatgcacaacgctctctctatctaccgcgagggttggcaactctgcgtcaacgagggcgaagcaccggctcttcgaggatttgcaggtgctgacacattggaccaacaccatgataatggcaactctgcctcgttaatgtcggccaccaacgatgataaggccaaaccgccccacatggccattgacctcacctccaacgggaggaatagattaggttttcagttgtttttagggttttctttgttatgtataaattacttcgaaatgattgaaaaatcggtgtccaccttatttgatcactctggttggatgggctccgcccagctggctatccacaaacatgtccgacaatttttttgaaggcgtacttatttgtattcaagcaagcggcaaaccaatacatgtacaattacaaataca

SEQ ID NO: 34678 - DNA, 757 bp, Triticum aestivum
  Clone ID: PAT_TA_34678
ggcccctccctgctctctcctctcccacgccgccaccctcgagcccgcgccacctccacctcgtctcctccccgcttccaactctccaacgctgccgccctcaatgcctcgtaagggacgctgtcgacacgtcggggatacgcagcgacggagctcagccggagcacagcagaaacccactcctaaccctattcgctcgattgacaagagcagggcaacagattggatcgagggcgccttggcctggcctggccgccgctgccacctggattcactagccgatgtgtggagttgccctggccgccgcctcgagtcacctccgtcgccgccgcgagtcagctccaccattggcgccaggaatctcgtcccaacaaggaaaattcctagggatttgattgatggaggcatcactatttggcgctggattatccatttttgcagcaccaacaatgttgtttttgtttggaatggccagttctcaatttctaaatcggccatgctatacttcttgtcagagcacattaccttgctgtttcttcaatctatatgtagcacaaaaatagatgacaaggtcgaatttgtaggtgacactattggacatgatgatgacgcaaagggcagtgcatgtaagcaaggaaattgactacaagtttcaacgtcaacctgaatttttattgtggatgtttgagcgtgaacctgaattttgaaaagaacttttaggatgattagctgtagtacctcggccgcgaccacgcta

SEQ ID NO: 34679 - DNA, 1830 bp, Triticum aestivum
  Clone ID: PAT_TA_34679
aactgttgggtgtctccaccaagagctccggttcaagcgccgcgcgcaagtgcgtgaagcggaacgatagcatctggggtgcatggttcttcttcacccactacttcaagccggtcatgtcggctgataagggcggcaagacgaaggcacccgctgctgccgggaatggtaatagtgccacactggatgctttcctggtgcagcatcgacatggagaacatgtacatgtgggtgtttaaggatcggccggagaatgccctggggaagatgcagctgaggagcttcatgaatggtcactcgcgccttggggagccacagtttcctttcagcgcagacaaagggtttgtgcgctcacaccggatgcagcgtaagcactaccgggggttgtcaaacccgcagtgccttcatgggattgagatcgtgcgggcaccaaacttagtgggtgttcctgaggctgatatgaagaggtggttcgagctcactgggagagatgccaatttcttggttcccactgaggcggatgacttggaatcatggaggaatctgccgaccacggaatttgagctcgagaggcctgcaactgctgctccagcaaagagcacctcacatggccatcacaagaaggtgctgaatggttctggccttaacctgtcaacacatgcatcaaagcatggttctggggatggtatggacatctcccgcgtgtgccgctcacgcaggaaggattcctccccctccgccatggaagaggattgcagcaattcaaattcagacaaggttcaggacatggatgtgagccacacttttgagccatcatggacgaatgacttcactggtgtgatgcgtcatgcttctgggccagtaactgccgcaaaaacaatatatgaagatagcaagggctacttgatcatcattagcctgccatttgctgatatacagaaggtgaaggttacctggaagaacactcttacgaatggtgtcggcggccgcccgggcaggtaccccaccgaatattattgaggccattattgtgcctcatgtgatgtgcttgtggatccttcacctgagcattgtccaccaggggagttcatccgggaagttccattgcctacccggatcccagaagatgctactctggaagcatactgtgatgaatcaggaacaggcctagagattattgtccctaaacaccgtgctggacctgaagaacatgaagtccgtttgtccctgaggcctccctcatcatggtgccaatgaaaacatgttgaagtatgcggggagacaaggtgtggatgttaccatacaacaaatgcagctcagttttgctaattgtgacggagcagtcctagtcgattgaagcattctggtagttggaagttggcagctgtggaaatttaggggcatgctacaggccacaaggaacatagcggcctatgttttgcgccctatgttttggtatcgttgctgggcagtaccttgtgtattatcttttgcttttgtggaatttttctttgtatgaaaaggtttgtcgcctgctcaatgtgcttccattccatctgtgcattactctggcgagcagtctgtttaggcatttatagttagttttcataggttggtgagaagtctgctttgtgggcgttcctggaaacttcatccaggaaaggagttcatgcaagtgtttctaggatttgtccatgttttgtgggtactatattgtttttattagcattcaaacgctttccagaaattggtgggaggcgagtgcaattgtttcaaggtaccagtgtaaacaatctgtcatcaatatagattttagtctttatcagttaa

SEQ ID NO: 34680 - DNA, 1141 bp, Triticum aestivum
  Clone ID: PAT_TA_34680
gagtgacaggtggcaggtatgcattcagatgttgcagctctaaggaagggtagtatatggcacatggcttcgtgggttgttcgacaagaagtgttttgggcatattcgaaaggcaatcttgtcaaaattgtacatcgattttcttattccgccatcagcttctattgatatgagcgatacaaaaagttcagcactgaattttagtatgttaacttcgaggagaagcgtcgcccccatctcccgctccgccgccaccgccccccgccttaccgtatcacccccgccgccgcctccctcgcccgcggccatgatgagatctggcgtgggcgccgcagatcaccctctggtgcatggcctcgaccagtttgctatgatctggcgacggggatgcaaggagaagctgctgcggtttcaaggggccgtgaggatgcccaccatgaaggcgtgtctgggatgatggaggtgatatccaggccctggtgatatcggccaggtccccgttgccgtcgactggcggcggccaccgtgtcctcttccatggcgtcggcggggccttcccctgccaagcgcagccgctccttggctggatcaccgtcggacacctcgccggcgtggtcggcaagatctgcatctcgatcctcgccactctccatcctcttgcaggtttataaatttcgaaatatagttgcagcttcacggaatggacggcccaaattatgttagtgtctatatgtttacttggtggtggtctagcatgagtgacacctgcatctgtaacttacccattggatgttgttcgaaatcacctgacaacacaggtgatgcttttcttccttttgtgatttgtgaataacactaagccaacaatcaatcaatataacttccagttagaacttagagcatctttacctaacgctttcatgccatgcagctttcagaccaaaggaacagggtttagtaagctaaactttcatgtctataaaattctgcagaaaaaccactaggtattacaagggcatctttcacacgttgtctacaatttgtagagaagagagtggtagaggattgtataaaggcctttggtccaccttattggtaaggtcgacgcggccccgatatatcaatcaacgtttatgtatat

SEQ ID NO: 34681 - DNA, 678 bp, Triticum aestivum
  Clone ID: PAT_TA_34681
gaatcgtctacttttttgtatcttgaacatctgcaaggagatacttagttatcttccaaaagttgttggaattgatattgtggagttagctctctgggcaaaggaaaatacattgacactggataaccaagagaataacaaccaagaagggcaagaaacatctgttgctactcagaccgagaggaaagtaacggcaaaagttactgttgaaaatgatcttgtatctcaagcaaaggacgaggaggaggacatggaggcacttcttgacacgtatgttatgggcattggtgaagccgatgctttctcggagagattgaagcaggagcttgttgctttggaagcagctaatgtctatcagttgctggaaagtgagcctttaatagaggaggttttgcagggtattgatgctgctagtgcaaccatagatgatatggatgagtggttgcgaattttcaatctgaagctgaggcatatgagagaagatatttcgtcgatcgaatcacgtaacaatggcttggagatgcaatctgtaaataataaaggacttgttgaagagctggagaaattgcttgaacggttgcgaattccgcaggagtttgcagcatcattaactgggaggttcatttgaggagtcacgtatgctgaaaaatgttgaggcttgcgaatggttgactgggg

SEQ ID NO: 34682 - DNA, 746 bp, Triticum aestivum
  Clone ID: PAT_TA_34682
ggtgaagcgcggcgcgccctgcggcctgtacagtttatgtccccggcagacgatctacgacggctctgcgacttcgtgcgaatcggtcggcactcgatctgtgtaattgagaacaaacccagaccaggccgagatcgagcacagcaacacacccacgccgcctccgcaccggaccgcactccgggccgcactcgccgtcggagctccccacctcgacccagacgtggtcgtccctgacgccggtttccctccggtgagcaccggctcctcccctatttgttcgatgtgctgtgcctcgctggctgcgccagagtgaggttgggtgcttcagctagtctattagcagcacatcattcgactgttgagggcaaaagtgtagtgatccaattctggacatggatacgtccattgagccagactcctcgcgatttcagtttttcatctttcagtagctgagggcaacagtcgcggtcgtcaatacaaatatttgtttgatatattactactgactcctcgcgatttcagtttttcaggtttaactgctcttggaatttcttcactgatactcgtataaatacttgtttgatattactacttattcaattttcagtgtctcttttattaagtactgctcctttaatatctctataataatactggtattgttgtactgtagctgcataaacctatgctcctgaacctttgctaatgctattgtgtacaagtgttacagtaacttaagatag

SEQ ID NO: 34683 - DNA, 914 bp, Triticum aestivum
  unsure (1)..(914): unsure at all n locations
  Clone ID: PAT_TA_34683
aagtcggaggagcctctgcgccagtgcgccgcgccctcgggcatactgggctaagtactgccctctccatttgagattcttcatcttaccgaggtttgcgttgacgcgctagcttcttcctcgcgttcgttagagaccgtggagatgggccgtgccatgcggtggctcaagaggctgctcacaggcaggaaggaggcgcacggtggcggcaaggagatccatgccgcgaccgactggcatgacgcggcggcggtgaaggagtccaccaagagatggagcttcgtgaagcagaggaagagcggagttgacgctgggaagcggccctcagagcctctcgccgccgcgctggaggtgaagccatgccgctgtgctggcggcgagcaggtgggggcacgcgaggagaaggcggccgtcgtgattcagaaagccttcagaggctacctggtatgttcttgatcagcgtcccattgattcatatctccatcgtacgtcatctctgtataagttggttgagatactgctgatcgcgtgcgtgtctgagtttcggctatgttcatcatttcttgttattcggcgcgctgaaatggcttgaacagtcccggtgtgcgcccgaattctgacgttaacgatgcagatcctcccatcaattattttagtggataggttcacactgtccgcacactgtttattccagacccgtcagctcgttttgtattatctgtttggactagtgggctaaacgtcgctgtatgtgatgtcactgctggtcatgttcctttccattacggacagttgttagttgttaactcttcctctgttcctgtgcaaagtcggcacgttgatcttgatcggctgcgcagttctttactctgcttcgggcccttcagcagcgacttctcagnaaanagccctat

SEQ ID NO: 34684 - DNA, 1349 bp, Triticum aestivum
  unsure (1)..(1349): unsure at all n locations
  Clone ID: PAT_TA_34684
cggacgcgtgggtttgtatgctcagcagcagcagcagtttatgcaagataacatgggaagtggcattgagaaaatcgccctgatatttaacatcggtgctggctattgtgacgttgcggtgtctgccactgctggaggtgtttctcagataagagcactcgcaggttgcaccgttggtggagaggacattcttcagaacgtaatgcgctaccttctacccgactatgatagcttatgtgacaatgctggtccaaccacggacaggatcaagtcaatgggtttactgcgaatggctactcaggatgcgattcacaaactggcttcccaggaaagcactgagatcaatgcagacctgggtaatggcctgaaagtgtccaagctgctgagtcgtgcagagtttgaacaggtgaaccaggcgatctttgagaaatgcgagaggatcatcaagcaatgcctgtcagatgcaaagttaacgccgaagcacatcaacgatgtgatcttggttggagggtgttcgcttcagcagtcaccgatccttctgggagcctggatctgctgacgattcaggcgaccccgatgaaccttggaatttgtgccgacggtgacggctgctgcacgatcattccacggtgcaccgctgttcccgcaagaagggacaagcctggatctgctaacgatgccaacgacgccgaggagctgcgggatccgtgccgacggggacggctttgcagccatcattccaaggaacaccgctgttccggctagaagggacatgctgttgacaacaacgcaggacaaccaggccgcggcgcggagccccgtcgccggggccctccgccggccggcgggggggggccgcccccgcgggtcctccgccatcgccggcgcccccccgcccccccggggtgccgccgcggccagcgcctcctcgctcttcgtccccggcagcggcctccgggtgtgcgctgctgtcctgttgccccaaggcgaggccaccccgccgctcatggggctgaggatgcccacgctggacgacggccatggctggtgcgggcaggccctggccaagatgtacggcagcaagctcgacctcgctgtgatccctaagaagctgcatccgtaagtgctttgcttaccagtttttcgaaaagaaaaaattgctttgcttgtgactttctgagactggctgtgtactctagtaaattagctcgcggatggtggtttcgacgatgtatcatgtcgtgtgagatctctatgtggtacatgtagacaaataaatgccagtgttgtgctgtgtacaatggtgccttgcgtgtaaaatgggatgttgcntgggtgcatataaggga

SEQ ID NO: 34685 - DNA, 1335 bp, Triticum aestivum
  Clone ID: PAT_TA_34685
ggccgggccgggaatctcaatcctcgcctccacctctcatccgctcgttcccccaccctgaccacctccggcgaccgatcaccgccgccatgggctccgaccgcggggagctcgcgcgcctctgcagcggccgcaactggtccaaggccatacgcctcctcgactccatcctcgcctgctccccctcctccatccacgacctctgcaaccgggccttctgctacttccagctcgagctccacaagcacgtcgtcaaggactgcgaccgcgcgctgcagctcgaccccgcgcttctccaggcctatgtcctcaaaggcaaggcactgtgcgcattggggaaaaatgaggaagctttggttgcttgggagcaaggacatgagatcgctgtccgtgacacaattgacctgaaacagttgctggaattggaagaattagtttcttctgttaaaatttatgagacggttgagtgtgaagacgttgtggatgcatcaccatgtgataccaaagttgttatctcagaagatcgttttatcaacacgtcattcactgcagctacaactgatacaaaaactgttgtttgtgaagagaacactgcaaattccaaatcttcatcaaatagtgatgcactgttaccgaacaacagtaaagaccataaagattctgtcagtccagcaaaagacaccacagtgacacatcaaactcccaagaaacagccaaagacagataagaaaaacaaagcaaaagttaaaaaagaaacaaatggccaggctgaagatgtggaggagagaagaagttccgatgaaaccataacactagatcaagcactgtttgctacaaaagtgtcaaaatcatccaaatcaataagtttggattttcgactttcgcgaggcattgctcaggtaaacgaaggaaggtacgaccaagcaatatccatttttgatcagatactgcgggaaactccaacttatccagaggcactaattgggagaggtacagcatacgcatttcaaagagaactggactctgctatttctgacttcaccaaggctatacaatcaaatccatcagctggggaggcgtggaagcggcggggacaagctcgcgctgctttaggagagtttgtcgaggctattgacgacttgactaaagcattggaatttgaaccaaattctcctgatattttacacgaaaggggaattgtaaacttcaaattcaaggactacaattccgcagtcgaagatctctcaacatgtgtgaagcgtgacaagaaaaacagttctgcacacacttacttgggtcttactctttcagcagttggagagtacaaacgtgctg

SEQ ID NO: 34686 - DNA, 1433 bp, Triticum aestivum
  Clone ID: PAT_TA_34686
tccgggcgtggatcgagcccgcgacgcctgttctgttcgtgccacctcgtcctgccccatcccacgcgtccgatcaatcaatttgatcacaacaacagccaatccatcccatggaataataaagaaactggggcacctcactgcgtggccggtggcgaccgacggcgacccctgctgcccttaccgtaccccgctacgctccggcgagtccggccgaccgcccccgccacctttcgccgcacggcgtgaccgagtggacgggcccgacggcgggcatcggccggcgcgcgagggcgggagggatcggcgatgagcttcgcggatctggagtccggggcgctgcaggcgccccggagggggaggggcgccgacgccacgcgcgcgctcgtcttccagatcaccaccgcggtgtcctcctaccgccgcctcctcaactcgctcggcacgcccaaggacacgcccgccctccgtgatcagctgcagaagactagtcataaagtcctgcaattggcgaaggatgcgaaggagaagctgacgagtgctgctgaagcagacaagagcactggaactagtgcagacaagcgggtagctgacatgaagcttgccaaagattttgctgcgacgatggaggaattcaggaaacttcagaatcttgcaattcagagggagatggcatataagccggttgttccccagggtgctcagccaagctatactatgaatgatggaagatctgattttgataaaatgcctgaacagcgcgcattgcttgcagaaccaaacaggttagaggtgttgcaattggataatgaaattgttttcaatgaggctatcatcgaggaaagggaccaggcgattcaagacatccaacagcagattggtgaagtacatgaagcatttaaggatcttgctacgctcgtgcatgcgcaaggaggcgtaatagaggaagtcgacagcaacattgaaaactctgcagccgcgaccagtgaagcgaagaaagaaatcggcaaagcgtccaagactcagaagtcaaattcatccttgctttgcctgcttatggtgatctttggggttgttttgcttatcgtgataatagttttggcatcttgagacacggatgcttagaggcctattggtgccctctgaggagccatattacgtgcaagattaatcctcgctgtgcgccgaagactgtcgctaactgaagtgtacattttctttttctcccctcttttctccttgtggtttgtgagtgcgtattcttatgtggcgtgagtcctttttttcccacggcttgccctgagtgaacagtaattctctttttctcctacaaaggtttgtttgctgctttgcttgagtcagaaacttgacattctgtaagcatttctactgaataaagcgaacagagattattcattaaaccgaaaaaaaaa

SEQ ID NO: 34687 - DNA, 488 bp, Triticum aestivum
  Clone ID: PAT_TA_34687
cgtccgcccacgcgtccgcccacgcgtccgaacgaggcggccatcttcgtcgacgcgcccctccgcgggaagtactgcgtgtgcttcgatccgctggacggctcctccaacatcgactgcggcgtctccatcgggacgatctttgggatctacatgatcaaagacaaggacaacgcgactctggaggacgtgctgcaacccgggactgacatgatcgccgctggctaccgcatgtacaggagctcatgcacgcttgtgttgagcaccgggaacggtgttaatggcttcactcttgatccttcccttggggagttcatacttacccatcccaacataaagataccaaacaaagggaagatctattcggtcaatgaagggaacgccagaaactgggacgcgcccacagcaaagtacgtggagagatgcaagttgacccaagacggctcatcaccaaaatccttgagatacattggaagcttggttgccga

SEQ ID NO: 34688 - DNA, 1540 bp, Triticum aestivum
  unsure (1)..(1540): unsure at all n locations
  Clone ID: PAT_TA_34688
gcaccaggcacgcgagcactacgtccgcgctgagcgaacgaggcgaacgggagggagggtcggggccggccggggaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagtgggggagggagcagaagaagctcggacgtgctctccaacgaggtgttcgtcaatgccctcgtcagcagcggccgcacctgcgttcttgtgtcccgaggaggacgagaaggcgacgttcggtggaccctaagctcccgtgggaaagtactgtgtctgctttgaccccctggatggatcctccaacatcgactgcggcgtctccatctggaacgatctttgggatgctacattgatcaaaggaagccaatgacaaccgtcgactcgtgggaggaagtcactgcaagcgtgggcgaatggatatgattgctgccggatactgcactgtcatgaggaagttgcctgcagcgcttgtacgtgaaacactggacatggggagatcatcttgacgcattacccctctcttctcccgtgtaccggggagacctatatcgattaacgaagagcataacaataacttgggacacccctaacagcaaagtacgtggaagaagtgcaagtatcccacggatggttcatcacccaaatcattgagatacattggcagcatggttgccgatgtccaccgcaccttgctatacggcggcatattcctgtaccccgcggacaagaagagcccgagcggaaagctccgtgtgatgtatgaggtgttccccatgtcattcctgatggaggaggctggaggccagtctttcacaggcaaaggacggtcgcttgacctgatccccaccgacatccacgagagatccccgatattcctgggcagcagcgacgacgtggaggagatcaaggcgctgtacgcggaggaagccaagaaggaaggatctgcatgatggtcgaccggtcgtcgcgcgcaaggcgtgtgaatcgatgacgactcgtgggccttgctgacaatgtgattcgaatgtcaggcatttcttttctatatatacgtctgtgtcattcagtgtaatatagcgtggaggccttgaacagcttcactcgtgagcagccaaggcttctgcttctttccacaattcgttcactgatgatacgtaatatacatccatgtatacatattacacctccagaactaaaaatacaactctccccgcgccttgccttctatacacagaaagttcgccgcgtcgggggagcaatcctgtcgactatttcagagccgaaactcgcatgccaaaggtctcagcctgagtggctggcgcggttggcgaagccatgtagtacaagcttggagtcaatnactacacagttttt

SEQ ID NO: 34689 - DNA, 1707 bp, Triticum aestivum
  unsure (1)..(1707): unsure at all n locations
  Clone ID: PAT_TA_34689
gcgtttttacaaaagactggaaatcttagttcgcatgctgttgtattcactgagggctcttggaaagtcccgaccgtccactctagcagttcaaccgcacatgcagtctcctggtatagcacctacagctccgcgggtacagtctccagtcctaccgcctatcgagccgcgtgtgcaatctcctagcctagcgcctactccttcgcctgggcagtctcctggcctagcacgtactccgtctcgtgtgctgtctcctggcctagcacgcactgtttcccgtgtgcactctcctgctctaccacctagtcagccgactcgcgttacgcccgtggtccagcacctccaggccccggagcttgagctggatctagtgggggagccgactcgggatctaatggggactctgagtcgctctgctcacgatctagcctgcaaatgctacctgcagcctcacgtggctccgctccttcagcaacctcggatttaacgtcggccatgcaacaagtttcacaaggataccgcaatattatgcagatgcaatctcagctggattcattacttcgatcagcacatcatacttggaatgtcaggagagaggctatagcagtccaggctctggcagtgccacaacataattcatctagaagggtgcaggcaaatgtctcgaattggccttagcccacatcatgttccatttcaccttcttcaaactaccaagcacatcatgtgacaaatgcagacagtgtaatcacatcgatggttaatggtgttgggccactctcaagggctcctgatggttcctcaccattccatctacagccgacacaacaggatatgcgcaacatgccaaaccatcaacgtggtcgggttatgggccttgctgcaaatcccttcatgcatatgagaccgccgacaggaggcccaggacagggtagaggtgctaatgcctatggagctccctaccctcaacaatatcagcaatatgaccagcgacaattcgacaatctaataggccaactggtgaaccgagggggtgcagttagccaggccataccaggccatctctacgttccccagcagagccaggcaatgagaactcaagcagtgtcccgacagtcaactccaccattgcaaccgcgcgtgcagtctcctggtctagcacctactgctccgcgtgtgcagtctcctggcctagcacccactgttccgcgtgtgcagtctcctggcctagcacccactgttccgcgtgtgcagtctcctggcctagcacccactgttccgcgtgtgcagtctcctggtctaccaccctctccgactcccgctacgcccctcctcgaggactccgatgtccccgagatcgagatggatccgaactggcagcccacggggcagatgagggggagcctggtaggctctgcttacgatcaagcaatcgaacggtatctgcagcctggtggtggtcagcggacaaatcaggctcggccacctggcaggtaaacatatactcgtcaggtgctgtgggtggctctggatttagagaggctaacatggatctgcgtgtgtgggtggctctgaactctgaacgtctgatctgcggttagatattaacgtccttatgttatatgttagtttgcaaatgtagggagtactgattgtgctgcttagcgttagcgtacatctgttgttgtgcaangaacgaagtatcta

SEQ ID NO: 34690 - DNA, 636 bp, Triticum aestivum
  Clone ID: PAT_TA_34690
caagctctctgtttcgttctcgtcaggctcagggcaagaggaagcaactggttggccgccgctgctgctgccgctgatccatgaacgtcccggtgggcttcctcgccaagctctggagtttcgtgtcattcttgcccttcttcgtcctcctgctgctgctcggctccgccaaagctcttctgatcggcccagtcgtcgcggccatcgttttccttggcgattcagccgtcatcgccggtctttggcctgcgcatttcgtctggacctactgctgcgtgctagccacgaagcgaattgggccggttctgaagatccttgccgtggtattcctgccactgccgttgctcctattgccggtgcttggcattgtagggagccttctggctggtatcggttatggagttttcactcccctcatggcgacttttgaggctgttggcgagggcgtcgcagacaagctctctcattgctttttggatggtactgctagcacaataaggggagcttgtatggtggtgcgtgatgttaccgacttctgcttccactcatacttctccttcatggacgagctttccgagaaaatgggggatgacgaagcacctattgacatcaagttgtcttatctaccgcggagct

SEQ ID NO: 34691 - DNA, 1433 bp, Triticum aestivum
  Clone ID: PAT_TA_34691
cgttggtggataaagcagggaatctggcaatgaagagaataattgttgaaagaaaaaaacagagtggtgggggtgatgtaaacaacaagcaggactggtggcgacatccctggagtgaaggtgagatggacagcctatgtatcactatggatgactttgaggaagcggccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgccagctgggtttttgctgtttggacctccgggctgtgggaaaacactaatagcaaaagcagttgcacacgatgcaggggctaattttattcacattaagggtcctgaagtattgaacaagtatgttggggagagtgaatcagatataaggaagatattcacccgtgcacgaatcaactccccgtgcattctattttttgacgagatagatgctctgacaacaaaaagagggaaggagggagcatgggttgttgaacgtctcctaaaccagttacttattgaacttgatggtgctgatcagcgtgaaggtgtttatgttattggagctacaaatagaattgatgtgatagatgatgctcttctacggcctggtagattggggcagaagtattttgtacctttgcctagtgctaatgagcgacattcaatattaaaagccctaacacattatcagaaaaaacctgtatcctgcactgttgatttggatgcacttgcacgacgtgaggattgcaacactctcactcgtccagaccaagcatcgctgctgaacgaagcagcccaggtagcgctggaagaggaagcggccatcccagcattggaagcgttatgcgaattcctagcgaaaggagtctcgtcaatgagtactgacttgactaagaagactaaactgcggcactttgagcatgctctgtctaaagtaaagccctcggtatctgaacagcaaaggaaacacttcgacgcgctgtctaagaaatattcggccaactgatccgccatcgtccttgtgcttacgaggaccatactgcagtttttgcttttttgttttcgctcatgtgatagcttggtgtccaggccatgtcggcgattccaaactcggcctcggggtttcgaattcttgttctctctttgcctgttgtccggcctccgctggtgcttcgtgcgtcggccgcttcgtgttgttctgaagcgggcctgcccggccatacttggccggttctgcgttgcgggcggtcctgcggctcccggggccaaggcccgccgcgtttccgatgctagaccatatgcagaaaaaaaaaaaaaaaaaaaaaaaaaaaaaaactcg

SEQ ID NO: 34692 - DNA, 1084 bp, Triticum aestivum
  unsure (1)..(1084): unsure at all n locations
  Clone ID: PAT_TA_34692
gcggggaattcggcacgaggctacctcgggctgccgcaggnaggacaggctggcaaccacccggnaacttcgagtcgcagttcgacgcgtacaagcgggccaaccagatgtttgctgatgtcgtctaccagcactaccaggaaggggatgtgatctggtgccatgactaccacctcatgttcctgcccaggtgcctcaaggagcatgacatcaacatgaaggtcgggtggttcctgcacacgccgttcccttcctcggagatttaccgcaccctgccatcacgctcggagctgcttcgctccgtgctctgcgctgatttagtcggatttcatacatacgactatgcaaggcatttcgtgagcgcatgtaccaggatactcggactcgagggtacccctgaaggtgtggaggaccagggaaagttaacacgggttgcagcgtttcctattgggatagactctgatcgtttcaaaagggcgttggacattgatgcagcaaaaagacatgtcaatgaattgaaacagcgatttgcgggacggaaggtaatgcttggtgttgatcgacttgacatgatcaaaggaattccccaaaagattttggcctttgaaaagtttcttgaggaaaaccctgaatggattgataaagtggttctgcttcaaattgctgtgccaactagaactgacgtccctgagtatcagaagcttacaagccaagtgcatgaaattgttgggcgcataaatggacgatttggaacattgtctgctgttcctattcatcatctggatcgatctcttgatttccatgccttgtgtgctctttatgcagtcactgatgtggctcttggaacatcactgagggatggcatgaatcttgtaagctacgaatatgttgcatgccagggatcaaaaaaaggagttttgatattgagtgagtttgccggtgcagcacaatcgcttggtgctggtgccattcttgtaaatccctggaatattacagaagttgcagactcaataaaacatgctttaacaatgacatctgatgagagagagaagcggcacaggcataactacgcgcatgtaacaac

SEQ ID NO: 34693 - DNA, 698 bp, Triticum aestivum
  Clone ID: PAT_TA_34693
agaaaaaatatccttgaccaatgagtctaaaagcacacggaaggcccttgctggcatctatgacgaagttttggttgttgacaatatcaactcagctgagaatgttgttcgattgcttactacaaagtacaaaagctttgttcatgcatgcgacacagaggtagcaaatattgatgtcaaaaaagagacaccggttgatcatggagaagtaatatgctttagcatctattcaggaaatttggatgcacatgccgattttggaaatggcaaaacatgcatttgggtggatgtgctagacggtgggagggatgtcttgatggcgtttgctccattcttcgaggacatgtctatcaagaaggtttgtcataactatagttttgatagtcatgtcattgagaattatggaatcaaggtggctgggtttcatgctgatacaatgcatcttgcacgcctttgggattctaacaggagaatcgatggtggatattcactcgaaggacttacaaatgacctgagagtcatgagtgatgttggaaatgatttaattaaaactggaaaggtatcaatgaaaacaatctttggtacaaaaaagattagaaaagacggaggtgaagggaaaattgtatatattgaaccagtaaaaaagctgcaaagggaagacagaaagatgtggatttgctattcatcattggattcag

SEQ ID NO: 34694 - DNA, 1247 bp, Triticum aestivum
  Clone ID: PAT_TA_34694
gtcaagaagaaggggctcaggaaggccggcgcgtccggcgtccgcgcaggggttggtgggtactcttatttgtatgaaccattatggtgggcaggaatgatacaatgatcgttggagaagttgctaactttgcagcatatgcgtttgctcctgctatactcgtcactccacttggtgcacttagcataatcattagcgccgttcttgcagacattatgttaaaggagaagctacatatctttggtatgcttggatgtgttctttgtgtcgtgggttcaacaactattgtgcttcatgccccccaggagcgtgaaattgagtctgtcgcagaagtgtgggatcttgctacagaaccagcatttctattttatgcggcaatcgtgcttgctgcaacttttgtgctcatattccgttatatcccacagtatggtcagacacatatcatggtttatattggtgtttgttcacttgtaggatctctatcggtcatgagcgtgaaagctcttggtatagccttgaaactgactttttctgggataaaccagctaatctatccgcagacatggttgttcgcaattattgttgttgcatgtatattaacacagatgaactatctgaacaaggctcttgacacattcaatacggcagttgtttcaccaatatactatactatgtttacatcactaacaatactggccagtgtcataatgttcaaggactgggatcgtcaaaatccaactcaaattgtgacagagatgtgtggttttgtcacaatcctttctggaacatttcttcttcataagactaaagatatggttgatggtctcccaccgactctgcctatcaggattccgaaacatggtgatgaaaacggctatgcgtttgaaggaattcctcttagatccgctgctgaagggctccctctgaggtccccaagggcagcagaataattttgaccaacttgagatgctcagtgatccctgtggccatggttcgcattttttcattctatccagtctgtagattgtactttagggctctataaacaggaaagggctcgttcccccttgtagttttcgaggaaccggtagagtattggggaaatatgttttatacatcaaaagtttttcatgtattttttgtttttgaggaaccggtatggtaaagtattggggatgcattttaaaccggctatcatctgtaactgttgtattttttgaaaatagggaaagaatttgaagaactcc

SEQ ID NO: 34695 - DNA, 443 bp, Triticum aestivum
  Clone ID: PAT_TA_34695
cacaatgataatcttccagcatgcatgtgtgctgctagctcttgatggatggtcactcgatttcagctgccattgtgcatcaccatctcctggatgccttgatatctgtgttgctttgttgatctttgtgtagctcttgacataatcggctactgttaacaacttgaaccagtaataatctgcttgatgatagaaaccttcttgttccttcagaagaacagagctaagtgcagggtccatttttctgaaggaaacactggattcagttaaaagaaaaaggaaacactggatttctccaccaaatggcaagcagaaaaagatgtctagtttggtaattttcaacgccttacaagttactgtacttgattagccagaaggaatataatgttcttttacaggtccagtgtggctccttgattcaggggaagcagagtgcagagtct

SEQ ID NO: 34696 - DNA, 435 bp, Triticum aestivum
  Clone ID: PAT_TA_34696
gggtccacgaatctctggatatggtgattcatgaaacccatggtatgatgtgtaaacacagtcccccctggcgaatggaagtagcataactcggtaatcatcgccggtgatatgatcgatgattggttggatgctcggataattgagcccgaggaacatggagtggttgccgaggctgtaaacccgcctccaattgaatacgcctggccaaacaaagctgggatctttctcgaacacgaagcagccagagccgtcaatgtcacgaacgcccgatgcattgtaccgcatgtggtttgatgaaatggtttggtcaatttggtacgtgcaaatgagcatcaaatgaccgccgtcagctgaacgaacgataaaccaccacccatcggctggtatgattccaggtcctggaatcatgaagcccagcgcatttgcgtctgc

SEQ ID NO: 34697 - DNA, 434 bp, Triticum aestivum
  Clone ID: PAT_TA_34697
gacgttcttgcaagttttcggaacaactgtcttgttgcaggaatacatagaagaagctagagatgttgggtcctattgtagtggagtttttgcaataggagtcttgttacagaaaaataaagaagaagttttacatcaagggtcttgttgcagaaaaatagagagaaaaagtttcgcaataggtgtcttgatgcagtaaattaaagaagagaatattttgcaatagaggtcttgttgcaaaaaattggagaagaagagatttttgtcacatggctcttgttgcagaaagttacacgagaagaggtttcacaacaggaacattgctgcaagaaattacagaacaagaatggacggctcgcctcttacaatcggacggctcacgaggcagcgggtctttttaaaagatccttcggccgacgcatagcactgcccta

SEQ ID NO: 34698 - DNA, 1742 bp, Triticum aestivum
  Clone ID: PAT_TA_34698
gcacgaggcaaggcgctcccaggctttccacttagatctggaccaaaaccctatagtccagatcctttttttttggcccgccttgcccttccggccatccccgtcttctcccgccgcccgccgccgccgccgcacccctttccttgcccccctcgccgcccccttccccccctcgccccgcccggcccccccgctcccgtcgcaccgccccctcccctcggcattccacgcccggcctcgcccctgctttgccggagccgccgttgccttcgccgctgtgctcatatcggcggtgcagcgcgccgccggatgtgggcagcattgattgggactgtggtaggagggtgttaacaccaggttgcctgagaaattcaccgactcgaaccctaacgcgcggcggcgggtcgaggccctgctcgtcccccggcccactcctgggcggattcccacctcgtgaaattcttttgtctcccggcccttcgcccctcccccccactctcccgtccccaaaattttctagggctttaggtccttcctccccgccgggagggcttgcctcggggttccttcgttcgatctctgctctgcgggttcctcggctttcgtcccgtgcggatagtgtcgcatcgaggacgagcggcggcgcgatgaatgtgcccatagtcgatccgttgcaaggggattttcctgagactattgaggagttcttgcagcatgggaatatgaaatgcattgcgtttaaccgcaggggaactctccttgcagctggatgtgcaaatggtagctgtgttatctgggactttgaaacaaggggacttgcaagagaatttcgtgataaagattgtactgcacctataaccagtgtcagctggtctaagtatggtcaccgtttgcttgcctctgctactgataagtcgctgacactttggaatgtggtaactggggaaaagattgcccgcataactcttcagcagactccattgcatgcccgtcttcatcctggttcatccatcccatctgtatgcttagcatgtcctctctcttctgcacctattcttgttgatttgaatactggaagtaccatagtccttccagtttctgcatctgacagtggtaatgtccctttacctaattcacgtaaattttcggatggttctcctccttttacaccaactgctgcaacgtttgataagaatggagagctgatatatgtgggcaattccaagggagagatattaattgtagattcaaaaggcatccaagtacttgggttaattcccatcccaggtggaacagttgttaaggacattgttttcagcagagatggccaatatctgctaacgaactctaatgatcgtgtcattagagtctatgagaatattctgcccattaatggttctgggaaggagattgaaaaaataatcaccaacaacaataatgactatggaagcaagtatgagaagctaaaagcaaatggtgcacgctgcttagttctttcttgcgaagtctcagatgccattgcaaaggtacagtggaaggcaccatgcttcagtggtgatgctgagtggattgttggtgcttctgcaagcaaaggagagcacagattgcacatatgggaccgagcagggcgtcttataaagatccttgaaggtccaaaggaagctctcattgatctcgcttggcatccatttgatcctacaattgcttcagtgtctgtggcaggcttaacatacatttgggca

SEQ ID NO: 34699 - DNA, 881 bp, Triticum aestivum
  Clone ID: PAT_TA_34699
gcacgagcccgagttaaccattagccaaaagtgatcttgcttttccatttcccaagagatctcagttcgtgtctgtcctccagtccagtgtttgtttgagcagcagccatggcctccaaccaggacaaggcaagctaccgcgccggcgaggccaaggcccacaccgaggagaaggccggacaggtgaccggcgcgaccaaggacaaggcgtgcgaggccaaggaccgggcgtgtgacgcgacggggaaggggcagggcgccgtggaggccacgaagcagaaggccggcgaggcagggcagaagacgtccgagacggcccaggccgccaaggaccgggccgccgagggcaaggaccagaccggcagctacctcggccgcacggccgaggcggccaagcagaaggcctccgaggcgacggggtacacgcaggacagggcctccgacgcggcgcagtacaccaaggactccgccgtcgccggcaaggacaagaccggcagcgtcctcagccaggccggcgagcaagtgaagaacgcggtggtcggcgcgaaagacgcggtggcgagcacgctggggatggggggagacagcacctccagcgaaaccaaggacgcgagcaccaccgagaccatcacaaagagccgccactagatatatacctgtcgcggttgcataatgctttctttccttttagttcctctggagctccacattcctgtggtgtgtccgagtccgtatgtcgacgtcgggcgagaatgtctgactgacgagagatgtatcttggtgttcagagttctcgttttaagttccacaaatggtgtaataataacaataataataaagtactccgtactgtaagtaaaaaagtccttaaaaaaaaaaaa

SEQ ID NO: 34700 - DNA, 823 bp, Triticum aestivum
  Clone ID: PAT_TA_34700
atttggcactccttctttggtatgccaggaactcacaataacatcaacgtgctgcagtgctctcctgtctttgccaagcttgttgaaggttattctcctccggtgaacttcgagatcaatcggcggcactacaacaaggggtactatctagctgatggcatctatccgagatggtcgacatttgtgaagacgatctcaaaccctgtggcaggaggcaagaacgcctggtttgcgaagttttaggaggcttgcaggaaggatgtcgagcgggcatttggtgtgctccaatctcgatttgctgttgttcggtaccccgctcagacctggtccaaagatcaaatgtgggagattatgacttgctgtgtcgtcttgcacaacatgatcatcgagagcgagcaaaaagacccagtgtttgacactgaaccatactacaggcagggtcctctagccgaagttgatcaccagctaccggcaacctggactgcctatctcagtatgcgtcaggagatccgagacccacaggtgcatcatcaactgcagcaggatctggtggagcacctatggaggctcaagggggacgccgtgcgcgacatgtgatgaaatatgagtttttatttgttgaactatataatttgtttcgaactatttgttgttgcactatttgttgaactatttgatttctattgattttctgtgatgaactgtgataaaaaaattatttatgttgagaattcacgccgaaccacgccgaatatggggcgattctcgccgatatcgggcctttttcgccgaaagtgggccgaaaactgggccaacatcggcg

SEQ ID NO: 34701 - DNA, 889 bp, Triticum aestivum
  Clone ID: PAT_TA_34701
tgccgccttgtcggcgagatgcataccgccgccgacggaaatacccgcccgatctgcgcaccgccgcccgtacggaacctcaggaccctgctccatctccggcgagttcccgcagccggaggtctggctcctccagccggcgtcggcgccggcgccgccccgtcggatcctagtatccggcgctgcccgcgggcgtcgccttagaccgctatccgttctcctccgcggccgtattctgcctccgcgccgttctactctcagagctaccagaccctgtaaggtcagaagctcttactacttgttgccgccaccctagtcctacatcatagtactaccgcttatggagctgcgtcctctgggagcatcagcatggcacggcctggctgcccagataagtgtggcaacatcagcatcccgtacccgtttggcaccggaaaaggctgcttccaagaaccctttaatgtcacgtgcaatgggaccggggcatatctgggctcaaacggacttagggtactgaacatctctcttgccttgggtgaggttcgtgttcagaatccacatataacatcacgatgcaacttcagcaatggcagcaacagcaccagtggtttggacgtcttaactcttgatccatttcatacggtttccaacatgaagaacaagttgacatcaatcggctgtggtggacttgcatgcttgtgggacaagccaagggcaagaaccagcttgagtacctcaccgctgactcatgcatttcatcctgcatggacgtaagcagcatcggtaatggcacagagtgctctggcatgggttgctgccaggcccctgtttcaggaaacatcaacgccttcctcgcccaatccataccagtatcagctatatacaactc

SEQ ID NO: 34702 - DNA, 1197 bp, Triticum aestivum
  Clone ID: PAT_TA_34702
ccacgcgtccggtggatcctgagcgccaccgtaaggtggtaaatatcgatgatccgagcgcaccattcttcgccgcccaaggggggcatggtgtcccggtggtgacatattcatttgagaacaagaaggctgatgtgcacactctcaagtaccagctttccctgtttgagacggaggttctggtacagacaccgcacggaatccttgaaatttcctctggactgcttggaagagacaacatctacaacatccttgcaactgtggcagttggtgttgcagtgggtgcgccattggaggacatagtgaaaggtattgaagaggtcgatgcaatcccaggccggtgtgagctaattgacgaggagcaagcctttggggtgatcattgaccatgcgaggacaccggaagctctgtcaaggcttcttgacagtgtaaaggaactaggcccacggcgtattgtcactgttgttggatgttgcggtgagaaagaaagagggaagaggccgatgatgacgaagattgccgctgagaaaagtgatgttgttatgttgacatccgacaatccagcaagtgaagatccattggatatcctggacgatatgttgtctggtgtaggatggaccatggaagaatacttgaagcatggtgcaaatgattattacccgcccctaccaaatggtcacagactcttcttacatgatattagaagagttgcggtgcgagctgctgttgcaatgggcgagcaaggcgatgttgttgttgtcactggaaaagggatgatacttatcagatggaaggcgataagaaggagttctttgatgacagggaagagtgccgagaagcactgcaatacgttgatcaattgcatcggtctggaatagatacctctgagtttccatggcggttaccagaaagccactgattgtgatgtatccaagaggccgagcttctgaaagatagactagcccatctgatccagcttttgctcaaggttctgacctcggctgctgactgctaacaaacaactagcttatgatcatcattgatgattgctggagagtagataagtagatggccttgaaaattgtaagttattttacggtacattaaaggcacaccggaatggaaaaaagcaatttccccaatgtcagttttcatgaaaaatagacaaataaatgtccgggttcttcaaaaaaaaaa

SEQ ID NO: 34703 - DNA, 753 bp, Triticum aestivum
  Clone ID: PAT_TA_34703
ccacgcggcccgcccccccccccccccccccccgccccgtcctgcgattccggcggcgatccaaggcaccacccccagcgcccccggcgtagcgttcggcgatccactccaccccctccctcccccggcgggcatggctggcggcgtcggcggcggcgggccccgcgcctcctccgacagcaaggcggtgcgctcccccaacccggcgatcgactccaccatcaagtccatcaaggaggtcgtcggcggccactccgaggacgacatctacgacgccctccgcgagtccaacatggaccccaacgagacggcgcagaggctcctcaaccaagatccatttcatgaagtgaaacggaaaagggacaagaaaagagagagtgctggtcagaagaacccttctgagaccacggcacaaggtgagcatggcacacaacagacaaagccacacactcaaagggttgagatcgatcaaagaagagcgtacaatcatggtcagacatatggaccaagtcgagaatttcgggtagtgagggataacagacacggtgcggtggaaaatggagcagagcaacacaaagtttcagcatatatgcaatcgtctgataggagtggagttgtagttcaatctgatcgaaatcgcccaccacctacaacctcagaaggtcagatcacgcatcaaagtgcaaagagtagctacaactctgacatgcatcagatgaagagggatgctcagggtactgctcagaggcatgc

SEQ ID NO: 34704 - DNA, 430 bp, Triticum aestivum
  Clone ID: PAT_TA_34704
cacaggagcgcatacgatatgtggtatttgctcgtcaggaccactgcacaaatattcgcttcgccggatgagatgggtgagctgatgactaaaatggaagattttacgcaccgagggtgggtctgcgatcactccatagtgttctgagggggattcaattcagcactagacagccaaaaggaagacacaataagctggccaagctcatatgcatgcacctctgccaactgaaccatctaatacctcaccggagtatgtaatgctatctaggctgatgaatgaattatctggtgcattatggttagcaacatggcatgctgttctgttttccctcattgatccggctgtccattaacttgcttttaactgaacttctattggattgtcttagcttaattaacctcttttatcttaatgaataatatctttt

SEQ ID NO: 34705 - DNA, 985 bp, Triticum aestivum
  unsure (1)..(985): unsure at all n locations
  Clone ID: PAT_TA_34705
gcacgaggatccttttcacctccagcgcctcgccacatgagcgctcccccctcctcctccccctcccccgctccgatcccccagcccgccgcaaccctagcccccgccagcatgcgcggcgcggcggcggacgacgactcctccggctcgtcgccgtcgcggatgtcggaggacgacgacgacggcgacggcggggcgggacggggcgacaggtgggcgccggatctgaggggcggcaacggcaacggcgggaggtgggcgccgccggaccaggtgctggagaacgtgctggagagcgtgctcgagttcctcacggcggcgcgcgaccgcaacgcggcctcgctcgtctgccgctcctggtaccgcgccgaggcgcagacccgacgcgagatcttcatcggcaactgctacgccgtctcgccgcgccgcgccgtcgagcgcttcgggggcgtgcgcgccgtcgtgctcaaggggaagccccgcttcgcggacttcagcctcgtgccgcacggctggggcgccaacgtctccccctgggtcgccgcgctcggccccgcctacccgcgcctcgagcgcatctgcctcaagcggatgaccgtctccgacgacgagctcgcgctcatccccaagtccttcccgctcttcaaggagctctcgctcgtctgctgcgacggcttcaccacccgcggcctcgccgtcatcgccgagggctgccggcatcttcgagtcctggatctgactgaagattatttccatgaggaggagagcgaggtggtggattggatctccaagtttccagagtgcagcacgtcgctggaatctcttgtctttgattgtgttagtgtcccattcaactttgaggccctggaggcactcgttgcacgctcaccagctctccgtcgtntgcgcgtgaatgaccatgtctcgatagagcagctgcgtcgtctcatgtgaagggcaccccatctgactcaccttgtgactg

SEQ ID NO: 34706 - DNA, 551 bp, Triticum aestivum
  Clone ID: PAT_TA_34706
ggcccccgccgccgacgccggcgccgggtcttcgtcctcgtcgtcccgcaagccgggcaagcccttcgaacccaagaagtggaacgccgtcgccctctgggcgtgggacatcgtggtggacaactgcgccatccgccgtaaccacatcatggatctatgcatcgagtgccaggccaaccaggccagcgccaccagcgaggagtgcaccgtcgcatggggtgtctgtaatcatgctttccacttccactgcatcagcaggtggctcaagactcgccaagtgtgcccactagacaacagcgaatgggagttccagaaatacggccactagaccaccctcctccgccgctgggcggcggcatgttatttgcctactaccaccccaccagaagcccaggcctatctcttgtcgaacatcgctatcgccagctactttagaacatttgcatctacatctcttgtttgatgactttgtataaaggattcatgtacttgcgcaactaatgctatcgtataggtaacggattcccccattaaatttacccgtgctttgt

SEQ ID NO: 34707 - DNA, 608 bp, Triticum aestivum
  unsure (1)..(608): unsure at all n locations
  Clone ID: PAT_TA_34707
cggccgcgtgggcggncgcgtggggagagagagcagagagagggagaggatgtcggccatggagacggacgctcccgacgcgccgccgccggccgccccggcccccgccgccgacgcaggggcctcctcctcgtcgtcccgcaagccgggcaagcgcttcgagatcaagaagtggaacgccgtggcgctctgggcgtgggacatcgtggtggacaactgcgccatctgccgcaaccacatcatggatctatgcatcgagtgccaggccaaccaggccagcgccaccagcgaggagtgcaccgtcgcatggggtgtctgtaatcatgctttccacttccactgcatcagcaggtggctcaagactcgccaagtgtgcccactagacaacagcgaatgggagttccagaaatacggccactagaccaccctccgccactgggcggcggcatgtctcttgtcgaagatgattgccgccggctctcgaagatcgctatctcggcctactttagaacatttgcatctacatctcttgtttgatgactttgtataaaggattcatgtacttgcacatctaatgctatcgtatcgtattaagggattcccccatt

SEQ ID NO: 34708 - DNA, 638 bp, Triticum aestivum
  Clone ID: PAT_TA_34708
gtctcccgtctcgctgtgcctcctcctcccctccgctctcctagggttcgctcgctcgtcgccaggttcgctcgcgatggaccagggcgacgtcgccgtggccgtgccccccgccgccccctcctcctcctgcgccggcgccggctgcaagaagggcaagcgcttcgagatcaaaaagtggaacgccgtcgcgctctgggcctgggatattgtggtcgacaactgcgccatctgccgcaatcacatcatggacctctgcatcgagtgccaggcgaaccaggccagcgccaccagcgaggagtgcaccgtggcttggggagtttgcaaccatgcattccacttccactgcatcagccgttggctcaagacccgtcaagtgtgccctctagacaacagcgagtgggagttccagaagtatggtcactaagacagttatggccaggggcgaagttacttcatggttgtctaactttagtgctattagtgataactcctggttaaggatagtggatgggttggttgatgtttctggagcttggatttttattaaaccacatgtatccttgttgagtactgttcatcatgtctatggatctctctgttttgcaggaatttaagtgtgaatttggtgggtactc

SEQ ID NO: 34709 - DNA, 958 bp, Triticum aestivum
  Clone ID: PAT_TA_34709
gccggccgggtcgggaaaagtctgttccggtctcccgtctcgcctagccctcgcccggaagaccgccagccctccgctcgccgagggggcgagggagagggagatgtcggccatggagacggccgcccccgacgcgccgccgccggccgccccggcccccgccgccgccgccggcgccgggtcgccgtccccgtcgtcccgcaagacgggcaagcgcttcgagatcaagaggtggaacgcccgtcgcgctcatgggcgtgggacatcgtggctggaacaactgcgccatctgccgggaaccacatcatggatctactgcactcgaggcgaggcggccaaaccaggccagcgccacccaagcgagggaagtgcacccgtcgcatggggttgtctgtaaccactgcctttccaccttccactgcattcagccggatgggctcaaagacaccgccaaggtgtgcccactcagacaacatgcgagtgggagttccagaaatacggccactagcccacccccatccgccgttggctagcgctagcatggcgtattcctactcacatccatttaaacatctgtgtctgatttttttgtttaaatggttcttataaaggatttttgtacttctgcctctacatctctaggtttcccgactttctacataagaatctctctgttgcacaaaaaatgctatcggaacctaagttatggccaggggcgaagttgcttcatggttgtcgtactttagtgctattagtgataactcctggttaagaatagtggatgggtggttgatgtttctggagcttggatttttgttaaaccacatgcatccttgtggagtactgttcagcaaatcgtccctgagagctaccgatggatctctctgtttttctggaattgaagtgtgaatttggtgggtcccccaaaaaaaaataattttttttatttaattaaaaa

SEQ ID NO: 34710 - DNA, 941 bp, Triticum aestivum
  Clone ID: PAT_TA_34710
cgttgctatgtgcttgatgtcttgacaatgtgggttatgtgctgctgtgttctttctgtccagtgtgaaaagtggaatgccataaatagaatagaagaagaatggaagttgatccccaggaaataaaagaataggaaaacaagcaagttggcagttattgtatttccaaggctgtagctggactgattttctgaatgttaaattactgtatcagacttggttaccatctatctattatattatatacctatatgacagaagacatgatgacgtagccagaagactagagtatgggtggaactaatagcatctcaattcttaagagatgcaatctctgtccttcctgagtgtgtaggctaccggcagagccgatgtgccgctaaggccagaggctgtagcggaagcggtcaccggtgacggtggggctcagatccccatcatcgactaagctgtggtgtatgcctcgacattgcctgctaggaccggggcttgttccagtgaattgacacgatgtggtggaggtaatgaaggctagcatccaagaattctttgagctacccgcccgcagcacccaagaatgaaccaaaggaggctgactgatgtatattccataaataaaagccagtgaaactggtatcgtatcacagttaattaaccacagcgacatggtggaggtaatgaaggctagcatccaagaattctttgggctacccatagcacccaagaatgacccaaaggaggcctactgccatgccatgtatatggagtattccataaataaaagcaaggaaaactggcatggtatcacacacatgttggattaggctagttggtgagttccataatatgatagcgctaactatgtcaaaatcagcagccttgacagcctacttatggaaaaatctgtgctcttatcccaaaaaaaaaaaaaaaaaaaaaaa

SEQ ID NO: 34711 - DNA, 1515 bp, Triticum aestivum
  Clone ID: PAT_TA_34711
accttgttgtttgaggaagaagagctttacttgttcacttcttcattgcttggtatgttagcagaatacgatgttcgcccacctcaaatatatccttcaaccatgaaacggttacaaagcgcttgtattaatcagatctacggacgaaaattcccaatggtgggactactcagtttgtgttagtaagttgtgggggttaaaatctaccatttaatacacagggtccgttgagaaatgacacttaggacaatgacgttagggtacgtgatctgatcgttttggtcatgcgaactttccagaataatgcattagatgcaaagaggaaatgcaaggcatagacgtgtcgaaccagtatttcctgtctagaagagttcttctcattggttgaaaaagtgtgcaacattttttcaccagaagatgatgactcacagttctataggaatgatactcaagagtactcagctgatggtgatccattacctggtattgagggatttcaaattgtcggcgatcctagtccaggatctactttaagagcatgtggtttccctacaaatggtactacactttgtaatttccagtgggttcgctgtcatgaagatggcaccaggtattctattgaaggtgctacgatgtatgactatgtggttactgcagatgatgttggcactcttcttgctgtagactgcactcctatggatgatagtggccgccagggtgatttggtgagggagtttgctaacaatgagaacaagataacttgtgatcaagaaatgcagaatgacatcaatatatgcatttcaagggggagagccgactttgatgtttatgtcctgcagggtattctcctgaagaatgggaacatgccacattggtccttagacgaactggatatcaaataaacatcagccacaaggatgaagttgtaattgacgagaaatattcaccaaatctacagacgaaaattcccaatggacgaactactcaatttgttttagtaagttctggtggtgtaaatctaccatttaatacacagggaataacggagcccaataatgaggataacgacgttaggctacgcgatctaatcgtattggtcatgcgaactttccagaataaggcattagatgctaaaaggaaaggcaaggcttagacgtgtcgaaccagagattcccgtctagaagagttgttctcattggtttgtgcagtgttccaacatttttttgccagaaggtggaaggcgttcttgattataccatgcattgtaaagatttgtgtagaggcgttaagcaacagaaaaaggctgggtggtcctcctaggttattttgtgtataatactgtaattttctgtagcgtcttctttttttgttcccctccgattttctcttctttacattgttttttcttatctctttactgccccctctaggttattaattagacctgggactgcacttgctggtaaaccttgagcaagtcgattaatgtaatcaatttctgagttattcgatagc

SEQ ID NO: 34712 - DNA, 794 bp, Triticum aestivum
  unsure (1)..(794): unsure at all n locations
  Clone ID: PAT_TA_34712
gcgccccgcgcgcccgcgcgccaggacgcgggggccgcaaggagagaagggactaggacacgagaaccagaagagagagagagagagagagagagaagaacaagcgagagagaggtagggagattgctggagctggatcggggcgccgggccggccgtgcagatcggaggaggtcatgaacaactaatcgacactcatttattatggatttgcaccagctattcaagtacagattgactggtgctaacgtcttctgcgaaattcccacagagaacaatttagcgaactcttcctggcaaactagtccactgaagttagagttcagcaactctccatacacccctctttctacccagcttgagtgtgacaatttgtctgctcttagcaacactccagataaccagagctctactgaaaccatttcagcccaaccaatctccccgcttgaagcagacagctcatacataaaggcaggtagcatccgtgagaacatccaagtgagacctgatccattgtatgcaacatcaagacataatatgcaacagactttgcgtgacattgagaacgttctgatggcacctgatgcggatgatgcaacaacgagcacaaagcatgagtttgaggacaccaagcctgctcagctcatgcggcagcggtcgaggacatggagccatgagtcacgacagccgttgcctggagttgntcgtccacactgtgcatctggtggataccccacggcaagctatgagttccgcccagagtaacgacaaaaggagttaagggacgatcggcag

SEQ ID NO: 34713 - DNA, 1370 bp, Triticum aestivum
  Clone ID: PAT_TA_34713
ccatagcctcaaatcttctcttgatgagagtaggctagaacggcgtgttaaggcagccattgaagctgaagcaatctcgcgccggagtcggcccgggggtgaagctcagattgctgaattaagggggaagatggagagtgccagaagggatattggtagtttatctgaattattgaaatcaaagcatgaagaaggtgaagcgtacctgtcagagattgagagtattgggcaagcatatgaagatatacaaacacacaatcaacaattgctacagcaaattatcgagagagatgaccacaatacgcagatctttatggaaggcgttaaggtgaaacaggcacaggatactttgcatttagagttatgcaatctgaacaggaatttacggcaggcaaagggtttgatggatctgtacaaagataaaatcgcccagttagacgacaagttaaaagtttggtcagagcagacagcgagactttcggaggatggacggcgacattctgtttcttcaggcaatgctcaaagaaagctggcggatgtattgggagaggctcaacaattgagacagtccatggatcaagtacaatccaatgttgggaggagtcgactagaagttgctgggcttcttgtagaactagagaaggataggtttagtaagaggagaactgaggacgatttggaatcgttatcaaggaaagctagttctcttagagcaaagacagagggatcgtcggtgttggaaaaggttcatcaggaggtgaatgagtacaggggaatattgaaatgtggtgtctgtcgcgaccgacagaaagaggtcgtgattaccaagtgctaccatcttttctgcaacgactgtatacagaagttgctcagaaaccgccagcgaaggtgcccttcctgtgcattaagctttggggctaatgatgtgaagccgatttatatatgatgcagcggtggcagctgtcgtgggtcatctaggacaagtgactgaacgctccttgtttggggttcttggtggcatgatccttcagtcggaaattgtagcttaaatttctgcaaggcggacccatagcatacgttaggctgccggcacaatgcccgtggcttatgctatgcaagtgtggcttcccgctcctttgtaaagtgtggaattttcttggttgaaatagctgctagtcttagcttgcatatacaatgtgttattttgcttgacatatccaaggaagaggagtttagtgactccgaaaacataccataggttgtattgatatatatggatcgattgtagttccttttgttgtaggtgatgttgagcatgtaggttttggccgttcgtttcagcttgtacctcccccgggccccccccgcga

SEQ ID NO: 34714 - DNA, 828 bp, Triticum aestivum
  Clone ID: PAT_TA_34714
ccgtccccgcaaacgtcgtcgagtccagtaggcgtttcccggagcagtcgcgcttctcatgcgacgatcggcggctcctgcggccggctgaaacccaagaagccaagaagccttcttccacaagggccaaagagcttcctaggctgtccttggacagcaggaaagagtctctgagcccaagttcacgtctgaagagctacagttacaggagaaccgatgactctctcctggacgccctgaagcctcaagactccccgggccacaggcgttccaacactgtcatcgccaagctcatggggctggaagaggcaccagatgctatggggatgctggtcgctgatagctacgagcctgcaagatcaccaagaacagcagcacaagccacacggagcgagcgtccatcgcgttcgcccaggagagattgccaggatgcgtgtggttcgctgctgaaaaacgagccttcagcactgaaaacaagacctcctccaagaattctcaccgaacctgctccctggaggcagcaggagagaggcgtcagcgtcaccaacagcaaggcttcacaatgccgagacgctgaggcgaggccaagaaccgcatctctctatgccgatatagagagaaggcttggtgggctcgagttctcagagtgcaacaaagacttcagagctctcagaattctgggtgcattgcatgcaaaggatgctaagcaccagaacaacgatggtgatgccgcatcggtggcttttcagagccaagaagaggattcagccaccaccagttccagaagcttccagtctcccatcgtagtcatgaagccagcaagaacca

SEQ ID NO: 34715 - DNA, 677 bp, Triticum aestivum
  Clone ID: PAT_TA_34715
ttggaacaaagagaaagaacgggtaaccaagaagcttaaaagggtggtgacaaaaattgttgccaagaagcttcaagcagcagcgaaaatggagctactgactaaaagaacaaagaaggcgaaacctgagaagctggtgctgcaaaagtcagatgctcagccgagacgggtgttggcatccacaagaccgaagcttaaagagaggctgaccaagtggcacggtcgcaaaaaggagctcgagatcgtgataagcgcacggacaagggggggtggagggctgcgtaagcctgcggtcgcgaggcgaagagcggtggagaggcgagccgaggtggacctggtgacggagcctggggctccccctggccggctgaaggagcttcactcgccttgcaaggatgggctcccctgcggtgacacctgaagaacctgcactgttgagctcaggcagcagggtagcatttatgcattcatggagttcttacattgatgttgatgatgtcttgctttagttggcctctgtggatgatgaccagtcaagtgatggtgtctgtaacaggctgtgagctcttgtgttgtgtaggctggttacattatttttttggcccctctatgaacttgtgtgttttctttgccatattaaaaaaaagcaaacaaaaatcgccatgcattttcatgca

SEQ ID NO: 34716 - DNA, 441 bp, Triticum aestivum
  Clone ID: PAT_TA_34716
ccatccatcacaaaaccacagtaactcatgccattttaagtgatataaaaactattcgctaattttcagtaaaccccttgttcttttgcttaataaacccacagttctatttttaagtgagtttaaagactttttaaaatactagcaaaacgacccatgcgtcgcaactgaagaaaaaaaaatcataatctctaatggtcatgaccacattttgctgcatcaccgagatacactatcactttcattttcgtgaaatcgtgaacaatttttgaaaatcatgaacatttttttaactgatgaacatatctgaaatcgtgaacattttccaaatacttgaacaattttaaaaaattgcaaactttgtctaaaatcataaacgttttatgaattcatgagcattttatactatttgcaaaaaataaaaaattatgaacatttttt

SEQ ID NO: 34717 - DNA, 437 bp, Triticum aestivum
  Clone ID: PAT_TA_34717
cgaagacgacagaagggatcataaagactagatacagaagttgatgccggactatcatccatccagagtatggtggagaacccaccttgcaaagccgaagacttatatccgcatactatatcatcattgaaggcaagttcgggggctactgagggagtcctagattcgggggtcctcaagtgtccgtcccaggagtatgggccaggttggatgggtcatacaagatcaagctgaagactatccttcgtgtccatgtgggacttctccatacgtaaactacaagattagagtccagatgtatcatttccttccctgatgaaccgaccttgtacaaaccctaggcccctccggtgtgtatataaactggaggggttagtccgtagaggctatccacattactatcatcagaatattcacaggctagacatctagggttt

SEQ ID NO: 34718 - DNA, 667 bp, Triticum aestivum
  Clone ID: PAT_TA_34718
cacacggctcctctccgatctccccacgactgcaacgcgcctcctgcgctccgtcgagctcccacggaaagaggtgtccagcgacggcggccggatcgagcgcgatccacgaccgcaacgcgccttcgcttcatcaccacataggttcaggaaagaggtgaaggtcaccgttgaaggggagcaggctgatcgtgcttctgtttctcgggtatctcgcagcagctggacagtgctaccaatatcatggttcaccgctacatgaaggcaaaatcaacgtgaaaatgtgcatcccaaggaactgcgacgatccaaataatgaagtcggatccaaagggtgctactactgcgtctcacgtccgggcaaagcgtcgtgttggcacaagttgaaggaatgccaagcaaattgcccaacctgcaccccgaattgcccaccgggctcggctattgaatttgaagcatgcacatgagtgcttgaattattatctggttgttcgatactcagcgaaagctatgtcagagttcagcattaataatgtgaaaatggacatgtacctttgcctctagtttgtgcgtgcaatctggtaagattggtttcagctaaatgtgtgtcagggttcatgattaataaagcgaaacgaaggatggtccctcttggccgttcttcatg

SEQ ID NO: 34719 - DNA, 769 bp, Triticum aestivum
  Clone ID: PAT_TA_34719
acccacgcgtccggccgacgcgtccgcccagataacacctcccgggtaacttccatcaattatcctcaccacgaaggcagcctactcacgcgtccgccccctcgctcgtttcctctcccatctaacccgccgccacgagcagcgccagccagcgggagaggaactggctccgctctcccatgcagccacaccagcttcgtcgcctggagggaggagaagatggcggtggcggcttcgatctatatatgatctgcctcgatgcgggtctcctccagtgagtgcctatgcggcgacggctacggcgacaacgagtgaaggagatgaagtggaggcaactcgagggcctcctagggggcctggtccagttctcccccgccgcctcctctgctcgatttggcctccaaaaaaaggtgggtaaggcgactccctttggctgaagctagctgataaactcgctgctgccaagtcccttttgggtgtcttgcacaaaacggtctgtcttgcttcagttcagagcaacgtcttaattcactcttttgatttgttaattatatatgttacgacctgcactttgttatgttatgcgacctgtgattcacgggccgtctgatgatgatattgagcatttttctcatgtattacaaatatcatgagtcttatgatgaagagatgtccaagtagctgcatgtttttggttcagttcagtagcgcaaaaatctgaagaagtataatcataatatttttgttgtctaatatagtaatatgtcac

SEQ ID NO: 34720 - DNA, 1030 bp, Triticum aestivum
  Clone ID: PAT_TA_34720
ggcgcgtcgcttttctcgccgtcattttgggtaatgcagcgtatcaagcaggtcgaaggcgaggatcagatgcggtagcagctgaaggagtcatggagagggggcggagacgaggaccggaggaggaggttcgaagggtggggctagggaggacggaggcggagtgctgctgcaacagctgtgggactggggatggggatgaagtgctagtgcaacttatattggggcgctggaaaggatggaaaaaaggtttacttcagctttgaatgtgggcacaaatcaaatgaaatctattcggatgggaagcaagttcaatgcggtggggaactattggatggtgccaggcagttcatttaacaagcaggagttcatctctgttttgctagacaatccaacacctgaaactgttgaaaagtagataatcagccaataaacagtaaatcatcacatctatttgctttcctggtatatggggccattattattctggtacttctaaagagtcattattcttatggtacttctacatttgcatatctttgtgttcagatggaagtcacctggcaaaggtctaacgtttcagatttaatgttatatacatgcccaagagtaatacgttatataatatactctagattgtattcttatttagtttttttcatgcttcttgtttcactgggctattgcaaagacgacatatccacttggagttggatattattttgataaccatatctagctatttttacaaaataatatcaattaacttgcatcgattcaatgctagagcggtagtcatgaaacattgccactgcgccacaaggcgattaaaatcatggaaattgatataaaagttacttgtgatttctatagtcatgtaatcacaaaccataatgataaaaaagccaaattgtttattttattggagaacacatcaactatatggagaatcaaaggtgaatgtaaatgaaacgctccatgtacgtttaggctccaatataagattaaaatagtggataaatcattgtac

SEQ ID NO: 34721 - DNA, 619 bp, Triticum aestivum
  unsure (1)..(619): unsure at all n locations
  Clone ID: PAT_TA_34721
tcaacaccgcatccgccaccacctcatccagagtacacacaaatcccgagctagcgaaaaccgattccttttcttaccgcaccgcgaagccaaggcgaaggcgaaggttatcatcggcgatgttcctggtggggatagtggccgagctgctggaggactacacgatgctggtggcggaggtgctggagcagctgctcgacggcgcgccgttcccccgccggatgcgcacgctcatgctgcggagcctccccttcgtggccccgccgctcgcgccgccgccgccgccgcacgccctccgcgtcaccacccgaggctgatcgatccagccgactgcctctgctaagcctcgtccgatcccataggttcatccggattgcctctttcggtttattctgttgattcgtttggtgtacagaccgactgtactacttgtactatgatgtctcttattatccagcggtggaaatgagactgagttttccatggctcctttgtaaatagttctggtgagatcaaggggcctttcaatttgagctcctttttcaggtggatatactagtagaaaaaaaaaaaaggatgatgtctttgctggatgggaacatnattaatgactgatgtn

SEQ ID NO: 34722 - DNA, 1173 bp, Triticum aestivum
  Clone ID: PAT_TA_34722
aataaaaatcggcggtctccctccctcttccacccctctctctcctgccataatatcatcgtggcctctccctccctcccgtcctctctgattgcccccgcgctcgccatggaggccgccgcgtcccctctgctcctctccgccgacgcgcccctcgccgccggccgccgcctcctcctcgtcccttctcggcccgcgcgcgccccacggcggggcgccgcgcccagcaggtgccggcgggcgtccgtccgcgcgtacgccgcggccgccgcgccagcgccggcctctggaaacggcctcgtcgggaataacaacggagtgtacactgttggagacttcatgacgaaaaaggaggatctccatgtcgtcaaagtgtcaaccccggttgatgaagcgctcgagatgctggtgcagaacaggatctctggtttccctgttatcgatgacgactggaagttggttggcgttgtctcagattatgatctattagctttggactcaatggcaggatgtggactggctgatacaaattcaagtatgttccctgaagtagatagcacttggaagacatttcgcgagatccagagactcttgagcaaaaccagtggcaaagttatcggtgatgttatgactccctcacctcttgtggtgcgtgaaactactaacctcgacgctgctgcaaggttgctgcttgaaaccaaataccacagattgcctgttgttgatagcacgggaaatttggttgggatgatcacaagggggaatgtcgtcagagctgctctcgaaataaagaagaaagctgaaggtgcttaaattagatggttctttatatggacaccactggggttgaacctgcggcaattcggcaattcagctgaattgaaatattgactggtagcgcagaagcagattttccctggagcatagatggatataatgttgtttacaatgtaatataagtagtgtactgttgcagagaaatggcatataggtattgcatgaggacaattgcgattcatttgaggccagcatactcagctgtctcgccatattaggtagtagtagcatggcatatggaggttaatattcttttctcgatgacttgtatgagcctcgagcatattaaagtggtctatatagtgcattcaaaaaaaaaaaaaaaaaaggccccta

SEQ ID NO: 34723 - DNA, 1069 bp, Triticum aestivum
  unsure (1)..(1069): unsure at all n locations
  Clone ID: PAT_TA_34723
ttgtatattgggagtgatcaaagaggaagctgtggttgaagtcccaaaataggatgtttaggagcaagaagtcacgccggatgaggttgtgcatgaagctgcagttggcaagggtttgggtggagctttgaagtttctaaaggagcgagggaccctcaatgagggcaccaattggggaggcagaaccacggacaagaagaaaagcaagcttgttggtattgaggaagaggctcaggacgggaaaaaagagatccgcatagaaagaatggatgaattcggtcgagtgatgacacctaaggaggcatttagggatctttcgcacaaattccatggcaagggaccaggtaaaatgaagctggaaaaacggcagaagaagtaccaggatgatatgaaagctaagcaaatgaaatcttctgacacgcctttgatgtccgcggaaaagatgagagacgctcaagctcgtggccaaacaccataccttgttttaagtggcaatgcaaaatcaggcccgacaggcgatgctagtggctttgccagcgtggagaaggcgcatcccgggagtctgacgcccatgctcggcgacaaaaaggtggagcactttctgggcatcaaacgaagcgcccagttcggaggcatgccgcctctgccgccaaagaagcctaagaanctgaggttgncagcggagtgggagtgaacaggaaccagcggcagctctatagcgagtatgcaatcttggagcagattatgagtaccgacatggacggaaggcgccaaacgcctgccacatgcaggagcacccgtcgagcggatgcgctgaaatgtactaataacctgtaaatttgcaccctaaaccgattgttttgatggtgacacacacacagagatggtgtaacttgtaacgcaacgatgtttctatccatgcacgctctaaaagttgcagagagaagcatgcttgctaacctttatgtggaaagtgatgcaagttgtacctcgcacccctctgttcttaggatttcttttccatgacaaacattacaatagcatgcttaatgggtttttttgacggtcc

SEQ ID NO: 34724 - DNA, 563 bp, Triticum aestivum
  Clone ID: PAT_TA_34724
gcagcctcggctgcgcgcgagcaagttcttgcaaagggaggaccggccgtggctgctgccagggcggctgcggcagcgggagctgaagcccgcggactcgacgtttacccaggcgataccaagacagagagtgagtgcttcgtggtcaggattgatcagttaccgttggagtccacagaagacaatgttcgcgtgctgatggagcagttcggtggggtgaagcatgtgttcattgcaagacacccgaggaccagagcgtctcttcggtatgcgtttgtctacttcttcgagaaggaagatggagaagcagcggtcgaagctctctctgatgggctggaagcaagggtggtcgggatgcttacatgttaaactgtccggtgggaattagtgtggcagttagaggttactgatgtgggttgtccaattggtatttctctagataagagtccagtctttgttgtggtatagagttcagtcgtgttgagatgaactgtccagatagagtccagtgatgttgagtgatgtcagaccacttgcgaatgaagttgaatggttatttgcct

SEQ ID NO: 34725 - DNA, 834 bp, Triticum aestivum
  Clone ID: PAT_TA_34725
ccacgcgtccgtggaatcggtgttgttccattcttgaagggtttgatattcacggatgatgcacctctatgcttcgtctccgtccgctgcccctgccgtgggggagctatgattccatgcattttgcttgctgtggggggtaatcttgttgatggtcctggtgaagggagtaagagacttggtgtgcgaaccaccgttgcctttggttttgctcggttgatctggggtccaattgctggggttgccatcgtcttgctagttgtccaactcggttccattcccacagatgacaaaatgttcatgtttgtcctactgctgcggtgctaactgcccaggtcgctgctatcaggtgcccgtgcaatcctccgaggtggccggtatgaatcagccgcgatcttgttctgggtgcactctttttgcggtgttctccactggcatgcgtggattattttctatttgacgctgctcttcttaacactgtactgaaaggggacaccccgcaaatagtagataccatcagaaaacactggaagaagataatagtgtcatgaactgtactataggccactgaaaccctggtggcagctgctctggacgtacgagttgtatcggtacagatatgggttccttggacccggtttgtctaaatgcctttgtcatgttaattttggcctcgcggcgagggacgacaatcgcggcatctgggtgcctgccatattactttggtcaccctcaaaaaccttttagttcggtattccagatatattttggcactccctgatgttcgctctgtgatccgtctattcggttgaatgtaagtgtgttctgtaaaaa

SEQ ID NO: 34726 - DNA, 565 bp, Triticum aestivum
  Clone ID: PAT_TA_34726
tgcaaatgtccgcgctcccaacaagcgcaagctttgtgaagctggccgacatgggtgtggatacatggggcctgttccttgagaagttccaggagctgctccctggcgcattccgcgcgcacaagcttggcgccaccgggcagagggggaggctgaggatgggtacttcttgtcagttttgagttagtgcaggagtagagaagtcagtttggctgctactgtttgctgtggcttcctgtaggtgtcaaggtatgcggtcggtcgtcgaataaagccatcctttacaatagggttcgagcgttgaatatgcctgcttcagaggtccatgttcagatgatggcctttcctgtacatagttttccttcttctttttccttttttccttttctagctagttgcctggaggaggttgggatgtgatgtctgcccagttcttggccacccaattcctccatgcatgatatgcattcaaagatgccattcaaataaaacagacatgcaagaaaaagtttctggtgtggtcattaaacattgtccagatttcagagtaatgttatatttcaac

SEQ ID NO: 34727 - DNA, 722 bp, Triticum aestivum
  Clone ID: PAT_TA_34727
ttccatcgataggagcgagtggatgtacaaggatgctgtgtattatgatcgctcaaaggcagaaggtggcagctcccaaagtaaagagctcgcacccatagtccatgcaagatgtatgccaggaatctcaaacgatggcatgcaggtggattagtatgggttgtcatgtcatatagcagcagaaacagcagcagcagctcagatgatgacattgaggtggattgtcaaagaagtctggtgcccagcagagcctcaaacgatggcatggaggcaaacattccgtgaggtcggtgcacagcgacgattgataatatactgcaggtggggtgatgacagcttcggcaacattttggtcccttgatctccaccaattgtcatgtagaaaaggtgttcttacagaaagaataaacataccgagccaattagtcggcattttgatcccagcgagtcaacattttgggagggtggggtcagatgacataagtttgatctttctgttgttcataggaggccatgtatgctagtgaaaagagtgtattattattgtcccttagccaggcgagcgaaacgggtgaggccagcgtcgtcgtcgagttactgctgtttttgacaaactttttctcagcttttgagatgtagtagcggtttttgtacttaaaaccaaactgacaatagaacttcatcatggatggatgcatatttgaactaccaaaaaaaaaaaa

SEQ ID NO: 34728 - DNA, 812 bp, Triticum aestivum
  unsure (1)..(812): unsure at all n locations
  Clone ID: PAT_TA_34728
gngntgnnnntttantacccctnctnggngctgtgttttcccctgctcgaaactaaccctcactaaagggaacaaaagctggagctccacccgcggtggcggccgctctacaactagtggcatcccccgggccgccggccgcgtacagtacagacagccaacaagccttgcaaacggaagcaaagcatgagggcccaggtacttctcgccgcgctgacggttgtcacggccgtcctcgcagcagctctgcccctcgcctacggccaagaagaagctatgcccagcgcgtggccatgctgcgacgagtgcggcacgtgcaccaggatgatcccaccgaggtgcacgtgcatggacgtgtcaccgagcgggtgccacccggcctgcaagaactgcgtccagaccacccttggtggccgcgacgtcttctggtgcatgctgcgcatcgaaaacttctgcaagcgccgctgcacgccggcccgcatggttagttaattcgacggaggatcatgtgctgtcgtcggtcgcatgaataatgccgcgcgcttagcttgcgcctttaattttcttggattttcagacctcgcgccgcatcttgggatgcagacaagaaataagcgtttggtgtctggattaaacaacatattctctgctcaaaataaattcattacaaaactcgagggggtgtcctgttacccaattcgccatatagtgagtcgtattacaattcactggcccctcgctttacatcctcgtgacggggaagaccctggcgttacccaacttaagcgccttgcagcccccaccctttnagg

SEQ ID NO: 34729 - DNA, 1369 bp, Triticum aestivum
  Clone ID: PAT_TA_34729
cccacgcgtccgcccacgcgtccgcccacgcgtccgggacacgacagggcacggcactgcacatgctatacacagacagaggtccaagtccaaggtcgtcacggtcggaagcggcagcaggcggcagcgcgccacggccagccctcgcgctggcgcttgcggtggcgctcgcactgacgctctcgccgtcgccggcgcaggccgcggcgggcgggttcagctgcagccccggcgcgcggccggtggtgttcaacttcggcgactccaactccgacacgggcggcatggcggcggccaaggggtggcacatcgcgccgccggagggccgcgccttcttccaccaccccaccggccgcttctgcgacggccggctcgtcatcgacttcctctgtgaaagcttaaacataagctatctgagcccttatctgaaggcaattggttctaattacagtaacggagtgaatttcgctattagcggttcaacaacactaccacgggacgccctttttgtattgcatggacaggtgcaagaattcttcttctttaaagccagatccttggaactcatcaatcaaggccaggaagctccaatcgatgcagaagcgttccaaaatgctctatatatcatagacataggacagaatgatattaatgctcttctgtccaacttgccttacgaccaagtagtcgccaagttgcctccaatacttgcggagattaagtatgctgttcagcttctgtatggcaacgggagccggaacttctggatacacggaacaggggctcgctaggcagcgtctgcgatcctctgaatgtagagctgaaaaacgcggccgttgtgtacaccgatctctttcccatcaagtatgaccttgtggccaaccacaccaaatacggttttgacagcccattgatgacgtgttgcgggtacggagggccaccgtacaactatgatttgagcaggagctgccagtcttcgaattcaacggtctgcgccgacggctcaaagttcatcagctgggacggcgtgcacctcaccgaggccgccaacgccgtcgtggctgcggccatactgagctccgcatattccagaccaaagatcaagtttgatcagttctgcaaagcccgatagatcatacttcatactatattggtgtagtacttatacataacttaaacctgcaaggatctggtttttctcctatttggggctgacagccgattaatgtggacgtgacatctgcaattcgggggagctggctgtgtatgtttcttgtgtgtgcgtagtaggtgccatagaattgggcccaactattgatacaagttcttcaccatcgatggatcaaatcccaaaaaaaaaaaaaaaaaa

SEQ ID NO: 34730 - DNA, 851 bp, Triticum aestivum
  unsure (1)..(851): unsure at all n locations
  Clone ID: PAT_TA_34730
gaggctttcgtttttcccctgagctgttgtttgataagttccaggcagatgagcaaggttgggtcgacaccatcaaatctgtcaattctgggggaatggtgaggataagtactatggactggcttggacaatcacagtatgcttctgaaactgtgttctggccatctttgtcatcagcgatatcagaggtaatattctccaagaatgcaaccgtgaggctgctcgtagcctactggacacacttcatcccgagcaccgagaagtacttgaagagcctcctgtactcaaacatcctctgcgcatcctccaaatacaaccactgcggcggcaaggtcgaggtcaagtactacttggttcccgggtacaacgagaccggacctgccttggctcacggcgccccgacagggaaccgttaccccgacttcacccgggtgaaccatggcaagtacgccgtcagcgatgtgagggcgaacatcggcaccagcaacctcatctgggactacttctacacaacggctggagtgagcttcggaacgtacgacccctccatcgtctcgcagctgcaagacgtcttcgatgcggattgggattctccctacactatgcccgttaaacctctggaggcgtccaggtgaagagatcagttcgttttctttgcttagtcaggtaatcatatttctcttattaatttgcttagtagtacattgtaataccttgtagttgttgccccatagcaagttgtggctgtgagcttcacataagatgaaaaaaaaccaaggaannctgtaacgnctccaaaaaantttgcgtacnaaataaatgaggttacgggnctcccnaaaaaaaaaaaa

SEQ ID NO: 34731 - DNA, 411 bp, Triticum aestivum
  Clone ID: PAT_TA_34731
cgcgtcccttgtcagttggaaaattattttgttactagtatactccaaagccgcaatgcagtacccattctatcacttgttaaatttatttctaacagagctcaaactttgggttgtcaatgagcctaattaagggcatgatcttcaccctctttgaaaccgtgggtcacctgtgacaccatctggagaatgaaatatactcaggcggggcttcctggatgattctttcaaagacaaatcctcaagtgacttgtttctttggatttttatcctttgccctctactcttcccttttcacccatcatcgctcccccactcccacacctgggaagatgcaatgcctgtggctgaagcagcagttttgcaaacctgagaacaaaagacatgtattgctaagcatactgaaggagt

SEQ ID NO: 34732 - DNA, 331 bp, Triticum aestivum
  Clone ID: PAT_TA_34732
tcaagtagaccccactggctaccttggtgcggcattttcaacagcacagaatcaccctttacacgatcaaaagatgctgtttcatctaatgaccctgttgaacaggggggctcttataaatggtcacaatttcgtggttcgaaattttcgatgtgggcaaccactacaggataaagtacagctgaagggccgtgacctcctcactctacatcaactttacacgagaacaaattaagtatatgctatggctatcagcacatctgaaattcaggataaaacacattcgacagtatttgcctttactgcacgggaagtccttatgcatgatttt

SEQ ID NO: 34733 - DNA, 1116 bp, Triticum aestivum
  Clone ID: PAT_TA_34733
ggaaggttcttgtccgtttgaagacttcgcaaatcacaatgcgtttacccttcttgagaagtacaaggcgacccatcttgtcttcaatgatgatattcagggaacggctgcggtggttcttgcgggccttatggctggtctgaagtttgctggtggaactttagctgaccacacattcttattcttcggtgccggagaggctggtacaggcattgctgaactagttgctttggagatatcgatgcagtccaagacttcacaggaagaggctcgcaaaaatatctggcttgttgattcaaagggattgatcgtgagttcgcgtaaagattctatacagcccttcaagaagctatatgcacatgagcatgaaccagtcaaagaccttttaagtgccatcaaggatatcaaaccgaccgcactaataggatcagctggtgtgggtcaaagtttcacaaaagaggtgatcgaggctatgtcttcgattaacaagaggccaatcatccttgcgctatccaacccaacatcgaagtctgaatgtacagctgagcaggcatattcatggagtcagggccgtgcaatattcgggagtggaagcccatttgatccggtgaaatataacgagaagcttttcgtacctgcccaggcgaacaatgcatacatcttcccaggatttggtttaggtgtagtgacctccggggcgataagggtgaaagacgatatggtccttgctgctgctgaggccttagccgaacaggtcacggcggagcatttcgacaaaggcctgatctatccacccttctccagcatcaggaagatatcagctaacatcgcggctcgtgtcgctgcgaaagcctacgacctcggactggcaagccatctccctcgcccaaaagacttggtgaagtacgctgagagctgcatgtacagccccatctaccgttcatacagatgaagccatggcgcctcatactctgaccatgaataatgttccgtcgaacctagactgtaactttgcccactccccccttccggctcgttggcttcggtcgtcgtgttgcccttgttatcgtatcatctataaatgaattgtaaggcagaccaacaccacagtatcat

SEQ ID NO: 34734 - DNA, 1155 bp, Triticum aestivum
  Clone ID: PAT_TA_34734
ttcgcccccacacccgtctcgtcctagctccctactcctcccgctcgccactcctccgccccagctctgctcgccctcgaccgcgggtcgccaggaagggaaggcccaacgggatttttacctaggagcaaaatttgggttttaaatcgcagattggatttgggttcagggatgaggggagaggaggggctgcatcacctggcccggttcccatctctctgaacttagatggatgcatctgtgaagtccaagaaggttagctcttgtggaaacaccggtcatagccgctgcggcgaagttcataaacctgtcctgccgtgtcgcatgcgggatcgctgcttgaatagaaataatcccttctcacttcaggtctggtttgcatttccttttaagtataaaagcaactgtattcagcatgacatttgagtaagcatcagaacctcaaaggccaagtttgtcagcaatattataccgttattggtgtaacacttccatagagaagatggtggatgacctgttttatgagggcaacactgatcacagcatcagctctgaggacgaagacacacttgtcaggagttgtagtaatctcagcgtaagctttggatatcattgcaattcttatcagagtttccctcttgaaaatgatgagcatgatacctctccccagatgaggtttgaaactaatgccatgactaagtcacgaaatggctcatttacttgcttatctggtgccgcaattagtgcaaacttcaccctggccaatacaaatatatgcaagggtcttattggggaagaaattttaccagaactagattctccaaattctttcagaaaaatcgtctcttctccatccatgtcaaggttggacttgctatccacctcacaaggcagccctgcatcaactgagagctccatatttgaaatcagtaaaaatctttggaggtccagcgctccaacaactgtatcatccaattttctgactggtaccgcggccgcgaccgcgcgtggagctgctggagaggatagagtccaagctgtgtgctctgagaaaaatggatggttgatttgtggaatttatgatggatttaatggacgagatgcagctgattttctggcagtaactctatatgataacatagtatattacctata

SEQ ID NO: 34735 - DNA, 730 bp, Triticum aestivum
  Clone ID: PAT_TA_34735
acgccaagtcagaaccactcgccctcccgccccgacctccgtctccattcttgcgtgcgtcggccacctccctccggcggggctcgagccacaccccccaagcgccgctgctccaccctctcccgtgcccatccactgcacgcatcgtcggactcaccatcctccgctgcaccgtggagatgggtgcgtctgtgtccaccctctcagtggaggcataggggcgccgcggcggtgatggggaacaagatcgcgttgccttttgccactagagcacctaggtgttctgtgtttcttgatttcccgtcgcatctgcatagtgttatcagttgttatgacgatgaaatggcttgtctaatcttatggtggattggtttatcctgttaattctggttttgcaaagtaatacggatgatgtcctgacaatttgatacctagaaatcaagatgttttccctgtctgttgaccacaaaccttgataagttaaacccaggtgcatgattttatacctgatctgatatgcttttaaactgtacctgtgtactgaacccaagttaagtatacccgagtattctcacgcttgcataatatgtgtgagctaggtttcagttggcctacccactgtcagttgttctcttaacatgtttgcctttggtgttttactagctactaccagtagtacagattcctggggtgaatggtcgcttgtctaactttggtttcttttcttttc

SEQ ID NO: 34736 - DNA, 900 bp, Triticum aestivum
  Clone ID: PAT_TA_34736
cggccgggccgagttcctccataaagaaattggggggagcatttgttgctgctactgctgtggttccagatgaagtggacaaaattaaggagattctggtgaagtggagtgatattgaccgtgttaacctcatcttgaccttaggtaacaacgtacatgcaggtggcactggcttcacacctagagatgttactccagaagcaactaaatctgtaatagagaaagaagcacctggccttgcgtttgttatgattcaggagagtttgaaggtgacaccatttgcgatgctatcccgagcggcgtgtgggataagaggatcgacacttatcatcaacatgcccggcaacccgaatgctgtcgcggagtgcatggaggctcttctcccagcgctgaagcatgccatgaagcagctgaagggtgacaagagggagaagaacccccgacacatacctcacgctgaagccgcaccagtcgaccagtgggagcgcagtttcagagctgcatcatcgggtggtggctgctcatgcgacccctgatcggcgctcatccacaggtggtggaacactcctggggaaccttctttcgtgatcctgctgcatccagtttcaagctgaagcggcgatggtttcggtttttctcgttatggctatttcgtgactcttgacatttgaggacccgtggtgtatgtgctaccaataaagcagcgagagtttctttctgctcttctatctatcagcctattctctcacaatgacagtgctcatattgcctgtattacactgtaacgtaagtgatgttagtgatccatggaaataaagtgcagtacacttgtacaagaaaacatgtattttcaagatacatagaaccaaccaaaaacattgatctttcaaaaaaaaaaaa

SEQ ID NO: 34737 - DNA, 1914 bp, Triticum aestivum
  Clone ID: PAT_TA_34737
ccacgacctcctgccccccggctcccttccttccaccagtcaagctaacctgccctgcaacttccgtcctgttcttctctggcctacctcctccagcaagggaggactgggagcaggagcaggggggccgcctccactccatccaatccgatccaatccgatccacgggagaaaggccaaagatttgacttctgctcgtgtgctacgcttgatcgaccgaaggattggcgatatggcagaagctgacatcacgcggtactggtgccatgaatgtcagcaggccgtcgaggaggccatggtggaggagctcaagtgtccgttgtgtgatggtgggttcgtcgaagagatgacccttgagcaggttgaggcattggtaagtcagctatcagagcaagggccaactcagtgggaccctctggacaacccttttgagcaggcaggatcgccgggggacagcgatgatgaagataatagcgatataggccgggagtttgaggggtttcatcagaaagcatcgtcgggtttcggcgcggggccgggattttgtcagattcgatgatgacaataaagagatctgactactggtcatgtgccttgcttgatcgaccgaaggattggcgttatggcagaagctgacatcacgcgctactggtgccatgaatgtcagcaggctgtcgaggaggccatggtggaggagctcaagtgtccattgtgtgatggtgggttcgtcgaagagatgaccgttgagcaggttgaggcattgacagagcaaggggcaactcagtgggaccctctggacaacccttttgagcaggcaggatcgccgggggacagcgatgatgaagagaatagtgatataggccgtgagtttgagggtttcatcagaaggcatcgacgggcatcggcactgcgccgtgtgcttgatagcatccatgatgaccttagagatgacagggaaagggacaactccgttctgatcagtgctttcaaccaggccctcgctctacaaggtgcagcgcttgaccctgacgaggaccgaggtgaccatggtaacgcaaataatgatgatggtttgctagacgagtatgtcctcggggcagggcttagtctgcttcttcaacatttggctgagaatgacccaagccggtatggtactcctccaacgaagaaagaagcagtcgaagccctgcccacggtcaaaatcgaagaggtcgtcagctgttcagtctgtcttgatgatcttgatatagggtcccaggctaagcagctgccttgtgaacataagttccactcaccatgtatcctgccatggcttgaactccatagttcctgcccagtttgccggtttgagctgccatctgatgagacaaaagacttgagcgagcctagcaacgttgatcgaatagagagcagccatgaggaggcaagagctgatggccctggaaacaatggtgaggacagtaacacaaacgacagggaggacagtaacagaccttgggcccttgttccttggtttaatggcctattctcgacacctgagccgcaaactgtcagagctactttgactgatcagcagctgcctcctgcttctggaaccaacccaaatgcagggcatagttgatcttctccagtgttgtgaataatgatcatacatctgaggatagtgatgcaactttgtcagtagaactcttctttccatcttctcggtcatctatctggatgttcattagggcaccttgggcgctgcgactgaggcattcataatccttgatatattgagctactactagttttatttcacttgtaaacatcgaccagaaagcaaccttgttaaagtcctctttggcgctgcgaatgatgcattcataatccttgatatattgagctaaaaaaaaaaaaaaaaaaaaaaaaaaa

SEQ ID NO: 34738 - DNA, 833 bp, Triticum aestivum
  Clone ID: PAT_TA_34738
tctcgccccccccaccccctcaccctaaccctaacccgaccgcgccgccgctcccaacctgcgcgcctccgccccaaaccacccgccggtcccctcgcgccaccacatctcggaccccggcctcttgtaagttgcctcttagtgtgagcaccgcagctggttttctactagcacctttgaccgccgttgaacgtctcagcaatgaaccctttttgctcatcacatttttgaattctctcctcacggcagcaggtgattttctcatggatgtttgcacaggagcttgttattgctttcatactagttttgttcagttggtaaacttgttgttgctccatccgctgtgcagaacaatacccctgaagatgcgtggagtaggctactcctctgaccataacaattggctgctattgacgacgcgaggtggtcttatatgttcagttcttaattatcatttcaaatccttggactagtggctgggatcgtattggttatttggagatacctatttgtaccgaagttcagttagtaagttgaatatagccctcttgttatagccatgtgcagttgaattgaatattttcggtccgctgctcactcttgatttttgctaaaaatctaaaatccttggtcagtggcatgttaattatacattgctcgctagttctatgcacataaaatacttggttgggactgaaaattgtagcacttgagcaagaaaggctgactaccaattcattagcatgtcaataaagtcaatctggtcttcctcttaggacttgttagggctcattaatagcatttggttgctcactgaaataggagaggagctg

SEQ ID NO: 34739 - DNA, 726 bp, Triticum aestivum
  Clone ID: PAT_TA_34739
aattcgagcggccgcttttttttttttttttttttttttttttgaccaaagaaacaccattaatatttcatgaggtaatgaaacagggtgttcccacagaaccaacacaagttacaggaagacatggtctgaacagctgactattacagaaaagcatcctagcctaggaggaggtgaacttggtgacagccttggtgccctcggagacggcgtgcttggcgagctcgccggggaggacgaggcggacggaggtctggatctcccgggacgtgatggtgggcttcttattgtacctcgcaagcttggccgactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggacttcttcttccccttcttctcgccgccctccttggacgccggcggccgcttctcggccttggtcttcttggctgccgtcgtcttctcggccttctccgccaccggcttcttctccgccttgggggccatggatgccgctgctacttcgccggggagacccgtgggattgtggggtgcggtggtgtttcgctgggaggggctctctctctctctctctctctctctctctctctctctctctctctctctctctctctctatctctctctcggtgc

SEQ ID NO: 34740 - DNA, 766 bp, Triticum aestivum
  Clone ID: PAT_TA_34740
tcggcacgaggcgaacacctgcccacgaactcacgtcccacacatccccccatctcccccgcagccctcggcccagatcccatctctcccctctctcctttctcagaaaaatcgccggcccggatctcgattcgccgctgccgctcccctcctcgtcagcctcgtggtcgcggtggccgaagtcctggctgtggacgccgccgctcccctcctcgtcagccttgtggtcgcggtggccgtagccgccggccctgcactctcctcttcaggatgtccctcgtgccaccctcatgttgttgtcgtcgcgccgcctctatacaccggcaaccaactgttcagttccatgggccctgattgtttcttgaatttcagattgttgggcatgagagccatcatcggctggttgatccacctcgctagctcgtgtccgtcgaggtcgttgactcttccattcctgaattgttaagcttcgctgcagcagactcgccttggagtttcagtttcgatcacatgcatgaccctgtaggtaaattgctttttttcccgtggatggtcttcagcatgcagatgggcttctattgtacgatgatactgctgcgaacagcgatcattatcccgcgactggtgaacaagttgaagtccacagtgatgtatagcatcatgagcgtaattatatgactactttttggtaactgtttctacatacatgttttattatatcacagttctgctctttgggtgtgcacttaatttatgggaggagccc

SEQ ID NO: 34741 - DNA, 797 bp, Triticum aestivum
  unsure (1)..(797): unsure at all n locations
  Clone ID: PAT_TA_34741
cggacgcgtggggccggtgtcagatcatcagtctccaagatcaccacttaccgccagcatgctccttataacactgacagtccacatggtgatgcatcagtgagagcaatgtccagagccagcatgatgatgagtgcagcagaagcaatggcgaaagcctgccggatggtgaatccacctcaaatggtagtttactttatgtgattactgtgagcatactgaagtatgatttgatctgagtcatctgcagcaaagcctgatttgattgtgtctggacctcctgaaaaaatcgaacaaggaccattacagaagcctgatttggtcgagtccgcacctacaaagaaacttgatttgattgagtccagtactcaacctgggcctgcagaggagcttcatttggttgagtccagaccttctaggaattctcaactgattgagcctgaacctgcaaggaagcttgattttaatcaaccctggccaacaacatgctttgttgatcatccttttgaaaggccagcagttactccaatcagctacgagaatgaaatgagattctgtttccactcacagtgggtcgcggatacaagcaagggtggcgccatatgccgattccacaactccgagctgcagcgggagctgctgggccgcctgagatgcagatggaggcgcagctcctccgagctgctgngtcgctgagatgcagatggagccggagcacctncgagctgcagcaggagccgctccgctgcccaagctgtagtgtgatccaccgcgaagatggagccccaggtgttctc

SEQ ID NO: 34742 - DNA, 1187 bp, Triticum aestivum
  unsure (1)..(1187): unsure at all n locations
  Clone ID: PAT_TA_34742
ggcacgaggtgaaatcgctacccaggctagtgaaattgtaaaagcgaacaatttagctgataagatcgtggtcattcatggacgtgttgaggatgttgatgttgaggagaaggttgatgtaataatatcagaatggatgggttatatgcttctctacgagagtatgctgccaagcgttctatttgcaagggataaatggcttaagccagggggtcttatcctgccttctatgctacgcttttcatggcgcctataacaaattctgatagatatgaaggaagcgttgatttctggtgtgatgtttatggcataaacatgtctgctcttgtgccacttgccaaaaaattcgcatccgaggagccctccattgaaatagttggtggagaaaatgttataagttggccatttgtggtgaagcacattgattgctacacttttacggttgaggaattcaagtctatcaccacaacatacaaagtttcatcaatgatgttagctccaattcacggctttggtctctggtttgaggtggagttcaatgggcctgcagagtcttgtagcaatttgtcctccgattcaagtccacttgatattattcagaagaaaaggcgcagggcatcagatagcacagttgtgctgtccacagccccagaagacgagccaacccattggcaccagacaattttgtacttccctgatcctataggggtgacgcaagatcaaatcatagaaggctctgtaacaatcaccccaagcgaggagaatccacgctgtctgaatattcacttggagtgctccacgggaggtcaaaacttggtgaaggattttgcaatgcggtaatcggcgtggtccctcaacctgtcagctcaattctgcggtaactagccaatgggcccaaggcctaatccacattcctcactgacccgaacctggctcaagacctggctgtactctctactcaattggttcaaaaaattaatccatgttacttaggaggcacagggccaggattttttggtcgaaacaagttgcaggcagccgtccagtacttttgttattgtctggtaatcacttgtttttgctgtaacagtagatgaaggcggtagtttncttggatgctaactggtgcaacattttttttttttttgagatatgttaattgcaattttggcggnaaaaaaaaaaaa

SEQ ID NO: 34743 - DNA, 983 bp, Triticum aestivum
  unsure (1)..(983): unsure at all n locations
  Clone ID: PAT_TA_34743
catatgtgttcaagagtttgagtaagtcggatccaattgcgctaagtgcggagatggcaaaagagcatgacagggactcgagtacccatgaacagcctttgacctctctggggaacaccattgataaagtaagaggtgaggcgagggaagttacggttgctaatgctcctattgaggggatgaaggaggaaggtctcactgatagccttcttgtattagtggggttggtaagtcccatcagcaaattgggtccggtgatccaagagataatctcgtgggatagaccgcaagtcaccggcggtgttcttgttgtaactttgctgaccatatacaacgagtgggtcggttatgcactggcagcatccttgatactggtggtgggcgcgatggtctgggccaaggagaggaagttaggcgagatatgctcggaggtgatcatcgacaagtcctcggacaagacgacgatggagagcatagtggaggcgcagcacagcatgaagaaggtgcacgagtacgtgaagacggcgaacgtcgtgatcctcaggctatggtccattgttctagcccgctcaccgaagcacacggagacggtgatctggatgctgacgggcctcgcggtggcgctggccgtggtccctttcaagtacgtcctgatggggctgacggtgtgctgcttcgcggcgaacacgagggtggcgaaggcggtgtcggacccccggggcgggcggcgctggagggagtggtgggagtccatacccgccgtcccggtccatacggtggacaagggcgagctacgaacaggttgaagagaaggccggctgaaaatccctggtcggtcccgtgaagctaatattgctatgtatgtacacgctggtagctttggttgcgcttcacactgaaacgttgtgccatgaacacgtcgtcagatgttcttgtgtatgtatgaataaaagaaatacatgatcaggttctgaanaaaaaaa

SEQ ID NO: 34744 - DNA, 552 bp, Triticum aestivum
  Clone ID: PAT_TA_34744
cgaggcgctccgcgggtccaaggtcaagggcgccttcatccgggtcgagttcgcccggccggctagagctgttaggaacctatgggttggaggaattagtccttctatttcaaagcaggaggtagaggaggagtttcaaaagtttgggaagattgaaggtgttgcattctcccatgatcaaacttctgcatacatcgactttgagaaactggaagatgccatttctgcccatagagccttgaatggggcagatttagggggcaaggaattgtgtgttgatttccagaggtccagaggcagagcggaacggtcggaagcaggcaacttcaacagtagaggatcattgccacccggtgaaatgggagttggacatgcaaagggttctgctggagtacgaatgagagaggcaaaaaatcctaccaatgttctctgggtgggtttacccaatacacataaagttaacgaggaggcactaaggcgggctatggcagcacatggtgtggttacaaatatcaaggtttttccagaaaggcagtatgcttttgtggagtt

SEQ ID NO: 34745 - DNA, 606 bp, Triticum aestivum
  unsure (1)..(606): unsure at all n locations
  Clone ID: PAT_TA_34745
attttcttgccgaccttgtttatattcctctggcaagcaacaccacactcagagttctctatgtttttcttcatgtatgtatcaggttgccacaatttcacacaagtctgcaattacagtatctctgatggcgtacatggttattgtttactgttgtgtgggagctagttttaaatgcagtgcagtagttctatgaaatataaattacaactggttactggatccttcctctagctcatccttaattgtatcaatttgatttcataggtttgacgtttgaggtacaacaaaacatcaactagagaaattgccacaagatattgatgatcgtagttaagctctacattgttatatccaggttgcgttgtagcagctggttagcgtatgcataactttccattatgtatttcaaaatgtatgattactgtttaactttgtaatgtttcttagttgattgaactttcatgctcccttatttgcgatctcagcacaaataagcttggattcactccagagtttctaggacgtcggtgcctctctaacaaagatttttcgagtccccagggaaagcttttataatctacctctgttgattattgtatgnnn

SEQ ID NO: 34746 - DNA, 645 bp, Triticum aestivum
  Clone ID: PAT_TA_34746
gccagatgaaatgggtcttggaaaaacattgcaggcaattgctgttgcttcttgccttcatgatgcctggtccgttcttgttatctctcagtctgaatagcgagtacatggggcttctatgactcttcagtggctcaacatccctacggaagatatcttggtggtgttaccacaaactggaggatcaaataaggcaggattcagattggtatattcaaacaccaaaggagattttcatttggatgggatgttcaatgtcatatcttatgatgtagttcccaagatacaaagcactcttctggacttggattttaagatagttgtagctgatgagtcacactgcttgaagaatggctaagcgaagagttcaatcgcttcacgtcctgttctgcaggaagctcaatacgtggtttagctacttggaacgccagggttatctctccccatcgagatgtggactcagatcgaggcgttatgttctactgtctccacgaacgtaaatgaagatggcaatagatactactggaggataagtactggcataacgaaattgcgtgcttccaaataccaaagcaattattactttggatgggttgttcaatgtcatatcttatgatgtagtccccaagatacaaagcactcttc

SEQ ID NO: 34747 - DNA, 675 bp, Triticum aestivum
  unsure (1)..(675): unsure at all n locations
  Clone ID: PAT_TA_34747
cccacgcgtccgaaatctcccaaacgcaaaaggcgatgcgatcgacccaaccctagccgcgggcggtcccagccatagccaccgcgatccccgctctccgcttccccgagtcgcgaaccacaggttggcttcgaccaccgccccatcaagcatcccagcacgctgcgcaaccgcgagctagcgaggggtgtatttgggatggacaccaaacgtgggaggagccttagtccagtggaaatcaaggatgaccactctagggggagtgagaatggaaggaaagacaactcagctgtacagaatgactctagccatgccagaccaggcagaggtcgggaatttgttacgcattctgataggcattcctatggagcacctcgtgaatccaggaggcatgatgattataggaggtatcatgataagcgagctgatgatcatggcaggagccattctagaacttctcggtcagatcgggaatcaagggctgacacttactattatccttcaaagcgtgatgacacatctgatagatcacatggtgattggagaaatgttgacagcaggtatggcggcaaatctgtcaagggagagcagaggactaagaatcaggannaacatgggcccccacgtgaataccctagacatgatggcacagagtatgancaagatgctgattta

SEQ ID NO: 34748 - DNA, 939 bp, Triticum aestivum
  unsure (1)..(939): unsure at all n locations
  Clone ID: PAT_TA_34748
gtctgagagcgggagcggcagcgatgacgattcggatgggtccgggagcgacgactcagaggaggagaggcggagggaggaggagcggagccggcggcgtgccgaacggctcgcggcgatggcggcgcgagccattgcagagagggaggaggccgtggcgaggctggagggggagaagaccagccttgagaagctgctcgccgtgcgtgagaaggagcaagcacaggaggcttcagagttgcagactagtatggattgaaaccatggaagctacagagatagagaaacaacggcatcacagcactagaatggaagcccttgtgcggttggctgagcttgaggttacaaatgcagagcttgcaaagtcacttgccagggaacaatggaatttggaagttcaagttgatcaagtggctcatctccgagaggaagttgacttgaagacttttgctcaagacaagtacaagagaaagatagcgaagatacagaagacaagtgcccctttggttgatgaaatagaatccttgagaagattaaagctggaagacgaaatcattgatgcagaatacacccagacctgtgatagaattgtcagcttngaaggacaaaggcaaggaaagattggaagaaaacattgggctggacaagaagggacatggtgcaacctacagaggttngaaattgggctccaagaagaggcttgaccacctcaccgttcggttggattccaaaaacaaatgcaggtcgagtccctgtcctccgaggaatcaactttgggactgnaaaaggagcgttttnnaggccctcganacnaagctcntcnctagcncctcnaaccctccgccaagggtaaacaccaagccgnacatggaagaacatnccacaaatctcccaaggcgcctgcaggtacgacgggcacaacactgggatatcatacga

SEQ ID NO: 34749 - DNA, 1326 bp, Triticum aestivum
  Clone ID: PAT_TA_34749
gaacggttccttatgaaaggcatatatgcggtagttctatttcacttcagatcaccgtatcaacgatggatatcctaaatggaaactgtcttttggatctttgtttattgcaagggtcacctaaagggaaactgtcttttggatctattgttattgcaatatctggttgtgataatttaaggatggcagcacattcatcatacacgggaattcactgggatttaaggatggtctatcccaaagtatctgaaaaaacagcaccgggtgcatgtttcccgcccaggagtatttggattgccttagccaacagatgtttctgatcatcgaaacgtgatcatagtaccaaaaatgccaaaccataaagaatgtgacccaactgcccaccttgaacaattacagggaagttcggcatctgggtgttctgtgcttaatgtagctgatgcaagttcgacaccttctaatcatacatattttgatgggcagaaaaccagatcgaattcttccaacttggatgggcagtgaaacgaaatgtgatcttgtaaagaggatgaaccctgcaatgaaaatttaccttgttaccccactactcgagacgaggccagcacgcgcacaacctcggggcggcacgagaagtctcctcaacatcctgacaccctgggggggaggggtaacgctactcctgtagcagccctctacggtatgcgggctgagccgccaactgtacaccgtgcagaacgccgccgacaggcccgcccgcggagaggtgccgccacatggaatgaagtttgctcccagaacatgaaacacatggaggctagtgaagggctaagaactcagattggcttgcagaagcaacttcatgcacagcttgagctccaaagaaagatgcagctgcaggtagaagaacacagcaagtacctggagatggtgatcgcgaggcagggcgagagcctaaagcagctcggcgcgctaccaaggttccagcattcgaacgtgcaggctgtggatcacaaggaagcatacagagaacaaacagcagacactgattcggccgaaatgagccatcgggagaaggaatgaccgcttctgatcattgcctcgggatcgcaaacaaacggagctgattagatcgagacaagagtagctcagaaaatgaggatcatagcctaatctaatttttgtctcgggtgatctttttcaggcactgtaattattgttggctgactttgctacatagatgtttgatttggaacgccgaacatttctttcttgataccaaacaatggtcaattttagtttatgtaaaaaaaaaaaaaaaaaaaaaaa

SEQ ID NO: 34750 - DNA, 511 bp, Triticum aestivum
  Clone ID: PAT_TA_34750
cacaaaaatgccatgactcagttgcttaaagtttgctttgttaagatgttcttcctgccaatgcagttgccatcttgatacggggcaaaccgtaggaatggcccgatcttcactatttggaggtggatctgggtgacaactgtggaaaacttttgaggaaacactcacatagacaagattcaccaccaaagtactcacatagacaagattcaccaccaaagtactcaaatctcatgccaaaacgagacgcacatcaagatccaagcagcaacaaaaggaaaagataactagggtagttcttccaaatctttaggagagatgggtcttgagagatagttattccccaatccaaaggatatggatgtcttgataatccaagaggattcttctcccgaaagagctcttgatctccaagggagagggtagattgagcaaagctctctcaagatttagtctatactttgctaaccctagatctgagagaagtacgggtatttatagcctaggcacg

SEQ ID NO: 34751 - DNA, 642 bp, Triticum aestivum
  unsure (1)..(642): unsure at all n locations
  Clone ID: PAT_TA_34751
ccacgcgtccgcgaggagcaaaaatatggctcgtgcgggggttatagaatcgaaaaaaagaagcaaacatgcccttatgcgctgcttcggccattgcctttcctcccacctgtcacgcaaaccttttgaggccttggtagtggactacgccgcgacctggtccacggagagagaacgccatggtggctcgcaggttcgtagtccggcaggtccccgccgacgaggagcacacggtcgagtacgacacggaagacggactcgacgtcctccggtttcagatcttctcgctcacctccgtcccgcccgacctccagaagatcgtagtggaagcggatggctccgtggtcgacgacggcaccgacctcgagtcaattcccgagggcctgtgcctcatgtccatttacgagggggaggacgcggacgcggcttcggcggcggcgccggcgcaggagaagtccgacgaggaactgatcaaggtggaggcggatggctccgtggtcgacgacggcaccgacctcgagtccatttctgaggtcctccgcctcgtccccgtcggcgagggggnngtgacgtggacgcaagctgcggctgcagctgtgagggcgcaaaagaagtccgacgaggagctcgcgatgatgattc

SEQ ID NO: 34752 - DNA, 2031 bp, Triticum aestivum
  Clone ID: PAT_TA_34752
tttttttttcttcgtctttttttgctgtttttatgttaccaaatcgacttatgttgttctttctcatggtacaacattcgatattattcccctttacattcgtgcaacagtattacatagtaaatagatacaaagaactgtgacataacattggtagctcatgtccaaaggacctttacagcaatgagtctgtctttgcaggtagcctcctgaagaagtttactggcgctgcgggcaccttgtggcgaaaccgtgggtgcctcatccagaagaacccaaggcagagcgcaatcacttgaaatggtgtaatatacagtataattgcagtgaacaggcaaaataataagaacatagctgttgctcttgggtccctccagctcagcagtgactgcaatctctcaccctgagttgcgatgtcgccaacaactgtctgtatcctgcctgcaacgtgtcgtagcctgtcatacctcatcctaatcaggtcagcgctcttcgaggttgggaacgtgtcaaattcctcatcaagctcgtctggatgcgcaacatccgcataagatatccttgtgttcatatgtggtgggacacgtggccggaaccgataattccacaacccaatcaagaacatgtagaggaagatcgtcggaaggataaggtctggatagaagacgagcatgatgaagagtacatggaccaagactgtggtgactgggtttttccactggcaaacgtcaccaaaccacttccctgcagcaatgaatccagagaagacttgcatcagacggaagaagtttgctttgcttcgtcgcatgctccacaggtgagagcgtgcgtctgacatgaactcaacaacttccctgcgaactggtggttccatgcgccccaggcgctgtgcaacaagctgcacagcctggtggcgtagcatttcctgctggactattggacagtggctgggcgtagtgcatcttgggcaagagaggacgtgagtatgtaaggaacacattgagcagggatgtgactgagaacctgatagcaaggtggatctcacccatctttttaacacctgatgggtggaggacaagcaggggatatgtgtgcgtgtacacccgcctagtctcaagggttgagatcctgattcggactttcccaatgggtttatccatatgactctggttgtggctgtggctgtggctgtgattgttgttgttgttgttgttgttgttgttgtctcctcctatgtggcagttgtcaaacagaccaatggtgagtaccgttccatggtcaaagacatcccatgtatactgctcattgaaccgagggttcaagttgtcaacaattgtgcgtgtccgcacccatttatgaccatacttggcaacacaatatggatcacatgaccccctttcttgcctggtctttgttgggttgaggccatttgcacttagaatcccaacttcaagcaacccaattggtggcttccacaactgcttcattgttggccggagatcgctacaatactgtgttgactcatcaagcacatgataaccaccttcaaggcaaatacgaaggttcacctttgcgtagaatttgtcttcctttagctggttcacatcaatcagtcctggccttctgagatcgaaccacaatggacgtactactgccttgtggtcagccctcttttgaatccttgcgagaggtatcatagtttcaccaatcacctcatctttgttctgtgcaacacgattttctatttgtatgatcaagtcatcctcaaaaggctctgctgcgacaaacatcatttcttcattccacatgaagttcttggttggtgagcgaacttgccttgtcttcagcagttggtgacccagcctcacctttacaaacacatcaggtatgtggtggtgttccattgtgaatatatcctgtgcctcaattacattgaccctgacgtaccacattctcggtgtagggtagacctttccacggatatagttgtgaagatgggaatctattggtgttgttccctgcatgaatggc

SEQ ID NO: 34753 - DNA, 876 bp, Triticum aestivum
  Clone ID: PAT_TA_34753
caatgtctggtgatgatgcgtcgatgagaaccaagagactgctcgcgaggcaagcaagggaggcaccgccagcggcaggctttgctattgaggaatgaatcaagtttagctcctgtgttgatacagcaactttggcaaactgtccgcagtctttgcatgaaacctcagcgatggaagctggaatggttcgtagtgtgatgtgacctgatgttatcaatgcagaagcagcgagaagtagttctgctgaagttcttatccacaatgagggaatgccagcatcagaaggcattggtttgacagagaacacgatcagcaatagttttgattgcatcgactcacaaggaggggcatctctggctgttcaacaccaattaaattctagtcctgcaattgataattctattaatcaggaatcttcaagtggtgaccatagaaggaccgaacatgttgagcgacagagtggtgtgggttcgcaaccattaccgggagagactgaccgacatttaggagatgctgaaatggaagttaacaccggcaatggagacaatactcaggcagatccaccggaatcacagactctggctcctgtgcccagccaggcttccttgcaaatgtctaaggaagttgaagccgaggccaatcttgtaatgccgtctgccgaaccaattgtagcaccagcaccacttctacgaagagaggcagaacaagtagaccgttctggtataacaccagcacagactttgcaagctgaaatgcaaccatcagcatccagggaactttctactccgacggatctgacaattcagtccgcacaaccaaatatggtgccaactgtgctttcacaaagagatgtagaacaatcaagcctactttctg

SEQ ID NO: 34754 - DNA, 535 bp, Triticum aestivum
  Clone ID: PAT_TA_34754
gacccacgcgtccgctggcatatgactaggagggtgtggcttggcaggggagggggcgtaggcgcgggcgtgagcggagatggccgggcgtgaacggagcgcgcgcgcagtggcgtcgccgccgccgccgccgccgctgaccaacgagctgtcgcgcaggacgccggtgctggggctgcgcctgtgggtgctcgtcggcctcgccgtcggcgccgccttcctgctcctcctcgcgctcgtctccgtccacctcgcggtggccgcgcggcggcgccgtcccaaggggaaggcggcgccggcgccgctgtcgcccgcgaccatcccgccggtgtccaaggagatccaggaggtggccgtccacgtgggctccctccgccactacctcgagatgggcgccgcgtacctcaaggacggcggcggcaaggacggcggcgactcgctgtgcggcagcgtggcgcacgggtcgcagcgcgtgcacatcgaggccggcaaggaccggcgcatggtggcggcgtgcgcggacgccgaggcccgg

SEQ ID NO: 34755 - DNA, 995 bp, Triticum aestivum
  unsure (1)..(995): unsure at all n locations
  Clone ID: PAT_TA_34755
taccggtccggaatcccgggtcgacccacgcgtccggagacagatgggagacgaccagatggagatgatgttgaactagcaattctagaagatgatctatatcactatggtagtaacagtgaggagatgcttctcgatgagttgaaggtatctcgagcaatgtcaaagcattttatcaaggttacatctacagccactatcaaggaggcaacactgcttatgcacgataagcagcaaggttgtgttcttgttgtagacaatgaagattttcttgaagggattgttacagttggtgacattcgtcgcagaggatttgaatcaagtgaagatgctaatggtactggggaaaattcatctgatctggatgtgaattctgctcttgttacatcgtgcctcacacgagggtttcagtaccatggcaatgaaagagggcttgtgacctgctttcccgacacagatctgagcacggctaaggtgctcatggaagtcaaaggtatcaagcaacttccagtggtcaaaaggggggctggtcgtaggaatgatgggcggcgtaaagttctcgggcttcttcattacgagtcaataggacgatgcttaagggaggagctggagcggtggataccgatttatcanagagaattcccagcagccagcagttagctggcagtgagcatggaggcaccgaacatgcagagctgaagttttggttgtnattttnagtgaagaacataccaaatacataaagggacgtttcaacaaacttagggatttagggttaacttgaacacctcagttaaaagagtcaccaaatgtaaagtgttttggagcttgccaggatatacatttcgtatggnttacagattatnagacgtgatggtgtggtttcagctttgatgttttgggtctgacatggaatanactgggacatattcttgccttttgaactaatcaaaacaaatgaaatcggtattgtgaaantgtagactcggnaaaaa

SEQ ID NO: 34756 - DNA, 633 bp, Triticum aestivum
  unsure (1)..(633): unsure at all n locations
  Clone ID: PAT_TA_34756
atgagaacttccaagagattcatgaggaccaagggcaggcatcgacatcaagagcgaatgaccgcactaacaccgagctggagctgaagttatctgctgcctcggaggagctacagttccttaggtcaaaactgacactcatggagagatatgccaacatactccacatttcaatattccgcaagcccatggacgaacggacacttcctcgctcacttcaagagtctgcagtctttgacatcagaaaggaatttgagaacatcttggattcgtcagatactgatgaactcgctcgcttggagatgttttaccgtagcatgctttctggtgtgaaggacaagcttctcaagagaaaagttcaagtgatggtccaggaatgcattgtttcactctctgcagggaggcaaaccccgcgtggtcagtgagttggaagacagttgttataaactgcattttcactgtacagaatccaacctatattatacagtatgtgttaaaatcgcaataagctctctgtgcaaacctgttgtttcacctagtttgtcaactttctactgcaacgtagaccaattattgggtatcactaccactgaaggnncttggcnacaattntnggcacnatttgtgcanccn

SEQ ID NO: 34757 - DNA, 668 bp, Triticum aestivum
  Clone ID: PAT_TA_34757
aaaaaaggctcattactatctttggctcttcagagaatgaagatttactaaaaagtgatcatctatttgttttaccacaactggatcttcattatgtttcaggaatttcaagattgatagctaccctgagttggacgctaccggttcattagttctcactgaggttggtccatttttcagtttgaagcttttagattcacagggagacttgaagcaagattttgacttgtcccaaaatcagattggtgaaacgctggagttatgttcagctgtgtactatggctcaagtgattgttcaggttcatatacacctcatcatgttgagttgcatgggcgaacattcacagttcttctaaggaatgatcacaagctaacactggcagggcagtacgaggggttcaatgcttcactccttgatctactgtcgaaggaacctgctctaaagagaaaacatataattgggttcttccaccagcaagcagcatgtcttcattaaaaataggttcctatctatccttcagtctgtggtgcttgaatatgtgaatctatttgcatcaggaagttgttttgcatcagatataaagttggacaatgtcctcataagaggacatcaaattaagatatatggggttatggtcagtaaatatgcaaattaattggcagtcccc

SEQ ID NO: 34758 - DNA, 1839 bp, Triticum aestivum
  Clone ID: PAT_TA_34758
ggtcgacccacgcgtccgcaatcgatcgaaggaagcagagctgggggatcgcggcgccggcggccggcggggggagaaccggaggggagccgtggagcgatcaggggggcatctgcgcccgatgtgggcgtggggcctcgccgagcgcgccatcgccggcctcctcggccccgccggcgcgaatggcggtcgctggaacaccgccgtcgccgtcggggtcacggccgcggccggcatcgcgctagtcgccatcgtcgtctcctcccgcaggggcgggatcaaatcgccgtggcggcggcggaggaagcgcgcgcttgggcccaaggaatggcgcagcttgttcacgccggaggggaagttttacgacggcggcgtcaagctactgaagagagttcggaacggaggggttgagccgagcatcagagcagaggtctggccgttccttctgggagtttatagcctgaatagttcagaagctgaaagggaagcaattaaggcccataacaggaagggatatctgctcttgaggaaacattgcctgcgaaaaaacaataaagaaagcgtggatgatcatatcacgagtgaggaagaaaatccttgtgtcatttcagagcaagaaatgcaggataagacaggtaaagcaattccagagaatcaggcggatgaaagcctctgttcatctagttcacgtgatgaggatgagagtgagaaaagtgatgtgaccgatgtggaagcatcccgtgatgatgtcgcctctgtggaccagtcttcagttgaggatgaagaagaaagtatgcccctgcccaaatattcaaacacaggaggaaatatagaaactgaaactaagctatctaaggttgcccgtcctgtgaagtctgcacggacagttgaggattttgagacatggcagcggataattcgtttggatgcagttcgtgcgaataatgaatgggtttcctactctccatcgcaagctgcggttaccagggagaaggcaattgaatctgcttcatctgtttgtctcaaagactatgagcacttggaagcacacaggatccatcatgcgtcacgtcttgttgcaatacttgaggcgtacgcaacctatgacccagaaatcggttattgccagggcatgagtgacctccttgcacctctccttgctgtgctggaggaagacgatgaagccttctggtgctttgccggtttcatgaggaaagcccgccacaacttcagactcgacgaagtgggtattcgcaggcaactcaacatggtctccaagataataaaaaccaaggacttccatctttacgtccgcttggagatgcttgaagctgcagactgcttcttcgtctatagaatggtggttgtgatgttccggagggagctcaccttcgagcagaccctcagcctgtgggaggcgatgtgggccgatcaggcagcgaggcgggctgggatcacaagatcatcctggagaaaacttcagcttggagcccctccaactgatgacctgctgctgtatgcaattgcagccagtgtactggagaagaggaaattgataatagagagctatagcagcatggatgagatcattagggactgtaacagcatggccgggcagctggacatttggaagctcctggacgacgcccatgatttagtggtgaccgtacaagacaggatcgagtagctgggatctgcccatgcttatatctgtatgattggtcctggcagttatcacgttatcatatgtctgttatatacaatatcttgtatgaggttatggatagaaacatttttgtcttgttttcaaaaaaaaaaaaaaaaaaaaaaaaaaaaaaa

SEQ ID NO: 34759 - DNA, 832 bp, Triticum aestivum
  unsure (1)..(832): unsure at all n locations
  Clone ID: PAT_TA_34759
caacccccgttttcgnaggggtcnttcnttagtgnattgagnangttggctttgtntancagtgaaaggntttntcaaggttattgtacccggttttcccgtcagagtttaangacgccntnggnggtatagatcctttaggngattggtaccggcccccccctnggngtanttcttgncttnagtaatttnccttaaagttaaaaggccagttgtnnattggttaaagcctccccaaaaagtttatttggaagttggaagagttggaagagcctttcgggcaaattttcaagggactatgncggacttccggatgcggacgatttggtcatattaattcaacagccggagatcagcccgaaaagtttgggataggtttctttacttaaaaagacccagttgtcggactgttcggatgccgcagcattgtcagctttcaagcatagcgtccgtgacgaatggctcgccagacacctcggccaaaataagccgagaacgatggccgcattaacaaacctcatgacccgcttttgcgcgggggaggacagctggctagccagatgcagcaccagcgaccccagtacatctgaagttagagatggaaacgggaaatcacggcgcaacagcaataacaaacgccggaataaagaagacagaacgaagggcacggcagtaaatgccggattcaaaagctctcagccaggccaaaagccgccccctaaaggcaccagggacgaattgtccagcccctggtaaacttgctaatcatacccagtagataatgttgggtcttcaagcagtccggcaaactcaacgccggtcgacaaggggg

SEQ ID NO: 34760 - DNA, 524 bp, Triticum aestivum
  Clone ID: PAT_TA_34760
ccaccaagcagcaggtcgccatggcggaggagcagatggaggaggaggcggcgtcgtccgcggcggcctccggcacgccgttccagctccagttcgacaagcccatccccttccagataaaattggcagagtggaacccagagaaggatctgcttgctatggttactgatgactccaaggttctcctccatcgcttcaattggcaacggctgtggactatatcccctgggaagtgcatcacatcaatttgctggagccctgatggtaaaatagtagcacttggtacagaagatggctttgttcttttgcatgtggagaatgggaagatgttacgaagtataaaatctcatgatgttgccatcgtatgtctgaattgggcagaagacgaaccactatcaaggactgacaaggaagacttgttatcttatgaagaccgcactacacgtttctttcctcctgctcccgtgatgcctaggataggcgggctcaattcgggagatactggtcttgcagatgagaatgaa

SEQ ID NO: 34761 - DNA, 388 bp, Triticum aestivum
  Clone ID: PAT_TA_34761
gcgttgatgcgaaatccatcatctttcaaggtctggttgaccggaacagagcccacagagagggtaatgacagagatgtacccatcagcagcggagtgcatgtctccggaccagagtgtttcagcagagccatcagggccgcggtgattcctcccaacttcaggttggtgactggagtcagcaagttcaacggtgagtctaagcccgatacttggcttgaggactaccgagtggctattcagatcgacgatgggaatgatgaggtggccatgaagcatctgcctctcatgttggaagggtcagccagagcatggttgaatcagttgacacccagcagcatctacacttgggaggacctctcctgagtgtttgtcaggacgttcgaagg

SEQ ID NO: 34762 - DNA, 667 bp, Triticum aestivum
  unsure (1)..(667): unsure at all n locations
  Clone ID: PAT_TA_34762
cccgcgcggcggcgcggctgagctccgaggtcggggccggggccgtacggatcgagggacggcgatggacggcggggttgctgctgcggtggctgcggcggcggcggcgtcgacggtgcgatgggcggtggcgcctcctggggcggcgggggcgggggcgggcgcgccgccgccgttcctgatgaagacgtacgacatggtgggggggccggccacggacgccgtggtgtcgtgggggccggccaacaacagcttcatcgtctggaacacgcccgagttcgcccgggacctcctccccaagtacttcaagcacaacaacttctcctccttcgtcaggcagctcaacacctacggattcagacaagttgatttctccaagtgggaatttgcaaatgagggttttttgagaggacaaaaacatctactgaagaccatcaacagaaggaaaccatcgcatgcaaacacccaagtgcaagtgcaacagcagcaaccccagcagcagcagcagcagcagcaaccccagttgcagaatgctccaatgccttcttgtttcgaatgtcaancctctgttaaagtggaattggatgagnaaataatcaanaggaaaactnaatgagactnagtaaanaaanncatacacactcanttgganttngatggacaaaaa

SEQ ID NO: 34763 - DNA, 593 bp, Triticum aestivum
  Clone ID: PAT_TA_34763
catgtaggacccttcactgaattgaactaagagagcccgggacagtgcctgttgtagtggcagtggcactaaacagctggaggaagagcccccatgatcatgggtgctctttgtgatttttgtggggagcaaaggccaacaatttattgccgatcggatgctgcatccttatgcttatcgtgcgaccgtaatgtgcattcggctaacaccctttcccagcgacatatgaggacccttctgtgtgatcgttgtgcttcacagcctgcagcagtccggtgtcttgaagagaacacctcactttgccaaaactgtgattggaacgggcatgccgcgacatccttggctgccgggcatctaaggcagaccataaactgctactcaggatgcccatcatcagaagagctggcaagaatctggtcctttgatgcagatgccccttctgcagctgctgagccgaactgcgaggaaggaataagcatgatgagcattaatgacagtggtgtcagtaatcattgtggcgctcaacaggatagcagcttgctggatatggctaacacatcactcatcagtgatccacacactggcgaaaagct

SEQ ID NO: 34764 - DNA, 706 bp, Triticum aestivum
  Clone ID: PAT_TA_34764
cacgagcttcaaaacaacatataggaccaacctctatgacatgctgtttggtctattcgtgggggtgaacaatcatttttaaagcattatcctggctggggtactgatatgctgcttgataaatacaatttgaggacggtggggaacactgaaggtggtgacacccgagcaagaatagaggttcagttcccggacacgtcgagcttggggtcgacagcgagcgcttggagcacgaacttgacgccggagcaaggaggccatggcatcgacgacgtgagcggaaatattggttctgttgtgctgtctgttggtcttccgaacttggagaggtgatacagccggaactctcttcagagaagattttgaagctaactggatgatagggtcagagatgatacccttgaaggattcagcaagcatgacccagctgccgtcgcgttggccagctaagatggtgttgactctgatgtggacaacgggtcacgcgtgatgtatgtggccggagaggttgattccggtggagtagagggagttgagcaaagtactgtgtttgctctgctcccgttgtgcaagatgggcacaccatcttcaacagtttgttgtggtgtgcgtgcggtgtgcttgaggttccagacaaaaagaaaactcgttgagtgtgattacgtcatgatttatgaagggaaactctagtttgtgcttgtaaaac

SEQ ID NO: 34765 - DNA, 788 bp, Triticum aestivum
  Clone ID: PAT_TA_34765
gccttccccggccgcgccgcccactcccgactcccacttcccgacggagccgatggcgacgctgcagctgaaccacatcgcgcgggagaccggcgacgtgcggggcctggccgccttctacgaggaggtgctgggcttcgagcgcgtcccggcgcccgcctactccggcttccaggtcgcctggctccgcctcccgggctcccccgacgtcgcgctccacatcatcgaccgcgacccggccgccgccgccgccgctgccgccccggggggctccacgcccgcgcagagctgcccacggcaccacctcgccttctccgcgtggccgacctcgacggtcctcaccgggctcacaggacgcgcgacacagagcttcgagaagtctcagagccagacggccgcacgccaggtgtccttcttttagaccccgacggcaatggtctagaagttacaagctcgagcccaggcgataagtaacctgctgggagcaggaaacaccttctatctctgcgacacatgtgcagtgatgcccacctcgaggttgaagatgatggaagctgcagaatctgagagaaaacatccggtgccatgcgttactcccaaataaataatgaccttggtacctatatctatctgctccccatgcctgtaatatggatatgcatgtctgagactcaagtactgaacctgtgctgtgtgttagaacatcaagttaaattagtactaccacaaatgatgtgcccttgctcatcaaaacaataaaaaaaaaaaaaaaaaaaactcggctaggg

SEQ ID NO: 34766 - DNA, 807 bp, Triticum aestivum
  unsure (1)..(807): unsure at all n locations
  Clone ID: PAT_TA_34766
tgtcgatgacctcgacggttcatcaagnaggaaanagtactacaggaagatcggcaaggcgtggaagcgtgggtacctgttgtacggcccgccgggcaccggcaagtccagcctcatcgccgccattgccaaccacctcaggtttgacatttacgacctcgagctgaccggggtcaattccaactcggacctcaggaggcttcttgtcgggatgaccaaccggtccattctcgtggttgaggacatcgactgcaccattgaactggagcagcgggaggaagatgacgaggaggattccaaatccaattctacagaaaagaaggcacaagacaaggttacattgtctgggctgctcaattttgtagacggcttgtggtcgacaagtggggaggaaaggatcctcatcttcaccaccaactacaaggagcgtctcgacccggcacttctgcggcctggcaggatggacatgcacatccacatggggtactgcaccacggaggctttccgaattcttgccaacaactaccattccatcgactaccatgccacctatccagagatcgagaagctgatcgaggaggttgccgaggtcctgatgaggaacgacgacactgatgttgcgctgcatgatcttgtcgagctcataaagttaaagaagaaggatgcgactgagatcaaaactgaaagtaagaagacagagaagaaagatgccactgatgacatcaagattgaggctacgcacgtggatgggaagaaagatggtggtgagatcaagactggaagtgtgcaggtggaggagaagaaaga

SEQ ID NO: 34767 - DNA, 2249 bp, Triticum aestivum
  Clone ID: PAT_TA_34767
gccggccggtccgggattcacaccatcaggaacagagaggaaacagagcccccaacccaccccaccctcacacagaaaagaacaaacatacaagagaggaggagcaacagggagccatggcgccgtcctacgataagaccattgccactgcggcctccctcgcggcatccctgatgctcgtccgcagcctcgcgaacgagctgctgccgtccgagctgcgtgacgcgctgtcttcagccctcgccagcctccgctcgcgcatgacgtggcagcacaccatcgtcatcaaggagatcgagggctggtgcagaaattgtgtctacgatgccgtcaatgcctaccttgccacgcgaaccagcgccagcctctccatgcagcgcctgcgcgtcagcagcgccgacgaagctgagaagatggtcgtcagcatggaggcaggcgaggagatggcagatttgtatcaaggagcggagttcaagtggtgcctggtcacccgcgaggtcaggggcgacccggacagcgtcggcggcggggcccgtgaggtcaggtcctacgaggtgagcttccacaggcggcacaaggagaaggcgctcaaggagtacctcccgttcatcgtcgccacggccaaggccatcaacgaccaggagaggagccttagcatctacatgaacgagcactccgacgagtggtccccgatcggcctccagcacccctccaccttcgacacgctcgccatggacaacaagcagaaacagtcggaggacaaggtccttaacatgttgaccaagaagaaggagacacacgggaggatcggcaaggcgttcaagcggtggcacctgctctacgacgtcggtggtaccgggaagtccggcctcatcgccgccctcgacaaccacctcaggttcgacatctacgacatcgagctcaccggggttgactccaactacgaccttaggaggcctcttgtcgagatgaccaacctgtccattcgcgtggttgaggacgtcgaccccaccttcccactcaagcagcgggaccttcgccacccgcgccactccaagtccaactctgcagcaaagaagaaggcagaagacaaggtaacattgtctgggctgctcgactttgttgatggcttgtggccggcgagcggggaggaaaggatcctcatcttcacatccaacggcgaggaacgtcgcgacccggcactccggcggcctgggcgcatgcacatccaccctcaccggcgccaccgccccacgccgccggtccggatccttcgcccccacgctcaccggggtcgcctccaactccgacctcaggaggcttctcgtcgggatgaccaaccggtccattctcgtggtcgaggacatcgactgcaccatcgaactgaagcagcgcgaggaagatgacaaggagcatgccaagtccaattctacagaaaagaagaaggcagaagacaaggtcacattgtctgggctgctcaattttattagatggcttgtggtcgacaagtggggaggaaaggggcatcatcttcaccaaccaactacaaggagcgtctcgacccagcactcctgcggcctggcaggatggacatgcacatccacatggggtactgcacaacagaggccttccggatccttgccaataactaccattccattgactaccatgtcacctatccggagatcgaggcgctgatcgaggaggtgacggtgacgcctgcagaggtcgccgaggttctgatgaggaacgacaacactgatgttgcgctccatgatcttgtcgagctcctgaagttaaagaagaaagatgccattgagatcgagaaagtaagcaggcagaggagaagaaagacgccaatgagatcaagacccagagtatgcaggtggacgagaagaaaattgttgatgagatcaagactgaaagtgtgcaggtggagaagaaagatgacaaaaaggtggtggtgaagagtgaattcacagaaaacggaagcggctaggagtgtggaagctgatggagaccagagagtgtgcgtaccctgtagataggtcctacaggatccattggaacatctgtcagatcattttgacaactaaaaacattccctttttttagtagttcgacgcacctgtacttaacagtgtgcttctaaataactttgtaaggactgttgcaacaagttacatatatgcaacttgacatcttgccttgtcaccctacacacagccaaccctcagacacaagcagag

SEQ ID NO: 34768 - DNA, 613 bp, Triticum aestivum
  Clone ID: PAT_TA_34768
gcgacccagtttctccatggttcaaccttcagaaacctaaaaaggctgtatagatcctccaagttgttctgaattggtgtaccagtaagacaccagcgccgatcagcagtaagagcagcagcagcttgggatattaaacttttagatgactttatcatgtgcgcctcatcaagcacaattctaaaccagtgaacagagtagaggccaccattttctgtagaactctcggttgaaaattctgatgccacgactccataggtggtcaggacaatatcattctgaccaataaagcttgcttcctttggtctgctttggccataatgaacatatatattcaaagaatccggttttgtatgagcttcaatctctgccttccactgactcagtagtgtcatcgggcagataactagatttccacctccaatcagtggggccttaggtttcctgagcttgctaaaagaaaaagggctagctagattcttcacggaatcaagggactgaataggagtttcacccagcccactagcttctccagagatctgagtactatgctgaggtgtgacgcgccctttgctagaatcagaaagaagaagacttatcgtcatgatagtct

SEQ ID NO: 34769 - DNA, 775 bp, Triticum aestivum
  unsure (1)..(775): unsure at all n locations
  Clone ID: PAT_TA_34769
ttgttcccatcgatacctctggtcgcagaagaggactcggcatttatacggtcctctaatgctgctgatagtaagagtaatacacttgttgagtccatttcaagttttttcacaaaacatgtgaataacaacggtcctcctttaactcatgatgatgtgttgagagctattgacagaggaggcaaggatgcgggcgcgctttgattcaaatcctgctacttattggctacttgacccgagggagggtaccaagggtttcttgaaaggagaggattctttgtatgtggtatgtttctttgtatgcattttatgactcatgattagattttgttgatcacgtcactagtgaaatctggaaaacagccattgttagagcatgctacaaaaccgcacaagcatacaacttcgttatgggctgcacattcatgcatgcacaaaaaatgttttccccatcgaacaagcatgggactcatgggtctttcttggtagccacatttcgtgttgaccatgctcacttttgtgggattatctgtattgacactatggacaggcctgggatacttggtgaagtactccccacttgtgccaagtggtcttgggttcgatgtggcctctctgcattgcaccatgcaggggtaaggcttacctcatataatccttccccggacccacctggtgtgggagcttctagcactgggtctgtcctatcatttatctggatcgacactatttgngtagtttgttncaatactttggtcaaccactacctgtagca

SEQ ID NO: 34770 - DNA, 700 bp, Triticum aestivum
  unsure (1)..(700): unsure at all n locations
  Clone ID: PAT_TA_34770
gactattcccgcgccacggggggctctccggcgggatgctctccggcgggggcgccagcgccggcggcggccgctccggggcacgcgtcccccgcgccctcggcgtccacaactcccgggtccaaatcacccggcccccccgtcatcttccactccagcgtccactcaactccgggttggactacagcgggtcggcccagggcaaggccctcggccacgaatgcggcccggaatattgatgggcttaaatcttttggtcagttgggttggttcgcgcgtcatggatctgaggtcttctccttgctcttgaccaccggttccagaattgcactttgtttggcgatttttatttggttccttctatctttttgagacgggtgattgaactgcagggctccagcgggatggctattgcttctgctgtgtaatccagagtaggctgcttccctccgttttcttgtaatcccctgccttctattccttctgtacatatgcgattttcttttctttgtttggaatcccctgcctctggactggatatatctctcgccatcccgttgctgcgcaggtccaaattcgccgtgatgtttttatacacaaaacttatgttccttttgaatctcaaacatgcgtatataccacactctccttgttgctgggtcgtcttggggtgtccgcttacttggaccgattntcgttn

SEQ ID NO: 34771 - DNA, 896 bp, Triticum aestivum
  unsure (1)..(896): unsure at all n locations
  Clone ID: PAT_TA_34771
cgcggcgcccgtcgccacctcgcaatcgcccctcctcccggcgcccgatgctcccgctccaccgcggcgccctccccccagccatcccccctcccccctcgcaatcccgtcccctcgcccctcatccaccgcatgtcgtgcgctccgccttctccccctcgcaaccgcctcgcgtcgtccggtctctatatccctccgcggaaacctcacgcgagcccatcacatatcccccctcccaatcccgtcccctctccgcggcaatctgttccgagcgtagcccgttctgccgtctcatccatcccgtttcgcatcccatttcctcacgccctcgtaagcgactttccccctcctcgattgattgcagcagagcgacccctggccggtggtgcgtccgtactgtatcgacaccgtcggcatttccggccattggttcggttcctgagggaaccggtccaagagaagtcacagcagaggtccgctcaagatgttttacgcgggctatggttacctggccagctggtttgagcaaacgtaccgctgctatccagcatctttttttgacaagccacacctggaaggtggtgacaaagtaataatgccgccatctgcccttgatcgtctggcttccctgcacattgagtatcctatgctatttgaactgcacaatggtgtcaccgacaggatttcacacggtggtgtattggagtttgtagcagaagaaggcatgatcatcatgccctactggatgatgcaaaacatgcttcttcaagagggtgacattgtacctgccccgcccgccactcgaaatantaagnncacctaacacgatccggaactcaatccangcactgggaaactaaaaatcntctaaacggggaanacagggttnaaacaca

SEQ ID NO: 34772 - DNA, 660 bp, Triticum aestivum
  Clone ID: PAT_TA_34772
cccagtcccagtccactcaccagcagagcagtaggagtagcgagatggctcccaagcgccgcggcagcaaggtggtgagctccgtggtgaagaccaaggtggtggaggagaccgtggaggtcgccaccaccatcctccccgcctcccagtcccagtcccagcccgactccgccgcccaggaggaggacctgcagcagccggaggtcgtcgacgtctcccgctcccgcgacgtccacgtcgaggtcgtcaccacccccggcgccaagaagcagcccgcctccaagaggggcgccgccaacgccaagccgccggccgggccgtggtggtgccggtctcgccgtcaccacacgagcaggaggtccagccggcggaggagcagcagcagcgcaagaaaggtggcggcaagccgccggcgtcgctgcagagccaggagacgcaggaggaccccttcgtgtaccaggacgagaccgccggcggcaagaagcgcccgcaagaggatcccacgccggagggccccgagacgccgacgcagaagaggtccagggccgagggcaaggccaagacgcgcaaggccgaggccgcggcgaggaagaagctgtccgcggcggcgggcaaaggaaaaggcgggcgccgtcgtcgtcgtctgggagggaacacgtc

SEQ ID NO: 34773 - DNA, 1581 bp, Triticum aestivum
  Clone ID: PAT_TA_34773
agatggctcccgagatgtggtacattgagctggctgttggtgggagcaaggtgcacgccggatgcaacggcaagctcgtctggcgccacaccccatggcttggtgcacattctgccaaggggcctgtccgccctctccgccgctcgcttcagggtctggatcctttgaccacagcaagcatgtttgctggtgcacgctgcattggagagaggaaggtgaatggggacgattgcttcattctgaagctgtgtgctgatcctgagacgctaagagcacgcagcgaggggctcgcggagatcatccggcatgtcctctttgggtacttcagccagaagaccgggcttcttgtccacctcgaagattcccacctcactcgaattcagtccacaaccggaggtgatgcggtttactgggagactaccatcaattcattcatcgaggactaccggccagtggaggggataatgattgcacatgctgggcgctcggccgtgaccctcttccgtttcggagaggttgccatgagccacaccaagactcgcatggaggaggcatggagcatcgaggaggtcgcgttcaatgttcccggtctctccatggactgcttcatcccacccaccgatatcaagtctggatccatcatgtgagaccgtggagcttccgcagagtgggaagagcaaggccggtggtcttctcccctgccatggtgccaaggttgctgctctagagaaggccgatgataatgttgcgtggcgcggccccctccagcgagattgcaactgattgcctggtctgttcatactgctgcttgcagtgctactgactcattttgatgaatgtagggtagaaagagaagggcaaaaggaggatttggatcttggaaattccaaatgccccctgtaaatagggaaggttaagcagtcacatggtcttcctcttccatatccctgaccctgaggagaggccctgtgtgaagaatcctttttgatctcattcagagataatggtgtagtaggcagtctttctgggttttttttttgccagtgcctgtggaagaagaaccaggggtgttctcctccatccatccagccacatgattaaccatcatggtggtggtgctgctctttccttggtagcaatactaattatcagaggccagcgaggaagaaggacttcttcgtcggcagccgagagtgatttcatcgttcctaattagcagtcgagtgtgctttggtttgaaatagtctctggtcaaactaacttttaggggagactgtaaggtcggtccagagtggttgttgctcattattttagtgttccatatcatgggtccgtcggtctagctgtttttttctctccctttctccttcacacatctctctttatttagtatgagatggtggtgattgtattttacaggagctgctgatgtatgccaaaaacttctatgaatggattgaggtgtttttccgtttgtgcactccttcttcaaccccacttttactattacatgctgaagtgttggtgatatttagctttgtgatgtgccatattgtagtaccataatgcagcatcagtggg

SEQ ID NO: 34774 - DNA, 2143 bp, Triticum aestivum
  Clone ID: PAT_TA_34774
ttttgtcctcatccgctatctgcttgatattatcatcacatctccccggcgcccgacccacggagcccaaccccgtcctcctcctccggcccctctccgccgccagcctaagagctgaactatggcgaagatcaaatccaaacggcattgctgggcacaggaaggcaagcacaaaagaagggccctactcagatcggcctggtgaggatcatcacctacacagtccccggcgccctagcactgtcctccctttacactgcctatcatggtcagggcagagcaaaggaccggccgttgcggcagcagcaggagcagcacaagtcgtcgtaggggaaccaaagactcgggcacatagttcattttgctgctgttgttgtattttcttgtcttttttttcctggttgtctggtgtacggtaaatttgtgggaacatagagatgaggattcgacgtctccgtggtagcattacctgataaattgccttaacatttctgcttaatatttccttctttgaattcgagttcagaaattaaagttaatttagttctggccttctatccgcttttcagaaaattatagcaaccttgccaaaagtcgcagtttgtcacacccctagattatgttgccaatccaagcaaaaccaaccaaaccagacgtaaattaatgcacattagttcatgcaacggaaatataggtaaaactcaacaaaactgcgttaacatcagacatagcttgcgtgggatctcttcaaaaaataaaaggacagacccagtgcatagaagctcccacacaaggtggggtctggggagggattataggaacctagtcttacccctgcaaagtgcaatgcagagaggctggttcgaacccaggacctcttggcacaagtggggaggacttcaccactgcgccaggcctgccctctgccaaatagcttcttgactcctacttttctcaattgcagttctctctacgataagcaaatgtattattgctgaagtctcaggactggaaagagagaatccagtcctctggtgatcaattttaagcttaccagtcgtagccagagcacatcgagttacgattacttcggccaaattcatcatgctttcatactctgaatatgcttcatacatctagttcaatggtggtaaattcaggattatgacgagtagagatgccttcatttcggaatattctcccaatctcataaactttctcgagccctccaaccagcattcttttcaaatgcagctccgttgcaatcctcaagtaaagatccctttggagggagttatggtgagttataaaaggtcttgcttcagcgccacctgcttctccctgtagaactggcgtttcaacttcaatgaacccaaatgattccatttcttgcggatttcagaaacaactttgtcttgttcgaaacacatcagcaactcaggatttgcaatcatgtcaatgtactttggcgataccgcttgtccacatctgtcaagccatgatacttatctggtagcgggagtaaggattttgtaaggatttcgaaaaagctgacataaacagatagttcccctttttctgtcttctttatggacccacttgcacctaagatatcgccaacatcaataaatgccttcagttgctcaaactgctcctccgtaaggctgtctttctcacagtaaagctgaatagttccggagtcgtctcttatggtcatgaaaacaagctttccaaatgctcttcgggcaacgatcctaccagcaatggaaaccgacgcctcggtgcagacttcaccattctcgagatgggtgtacctctcctgaagctccttggtcgtgtgagtcctgtcccacttgtacgcgtacggttcgtaacccttccctcttagctcctcgaccttttttaagcgaatggcgcggatagagtcgcggtcggaggtggaggatgaggaggcgctgcggcggcgccggtcctgcggcggcttcgtggtggcggcagcggccggggagcagcagcggatgtggaaacggtgggccctcccggccgaggcggcggcggcgcgggaggccgcgaagccgaggagattggaggaagccctccatacccgcagcgcctccattagtcgcgtatccgagcaggtgga

SEQ ID NO: 34775 - DNA, 508 bp, Triticum aestivum
  unsure (1)..(508): unsure at all n locations
  Clone ID: PAT_TA_34775
gagaactcctcccaaagaaatagtgttccatggacgtcggtccttgattctgatgaaggagaccatcccagtccatgcccttgcgccaaaaggttctctttcatgcgttgaatccattcagggaagaaagaaagcgatccgttgaccacacgcgcagaatttcgcatgtgagtctacactgttcgtcgagttcttcgcgccgttctgtcaaactcgggattgacgatggtgttggacatggacagaaacaggttaccgaagaaggactcaacaacgaagagatctatgaagacgagggcgtcnactacgattattatgatgatcctgaggagtgaggacacattgactacatcgactgcctgtggctgagatggagttgctacgcgttatatattccactatgtttctgattgtaataaatgtcttgagacattccagtatgtatgccttgtgggaagagttgttaaacttatacttattttaatgttccgcaatgataccatttcac

SEQ ID NO: 34776 - DNA, 1225 bp, Triticum aestivum
  unsure (1)..(1225): unsure at all n locations
  Clone ID: PAT_TA_34776
cgcactctcttcccccgtctccgctcctttgcgctgcgagcttctctcctctcccgcgatctcctccactccacgatcgaatgggctcagcttcagatgatagcagggagcacctgctggacgtgggcgccctcgccgccgacggcgcagcagggcccaagatacgggtgcgcgggctgcggcggcggtcggaggcgagcggcgaggagatcctgcgcggggtggacctggacgtgccgcgcggggtggtgatgggcgtcatcggccccagcggcagcggcaagtccacgctgctccgcgcgctcaaccgcctctgggagcccgcccccgggcgccgtcaccctcgacggcgccgacatctgcggatgggacgtcctcgcgctccgccgcaaggtcggcatgctcttccagctccccgccatgttcgacgggagccgtagcagacaacgtgcggtacgggccacagctgcgcggcaagaagctcagcgaggcggaggtgaagagcctgctgagcctgtccgacctcgacccggccctgtcctcccggccggcgtcggagctgtccgtggggcaggcgcagcgcgtagccctggcccgcaccctcgccaacgacccggaggtgctgctgctggacgagccgacgagcgcgctggacccgatctcgacgcagaacatcgaggaggccatcgtgcggctgaagacggcgagagggctcaccacggtgatcgtctcgcacagcgtgaagcagatccagcggatcgccgacctggtctgcctcgtcgtcgacggcgaggtcgtggaggtgctcgcgccgtccgacctctccgaggccaagcaccccatggcccggcgcttcctggagctcagcagctgaatgttttgtttcgctgccgagaacgtcattgtccagtttcgaccgacctctgcttaattcggacacgccgctgtaatcttgcttcattccgtcatgccgctgtaatcttgctacgacgggcgaacgctgtgcgcgatttgatgggagacgagctgttgtacgtgcgtaaatgtacttctcgtatggactagcagacaggagtgcgtgtgcagacaaagactcgtgcaataatctttattaatgccgttgcagaattctgaacttctgtaatccacgcagggttttgaatatgggagttccgccgaaggtgcgcganaacgacttgaggcgcgtttggttaaaaaaaaaaaa

SEQ ID NO: 34777 - DNA, 1903 bp, Triticum aestivum
  Clone ID: PAT_TA_34777
cggacgcgtggggcgagatgctcctccggactccaccgcagcggaagcggcgggccgtccccgacgccgaccccgacgccaacctcgacctcgacctcgccgccgccgtcgccgtcgccaccggacggacccccgtctccgaccgccgcctcgtgccctacgaccgccccacggccctcgtgtccgcctccggcgccgaggagccctccgacgacatggtctgcacataccactgccgtcagatggtgaaatcggagttcgtggtggcactggacacagcggagaaggcggttcaggagtatcgagtaaagcttgacacattggagaaacagttatccaagagtgaggatgaaaggactacatatcatgataaactgaactatgtcgaacaagaactagcagcaacaaaagggcgggagactgcattgcaagaacggttattgaaggagctgggcgagtatcaggaacgataccgacagcaagtcaggaagataggggaacttgaggttaaactcaataaagagattgattctcgaattagcgccgaatcatcttcagcatctgcacaggagtcggtcaaggagttggaacgggctatgcagcggtcatctgaaaattcagaaagggagaagaaagcccttcagaaggaactttcatatatgcaagatgactcaaaactatccatctctaaacttaatgctgagcttgaaagaatgagcctcagggcgcaaaactctgagaaggaagcaaagatgttaaatgagcagttggaggacttgaaaaagcaattaaatgagtgtcttcgcgaaaagaacgaaaccgagctcagactactggattctgctcctttgtctgttcagcgtaatccaacagatgatcagaagttaataaaacttttgcaagaggagctccggaactatgaaaaagaagtgcacgaagctagaagattaaaatcttcccacacaaatgttgagctgctaagtgaaaagctgttggaggagcagagtcgaaggaaacgagccgaaacagaactatctaagctgcaagaaatcgaagctaaagcacagaagttggagctggaattagcgtcatgtacatcattacttggcaacatacctgatgtgtcttcttacagcaacattgcagatttgcaaaggcaagcattgacagacttgaataaattgggtgaagtaacatcacggttgaaagaattggaggttacgttggaatttgctgagatcagcaagcaacgtgcagaaggtgaagctacccttgccaaagagagagctgaaagtgctagcagggaggtcaagcgccttgaacttctgcttactgcagtgagtgaagaaagagatagattacgaaaagatcataatatgttatctaaccaaaaaactagggatggagatgacatgtcatccaagaaaatggagtcagatctatctcaaatggaaaaggtagtaagagaactagagaccactctacacgagcagagagaactaattagtcaacaacatgcggagctcaatctaatgaatgagaaattgagcattgaagcaagaaaagcaaaatcattggagcgagagggagatcaactgcgctctcaggtggcattactcgagtctaagctgggtcatggggattactctgcctcaagcacaaaagtacttcgtatggtgaatactcttgcaatggatagtgaagcaaagcagacaatagaagcactgcaagctgagttaaagaaaacaaaagagaggctgcaggcaatcgaagaactaaaagggcaagctgatgctggaactgtagtagatgcaaatgttgcagaaaagctagcacagcttaaaaatcaagttgccacactagagaaacgtgaagaaagataccaggcagtgtttctggagag

SEQ ID NO: 34778 - DNA, 905 bp, Triticum aestivum
  Clone ID: PAT_TA_34778
ccatgcttgtgtgcttcaaaattttggatgagttccctctgaatggaaccacaattatttactggattaaaaagggaattccttatccatctttgcctaagaaggaaaaaccgaggcgtgtggaattgtacttctcgagttggcgtattagacctgttcaatcgcccaaaaaagatggccagcaacccatggcatgtgaagtaactctgtttcactacgaggatatgggcatacccaaggatgttgctaaagttggtgtccgccacggcatgtggggtgctgttaaaaagctgcagtccggctttagagcatatcagctaatgagaaaatcagaaaacatcctgtcacgcagtgccatcatggctcgggtgaccaccaagacatgcattgctggttcagatggctccttggatcaagggcccttcagcacagaacaagccagtacagaggacgacaactccagggcagtccaacatggtttcgactggaagtgggtggtggtcggtggcgcggtggctgccgcttgcgtgcttaacactggaattgtagggaaggccctcttacttggagttgcaagaaggcaggcaaagaagtgatgagcatctaccagcatccacaaagtgagcttcacgaccatcagggcctgtctctgtctagaaagtcgcaatcgagaccgaggataaaggagtgaaatccataccatactacaggatgcagataattcgggtgcctaattttggattgtgccttttaagcagtatattgcaaatgtgtcttgctataaccgattatgtggtatcaggaatcgttagatgacgatgtatctgaagatgtgagttctgttaacaacatttgctaacttccaagttccaagagtgcactttcaacttggtaaaaaaaaaaaa

SEQ ID NO: 34779 - DNA, 718 bp, Triticum aestivum
  unsure (1)..(718): unsure at all n locations
  Clone ID: PAT_TA_34779
tcgaactaattctgtactagaccagctcatggtgtgggaagcatctcatatggttcaccgaatcaattgatgaatctgaagcgattcaagaggaggagcaaaaactgtttatgcctatagtgaaacggaaggccatgaacaacgcgtctccgggaagtgaattttatggtgcctttcattctgctcatttggcgcaattttaaatcacaaagtggaggggagaggtctggctgctactggtgggaaatgggtgcctctccagtcaaccgagcgacgacaaatccaactgggaagggctctgtggtgatcttcatgttatcagtaactgttcatgattttcctggctaacagttgttatctttcaaggctacgagtttagtcctgtatgcaatacaaaacattcaagcaaataatttgtgctttaccttttgaaacgcgtgtgcaacatgtttttttctcttttatccaagctactatgcaaaactgtattgttttacggccatttggttcacatgagtgagctttgtgggactaggatagtacatgcatgtgcagtattacagatacacaattagctgttgaatgattcttatttgtagttatctgaaatattacttcctgactttaaatttacctttctttctttatncatgtacaagctcaacacatggggttctcttcttgattcctgctggaaagcaagccatgcgtcagcgta

SEQ ID NO: 34780 - DNA, 1468 bp, Triticum aestivum
  Clone ID: PAT_TA_34780
aaacgtcggaggagcggagaaatatttagccctttgttgttgcctgctctagagcttgtttttgtttccatgagttggttggttgggctcgtgaatcatgtcagagatccgccgcgacgtgccggaagggacgggggcgggggcggaggggaagggcgccgattcccacgtcggcagccgggcggcgcggcgccggaggatggagatacggcggcatagactggtggccgagcatggtgcggaggaggtgtccaggaagaggcggaagttggatggagaatcctcgacggacgaggaggagattgagcccgccaagtacggcgtcacgtcggtgtgcggccgacggagggacatggaggacgcggtttccgtcaggcccgagttcctccccggccaccacttcttcggggtcttcgacggccatggctgctcgcatgttgctacgtcgtgcgaggagcggatgcacgagctcgtgtcggaggcgacccccggggcgcggtcgttagggtcagccgacgcggacaggtggatggatgacgtcgagaggagcttcgcgcggatggacgccgaggccgtgagctcaaggtctagggccagcggagcgcccacctgccgctgcgagttgcagctgcccaagtgcgaccacgtcggctccacggccgtcgtcgccgtggtcggccctcgccacctcgtcgtcgccaactgcggtgacagccgtgcggtcatcggccgcggcgccgccgccatccctctctctgccgaccacaagccggaccgccccgacgagctggagcggatccacgcggccggagggcgcgtcatcttctgggacggcgcccgcgtcttcggcgtgctcgccatgtcccgcgccatcggcgacagctacctgaagccgttcgtgatatccgacccggaggtgcgggtcctggacaggaaggacggcgaggacgagttcctcatcctcgccagcgacggcctgtgggacgtggtgagcaacgaggtggcgtgccacgtcgtgcgctcctgcctccgcagcagggcgccgccgcacccgcacggcggggacggggagcgttcgagcccaacctccaacctgagccccaggcagagcagcggcagcggcagcagcagcggggacgaggagggcgctgggcccagcgacggcgcagggtccgagagcgacggcgacggcgagagcagcgaggacagggcgtgctccgaggcggccatcctgctgaccaagctagccctggcgcggcagaccgcggacaacgtcagcgtcgtcgtcgtcaacctcaggcggcgcaggaggtcgtgatcggcggatccaacggactagccgttcttggctgattgatttgctggccgtccgtgaattcaaatcggagccacagttcacatttgcttcggccgtgcaatcattgaacaaatgtcaaagcaaagatcgaacagaacagtgagatcctta

SEQ ID NO: 34781 - DNA, 1372 bp, Triticum aestivum
  Clone ID: PAT_TA_34781
aaatccttcgtaccgaaacaagtatggtggatttgaggaaacttcaggagcaaattagcaccaaagcaactgctagaagtacatattttacacttcagcagcaacagtatgctgctctttctgaggaaaatgaagatactgatgaggagctgaaggagtggcaaacaaaatttgaagaaaaaattgcattactggaaacgaaaatcgctaaacttgaaagagagatgaatgatgaatatgcaaaaagctctctgctatctgagaccatcaatgattcaacacgcgaaataggaaagctccaggcagaagctgatgctcacatgtccgtgaagcatgaaagagattcagccatcagaacgatattcaataaacataatctcgggccagttcctgatgctccttttaccaatgatattgccatgaaccttacaaacagaactaaagcaagactatcgaatctcgaggacgatttgcaggaaaagaagaaaactaatgagacacagttagaatttctttggggacgttatcttaaagtaaatgctcgctactctgaagttgatggccagatacaatctaagaaggaatctaagataggtgttttaaggcgcataaaagataaagagaatgagcgagatgccgcagagacggagctttcaaggcataatctggcccgtattgatgaaagagagcggcatctgcaaattgaagttgagaggaagacaattgcgctgggagaaagagactatgatttgattataagtcagaagcgctcagagatatataccttggatcacaagataaaagcacttcaccgagagaaagataacatagcaactgatgctgatgacagagtaaaattagaactcaagaaggatgagttggagaagtgcaagaagaaacttaaaaagatatatgatgaacataaggataaatttagaagtgtccttaagggaaggcttcctcatgagaaggatgtcaagaaggagattactcaagctttcgggtctgtagactcagaatacaatgatttgaactcaaaatctcaggaagcggaacaacagttgaaattggcacaaatgaaaattgatgctgctaaaagccacttggcaaagctccaaaaagttttggatgcaaaaagaaagcatctgaactcgaaacttcaatccattgctaaggtatctgttgacatcaacgcttaccccaagattctgaaagatgccatggacgagagagataaacagacaaataatttcagttatgctaagggaatgcggcaaatgtatgaaccttttgaaaaagtggcccgacagcatcacaagtgtccttgctgtgatcgtgctttcacacctggtcgacgcggccgcgaattcgg

SEQ ID NO: 34782 - DNA, 663 bp, Triticum aestivum
  unsure (1)..(663): unsure at all n locations
  Clone ID: PAT_TA_34782
ctcgtgccgaattcggnacgagctcccggagaaggtaggggttgttcatcagttcatcgcgtcnccgancangaccgcctgaatccccctcctcgncttcctcggccttcccagctgctccgatggnggcctccgangctgagcagaaagtcgtggagcacgtccgctcggncggcaacgcgccgatactgaagcangacaagttcaagatttcaggacnagatanattcttgagggttattgaattcccgggacgaaaacttcatcaggatacactgtttgtctatgtcaacagttcgttttctccaagcccagacgagctgataattgacttgtataataattttgcaatagacgggaagcttgtggtaaactatgctttatcggcagcgtggggttaaaagattggatttgcgggaagaatcgaatggatcgaaaacgccgtttgaaatttgaccgttttactgtgtatagctggagttgtagttggtcagtcaaagaggcactagctctcacatatgttgatgatgaaagtaaaggttcttgcgagactgccttttctggcattgaactgtccaagtgttctctctctctacagtatgtttattggttcttgattcatgtcgtgtgtgtgattgggcctagagaaacggatggattttt

SEQ ID NO: 34783 - DNA, 539 bp, Triticum aestivum
  Clone ID: PAT_TA_34783
gcctcgagtggttctgatcctcaggtcatgatggagctggggctccctccattgcataagcttggggactctttgtgctcgtggttggcacgtgcaaccagcttactggagcgggcggatgcatcagttggtctgcaggggtcgttgccgacgatgcaggcggcgctggtggcaaaccacagggaccaaggtactgaggacattggcaacaccatgcagccgctgaccttggggttagttgctccggtggtggccactaagatcagcctagctagttctatctctgatgaagtacaggctgttgcaaagggctgcgctttcgcgattgatgaaggtgacactttgcatgacttaaccgagctgatcaaatgcctcattgccatgtctgccataacccagggattgattcgccttgtcaaagcggagcaaatcaaggatgccaaccaggtggtatgtgccgccgtgagtgtcaactctgcaacatgttagtcgccgctttgttccctctttcctcttccttttcctctttcctcttctat

SEQ ID NO: 34784 - DNA, 520 bp, Triticum aestivum
  unsure (1)..(520): unsure at all n locations
  Clone ID: PAT_TA_34784
ggccatcaatcccttcccaagttcccatctccacctccccaccccaccgcggcgcttctctcctcgtcatgcagacctagtgcttgctaaggccaccgccaccgctaggtttaagcttctccctccgtctccgccaccatggccgtcgacgccgccaccgccccctccgagctcgacggcagcatccgcggcgagggggaggtcgcggccaagccgcccccctccgccgctgcaccggcggcgcgggagagccccgaggagctggaccggaggtacgctccgtacgcgcggcgggacgcgtacgggcccatgggccgcggccccctgggggcggcggaggcggcgcggatgggccgtggccgcggccgtgctcctcccgctccgggtcgtttgggccgtgctcgtgctcgtcgcctactacctcgtgtgccgcgtgtgcacgctgtgggtgtngggaggaggaancggngggcgagggcgagggctacgcgcggctccaggggtggaggcgggcgtgggt

SEQ ID NO: 34785 - DNA, 1284 bp, Triticum aestivum
  Clone ID: PAT_TA_34785
acgatgatgactggagaaagctttgggatgactataatggcgaggaggtgaagattaccaaggaagaagctaagataattagtagactgatgaaggggaagactccacacgccaatgttgatccttatccagattatgttgactggtttgaatatgctgataaaggccatccactttctaacgctcctgaaccaaagaggcgatttgttccctcaaagtgggagcaaaagaaggttgttaaactcgttagagccattcgtaaaggatggatcaagtttgacaagccaaaggatgagccaaactattacctcttgtggggagatgacactgatacagcagacaataagcggcaaggcttgagctacatccctgcacctaaaccaaatttgccaggtcatgaagagtcgtataatccttctgttgaatatattcccacacaagaggagatagataactaccagcttatgtacgaggaggacaggccgaaattcatcccacggcgatttgaatctcttagaagtgtacctgcctacgagaaggcacttagggaaggatttgatcggtgcctagatctttatctatgtcctagaactcgcaagaagcgtataaacattgatcctgagtcgctcaagccaaagttacccagtaaaaaggatctgaggccatatccacgaacttgttaccttgagttcaagggccatggtggtccagtgacgtcgctgtcagttgaagcaacagggcagtggatagcatcaggttcatctgatggaacaattcgtgtttgggaggttgaaactggtcgctgtcttaaggttttcaatgttggtgctgatgtccatcatatttcgtggaatccttcacctgagaggcccattctggctgctattgttggccgtgatcttctgcttcttaacactgaggtgggggatgaggaaacacaagtgaggacaaaggagctcctccatgtagaggaaccgacccctgaagatgatggtgataagaaaccagctgtgaggtgggtgaataatgacaaatttgacggaatcacattgattcatcatagggctgcatcaaccgtggagtggcattcgaagggagactatttcacgacagtcgtgccaactggtgaatcaagggctgtactgttgcatcagctctccaagaagcattctcaccatcctttccgtaaattgccgggactccctgttgcagcagtattccatccaactcaaaagatgttctttgttgccactaagaagtttgttcaggtttatgatctccaaa

SEQ ID NO: 34786 - DNA, 1111 bp, Triticum aestivum
  Clone ID: PAT_TA_34786
ctctgtcgctctctatcctccaagggggaagaagggatagagtggggagcggagctcagctcacttcagcgggagctcagcccatggccatggcgacctccaccttctccgcccacccgctctcgctcaagccccagctcggccccaagccccaccgcctccacctcgtccccttcccgcgcctccgctcccaccgccgcctcgccgccgccggggaggcccccgtcgaggcgccacccaagccggcggaggcggatccctcccccgccgcatccaacgggtccgccgctcccgctgccgctgccgctgccccggtcgccgccgccgctgctccggtcgccgcggccaaggccgaggcggtggcgtcgcccaagttccagggactcgaggtgggtcaaccgggacctgggacctcagccggttcgggaacaccggcggcgccgtcgcagaggccgaccgtcatagacgccgaggccaggaggaggaaatggcttgaagattccccggaggcaagtagcagcgaagacgccgttgtgttcgacacttcgattatcccatggtgggcatggatcaagcggttccatctccctgaagccgagaagctaaatggccgtgctgccatggtgggcttcttcatggcttactttgtcgatagcttgacgggcgtggggcttgtcgaccaaatgggcaacttcttctgcaaaaccctgttgtttgttgctgtggctggggtgctgctggtcaggaaaaacgaggacatcgacaatctgaagaagctcattgacgagtcaacgttctacgacaagcaatggcagtcaacttggcaagatgattccccttccgggccaaagaaatagcttggaagttgaattttgcggtggctgaggggcgatgcggactttcctcccttatgttgtactgtttcttttatcagccttctttttcatcaaactttgtaataactatgccatcttgtaaaaagtacgaactcagttatgtgctagagcctagaggtaaacgcttctgcgggttatttaaaaaaaaaaaaaaaaaaaaaaaatcatagaaggaaaaatgatttatagaagaagtttatcagttgcagggtttg

SEQ ID NO: 34787 - DNA, 593 bp, Triticum aestivum
  unsure (1)..(593): unsure at all n locations
  Clone ID: PAT_TA_34787
aaaaaaagtattccttggacgaccgcaagaggcagccatggcgacggcggaggcggggggcgatggcttcgagtttctgtcggatcctgttgacaggttccccctgccggatcttggcggcggcgagtccatgctcgacgctgaacccacccgaactctggtgtgcacaaccgcctagtccaccattggtgatgtaggcgatgcggcgctgacagtccaagtagacctaaacaacacttgcgaggggctgagtttgtcggcgctgaactatgaggaatcaacgggcaaagatgatcctcaagccccgggctagacgtagagagaatacggtgtcatcaaccgacgtggccgcgccgaggactccttccctcgcctcctccaggaactgccccatcagcggtggcaaaaactgctccttgaacttggatggaccgcccgcccagctgcgctgtgttctgcgccacttagttcctggccaatcctgaaggcatcataagacattctggaatctggntagaatacttattgctttagtttgctgctaggtagcttatcccttcctgtgaatctgatagcaagaatacatagttgct

SEQ ID NO: 34788 - DNA, 1566 bp, Triticum aestivum
  unsure (1)..(1566): unsure at all n locations
  Clone ID: PAT_TA_34788
gcgaaattgcgtggtagagacctcgcatcgctccccacccgtcgtcacccgtgccgtagcctcacgggactcttttccctttaaatccccatgctctcccgtctccgcctccactcatccaatcctccctgccaagcgagccccagaaagtttccgatcgaatcgaagcaaaggctttctcgtccgcctccaagatgcagatctttgtgaagaccctcaccggcaagaccatcacccttgaggtcgagtcctctgacacgattgacaatgtcaaggcgaagatccaggacaaggagggcatccctccggaccagcagcgcctcatcttcgctggcaagcagcttgaggacggtcgcaccctcgctgactacaacatccagaaggagtccaccctccacctggtgctccgcctcaggggtggtatgcagatctttgtcaaagaccctcaccggcaagaccatcaccttggaggttgagtcatccgacaccatttacaacgtgaaggcaaagattcaagacaaggagggcatccctcccggaccaacacgcctcaccttcgctgggaaacagccagacgatggatcctccctgccaagcgagacccaaaaaatttccgaacgaaacgaaaccaaggctttctcgtcctccgagatgcagatctttgtgaagaccctcaccggcaagaccatcacccttgaggtcgagtcctctgacacgatcgacaacgtcaaggcgaagatccaggacaaggagggcatccctccggaccagcagcgcctcatctttgctggcaagcagcttgaggacggtcgcaccctcgctgactacaacatccagaaggagtccaccctccacctggtgctccgcctgcgtggtggaatgcagatcttcgtcaagaccctcaccggcaagaccatcacgctcgaggttgagtcttcggacaccatagacaacgtcaaggcgaagatccaggacaaggagggcatccccccggaccagcagcgcctcatctttgctgggaagcagcttgaggacggccgcacccttgctgactacaacatccagaaggagtccaccctccacttggtgctccgcctgcgtggtgggatgcagatcttcgtcaagaccctcaccggcaagaccatcacgctcgaggtcgagtcttcggacaccatcgacaacgtgaaggcgaagatccaggacaaggagggcatccccccggaccagcagcgcctcatctttgccggcaagcagcttgaggacggccgcacccttgctgactacaacatccagaaggagtccacccttcacctggtgctccgcctgcgtggtgggatgcagatcttcgtcaagaccctcaccggcaagaccatcacgcttgaggttgagtcttcggacaccatcgacaacgggaaaggcgaagatccaggacaaggagggcattcccccgggaccagcagcggccttatttttgccggcaagcaacttgaggacggccggacccttgctgactacaacattcaaaagggggccacccttcacctggggctcccccccgnggnggga

SEQ ID NO: 34789 - DNA, 628 bp, Triticum aestivum
  unsure (1)..(628): unsure at all n locations
  Clone ID: PAT_TA_34789
acactccattgtcccagtccggtccggagaggccgcccgtccgtcggcgcgcgcgcgatgctcctcgcctcctccggccaaatggcggcgctccgcccgccgcgcctcctcctcctcccgccccgcccggctgcgctgccgctccggcgccgtcccagcatgggcgcctcctcggcgaggcggcgtggcggcgctggccgcgtctgtgtgccccggtgcgcgggcgccacaccccctccgcaaacctccgcggtacaagtcccagctcgcagaaagtgctcgccgttgcttgatagtgctctattgcctggtggaagtgaattggctgtgcatgaatggaaggccgtccagatatttggaggacagcagcagaaaaataccctaccgtgtactctcagagatcttatttgatctcctctgaattgaattataacaatttgaacaacaaacattggattctctcanggtctgcgggttttggtggcgctcaagacaaaagnanccttttgctanaataagtcgtggcaatacagttaggaacatggtacggtgcgataagttttanngaaaaatctcgataanatgtcaatttagtanagaagactggacngaaaanatggacggatat

SEQ ID NO: 34790 - DNA, 779 bp, Triticum aestivum
  Clone ID: PAT_TA_34790
ggaaccctgccatggaaaacttgcctagccgccaccatccaccaaggcaccaacccacagcacacatcacacgtacgcgccgacggcgtacgccatgcagcgcgccgccgtaaggttcgcttccatggccggtcgccgcttcgctgcgtcggccacccgcccggggctcccaactggcgcggctcctctttggcctgccgcggcggtggtcaacggtaccacgcgattatccatccagccagcttttgctgctgccgcggcggctctgtgtgcccggcgcggttacgcgggcaggtctctgaagacgaagacggtcagcaaggaggaggaggaggacgacgacgacgacggcggcggcggcggcgacttcttcgatatgtcctgcgacgaggactccgacgacgactccgacagcgacgatttggaggacgctgatctgtatgcttccggaagtgacgagtaggaaccagtgaagaagcgcgggaggtgctgactgctgagagctcggctccgtcgagagattttgttgtttcgtttctttctcgagatggagaacaaaataagccatgccattttaccaccaggcatgctcaacattaagttgtagtatgctacaagaaaattgtttgtagtacctaaatttcagcttgttgaatcgtcaatttattgaatttcaaatttaaattcagagtgatatatagtctacagtctgtaggaaaattggtactttggcaataagaattcgacgtgcaaaaaaaaaaaaaaaaaaggggccctag

SEQ ID NO: 34791 - DNA, 1118 bp, Triticum aestivum
  unsure (1)..(1118): unsure at all n locations
  Clone ID: PAT_TA_34791
ggcagttctccggtcctgcccccaactcgaggagctctctgtcaagcggctgcgtggcctatccgactcatagcccatcaccgtctccagccctcgtctccagtctctggccctcaaagagctctataacgggcagtgcttctcctgtttaatcacgtgctcccccaacctcaaaaccctcaagatcatccgctgctccggtgattgggacccggtcctccaggcgatcccacagggttccttgctagccgagcttcatctcgaaaaactgcaggtcagtgaccttggtgtggcggcgctctgtgggctagaggtcctgtaccttgccaaggcgccggaggtcacagatgttggtctggcagcacttgccaccaagtcgccacgtctacgtaagctgcatgttgatggatggaaggcgaataggattggcgaccgtgggcttgcaaccgtggcgcagaaatgtgctgctttgcaggaattggtcctcattggtgtgaatttgacatcggcgagtcttgagttgattgctgccaactgccccactcttgagcggcttgcgctttgtgggtctgacacatttggggatgcagagatccccggcccggcgtcggcgcgtgcttctctgaggaagctgtgcatcaaggcatgccctgtgtctgatgccggaatggacaagcttgcagcaggctgcccacgccttgtcaaggtgaaggtgaagaagtgccgtagggtgacgtttgagtgtgctgagcggcttcgtgctagtcggcatggtgctcttgctgtgaattttgacacgccaggtggtgcaggcgaattgcaagatgctagtgtggatgagagtggtgtactggagaatgcagggagtgatgtggtacaagatgattttgatgatcagataggggttcctgaccttcctgtgtggcaccaagtggcagaccatcagggttggaaaagccccgattgttcctttgatatccaangagcttgccggtttccatgtttcccgagacgtccacgtgggagcccccataccctcgtgccgccgcaagtttttgccgccgggcgcccctccccgtctncctttaaggttggtacanttaatgagcctttttntc

SEQ ID NO: 34792 - DNA, 719 bp, Triticum aestivum
  Clone ID: PAT_TA_34792
gattcccgcatctctcgcaccgccctcactccgattcgtctctctcccccacttccgatccatccagacgccgagatctcgcggaggtttctcttgccggatcaggaggaggaaatcagtttcgcttgtgagtggtgaccatggcggaggcggcgccggcctcgccgtggtgggcggggcggatgacagcggcgttcggggcgccgttcctgtggctcgtctgcctgatctacttcatccagggtttcagatcttttgtctggacagctgtctcatatcaaatgaaggacatcatgaagctgtcaccctcaacatcacagtttttggtctctgctgcatttttcccttggagcataaaacctatatatgggattgtgtcggactgtattccaattaagcagaggaagcgtgtaccctatttgatcatttctagtggtctttctctatttccatggcttattattgggctgtcagaacatttgaggagctcaagcaatctttttacgctaatgttgattgtacagaacttgggatctgccatggcagatgttgttatagatgcaatgattgcagaggcagttcgatcagcagggcacagaatttgctggtgatctccagtcattatcttggtcatcaatggctgtaggggggatatttgggagcttattgggaggatacgcattgtccaatctcccaataaatgctatttatattatgtt

SEQ ID NO: 34793 - DNA, 536 bp, Triticum aestivum
  Clone ID: PAT_TA_34793
gtcgacccaggggtccccgcccccttcgcgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcatctaaagctaaacaagcgagggaggagatatcggagcaatttaaggatgctcgcggacccaatgatcgcttcaagcagtgatacttgccatcagcgttcccggtcatccgttcttgccctggttcgggatgccatccgcaagtggccattgtataaaatccgaatctaaagtatcttattttctatttagaaatctagacgcagtgaattaagtctgcccaagggaactaattctagcggagagactctccttggctggacctcggttttgcaaatttctatgcttgatgttgttttatgagtaatatgtaccatcgcagtctatctgttgttatgccattgcctggc

SEQ ID NO: 34794 - DNA, 575 bp, Triticum aestivum
  unsure (1)..(575): unsure at all n locations
  Clone ID: PAT_TA_34794
gtttccgcgctccacatttcgcctggccggcggcggcatcttcagcagggcgctgagctacgtcgtcaacgagttcctcgtcgagggcctcgccaacaaccgtgccttccagaggtttgctgtgaggaccaacaggactttggaggatctctcttctaaagctaaacaagcgagggaggagatatcggagcaattcaaggatgctcgtggacccaatgatcgcttcaagcagtgatgcccgttccgagtcatctgttcttgccctggttcgggatgccatccacaagtggccattgtataaaatccgaatctaaattatgttattttctatttagaaattgagaactagacgcagtgcattattgcatttctgcagcctgcccaacggaagtaattcgagaggagagactctccttggctgggcctccgttttacaaatttctatgcttaatgttgttttatgagtagtaatatgtaccatcgcagtctatctgttgttatgcccttggctggcaaatctatataactctggctgcgttgacaacctggaaagattttgccgctccnnanaaaaa

SEQ ID NO: 34795 - DNA, 747 bp, Triticum aestivum
  Clone ID: PAT_TA_34795
atcggtgagggagaagatccacagtcgatgcatcccaatcagcgggccgcgccgggatgcaccggcccccttggcgagtcgcctgcctccgcccccttcgcgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttagaggaactctcatctaaagctaagcaagcgagggaggagatatcggagcaatttaaggatgctcgtggacccgatgatcgcttcaagcagtgatgccttctatccgcgttccgagttctgttcttgccctggttctggatgccatccgcaagtggccattgtataaaatccgaatctaaatcatcttattttctatttagaaattgagaactagacgcagtgcattattgcatttctgcagcctgcccaacggaagtaatttgagaggagagaactctccttggctggacctccgttttgcaaatttctatgcttaatgttgttttatgggtagtaatatgtaccatcgcagtcgatctgttgttatgccctttgctggcaaatctatataaatatggatgcgtcgatatctagctgttgttatgcccttggctggcaaatctatataactctggctgcgttgacaacctggaaaaatttgcagcacactcgagaaaaa

SEQ ID NO: 34796 - DNA, 647 bp, Triticum aestivum
  Clone ID: PAT_TA_34796
gccggccgtgccgcagtcggcggctcaacccccatcgcacagaacgagattccttcctccccccgaaggccggcagcgccatggccggtggcagcctggagacggcgtgggagctcgcccaacttttcgtcctccgccccgtcctggccgtcaccttcgtgctatcattcatcctcctgagctggtatgtggcgtggaggacggtgctggtgcacgtcccgctcgtgcaggagatcgccgggctgcgccggaagaagcccgtcaagcccaagcccccaaaccgcggtcgcatcgccaggttctacgagtcgcaagcccagaggaacagtaaatcagaagggacctcttaaggaataatctttggaactttgaaagaagcaacctcagtcggcagaacccctcatctcattccaattcagaatgttgtacgtccagtgaaatggcatattctcttctttgggcagatctcaacacgcttaggttgcaaccccaaatacacaataatgtatgcactatatattaaccagcccctgtgtaaagtttgtgcgaactagcggaacgtcttgccttctcaggccgacagcttcgtgttatatagatggggccccctcccataacggcgcaaaaaaaaaaaaaaaaaaaaaaaa

SEQ ID NO: 34797 - DNA, 984 bp, Triticum aestivum
  unsure (1)..(984): unsure at all n locations
  Clone ID: PAT_TA_34797
gattaggtttgcccgacaactttttnggacaatgcatgagatagcatttgcatctactaataagccaaagctacttagccaggaaagcatgatcgcttggacatcataagcaatttgtgatgccgaggatcttgtagaggatttaggaaagtgaattccaacattattgaagcaaaattggtgaagttgaatgaggattggagatggcgtgtaacctacttacacatagatggagactcgggatggctgatctacacaggcgtgggcaccatgtttattactctttgttacccaacataatttccgtttataaatttagctagcggccgtgcacatcttgaggtgtccgtcaactccaaacacaagccccattcccctgtatgactaaattcaggtattcgtgagttcctttaaatgttggaaatgttcttggtactaaagacaatgttgcagcaaagaagtgggtatcacttattgatgaccaggtgatgaatatattggtagggatacatgtaatggaccatatttttcaccattcccatatggctatggacttgaacacctatggaagaagaagatgtgtagccaaatacttctaggagtactatatatatgcatgtgatattcactataccttttctcattgcccattacttcacgtgcaatatattgcagtatgtagcagccaaggtgatatgcacgagccaaggtgatactgaggaacttcttatttcataccgattacatgagtatagaggacaagtttgttaaatgttcatgttttgttattgccagtgagttgatatgcatgtgttctgatgatccaacaaacactgcctcttttggtgatcacccaccttttggagcatgttgaactttgatttcaatccatgtccgtgtctttatgatcagtcattgacattgtgagactgtcacctctgtgttaatatagagctattattagcttactctgctctttnnntt

SEQ ID NO: 34798 - DNA, 782 bp, Triticum aestivum
  unsure (1)..(782): unsure at all n locations
  Clone ID: PAT_TA_34798
ctcagcagcagcaacctcctccgcaccaggaatgacctcgtccccatcagcaggcctgtcaagcttcacaccaacatcctccttgtagtcaccgtgaacctccatgagcttccccaggtcgaacttgggggccttcaggatcttcaccttgcggacgtacacgttctggagggggaagatgcttgaggtggccttctcaatctcctttccgatcacctcagggatgaacttgttcacaagctccttcaagtcacagcttgcagcttggttgagatcatggtcaaccaagctgcaagctgtgacttgaaggagcttgtgaacaagttcatccctgaggtgatcggaaaggagattgagaaggctacctcaagcatcttccccctccagaacgtgtacgtccgcaaggtgaagatcctgaaggcccccaagttcgacctggggaagctcatggaggttcacggtgactacaaggaggatgttggtgtgaacttgacaggcctgctgatggggacgaggcattcctgggtgcggaggagttgctgctgctgagtanagaatagaatccctattttgctgcttcatatctagaagatgatatatgtgccacttgggtgtcctgaactttgtatcaattttgatggctgattccctgatacttgtgtcgacatccctagcaacgtcaactacctatttgtccgtgtactttccgggatggagttagagtnaaacaaatattagttatccgccggtgtgttttaagttgaanaaactagcgggttgtt

SEQ ID NO: 34799 - DNA, 551 bp, Triticum aestivum
  Clone ID: PAT_TA_34799
cgttcacgctcggctcggcaggcgattcgtgccagccgccgatggccgtcatggcgttcgccggcgaccaggcccagaacttccactacgcccgagaggacgcgcgttgcgctctacagcgtctactacaacacgagaagcgacgaccacagctcgctctgcgggccggtgatcgacgacgtccgcgtctggggcttgaatggggctgctgggctgaaggcgagcattgggctgcttattgccatggctagtgtcatcgttctcgtgctgttctgatcttctgaatatacgtatgtaacctcccctgcaaggacgaggaggccactagttttgttagcagtaagcctgaggtttctgtgagattgatgagtaatgtgagcttaggctaaagctaccagtagctgtaagtggtggttttgttgctttcttgtgtgattcagaaagtagcaagccatgatgggattgcgtggtaaaatgtgagatgtaagaattgttccaacttcatctcttcaatgcattagaaagttcagaaaaaaaaaacaaaaacaacc

SEQ ID NO: 34800 - DNA, 842 bp, Triticum aestivum
  Clone ID: PAT_TA_34800
gtacttgggaagaagtcgttctttctgggggagatgggaaatggagcaaagatgaaactggtggtcaacatgatcatgggaagtatgatgaatgctttttctgagggactctgtttggctgacaaaagtgggttgagcccccagacgcttcttgatgtcctggatctcggtgcaatcgcaaatccgatgttcaagatgaaagggccttcaatgctgcagggcagctacaatccagcgtttcccctcaaacatcagcagaaggatatgaggttggctctgtcgttgggagatgaaaatgccgtgtccatgccagtggcagctgcttccaatgaggcattcaagaaagcaagaagcttgggacttggcgacctggatttttctgtggtgcacgaggtgctgaaaggcacaggtggttcaggctaaagcgtgatcgggggctgaatgtttaaacaacgttgctatacacacgacgtcctatgcacgatttacagacgatactaataatcaagccgttggtgtaatctagctctctgcaggacaccgttcgattgcacatcgtgcatgcatcgtccattcaccagtcgtccgtgaagtagtttcgatgtttaaaaccacatgccatgggcatatatgcagacattcttgtagtttgtccaacccatgtggcttaccatcgtactattgatatgtacattcaacagttgatgtcggattgtgctgtacgatgtagctgcaagtttcgaattatcgcttgtacatgaatggaccattgggatttgggacttgattgctgccaggagatgaaccctccagacgggaataaaagggccagttcttccttg

SEQ ID NO: 34801 - DNA, 1280 bp, Triticum aestivum
  Clone ID: PAT_TA_34801
cgtccgcccacgcgtccgcggcgggctgtggctgcccactggaggagcacaggtgtgtgtcgctagcggcggtgcgtgtgcgcgtgcagggagggaagaggggacgagcgagagagaagaggagccaacctccgccgccacggcttccgcgtgctaggaagacgaagcagagcagcagcagggagagggaggccgcgatggaggtgggcttcctgggactgggcatcatgggcaaggcaatggcggccaacctcctccgccacggcttccgcgtcaccgtctggaaccggaccctgtccaagtgcgacgagctcgtcgcgatgggtgccgccgtcggggacacgccggcgtccgtcgtcgctaagtgcaagtacaccatcgccatgctctccgatcccagcgccgcgctatccgttgttttcgacaaggatggcgtgctcgagcaaatcggagagggcaagggctacgtggatatgtccactgttgatgctgcaacttcttgcaagataagcgaggcggttaaacaaaagggcggagcttttgttgaagctccagtttcagggagcaagaagccagctgaagatggccaattggtcattcttgctgcaggcgacaaggcactatatgatgatatggtccctgcatttgatgtacttgggaagaagtcattctttctgggggagatgggaaatggagcaaagatgaaactggtggtcaacatgatcatgggaagtatgatgaatgctttttctgagggactctgtttggctgacaaaagtgggttgagcccccagacgcttcttgatgtcctggatctcggtgcaatcgcaaatccgatgttcaagatgaaagggccttcaatgctgcagggcagctacaatccagcatttcccctcaaacatcagcagaaggatatgaggttggctctgtcgttgggagatgaaaatgccgtgtccatgccagtggcagctgcttccaatgaggcattcaagaaagcaagaagcttgggacttggcgacctggatttttctgcagtgcacgaggtgctgaaaggcacaggtggttcaggctaaagcgtgatcgggggctgaatgtttaaaaccacatgccattgggcatatatgcagacattcttgtagtttgtccaacccatgtggcttaccatcgtactattgatatgtacattcaacagttgatgccggattgtgctgtacgatgtattttttgaaacaaggcaaaagatttgccattttcattgattaagggagaaggtttaagac

SEQ ID NO: 34802 - DNA, 1250 bp, Triticum aestivum
  unsure (1)..(1250): unsure at all n locations
  Clone ID: PAT_TA_34802
actggaggagcacaagtgtgtgtcgctagcggcggctgcgggtgcgcgtgcagaagggacgagagagagagaagaggagccaacctccgccgccacggcttccgcgtgctaggaagacgaagcagagcggcagcaaagagagggaggccgcgatggaggtgggcttcctggggctgggcatcatgggcaaggcaatggcggccaacctcctccgccacggcttccgcgtcaccgtctggaaccggaccctctccaagtgcgacgagctcgtcgcgatgggtgccgccgtcggggacacgccggcgtccgtcgtcgccaagtgcaagtacaccatcgccatgctctccgatcccagcgccgcgctatctgttgttttcgacaaggatggcgtgctcgagcaaatcggagagggcaagggctacgtggacatgtccactgtcgatgctgcaacttcttgcaagataagcgaggcggttaaacaaaagggcggagcttttgttgaagctccagtttcagggagcaagaagccagctgaagatggccaattggtcattcttgctgcaggcgacaaggcactatatgatgatatggtccctgcatttgatgtacttgggaagaagtcgttctttctgggggagatgggaaatggagcaaagatgaaactggtggtcaacatgatcatgggaagtatgatgaatgctttttctgagggactctgtttggctgacaaaagtgggttgagcccccagacgcttcttgatgtcctggatctcggtgcaatcgcaaatccgatgttcaagatgaaagggccttcaatgctgcagggcagctacaatccagcatttcccctgaaacatcagcagaaggatatgaggctggctctgtcgttgggagatgaaaatgccgtgtccatgccagtggcagctgctgccaatgaggcattcaagaaagcaagaagcttgggacttggtgacctggatttttccgcggtgcacgaggttctgaaaggcactggtggttcaggctaaagcgtgattgggggctgaatgtttaaaaccacatgccatgggcatgcagatattcttgtagttcgtccaacccatgtggcttatcatcgtactattgatatgtacattcaacagttgatgctggattgtgctgtacgatgttttttttctagcaaggcttgtgcatgaacgaaccattgggatttgggacttgaatgccgccacgccagnaggaaatataag

SEQ ID NO: 34803 - DNA, 745 bp, Triticum aestivum
  Clone ID: PAT_TA_34803
ggcatggacttcaccactgacaagctcaggtcccttgtgagaaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgatcggaaaggagattgagaaggccacctcaagcatcttccccctccagaacgtgtacgtccgcaaggtgaagatcctgaaggcccccaagttcgacctggggaagctcatggaggttcacggtgactacaaggaggatgttggtgtgaagcttgacaggcctgctgatggggacgaggtcattcctggtgcggaggaggttgctgctgctgagtagagaatagaagtcgctattttgctgcttcatatctagaagatgatatatgtgccacctgggtgtcgtgaactttgtagtcagttttgatggctgatttcttgagtacttgtgtcgacattcctagccagcgttcagctatcttattttgttcgtgttacttttctggatggaggttatgagttgaaactaaatatttagtttattcctgccggtgtgtttttatgtttgaatagaacttatgctgtgttgttttgtt

SEQ ID NO: 34804 - DNA, 1602 bp, Triticum aestivum
  Clone ID: PAT_TA_34804
acccgccaccggtgtccccttcttcgtcagcttgcaatctccacccacctcactcccactcccacctcccatcccccgctctttctacacatcgaggacgaaacggtggtgagggagccgggggactagctgctaggcggaggaggagatggagcgagggctcgtcgcattgctgggtctggggctggcgcttcttctgctggcgccctcccgtcgtctcgcctcggccgctccggtggaggacggcctcctcatgaatggtgatttcgagacagcaccacctggcggtttcgtcaaatctgcttcagtttccgagggcgcagcgatcccaagctggatgatcaatggaacagttgagctcatttccgcaggccagcaccagggtggcatgatccttattgttccacaaggcgatcatgctgtgcggctagggaatgatgcaggcattgggcaggtggtggaggttgagaagggctcagagtacgcgatcacattcagcgccgcccggacctgcgcgcagctggagtcactgaacatctccgctgggagcgtgtcgcagacagtcgacctgcagacactgtacagcatagaaggctgggatgcatatgcactggctttccaagcagtggatgagcaggccagcattgagttcaggaaccctggcatggaggacgacccgacctgtgggcctatccttgacaacgtggccatcaagaagctcttctcccccgacaaagcaaaggagaacatggtgatcaatggggactttgaggaggggccatggatgtttgcaaacacaagcttcggcgtcctgctcccgacgaacctcgacgagcagacgtcggccttgccggggtggatgatcgagtcgaaccgcgcagtccgcttcgttgactccgaccagtacaccgttccccaggggaagcgcgccatagagcttctctccggcaaggagggcatcatctcgcagatggtggagacgacccctcagaaggcgtacaccctgacgttcacgctgggctcagcaggcgattcgtgccagccgccaatggccgtcatggcgttcgccggcgaccaggcccagaacttccactacgcccccatgggcaacgccacgagccaggccgtgaacgtgaatttcacggcgcgcgccgagaggacgcgcgtcgcgctctacagcgtctactacaacacgagaagcgacgaccacagctcgctctgtgggccggtgatcgacgacgtccgcgtctggggcttgaacggggctgctgggttgaaggcgagcatcaggatgcttattgccatggctagtgtcatcgttcttgtgctgttctgatcttctgaatatacgtacgtatgtaacctcccctgcaaggacgaggaggccactagttttgttagcagtaagcctgaggtttctatgagattgatgagtaatgtgagcttaggctaaagctaccagtagctgtaagtggttgttttgttgctttcttgtgtggttcagaaagtagcaagccatgatgggattgcgtggtcagtgagccaagggcttgtgatgtgagatgtaagaattgtttcaagttcatctcttcaatgcagtag

SEQ ID NO: 34805 - DNA, 1322 bp, Triticum aestivum
  Clone ID: PAT_TA_34805
aggaattcggcacgaggcctgcggctgcccactggaggagcacaagtgcgtgtcgctagcggcggctgcgggtgcgcgtgcatcagtcagggaagaggaggggacgggagagagagaagaggagccaacctccgccgccacggcttccgcgtgctaggaagacgaagcagagcagcagcagggagagggaggccgcgatggaggtgggcttcctggggctgggcatcatgggcaaggcaatggcggccaacctcctccgccacggcttccgcgtcaccgtctggaaccggaccctctccaagtgcgacgagctcgtcgcgatgggtgccgccgtcggggacactccggcgtccgtcgtcgccaagtgcaagtacaccatcgccatgctctccgatcccagcgccgccctatctgtggttttcgacaaggatggtgtgctcgagcaaatcggagagggcaagggctacgtggacatgtccactgtcgatgctgcaacttcttgcaagataagcgaggcggttaaacaaaagggcggagcttttgttgaagctccagtttcagggagcaagaagccagctgaagatggccaattggtcattcttgctgcaggcgacaaggcactatatgatgatatggtccctgcatttgatgtacttgggaagaagtcgttctttctgggggagatgggaaatggagcaaagatgaaactggtggtcaacatgatcatgggaagtatgatgaatgctttttctgagggactctgtttggctgacaaaagtgggttgagcccccagacgcttcttgatgtcctggatctcggtgcaatcgcaaatccgatgttcaagatgaaagggccttcaatgctgcagggcagctacaatccagcgtttcccctcaaacatcagcagaaggatatgaggttggctctgtcgttgggagatgaaaatgccgtgtccatgccagtggcagctgcttccaatgaggcattcaagaaagcaagaagcttgggacttggcgacctggatttttctgtggtgcacgaggtgctgaaaggcacaggtggttcaggctaaagcgtgatcgggggctgaatgtttaaaaccacatgccatgggcatatatgcagacattcttgtagtttgtccaacccatgtggcttaccatcgtactattgatatgtacattcaacagttgatgtcggattgtgctgtacgatgtagctgcaagtttcgaattatcgcttgtacatgaatggcaccattgggatttgggacttgattgctgccaggagatgaaccctccagacgggaataaaagggcca

SEQ ID NO: 34806 - DNA, 1595 bp, Triticum aestivum
  Clone ID: PAT_TA_34806
cggtgacccccttcttcgtcagcctgcaatctccactcacctcactcccactccccctcccaccccccactcttctacacatcgaggacgaaagggtggtgagggagccgggggcctgagggggctagctgctaggcggaggaggggatggagcgagggctcgcattgctgggtctggggctggcgcttcttctgctggcgccctctcgtcgtctcgcctcggccgctccggtggaggacggcctgctcatgaatggtgatttcgagacagcaccacctggcggtttcgtcaaatcggcttcagtttccgagggcgcggcgatcccaagctggacgatcaatggaacagttgagctcatttccgcaggccagcaccagggtggcatgatccttattgttccacaaggggatcatgctgtgcggctagggaatgatgcaggcattgggcaggtggtggaggttgagaagggctcagagtacgcgatcacattcagtgccgcccggacctgcgcgcagctggagtcactgaacatctccgccgggagcgtatcacagacagtcgacttgcagacactttacagcatagaaggctgggatgcatatgccctggctttccaagcagtggatgagcaggcgagcattgagtttaggaaccctggcatggaggacgacccgacctgcgggcctatccttgacaacgtggccatcaagaagctcttctcccccgacaaagcaaaggagaacatggtgatcaatggagactttgaggaggggccatggatgtttccaaacacaagcttcggtgtcctgctcccgacgaaccttgacgagcagacatcggccttgccagggtggatgatcgagtcgaaccgcgcagtccgcttcgtcgactccgaccagtacaccgtgccccaggggaagcgcgccatcgagcttctctccggcaaggagggcatcatctcgcagatggtggagacgacccctcagaaggcgtacaccctgacgttcacgctgggctcggcaggcgactcgtgccagctgccaatggctgtcatggcattcgccggcgaccaggcccagaacttccactactcccccatgggcaacgccacgagccaggccgtgaacgtgaacttcacggcgcgcgccgagaggacacgcgttgcgctctacagcgtctactacaacacgagaagcgacgaccacagctcgctctgcgggccggtgatagacgacgtccgtgtctggggcttgaatggggctgctgggttgaaggcaagtattgcgctgcttattgccatggctagtgtcatcgttctcgtgctgttctgatctcctgaatatacgtatgtaacctcccctgcaagggcgaggaggccactagttttgttagtaagcttgaggtttctatgagattgatgagtaatgtgagcttaggctaaagctaccagtagctataaatggttgttttgttgctttcttgtgtgattcagaaagtagcaaaccatgatgggattgagtggtcactgagccaagggcttgcaatgtgagatgtaagaattgttacaagttcatctcttcaatgcattagaaag

SEQ ID NO: 34807 - DNA, 837 bp, Triticum aestivum
  Clone ID: PAT_TA_34807
gaattcggcacgaggagaagccccgacgctcaagcccccagacgccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttaaaggagcttgtgaacaagttcatccctgaggtgattggaaaggagattgagaaggccacctcaggcatcttccccctccagaacgtgtacgtccgcaaggtgaagatcctgaaggcccccaagttcgacctggggaagctcatggaggttcacggtggactaccagggaggatgttggtgttgaacctggacaggcctggtgatggaaaatgaagg

SEQ ID NO: 34808 - DNA, 889 bp, Triticum aestivum
  Clone ID: PAT_TA_34808
tcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcaccattggcttcacgaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattgagaaggccacctcaagcatcttccccctccagaacgtgtacgtccgcaaggtgaagatcctgaaggcccccaagtttgacctggggaagctcatggaggtgcacggtgactacaaggaggatgttggtgtgaagcttgacaggcctgctgatggagatgaggtgattcctggagcggaggaggttgctgctgctgagtagaaaatagaagtcgctattttgctgcttcatatctagaagatgatatatgtgccacctgggtgtcgtgaactttgtagtcagttttgatggctgatttcttgagtacttctgtcgacattcctagccagcgttcagttatcttattttgttcgtgttactttctggatggaggttatgagtttaaaactaaatatttagtttattcctgccgtgtgtgttttatgtttgaatggaacttatgctctgttgttttgctagctgtatctcagtaccaactttttgttcgcgtgccccacaaattttcaatctttt

SEQ ID NO: 34809 - DNA, 963 bp, Triticum aestivum
  Clone ID: PAT_TA_34809
gccggccgggctgcgttcccctcgcgccccccagaagccccgacgctcaagcccccagacgccgcagcgccgccactccacccgcagcggcaaccatggcggtcggcaagaacaagcgcatctccaaggggaggaagggtagcaaaaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcaccattggcttcacgaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattgagaaggccacctcaagcatcttccccctccagaacgtgtacgtccgcaaggtgaagatcctgaaggcccccaagtttgacctggggaagctcatggaggtgcacggtgactacaaggaggatgttggtgtgaagcttgacaggcctgctgatggagatgaggtgattcctggagcggaggagttgctgctgctgagtagaaatagaatcctattttgctgctcatatctagaagatgatatattgcactgggttcgtaacttgtatcatttgatgt

SEQ ID NO: 34810 - DNA, 942 bp, Triticum aestivum
  Clone ID: PAT_TA_34810
gtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattgagaaggccacctcaggcatcttccccctccagaacgtgtacgtccgcaaggtgaagatcctgaaggcccccaagttcgacctggggaagctcatggaggttcacggtgactacaaggaggatgttggtgtgaagcttgacaggcctgctgatggagatgaggtgattcctggagcagaggaggttgctgctgctgagtagaggatagaagttgctattttgctgcttcatatctagaagatgatatatgtgccacctgggtgtcgtgaactttgtagtcagttttgatggctgatttcttgagtacttctgtcgacattcctagccagtgttccgctatcttattttgttcgtgttactttctggatggaggttatgagttgaaaactaaatatttagtttattcctgtcctgtgtttttatgtttgaatagaacttgtcctctgttttgttaagtttatctcagtacaacttttgtttgcggcatacaagat

SEQ ID NO: 34811 - DNA, 1205 bp, Triticum aestivum
  Clone ID: PAT_TA_34811
attcggcacgaggcagaagccccgacgctcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgatcggaaaggagattgagaaggccacctcaagcatcttccccctccagaacgtgtacgtccgcaaggtgaagatcctgaaggcccccaagttcgacctggggaagctcatggaggttcacggtgactacaaggaggatgttggtgtgaagcttgacaggcctgctgatggggacgaggtcattcctggtgcggaggaggttgctgctgctgagtagagaatagaagtcgctattttgctgcttcatatctagaagatgatatatgtgccacttggtgtcgtgaactttgtagtcagttttgatggctgatttcttgagtacttgtgtcgacattcctagccagcgttcagctatcttattttgttcgtgttacttttctggatggaggttatgagttgaaactaaatatttagtttattcctgccggtgtgtttttatgtttgaatagaacttatgctgtgttgttttgttagttgtatctcagtaccaactttttgttcgcgtgcaaaaaaaaaaacctcggccgcgaccacgctaatcactagtgaattc

SEQ ID NO: 34812 - DNA, 1226 bp, Triticum aestivum
  unsure (1)..(1226): unsure at all n locations
  Clone ID: PAT_TA_34812
aatacaatcttaataccctaaaaatcttaataggtttatttattgttaaaagagataccctagacaaagaaaacagaaaagaaaggaggaaacaatctgtacagggtgccgaaaggaagctagaacaaaggtctcagtctcaggggatgatgatcacgcatgatcaatcagcactgctctttctctaccgcctacaatgcaaattgaagcgcaatgcaatgtcctacaggaaatgctcatcatgctatctctactaccctcggccggagccgagttctcggggacgccctcgttcgtcgacgccgatcttcatggctggaacctcgccgagggccccggagtcgccgctcacctcgaactcgctcgagctcgccttggactcggcgtccggcgttgccaccaccggcatggccgcccctccggctcctccggtcctcccgtgacgggacgtcctctgcctcgagcatccggacgacctgccccatcgtgggtctcttctcggagtccgggtcgacgcaccccagcgccactaggagggcgcgcttgagagcacggatggtcggctttacctccatgtcgcggtccaccacctcgtcggctctctttgtgccgaccatcattttgagccactccaccagatgcacctcattggctggccgaccatagtcgacaggatccctcccagtcactgcttccagtagcagcacgccgaaactgtagacatcgctcttctcgtttaacagacctgtgttggcatattcaggggccacatacccgaaggttcccataactcgagtcgtgatatggctcttcccagcacccaacatcttggccaatccaaaatcagaaagcttcccattgaaatcctcatcaattaggatattgcttgatttgatatcacggtgcacaacttttggctctatggcttcatgtagataagcaagcgctttagcaattccaagaatgattttcattcgagcttcccaggtaagaacaccgtgctgccgcatggcgccgtgaatccactgctctaagtttccgttgttcacatactcatacacaagcatcctgtggattccttcaacacaatatcccagcagacggaccagatttttatgcctgacatggccaatagcctcaacttcaaccctgaactccttttnctgcctggcccatgttattcagtagcttttttattgctacatcagtcccatttatgagtcgac

SEQ ID NO: 34813 - DNA, 2137 bp, Triticum aestivum
  Clone ID: PAT_TA_34813
cacagggcgaccctcgcttccgccgcccccacacttcccctctctcccgcgcgctctcgctgccgcccctcccatggacgcctccgccggctcgtcgccgccgcggcactcacagggggacgcgccgaggcgcggcgggccccgccgcgggaagggccccgcggtggagatccggcagggagaggacgacttcatgttcgcgcaggataccttcccggccctcccggacttcccttgcctctcctcgccgtcgagctccaccttctcctcttcctcctcgtccaactcctccagcgccttcgctgccccagcgggagcgggcgggcggggggacgagggagcgcgcggcgagccgtccgagcctgcagcggccggggacgggatggacgacctctccgacatcgaccacctgctcgacttcgcgtccatccatcgtgctttactctgatgtcaagtcgggcaaatatctgatacgcggcgtgaaggtaagagcgcaacaggatctagccaagcacaagaatggcagtccagagaaaggtggggcgtccgacgcgaaggcgggcgcagaagacggtggttgcaaagagaagtctccgcacggtgtcccggcgatctcgccaggaggccgcctccatgaaccagatggccgtgagcatctgaaatgagcaagctcgcgcggtccgatcccccattgaagactcgcctccgtcgatccaccatcgaggccgcggccgcgcgcctcggtggggggcgccagggcaccatgcagctgctcaagctcatcctcacctgggtgcagaaccaccacctgcagaagaagcgcccccgcgtcggcgccatggatcaggaggcgccgccggcaggaggccagctccctagccccggcgcaaaccccggctacgaattccccgcggagacgggtgccgccgctgccacatcatggatgccctaccaggccttctcgccaactggatcctacggcggcggggcgatctacccattccagcagggctgcagcactagcagcgtggccgtgagcagccagccgttctccccgccggcggcgcccgacatgcacgccggggcctggcccctgcagtacgcggcgttcgtcccagctggagccacatccgcaggcactcaaacatacccgatgccgccgccgggggccgtgccgcagccgttcgcggcccccggattcgccgggcagttcccgcagcggatggagccggcggcgaccagggaggcccggaagaagcggatggcgaggcagcggcgcttgtcgtgcctgcagcagcagcggagccagcagctgaatctgagccagatccaaaccggcggcttccctcaagagcaatccccccgcgcggcgcactcggcgccggtcacgccgccgtcgtccggctggggaggcctctgggcgcaacaggccgtccagggccagctcatggtccaggtcccgaatccgctgtcgacgaagtccaattcctcaaggcagaagcagcaaaaaccctcgccggacgcagcagcgaggccgccctccggcggcgccgccacgccgcatcgcccggggcaggcgtcggcttccaataagcagcggcagcagggtgcgaggacgccggcggcggcgccggcggcaggagacaagaacctgcggttcctgctgcagaaggtgctcaagcagagcgacgtcggaaccctcggccgcatcgtgctccccaaagaagcggagactcacctgccggagctcaagacgggggacggcatctcgatccccattgaggacatcggcacatctcaggtctggagcatgcggtaccgattttggcccaacaacaagagcagaatgtatcttctagagaacactggtgactttgttcggtccaatgagctgcaggagggtgatttcatcgtgctttactctgatgtcaagtcaggcaaatatctgatacgcggcgtgaaggtaagagctcaacaggatctagccaagcacaagaatgccagtccagagaaaggtggggcgtccgacgtgaaggcgggcggagaagacggtggttgcaaagagaagtctccgcacggtgtccggcgatctcgccaggaagccagctccatgaaccagatggccgtgagcatctga

SEQ ID NO: 34814 - DNA, 1470 bp, Triticum aestivum
  Clone ID: PAT_TA_34814
ccaccacggacgacggcgacggacgacacctccactaccgcctgtcgcccctcgccgcgcgcgaccgacgcccaccgcgttacgatggtgaccgacgcggccgcgctggcgggcgtgaaggccgcgacccccgcgccccttccccgactgggtgcgctggccgacgacgcctccgctaccgcctctcgcccctcgccgcgcgcgaccgacgcccacagcgttacgatggtgaccgacgcggccgcgatggcggtcgtgaaggccgcgcgccccgtcttccgcggcgcccacgacggcgtggcgttcgccgcaaacgccgcgttcctcgccgcgggatactcgctctgcgccgtcggccctgccgcgctcaccgacccccttcccgcagttgacgaggaggtgggaattgatgggtggaacactatggacaattgctatgcctttctgcactccaaggaaggacgagggcaagaagaagcgcattttagtgaaatgtctagtgattgatgacttccttgctattgatgcgctggatcttgaggcacaacacaaggaaccctgcaatgtccagataaatgtgaaggatttcttctctgaagaacagcccaagaattataaggatatgtacaagaattttgcgggcttcatcaatacccttaactcaagcttgttagttgaattggatggtaagaatgctgctgctgctgccgcccagaatgttatgagcagttcatcaataaacagttctgaaaatgttctgcgggatacaaggactactgaacctgctggcctgatatatcctccagtagctctgtttggtcatgatgacaccttccctgctcctggtgcaggcttctaccctcacagtggtgggccgggtggtagtatgcacgttggcccaaatgatccacgcttctttccttcaaatccttctcctgctccttttggtggccctgggagtgttccacctggtggccgttacgatccgatcggcccgcccgatgttccaggatttgaaccatctcgctttgtgaggcgttcgaggcatccaggtggaagcactcacccagacctcgagttcttccaacaaggcccagacttctgagactcggcttcatgccacctgcaccctgcgctgaatgactctgctttgtttgtgctgcgctcatgaactttttttcagtagaccctgcttgggaagttgggaacatgaatgtaaactttgtatttaccttccagacaatgctttgtgacggttgactgtacagttgtatatagacctgtctccgtatccctctctgcctcttacctaaactattggtgcgactcccaacatctgcaatgcctgcctcgtcgccacccagtagcctcaaaatttgctccagtttctccacatgcagtatcatcgcaaaaagtctatccacgggcgctccaagcgatcctctaaatcttatgtatatatatacaact

SEQ ID NO: 34815 - DNA, 820 bp, Triticum aestivum
  Clone ID: PAT_TA_34815
tcggtgagggggcgcaaccggctcggctcgcgcccgcctgttgacgcgggcgtctacgcggcgcaccggggatcgggccatgggcccacacgccccggggccctgggcccggcgcttaccgcggtcgggatgacactgggacaaacccttctgcatggtgggctccgataagccgtcggccaagtgtcgtacaaccacaagttgtcggtcatccgggcaggtgctggctaggtaccgcccagtagcggctccattggatggcgcttgagtacaagtttctgggggaggtggaatgctctgcaggtatgtcatgtgtacctgcaagtgaaaatgcccgggtctcagattgtgagtgttgctggttcggtgtaagatacagagtggttgttcattgtactttaaacatcagtacatcacgaattcacaatgttatagtgctttcttatttgaataaaacaagccaagaccacggcactggcatcacacgacgacggtaacacactgacgaaccttctgtggtggctccatagccgcggcaatgtcgacaacatggttgtcggatccggcaggtgctgctggtatcggcagtacggccattgatggcgctgagtacgagttgctggggaggtggaatgcacttcaggtatgtcatgtgtacctgcaagtgaaaatgcccgggtttcagactgtgagtgttgctggttcggcttaagatacagagtggttgtccattgtattttaaacatcagtacatcacaaattcacgatgttatagtgctcttcttatatttgaataaatcaagttggtgcacagccaatt

SEQ ID NO: 34816 - DNA, 494 bp, Triticum aestivum
  Clone ID: PAT_TA_34816
gcgagtcggagggcgaggcggtgccgctcgtcaccatcgccgccgccgccaagactgaagcgcgtcaggaagctctccgacgagttcgaccgcatcgccgccgcgcagctggagggcggcgggaagaagaagccctctgccgtggttccggccaaggccccgctcaggaagaaggtttcgggtgctgcggcggttcctgctccggccgctgaggcgccggcgaagaagtcgctgaagaggaaggcggtggcaccggcggctgtgacagcggcgaggacctcaccgaagaggaaggctgcggaggcgccggcggcaaggaggacctcgccgaggtccaagcactgatggatttctgttctttttgtcagttctgtcgctgtagcggttcaggtgtgatatcggagatgcagtctgctgtgtgtttgtcgaaatgctcgaatggaatcagtgtcatgcttatttctgtatatgaatcaaatttctcaaaaaaaaaa

SEQ ID NO: 34817 - DNA, 802 bp, Triticum aestivum
  Clone ID: PAT_TA_34817
acttgcacgccctctgcggaaagtttgaagtcttcttacaatgacagccagctccaagctgtaagtattgccattgggtcagcaagctcgaaaacaaaatgtgatctgtctcttattcagggccctccaggtacaggtaaaacaaaaactattgttgcgatcgtgagtgcattgctttctttacatgccgacaactcttacaatttaccaagaaatgaatcgctggctagtgctgaatttaccaagccaagaacaaagattagtcaaactgctgcagtagctagagcttggcaggatgcagccctggctaaacaacagataaaggattcccagagagaaaacccgaggacagaacggctttcaaaaggcatcctttcaagaggaagggctctaatatgtgcgcagtcaaatgctgcagttgatgaacttgtgtcaagactcagtaatggattgtatgatactgaaggaaagctgtatagaccttatatagtgagggttggtaatgcaaagacagttcatcctaattcaattcctttctttattgacacacttgttgaacaaaggttgtcagacgagttaaagattaatgatgaatccaaaatttcatccgatggcgaatcgtctggttcactcaaggctaggttggagaaagttgtagacagaattagatattatgagtcacggcgaatactagtggagggtgataagacagaaactggatcttctgtgcccgatgaagatgagatgggtgaagttttctgatgaagcaattggtgcaaagctcaatattttatatacacag

SEQ ID NO: 34818 - DNA, 1327 bp, Triticum aestivum
  Clone ID: PAT_TA_34818
gccggccccgccgcgccccttgctccgtccgtagtactcctccaagagctcctctggccagccatcttctccggcctctggtctcaatggcggcaccagagccccgcccctatccgttgcaaagcggcggtgagcagagccaagggcgcgccgctcgtcatcgaggacatcgtcgtggatccgcccaaggcctacgagatccgcatgaaggtcatctgcacctccctctgccacaccgacatcaccttctggcgcggcaaggaagacttcccgctcccgcccgtgttcccaaggatcctaggccacgaggcgtacggggtggtggagagcgtgggggagcggcgtggaggggattcgcgggtgggggaaggccgtggtgccggtcgttcctggggccaatgcgactcctgcggcgggctgcgcgttcgcggggaccaacattgtgctccgccgctcgccgttcgtcagtcggcccccgggactgcgccgcgacgggagcacccgcttcgaggacaagaagcgggagacgcaccacgtggtcctcgccgtctccagcttcaccttcgacaccgtcgtcgacgtcaaccaggtcgtctaggtcgaccccgccgtgccgcccaagctcgcctgcctcctcggctgcggcgccggcaccggggtcggggtgcggcggaggttgacaacggttccttgtttccctacgatagtattgttcggtgtgttagttcacggagtgtcggtggcacaaggcggctagatgtgcggagcaaccaagagcttcggtgttgatttgaaccctgacaaagaagaactcgggaaaaaattcggcgtgacagatttcgtgaacccgtcaaaactcggcgagagcccactcagccaggtgatcatcgagatgaccggcggcggcgccgactactgcttcgagtgcatcggcgccgcgtccgtcatgaccgaggcgttcagaagcgccaagcaggggaacggcaagacggtgatcctggggttggagaaggacgggaagccgatcagcctgccgtccatcgagttcctcttcggcaagtgcgtcatggggtcgctcttcgggggcatcaagcccaagaccgacatccccatcctcgccgagaaatgcttgaacaaggagctggagctggagaagctgatcacgcacgaagtgggcctgcaggagataaacacggccttcgacctgctcctgcaggggaagagcctcaggtgcatcatctggatcgacaagctggaggcgtgaagaaacatgggggaaaatgttggtcaggagatggccgatgcagcgaccgaataaaactgttgc

SEQ ID NO: 34819 - DNA, 1189 bp, Triticum aestivum
  unsure (1)..(1189): unsure at all n locations
  Clone ID: PAT_TA_34819
cagcccgggcccgccccgacgcctcctcctcgccctcccgcacagccacccaccgccggggggaggcgaccgagggagcccagtcgtcacccggagaatcgagggggaacgcgccgagggagcagagcaaaatgttcaagttcctcaaggacgtggtcgcgggatccggatcgggcctcaaggacttcccctacaccatcggcgagccccacgcctccgcctggggctcctggacgcaccaccgcggcgcctccaaggacgatggatcgcctgtgtctattttctcattgtcagggagcaaccctcaggacaggcacatggttgctggtcgtaatggggttaagagattacggacggtgcgccatccaaatatattatcctttcttcacagtacagaagcagaagttcctgatggacctgctataaaacacacaatatatatagtcacagagcctgttacaccactttctgaaaagatcaaagagctgaacctgggaggtacacagagagatgagtattttgcttggggtcttcaccagatatcaaaagctgtgagctttctcaacaatgattgcaagctcgttcatggaaatgtgtgcttggctagtgtagttgttactcaaactctggactggaagcttcatgcttttgatgttctctcagaatttgatgccaataacgaaatcgctagtagccctatgttgcaatttgaatggttagttggagcacagtacaagccactggagctgacaaagtcagattgggcttctattagaaaatcacctccgtgggcaattgattcatggggattggggtgtttaattcatgagctcttttctggtggaaagttgagcaggacagaggaccttcgcaacattgcttcaatcccaaagtctctgcttccagattaccagaagctcttaagttctacaccttctcgtagaatgaatccttcaaaacttattgacaacagcgagtttttccagaacaagttggtagagaccatccagttcatggaaagttcttaatttaaaggacagtgttgagaaagatagctttttccggaaaccccaaatatagcagaanaacttcccgtgagatanttcnaaaaaagttgctccctgtatgggatctgcnctgaattgggttcgctgctgctccanccttgacngtcngtaaagagggttcg

SEQ ID NO: 34820 - DNA, 995 bp, Triticum aestivum
  unsure (1)..(995): unsure at all n locations
  Clone ID: PAT_TA_34820
gccggccgggttgcgattctattcgctctccctctccttccttgatctctcctcctccccttccccaacccaagtttccacccgccggcctcttctcctctcccgcacccaaccatctcgacccacacccgcaatttaccgcgccaagggatgacctctacacccgcgggcgacgtcctgccggcgctgccgccgatcaggaagagggcggcggtggccgatcctacgcctgaccacgcatcggcctcgacgacgacggtgccggaagcggagcccctgccggctcccgtggcggcggaggaagaggtggtggcggagtcccggacgccggctgcggtggcggacgaagaggaggaggaggaggaggaggaggagcccaggacaccgacttcggaggagagcaagctccggccgccgaccgagtgccccggcgcgccgaggaagcccgtggctttggtcggtacgaggccatcgccgaagcggccgctgcgcttcttcgacgtcccgggcgacctctccgccgtgttcatggccctgccgcccaagaagcggatccgcgctccgccatgcctagtcgccttccgcccgaggtgcgggaccgcgtggggccatggatcggcgctgtagccccggctggccgtaatttatgggctccatggtgcaattgttcatttatcggcgaattcttggagttcttgcgttcctcttctttctttctttctctttcttgcggcggcttcttggtttccacggccatgatatagtataatctctagtgcaaataattaacgcgttattttgccattttctctgtctttctgatttttagtgggtttgtgtgaaggagaaattgtactagaattgaaaaggttggtatttatataatatagggatgttgattggggaaaagaacagaaatactaattaaacataaaaaaaattaacgaagattgcggccaaaacatctccctgttaaattaccngacnaattgcca

SEQ ID NO: 34821 - DNA, 2110 bp, Triticum aestivum
  Clone ID: PAT_TA_34821
cctattgtcctctacataagagagtcgagaagtttcttcacaagtcccccaaatgtatctcttatttgagaaactactgaccaagcttgaagggccagtgctacttctcggctcaagaattgtggatatggactttgatgatgacgagctggatgacaggctatctgctttgttcccatatagcatagacatcaagccgcccgaaaatgagaattgccttgtaagctggaactcccagttagaagaagatatgaagattattcagtttcaagataatcggaaccatatcacggaagtccttgcagagaatgatctcgagtgtcttgatttaggctcaatatgtctatccgatacaatgggcctcagtaagtatattgaggagattgtggtatctgcagtttcttaccacttgatgaatcataaagacccagagtaccggaacggaaaactaattctatctgctaaaagcttgtcccatgcattggaaatttttcaagagaacaagatgagcgataaggacaccatgaagttggaaaggcatactgacgctcgaaagggaattgtaccgactgctgcaaaattggaaacaaaacctgcaactttgctgccaccagcagctcctgctgccgctactccagctcctcctcctgagagcaaaacagaaccaaagaaaccagagaatccacctccacctgcaaaactaccagaagtgcccccagataatgagtttgaaaagcgcatcagaccagaagtgatacccgcgaatgaaattggagtttcatttgatgatatcggtgcattggaagatatcaaagaatcccttcaagagcttgtcatgctacccctccgacggccagatctcttcaaggggggtcttcttaagccctgtagaggtatattactctttggtcctcctggaactggcaagacgatgctagccaaggctattgcaaatgaagctcaagcaagtttcataaatgtatcgatgtcgactatcacatcaaagtggtttggtgaagacgaaaagaatgttagagcactgttcactttagctgctaaagtatcgcccactatcattttcgtcgatgaggttgatagcatgcttgggcagcgaaacagagctggagagcatgaggcaatgaggaagattaagaatgagtttatgacacactgggatggtctcctgtcaagaccagatcaaaaaattcttgttcttgctgcgaccaaccgtccttttgatcttgacgaggctatcatcagaaggtttgagcgcagaatcatggtcggcttaccatcagtgcaaaatcgggaaatgattatgaagaggcttctgtcgaaggagaaagttgatgaaggactagattataaggaactagcaaccatgactgaaggatacactggcagtgatctcaagaacctttgcacaacggcggcatatcgccctgtgagggaactgatacagaaggaaaggtagacgcagctggggaagatgaaactggaaaaaggaggcagtccactagatccttcaaagataaaacaaaaagacaaggagatcattctaaggccattaaacatggcagatttgaaagaagcaaagaaccggcgggcggcgggcgctgccgctcgaggttccccagggggtgaggtgacgcgatggaatgatttgtatggtgaaggcgggtcgaggaagaaggagcagttgacgtacttcctgtgaacccaagtgtatgaacataattcggaaagtagaatagatggcgaacaagtacgagaaaataggcccggtttcttttgtcaaacacatgaatggacagcctatcgccacgtaaaactgtagtttgcctgtgttcggttgttgtaccactacactaataatgaatctgcagggcagatccttttgattttgttctttcttttagttttgctcctttgtgtgcatctctcaatctaccatgttttgtgtataggtagttcatactacttggtaggttgtggttggccacaaaacagtatcagcgtgccagtctgtatcagtatgcttctttcatgaatctagtgaaactccttagtgaaaaaaaaaaaaaaaaaaaaaaagtcgacgcggccgcga

SEQ ID NO: 34822 - DNA, 664 bp, Triticum aestivum
  Clone ID: PAT_TA_34822
gcggaccatagggcgacagcggcgacctcggttcgatctgtgggagagagaatatgagagggagaagaagaaaggagaggatggagaaagagagaggaaataggagaaggaggcgacgtcgaatgggagagggtcagtgcggtggcgcatcggacggcggctcgtgctgtggtgcggcgccgtcgtccacgtgctcctcctgaagctcctcctctccaccacgggtggatgcctggtgaggccagcgtcccctccacactcatgtgctcccccgcttccctgtgtcccctttgtctcttcccctgaccctctctttctgtcacacatggagagaaccgtggtggctgcacatcagattttgctacgaaatacaacttagttctgaaaataagaaacaaagctgattaaatcccctatgcatctgttgtttgtttgctgatttactgggtagatcttgaactggacgacacaaaggaggtggcattagtagtcatggagatcctcgtgttctgaacatcaattagttccatggggctaaatgatactgtaatctggctttcgtggcctatatatagtatttagtaaataagtctgttccatatcccattaatatgaatgcagctcgtcaaactgttcccattggtcgtctatttgatcttattat

SEQ ID NO: 34823 - DNA, 649 bp, Triticum aestivum
  Clone ID: PAT_TA_34823
cggtccggaatcccgggtcgacccacgcgtccggaactctgcattacatgaaataattattttaagtgtttttctcaacttgttttcactgtcacttgatatatacttagcctgtacttgaagatatgggctagatcgcgagcggccgcccgcgatctaggacttggtgccccatcatcgagtgcacggatgcaacaacaacaagaagatcatggtcgtgcgtatcatcaagcacaccatggagatcatccatctcaccgatgctaactcaatcctgatcactgtcgacgctatcatccacaggggcctcaaatttttggagatggccctggttctcttgcagggatatgatgatatttccaaggaaatatactgaacctgatgtgacaaagggttgtttggacctgggaattttaatgctgggttgatgagttcatttggctgacctacaatatggacatgggattggctgtgtggtttgatgatgttgcactcgttggtgccatcttatgagtatggtgatgatcctaagtaattggttgtgttattttggttggtactatcttataaacatgtggtgtaatgatactactgggacaaagttggcgaaatcctgtgttgtttgtttaaaaaaaaaaaaaaaaaaaaa

SEQ ID NO: 34824 - DNA, 1412 bp, Triticum aestivum
  unsure (1)..(1412): unsure at all n locations
  Clone ID: PAT_TA_34824
tgnccccccacgcgtccgccacgcgtccggagactgtcgtgaaagacactgtgaagtatacacagtatcaaagagcaattgctaaggctttggttgataaggtctcacaggatgaagtttccacaactaggacggtcttgatggttgttggagcaggccgagggcctctcgtaagagcatcattgcaagctgcagaagaaactggtcggaagctaaaagtatatgcagtggagaaaaatcctaacgcagttattactcttcatagtttgatcaaattggaagggtgggaaagcatggttactattatttctagtgacatgcggtgctgggatgctcctgaaaaagctgatattttggtcagcgagttgcttgggtcctttggtgataatgagttatctcctgagtgtctagatggtgcccaaagattcttgaagcctgatgggatttctattccttcatcttacacaagctttatccaaccagtaactgcatcgaaactacacaatgatattaaagcacacaaagatattgcacattttgaaacggcatatgttgtcaagctacaccgagtagcaagacttgcacctccacaagaggttttctctttcgcacatccaaacttctcaccaaaggccaccaaccaaaggtataccaagttacagtttgaactaccacaagacacgggatcatgccttgtgcacggattcgctggatattttgatgccgtactatataaagatgtccatctaggaattgagccgaacacatgtacaccaaacatgtttagctggttcccaatctttttcccactgaggaagcccatatacgtgccgtcagagtcgcccatagaagtgcacttttggcgatgctgtggtgccaccaaggtgtggtacgagtgggctctggtggctccgtctccatccccgatccataacagcaatggccggtcatattgggtcggtctataagttggaaaatcagaatactctgtgtcggttttttgagagagaagaaattgtcgatcatatgcttggtttttgagtgtgtccagctacctggatcaaagaaacagatcttagaacctggatacaggcacatgctgtaactcgcaagcttttgctttgtaacatcttttacttcttattgttgttgccgcgctaatccttgtgcgtgctagggttttaggtgctgagctcgtcatcagttttgacattgccttttctgttcttgaggtgaacatgcggagacgcagatctagtttcgtgctagggtagtcaaaatgtgtttctttcgtccgggatgcaaagcaagtggctttactgtagaatcacaaacatgcatagggtttgctactcaaatatatttctcgatgcttgggaaataacaatttagttgttgtcaaaaaaaaaaaa

SEQ ID NO: 34825 - DNA, 2381 bp, Triticum aestivum
  Clone ID: PAT_TA_34825
gattgcatgttacacaaattagtgattggttgccagagaatagaactcgaggacagataactgaaagactattatcaccaatctttcagccatcagaggtcgactgtgggcagtcatctcaagatcttgatagtgaatttcatgttactttggaactaacagagctgggcatatccataattgaccatatgcctgaggaagttctttacctctcagtccagcaattattacttgcctactcatctggaatgggttctggaatcaataggtttaaagtgcgaatgcactggattcaagtggacaatcaattgccttttgtttcaatgcctgtcctcttttgtcctcagaagacggacaatcaatcagaccatgtgctcaagttctctatgacgatgcagaccaataattctctagatttttgtgtttatccatatattggtgtgcaggttcctgagaattgtgtgttttttgttaacatccatgaaccgattatttggcgcctccacgagatggttcaacacctaaaaattgataggatatctacctctcagccttcagctgtttcaattgatcctattctgaaaatagggcttctgaatatctctgaggtccgctttagagtatcaatggcaatgtccccaacccaaaggccaagaggagttcttgggttctggtcttccttgatgactgcattggggaacatggaacacatgccggtccgtatagcgcacgggtaccgtgaggagttgtgcatgcgacaaagtgcactaatgaactctgctatatctaacatccaaaaagatcttcttagccaacctcttcaactactttctggtgttgatattcttggcaatgccagtagtgctttgagtaacatgagcaagggtatagcagcactgtccatggacaagaagttcattcaggcccggatgagacaggatagcaaaggcgtcgaagattttggtgatgtcatacgagatggaggtggggctctcgcgaagggaatcttcagaggtgtcacgggcatattgacaaagcccattgagggtgcaaaatcttctggtgttgagggctttgtacagggagttggaaaaggcttaattggtgcagctgctcagccagtgagtggagttcttgatcttctgtcgaaaaccactgaaggtgcaaatgctgtaaaattgaaaatatcatcagctataatggctgaggagcagttgctgcgtagacgtctcccccgagcaattggtggtgatagcttgatctatccttatgacgagtataaagcagctggccaggctgtcttgcagttagctgaatctggtacgtttcttggccaagttgacctttttaaagtgcgaggaaagtttgcatctactgatgcttatgaggaccatttcatacttcccaaggggaaaattctcttagttacgcacagaagagtatcgttacccgaggtaccgatgatgacccagagaaagttcaatcctgcaaaggatccatgctcggtaatctgggatgtattatgggatgatcttgtcacattggagactactcatgggaaaaaagatgctcctggatccttgccttcaaagcttattttgtatttgaaggctaagcctgcgaattcgagggaagctgttcatttgatcaagtgtaatcgtggttctgatcaagcgactatcatttactcatcaattgataaagtctatagaacctatggcccaaatgcaatcaaggaattactgagatggaaggtaccaaagccatatgcccctcgcaataccaaccgtcacactgttcaagatttatcatttgcatagatgatattgatcatgcaaaaggtcaagaaacattatatacacttgtgatgttccagatgggctgcgtttgagtacccatacctgctaaaggaaaggtattagttggcttgcagcccgcgtagttgctaatggattgaagtcgctaaagtaaaataagatatcatttgttgctcgatttaagtggtgatttccttccacagttacggctcttacctacaggtgggtactactggcaaaggagaacctgtccactccggctagaaaaacggaaagcctttttcttactagtttgatttctactccattggatgctcgaggctcaagaagaaaatatggaaaaaacaacttgtttacaggtatatgttaggatgtcaggatagctggtggtggctcttattgattacatgtacatagcctttttgtgatgtgaagccagagcattttctttaagcagaactagatgaccctttacgccctttgcgcaaaaatcagttgtagccgtgaagacaagtaacatataacctatgaacagttatgttttacgaatgcccatgaaaaaaa

SEQ ID NO: 34826 - DNA, 376 bp, Triticum aestivum
  Clone ID: PAT_TA_34826
gtcgacatcatgagcttactgaagtttgtcccagttttggtcgtccacgatgacgatacccttcatactatgtgtaaatgcccctggcgacgaacctgtggcatgcaatggccaaagattggcctagccctgatgtggattttgttcacaacaatggccctgaatggatgttctcctgctctagccactcacaaatacgccaagcgtggtgttgctgaccatgtgacgtacttggcacgtccgtaacgagataactcgtcagaagaatccgccccctacaaaggcctcctgcagatttctccatggatatattaattccctgctatataaccggcaacagcctatcgctgatattgttaaaggcaaaacggtggtg

SEQ ID NO: 34827 - DNA, 584 bp, Triticum aestivum
  Clone ID: PAT_TA_34827
gtggtggaagaagagtgggacagggacgaggacaacaggcccgaagggaataaccatggccagcaaggtttcggtcgtggtggaagaaaaggggacagggatgaggacaacaggccagaagtgaataaccatggccagcaaggttttggtcgtggtgcaagaagaggggacaggaaccatgacgatccagtggaggacaatgaagatcgtaatgcagcacaaggtttcgctcgaggagggccaggcccccgtggaggcggccggaatcaaggcggccggaatcataaccggagggatcaggcgctgaggaagcatatgcaaggaatgacagggctttagctcaccaccgtttgaagttcagcaggaagtgtaaatttgtccaaatggttttgagggacagatgatgttcacacaagcgcttgtattttggttgttacaattacatgatacacaacatgcagctgcagcccccatagatacttttttgttttggaaaaagacgttggtatgaaatgtggagatcctttaaaggtgaattcccgttgaagtaccctggtcccccccggaactgcttcctttttggt

SEQ ID NO: 34828 - DNA, 913 bp, Triticum aestivum
  unsure (1)..(913): unsure at all n locations
  Clone ID: PAT_TA_34828
gtttgcgaacggaccgctacgaccgcaccaggctcgagtcgcgaccgatccgcatctctctcaagcccggtgcgatgttcctgcggcgcctgagcacgtccgcctccgccctcctccgccggcgccgccgcggcgccaaggacgacggcgtcctatccgccctgcgtgcggagatcgcccacgagctctcctcgcccccctcctcctcccccccttccctccattctcaggaggctctcgactttgacaccgtgtcggacgcgccgcgtgcgcaggacgtgcttctgcgccgccgcggagacgccgaggaggtccacgtgtcggcgctgctcgccccgctgcggttcgaaggcgaggagccgctgcccagggacgcgctcatgaaggtgttcatcagcaagccaggagtggaaccgctgctgcgcttcgactgccgcgcggttgccgccggccgcggcgctgctgctggctatgatataactgccctctcgtatcacgcgttccctggcgatggtggagacagcaagtatgaagggccagacttcggggatttggatcctaagctacaggctgcactgaaagaatatctcctggcaagaggcgttacccccgaactggcgacctcacttcgtgaacacttgcttcagaaggagcaggcccagtacgtgagctggctgaaaacattggaggggatgttcaccaaagatcattgacctgatcgttgtccaaaaagatgaagaagagaacgatgttaacctattatccccatcctgtcaactttgctctcaattgttatctgttcctgacgantcnaatgctnatgtccnttttggccgtnacaatgcgggatataaggtgaatgctgtaccccngtnattttgtgtcccgtccaattntcaanaaaaaaaaaaaa

SEQ ID NO: 34829 - DNA, 538 bp, Triticum aestivum
  unsure (1)..(538): unsure at all n locations
  Clone ID: PAT_TA_34829
ctcatgccgaattcggcacgtcgccgcaccgcaccaccaccggtagccatgggacccacaggtcagtgtcgcaccctcttgcttctgctcctcgccgccgccgccgccgccgccgcgccggagcacgaatccttgctccgcctcccctcctcggcgcgctccctcgccccgaagaccccccgctccgccggcgccgacctcatccgcgccctcaacctccaccctcgcgacgccttcccccgccgccccggcggcgtcggcgtcggcggcagcgatgctctcccggccggaaccctcgtcgagaggccgatccgcctcgccgtctctggtggccggagacgacgggcacgtccgggtgagcaaatctccgggcaccaacgccggggtactaccggcctgccaccaaccccggcgccgccctcggctcctccctcttcccttccttcgncacccgaggcaagccccgtggtgaggggcggccccctcggctcagctggccggcgaantagctcttcacganaatngncactnaaatatn

SEQ ID NO: 34830 - DNA, 592 bp, Triticum aestivum
  Clone ID: PAT_TA_34830
cccacgcgtccgtctcaccctgctccaagcctctctgtcgcacgcatcccaccccaccccacccgaccgcgtcgagtcgagtccaatcgatggagcagcagcctgtggcggcggcggccgcggagccggaggtaccggcggggcttgggctgacggccgcggagtacgcgcagctgctgcccacggtggaggcgtaccaccggtacgccgtggggccaggccaatgctcctctctcgtggcgcagcgtatcgaggcgccgccagccgccgtctgggccatcgtccgccgcttcgactgcccccaggtgtacaagcacttcatccgcagctgcgcgctccgcccggaccccgaggccggcgacgagctccgcccgggccgcctccgcgaggtcagcgtcatctccggcctccccgccagcaccagcaccgaggcgcctcgacctcctcgatgacgcgcgcagggccttcggcttcaccatcaccggcggcgagcaccgcctccgcaactaccggtccgtcaccaccgtctccgagctctccccggccgcgcccgccgagatctgcaccgtcgttcttgagtcctacgtcgtcg

SEQ ID NO: 34831 - DNA, 480 bp, Triticum aestivum
  Clone ID: PAT_TA_34831
aggttattttggcttatgttatttgagcctcttagtattgcctttgagtcactgcagtctatcatggtgcatggatttcagttgcttgacatttggcagcgacatctgatggacagtggtgtggactatcttgatttccaaaaaacttataaacaagcagcaggttcattttctgaatggagaggccaacttataaggaattttggtctttgtcattgacctgataagcttgttgatgtcacttggtcattattcgatgatcttttggctccgtggtatggcgtttcacctggtcgacgcagtgctcctgttgaacttgcgtgctcttgtagtttcatttttgaagaggattaagacctacattaagttaagaaaggcactccgttcgctcgatggagcactcccagatgctaaatacgatgagatctgcgcatatgatgatgagtgtgccatctggcggggaccaatggctcgagctaa

SEQ ID NO: 34832 - DNA, 958 bp, Triticum aestivum
  Clone ID: PAT_TA_34832
agccaaagcagcagccttccccggttaactctcccgcggattgcccgagatcgatcgagcgaggccgacgccggccatgagcgaccagtcccagcccgtccgcaccggcgacgtctacccgccctccgccgccgcccacgacgcgcgccgccagcgcgacgaggtcctcgccacccatgatgatcagcagcagaaacaagatggccgacgcggcgatctccgggtcactgagaccgacgaaccgcacgccgggagacgcgtcgtcaccgccaccgcaggcggccaggtgatggcgcagttcacggtgccggtgccgggcgccggggtggaggaggcgacggacgcggtgaccatcggcgaagctctgcaggccgcggcgcagacgtcggcgggcgagaggccggtggacctcgccggacgcggctggcggtgcaggccgccgagacgcgtgccacgggggccggcggcggcgtcccccgccgcgtggcggccgccgctcagcaggccgcggagaccaacatgaggccccgcctcgcggacggggagaaggtccggctgagggacgtgctgggcagcgccgcggcggtgctgccggccaacaaggtggccacgagggaggacgccgttgcggtggccacagcagcggagcgcaacgccgctgcgggagcaggtggaggaggcaagggcgtggccgacgcggtggccgtggccgccgagatgaacgacaagaggatgacgcgcacgcggcaggcttaggctaggtagcaggctagcagcctagcagaagaacgtgcgtggccactgtgatacgttgtactgcgtatgcaccacgcatatcactactacgtacgtaacgtacttctctatccgtgttgtaatctgtacatcatattgtacgctttttcagtagtataaaacgttcttattttaaaaaaaaaaaaaaaaaaaaaaaaaaaaa

SEQ ID NO: 34833 - DNA, 514 bp, Triticum aestivum
  Clone ID: PAT_TA_34833
cgagaagggggaggtaggtgccatctgccatgtcgacgacggcgcacaaggtggcgacgcaggcggcgtcggcggcgggggcgagaatgaagggtcggcggccgccgagcgtggtgagggagatcgtgtacgggatgagcctggggctcttcgcggggtacctgtggaagctgcaccactggagcaaccagcgccgcacccgcgagttctacgccctgctcgacgagggcaggatcaccgtcgtcgttgacgagccggccggagccaaggattagccccatccatagtttcacctacctactaggagaggtattttcagcccgtgcttccacagatcagtaggacagcagcggtttggcttgttttgtttagctagctagctagctcagctctgttcttttcttcctcgtgtcactctgtaatgtgtactgcactgcagctctgctgcctgcctttgtctcgttgccgatcgaagagaataaaccgatgcgtgtcattcatcaaaaaaaaaaac

SEQ ID NO: 34834 - DNA, 758 bp, Triticum aestivum
  unsure (1)..(758): unsure at all n locations
  Clone ID: PAT_TA_34834
gctttggatcagccccgttcgtgctttatangggtagtagattttgtctgagcatacaagacttcagcttatattttagttttaagtttctggtcccagtatgctgtcattgttgtatgagtcaatcgcggtgtggtcgaagttgttggtagtttttgaactgtgtaccttcgcgtgcgagctgggcaattagtttagttgtacttcttttgtagtaaacttccttccataaaactttcaaccctattttacttttaccagttaaaaagcacacactttatcacttaaaatgcaaaattttaccaagtctacaagtacccacaaaatattctttttagcggaagtacccacaaattgttatgcctttgcccccaaaaaacaagagcctgttaatcggacgatgagtcagcaatattgattggatctatattacattgagttactgggactaggactatacatacaacaaatgttcaggaatcgttaactggtaactgcttggtcatctgttgagtaaggggttagaggggaatcagccagttaaatggctgttcgctgaccaaccgagcagggattagttggcaagttgactgattgtcggccgatattttaaacactgcatacaactacgagcttactgggctgggtattcgatacaaagacatgtagaaatgggggatttaggtttaaggctttccaatgtctaaggaagcaaaaattgggtggaatattccaccctaagatttattcttgggtct

SEQ ID NO: 34835 - DNA, 957 bp, Triticum aestivum
  Clone ID: PAT_TA_34835
gcaggtgtgatgaagataactttataagtgtggcgtacaattacaatgacatggcaagactggatggcaataaatacaaggttcaccgattatctctgagttctgtggctggtcgtggagcatcatatgccccaactattgatgtctgcttatcacaagttcgatcatttacacttttctgggcccccctgccttctcttttgctgttcaagtatctccgggtgttgagaatagaagaatacagccatgattgggaggccacacttgacctcactgctattggccagttgtttctcttgaggtatttgcatgttactgtgtcatgtttcgtacagctacctgctaaatttgaagggcttgtttacttggagacattggacatgcctcgtgccaatctcaagagcatctcctcagatatagcccaattgcctcagttgtcatatcttgatattcggatggaaaaattcatgtgtgaatgtattgggaatatgaaatcactgcgcactctggtaatagatggtgatgagttgtccatgaaggaagtgaactcagtgaaggttattatgggtctcggagagctgaccaatctaaggaaactgcagatcggagtgaatggttgggaaaagccagaacatgatgctttcgccagctcccttgcaaagctccgtaacctcaaatgtctcaaattcactagtggctatactatgaagataacgagctggcctcattatccaatccttttccgcatctcgaggaatttatcagcgcccctagatggatattctgtagagttcctgtatggatgggtggtctaaattgccttcgcatcctagagctgcgtgtgatggaggcgtcaacccaggatgtcaatcttcttggagagcttccgtccctcgtagtactctggctcatggcgttaaatatcccaaaagaaagagttagattgggcacgggact

SEQ ID NO: 34836 - DNA, 1519 bp, Triticum aestivum
  unsure (1)..(1519): unsure at all n locations
  Clone ID: PAT_TA_34836
gaattcggcacgaggtcgaacgcgaggaatattttctcaatcgaataagtatatctcgagaaagaaaataaaaatatcacaccactagtatggcgctgctgagcccgcgtgttccgcggctgcccctcgccgcccactccgccggcgccggcgccggatccctccggtgctgcgtccgggttgctgcctccgctgcgcgatgccaagtgacggcgtcgggaagcgtggcggcgggctcctcgtcgtcgtcggagctggaggccatccggtggggcagcgccaagctgcagggagctcgcgaggagatggaggacgaggtcgtcctccgccctgactccctcctccacggcttctccttcgccgccgtcctcgacggccacgccggtttctccaccgtccagttcctgagggacgagttgttcaaggaatgcgcggccgcgttggacgggggcgcggtgcttaacaccaagaatctcgaggccatcacggactcgatcaggcgtgcctttgccaccatggacgccaacctctccacctggcttcagcaaatggataaggaagacgactctggtgccacggccacggccttgtttctgaggaacgatgtccttgttgtctcgcacattggcgactcctgcttggtcatatcgcgtggtggaagacctcagtctctgacaaattttcatcgaccatacgggaacaacacaacatcccttgaagaggtcaagcggattagggcagcagggggccggatgccccttggtcgcgttcgtgccctcttttcgggatctcgtgctctcggagacagccgatttaagcccaggaagaatgagatgctagtaaaaggagttaacgaaggaagatggactgaaaaattcgtttcccgaataaaatttaaagggggtctaataatctcttcacctgacgtatctctggtggagcttggaccggatgtggaatttgttttggtagcaaccgatggcctttgggattacattaaaagcactgaagctgtagcctttgtcagagatcaactatgtcaacatggagattccagccggcctgttaggcgcttggggagaaagctctggatcggcggtcacaagacaatattagcatagtcatagctgacttggggaggacaaactggcaggagttgcccgttccaaggccaaacgtgttgttggagctaagtcaagcagttgcgactgtaggggctgtatcagtaggaatttggatttcatcgcttctcactttgcaataggcctagttaaggtcgggggtgacattttcacatcttcggctccagctgcaaatatatatgtatatccttataggtaattagtttcctgattaaactgttcagtggtatctggactgatgaaaagaaggagatcaacttggcccccaacttacaacttgcaacgtactacaataaggacctgtanancccttcnaantttccttttaccttcccttttaatgggganataaaccttaaaatttggnacgcacaaca

SEQ ID NO: 34837 - DNA, 934 bp, Triticum aestivum
  unsure (1)..(934): unsure at all n locations
  Clone ID: PAT_TA_34837
ccaccttcccctctccctcttccttcctctgccgccgccggcgacaccttgctcgcgaggggtatacgcggggagagaaagaggggaacgtgttcgtgaagaagcctaagatttcggaggtcgacaaggccatcctcgccctcaagacgcagcgccgcaagctcgcgcagttccagcagcagcttgagaaggtgatcgaagcagaaaaggaagctgcacgccagttggttcagcaaaagaagagagacagagctttgattgcactgaagaagaagaaatcccaggaagagctcctgaaacaagttgatacatggcaaatgaatgtcgaacagcagctggcagatattgaactagcaagcaagcaaaaagctgtattggaaagcctaaagactggaaatgctgcccttaagtctatacagagtgagattaacatcgacgatgtccaaaagttaatggatgacacagctgaggccaaggcttatcaggatgaaataaatgccgctctgggtgaacaactatctgctgaggatgaggaggctgtcatggctgaatttgacaacttggaagctgagcttgcacttgagactctgcccgaggcacccggcacagaaggacaatcggaaaagaaaaccaaagcaccggccaacactgaagctccagctgaagacaatgaagaaggcaaaaagccacccgaaggaccaacnaaagcgccagagaggtccgaagccccagaaaaaacaaaagtcttggaagagccactacccgcaaagaggaggagctgagctgaacagggcactccaagtcctgcggtttgcaggagctgtaaaaaancngccaattgattggacnacttaaatttgtcaattcataaggttcaatgtgtacagaatctgaaatgttgggcccggttatcaattgatgcagtgaaaaaaaa

SEQ ID NO: 34838 - DNA, 645 bp, Triticum aestivum
  Clone ID: PAT_TA_34838
gaataaagacttggcatctgttctaaagacaccatgcttttaaataaatcttcatcgaaagatgacaactgaagtttacacagacatgcaaacgaataacaaactttcgataataaaaattacagaaacacacggaagccttgtaattgcctcggattgtaaaaatgttgcacttggcacagttcttcttaacatgattgcggcggcgggggcggctgctgctcgccttgccaagcccagactatgtccttcagcgccggcctcatctcctggttcaagaccttctggtactcgatagtatcaccgtttgtcttcttcaactccacgagatggaagtcaggggtgacctcgaatatctctgcatcaatggacatcacacctttccttccaggcttgaagctttccatcctcatcatgccaccatctttcttgacgagcttcagtcgcatgcactttgcgatgtcctcaatctttgacacgattgtcgaagccgagttggtggatgtgaacttggactccctcttcttgtcattgtcctcaaacatacctgagaggtcgagtccagttgagagggagattatatcaaaagcattcaagttggagagcttctttgcttcttgttccttgccctctcggacgcgtggg

SEQ ID NO: 34839 - DNA, 2202 bp, Triticum aestivum
  Clone ID: PAT_TA_34839
ttttgtacaaacacttggcatctgttctgaagacaccatgctttcacttaaatcctccatgattgaagataactgaagtttacaaagacgaaacttggggtgtagaaacgaattaccaacgtgcgataaaaaaaaatacagaaacacaggtactaatggtaatagccaccacatgtacaacgaatgtagcagttggcacacttagtcgcaaaatggttgctgcggcagctggtctctgaaactcggcttgccacgcccttgctgctgcggctgagggccggcgtcctctttggctcgccgaccactaggtccttcagcgcaggccggatctccttctgcacctcgacgatattgaagtactaggttagtaccaacgtctgatcatcattcgacatcacagattttctgccgtcatggatagtctccatgattatctcatcaacaacttccacatcgaacttcagcctcccggcgtttgccatgtcttcaatctatgaaatgaccgtcgctttcgaggtggagcttttgaccttggacttcctcgctgtctcatttttctcaaacatccgtcaaaggcagattgcagtttattacgatgttttaccgcatcctcgcaactgagttagagtttgtgaagatagctcatccccctgcgttgccgatttctcccaaagaaaacaatgatgatgttcttcagtttcctgaggtaccatctcaagcgcctgcgaggtctatagcttctgggcaaatttaaagttttgcacgttccacgacctgcagagtttgtggagatgagctgaatcgggcacctcaagtccgggtgtggatcagggcattcatatatctgccatttgatggttctcctaagagatctaactggggcatttgaattctggctttcccaatcttcttatacatattcatcagattcttatcctggaacgggagatacccagccaaaagcacaaagaggatcaccccacatgaccagatgtcagccttggctccatcatagcctttcctattgatcacttcgggagcaacataagcaggcgtgccgcaggatgtgtggagcaacccgtcaagtcttctgcattcagaaatggtactgagaccgaaatctgaaaccttcaggttgctgttctcatcaagaagaaggttctccggcttcaaatcacggtgatagacgcccctgctgtgacaaaagtcaactgcgcagatcagctgctggaagtacttccttgcagcatcttccttgagccttcctctctgaaccttgttgaacagctctccacccttcacatgctccaacacaaagtaaatctttgttttggttgccatgacctcatacatctgaacaatgtttgggtgcttcaccagcttcatcacagagatctcgcgcttgatctgatccgtgagcccgcccttcagaaccttctccttgtcggtcaccttgatggcaacactctgcgaggtctcgatgttacgggcatggtagaccttggcaaaggtcccttgcccgagcatcttccccatctcgtacttccccatcagaatattccccttctgctctcccatgacggcaggcagatgtatgctacgcacacagaacagcagcagcgatcccgaaccttcaaagggagcctgcgggtgctagatgacctcaaccgtcccctccgaggtggtaatctaagatgatggttgagatgccacgtcgaaccccattgtgcagaagcacatggaagaagaggtgtgttgtgtgctgctgtgaagcggtgtcatcaaggtcaatcaaagcagaaacaggggcggctaccctgccgattccctcgcaaggtagctctctagcatgcaaacacatctttctgcattccctaagatgtttcctccttgctgaaatccaggtacagatcccggcggctcgcgacgcgaacggaaccgcggcagcagccccggcggtggagtagatcccttcccttcctccgcgaagaaccggcggcgctcgcgagacgaggaggccggcgggggagggaggaggcggatgcgtgggcggcggggctgggagacggcggagtcgtggcagatttgcggctcttctgttgggggtgggaggctgagtttgtttcttcctttttccaccgccgccaccactcccacctccaccgccacccccaccgccgccgcctccgccggggctagggc

SEQ ID NO: 34840 - DNA, 1042 bp, Triticum aestivum
  Clone ID: PAT_TA_34840
tttgcattcacccccctgatctacgcctcgaggtcaccacaaccagcgacgacccaatcctctcgttctcccccaaatcgaagccagtcttcttcctcttcccccaactctccctcccgatccaatcccagatcgctgagaggcaatcatccaatccaaagccattgctggtcatgcagagattaatggcggccggtccatataagctgccggtgtgcatcgcaatggatccatggaaggcggcggaggagcggtaggtggaggagcagaatccggcgatgtccagccaggcaaggccatcgcggcggccggcggcgtaacacgcgactgcggaggatctggttctggaggcccccaccgtgctcgggcagtcaggttccgaccgcgctcgccctcgtacatccttcggcggcggcggtatggttgcggagccaaactcgtcgacttggacaaggatgtagcagctgatggcgaagctggtgtcgggcatgcaggtactcttctccatcggcctcatgttcatcttctacctcaagatactatgattattagagacagtatgcagaaggattgaacaagaagaattgaatagatcagcgagttgtacctggatccatgtttagattgaagtgacgtgtgggctggagctcttcatgcacggcttcaccctcttcatgtacggcttcatcctcttcatgtacagcttgctcctgaaagagagcttcatcttcttccctgttatcctgtatggcttccactccctcatgcacggcttcgtctccctcatctggtggtagtatattcaagtcaatggccatggatggggtgtgtgtgtgtgtggtgtattctttggtaaatgtgagctggctttgtagctgtgttaggcgtttggattccaatttttggcgcctgtaatctggcttactagtattgaaactggcgggaacagtgtactggagtaactggctgaagctaaattagctagcgggaggaggaattgtattttgcttgtgatttaatgagacatgtgtattaactgtgt

SEQ ID NO: 34841 - DNA, 637 bp, Triticum aestivum
  Clone ID: PAT_TA_34841
gaggaattcggacgaggcctctctataaggaggacgtctcccaccgcagataatgcgccgccgccacagaccaggtctccttcctcttcttcgatcaaggcaatctctttcctgttctttagtccaatccttctatttcctgatccaatccttctttaacctgaaactgtccggggctcacccgatctcctccaccagcgtggccaccatcctgatcccctctttcttctctaccatgagcgcctactcagccgagattcgcccgcgaggagaggcagggagcagcagcacgccctgggcatcccgtgagcccgcctaatcccgctgttgccctccgagattcgccgaccataagcagttccgcgtgcacggccatggaaagacctccaagccgccgccgattcgtgtacttcgagggctgccacccacaacgaggaacacgagcgtggtgcgtcgacgtggcaaacccgttctccttcctcactaccatgtgcagttcgccgatgcccgtcgccaacccagtccttacgcgaacgacacaatctggaccctgattatcatgattgcatgagagattaataccattgtaccatgtgtgctagctagaaaccgtatggtgatgctaggtgtattcttg

SEQ ID NO: 34842 - DNA, 435 bp, Triticum aestivum
  Clone ID: PAT_TA_34842
actcgcgggtcgaccggaagggagaaagtgttcttcgcgctgctcgtgggggcagagctcgacggcctcaccaacctgcagccccgcggcggctgcgacgaccccagctacccttactacttcaagtgcaagttatgttcgagggatggatcagttgtgatgattcctgggcagggaacaccactaactgctgagcagagccagaaaggagagatgacttgtttgatggtctttgaatgcagaggctatgaacctattgagttcgcttttggtaatggctggaaggctgaatctgtacatgggacaccatttgacattgatctttctgaaggagagtttgatgagtatgatgagaagggagagtgccctgtcgctctatccaagctgcagtcaacattcagagtgggtgaagaagcagggttttcatggggagaa

SEQ ID NO: 34843 - DNA, 1205 bp, Triticum aestivum
  Clone ID: PAT_TA_34843
cccacctcccctctccgaacttactcacccaaacccaaacccacccacttctcctctcaagccttcgcctgccaccgacgccacccaagcccccaaccctagcgaggactgaaagaggaggaggcggcggcaaccccgtcgaccggaggggagatggtgttcttcgcgctgctcgtgggggcagagctcgacggcctcaccaacctgcagccccgcggcggctgcgacgaccccagctacccttactacttcaagctgcggtgcgagagctgcggagagacgagcgccaagaccacctgcgtctccctcaacgacatcggtcggaactgcccaccggcctgaagcacctcgaatctcctccagaagtgcaagttatgttcgatggaggcttcagttctgatgatgcctgggcagggagcacagaccactttcggctccctcgacgagggcgtccatctgctcacttgcgaaggcaccgccaatctcctccagaagtgcaagttatgttcgagggagggatcagttgtgatgattcctgggcagggaacaccactgactgctgagcagagccagaaaggagagatgacttgtttgatggtctttgaatgcagaggctatgaacctattgagttcgcttttggtaatggctggaaggctgaatctgtacatgggacaccatttgacattgatctttctgaaggagagtttgatgagtatgatgagaagggagagtgccctgtcgctctatccaagctgcagtcaacattcaaagtggtgaagaagcagggttttcatgggaagaccagatatgtctaagatccagtttctcttgggctcttcaaacattggagtcagagatgtataaagcgcatctacaaagtcgaatcctcaatgttgattttgtatttgaactaagttcgtgcccatgattcggtggtcggtggatttgccatgaatttggttaagcttgcagtgatgtggcctcctgtttggaaaaattgaatattctgcctatcagtggtttcaaacttagatctatggctctaccatatcaatcataaaattatgtggctgaagttctcttctttttccttataactaaaatttgatatttgatgctctttatcatacatctaaataccggacatgtgcactgctcaaatctgatcacttatgcactcaaaaaaaaaaaaaaaaaaaactcg

SEQ ID NO: 34844 - DNA, 1184 bp, Triticum aestivum
  Clone ID: PAT_TA_34844
cacgagggccacccgaccttcggcgagccccgtgcctccaccggcctgctccatccgcctctcaaggcccaagggaggctccgccccgccgcgtgccgaggtggtggcgcgcgtccggaccgcctaccattgcgatggcatggcagattttcagcatgtcgtcccagttcatgcggctcaagtgagaaaaagaaaacggttagattgtcccagtgttaaagatgatttaggcactgataaggcaggaggtctagacatggatgatggagatgtcatgatgttggtaccaccactcttcgcaataaaggataatccaacaaacatagcgcttctaccatcgaccaatgcactatccaagagcatgcaaaggggagttgtgcggcatcggtgggagatggatattgaaccaacccttgcgcttcctttcaacattcaagctgtccccaagaaggttaactgggaagaccacataccaaggaattcatcagagtgggattcacagatggctgtgtgcaaattatttgacgagcgtcctgtgtggccaagacagtcactttatgaacgtttgcttgatgatggtgtgcatgtgtcaacaagccagttcaaaagccttttgtttaaagctggatactacttctctactggaccctttggtaaattctggatcaaaaaagaatatgatcctcgtaaagatcctgagtcacgaatatatcagcggattgattttcgcatgcctcctgagctaaggaatcttcaaacgaaaaggcacaatggatctgagaagtggtcagagatgtgcaagcttgaaaggatgccatcgaaaagtttcatcttcctgcaattatttgaactgaaagatgacttcattcaagccgaaattagaaaaccttctcatcaatcaacttgctcacattcgacaggttggttttctaagccaatgattaaaagtttgagggtacaactatgcataagggtcctctcattatgtcctaatgaagatgccaaaacccttttgagaaggtcccatcaacttcttgaaagggccaaaaagcaggaagctatttgcagatctgagcaactgaaggaaagaaaagatggtgatgagagaagctcctgctgaacattgtggatctcgagggatcagatggacactaacaactctgatagtggaaaatgctggtgac

SEQ ID NO: 34845 - DNA, 690 bp, Triticum aestivum
  unsure (1)..(690): unsure at all n locations
  Clone ID: PAT_TA_34845
attgtcaccggagcacagctcggggtgtgggacttcggtttgaagaacgtcctgtacatgaagcttctctactcgagggtccccggttgcaccacccggagatcgctctgggatcacagccctgccgccgccagcagccatccgacggttggtccttctaacatcacgtatctggacccggggggttctggcgcaggctcgagcgatgcagggaagttcgtgaagatcgtggacaggtcggagctgtgcaaaggccccgacgacatgccggggcactggctggtgaccggcgggaagcttggcgttgaaaaggggaggattgttctgagagtgaagtattccttgctgaattactgacagcgttatctgtgttgttgaaaacttcggggtgcagcatatggtgttgtaagtgcagctgcagtcgtgattcccttttcttgttttggtagtcaagtgatagattaatctggtacgtgtctgtttgcagccgatcgctgttcctatagtttttacaagagatttttctccatgcaacgggacaattttggtggagttcttcgacggtgtttgtacagggcttcagtcttgtaaagtgcatatttgtcattcaagatcgacactctttccctttcccgtcccctttaaactctatggactgatgtatttcggttanaaagtaangaaagggga

SEQ ID NO: 34846 - DNA, 788 bp, Triticum aestivum
  Clone ID: PAT_TA_34846
ccggaggctcagggcgagcccgagaccgagcacacgcacatggagaggagcatgtcggaggcggcggccgaggccgagctgccgcggctccccgcgcggctgcgcaagtcggccagcgacaagtcggcgttcgcgcacttcgtggccgaggaggacaccgaggtggtggaggcgcgcaggcccgcgacgacgagggacggggaccgccgccgccgccccctcgcggcggagccggaggagccggtgtcggaggaggagatcgaggaggccggcggcgaggtggacgcgcgcgcggacgacttcatcaacaacttccgccaccagctgaagctgcagcgcatcgactccttcatgcgctaccgggatacgctccgccgtgggcaggcgacggccgtggcgagcgccgagcagtagagcgattccggagggggagatccaggggcctagatgcaagaatgagaagagatgcggggagaatgagaagagatgcggggaggaggaagaggagacggtagtttcttccttccttcgttccccttctgtttcgtttttttttactttctttcccctgcttggatgctagtaatatattctagttttggataaaaaaagtctgtgcaatgtggaaccatatcatcccgtggattgcaacagctagttaatctcatgatgtgtatgtaaatctcttgccatttcgcacattttgggtttggttctgcaaaaaaaaaaaaaaaaaaaaaaaaaaaaaaaaaaaaaataaaaaaaaaaaaaaaaaaaaaaaaaattta

SEQ ID NO: 34847 - DNA, 613 bp, Triticum aestivum
  Clone ID: PAT_TA_34847
gttaatacaccgatttcaatttacaaagagaatccattgccaagtcagggccttgagagagctaggagcaaagacagggtgtggaacacccttggaacacaagcagatagaaacaaagaaaataacatgatgcctgccagatggacttcgcacaagattccaccgaaggtagcagcacggccagcagttctgcccgctcgtgtcaactccattgaggtcttcgtagatgaagaatgtgccgaggaaccagccccgtctcaagtgccaaagagtccaaaaccatcagttctgaagcttaggcaagcaacaagcaaaaaccttaagaaggaaacagaattgcttaaggagaatccgctgcgcaacttcccgctgagcagccttagataattaacagtaatattgttgacgacttgtttgaatctgtgcctttatgccaaataagctttagactctaaagcttatagatgcaccaagcatgtaggctcgattgttgtgatccctgtacacgaattgttgaggatcttgtacattgattttgttttgtttggatgtccgtaatattgcatagaggttcacaaaggaatttgatcttgccagcttctattggcactat

SEQ ID NO: 34848 - DNA, 625 bp, Triticum aestivum
  Clone ID: PAT_TA_34848
gaagcagttagttccttacagttgggtcaccgacggttgccgtgctactatgctcctctcatgttgtagtgactagctgctgcaattcacggatcatgctctctcgtgggaaggaggttgtggctttctcaattgatcagacagaaccccacatagttcttttcttgatatatattgttatttctgatactgtgtggaccatcagaaacctgatgtgtgtgtgtgtatcatagaatatcttgctattatgtatattgcttcccttttattcatgtactacttctctaaatataagccacttcttttctattgttagctctatcttttgatgttaatgcactaaaagtctaaagcctttccctatgcaaaatgataatattagagctatgcgtcttataatccctactgtatatgacaatgcgatatttagttatattatgtttgtagcatgacatttttccattcctttttttaaccgctgtatcacatacagaattatgatgtacaatgactgctcttgtacaaagtgaggaattcagttctctattctatcccaagttccccattaggatctgaatctaaatgaccccttcttcagttcagtcctagcaaaagctgatccgag

SEQ ID NO: 34849 - DNA, 753 bp, Triticum aestivum
  Clone ID: PAT_TA_34849
cccacgcgtccgcaggctgcagctcctccaccgccgtacgggcctataaagaggctctcttcatcccctgaaggtccctacctcgcctcctcccagccctccccactcatctccgccatccctatacccatctcctctccgcgtgacccagatgaggaaccatcgatgatggcgtacgggaagcacgcatggagggcgctgccgaggcgacggcgccggggacggaagctacctctaccgacaacagcacgaatcatcaagggccgcggcgctgccatcccagttgtcggcgtcctcttctgcgccctggccacagaggaggactgccacaactgttgtggatcctcatcgttcgtgttgtgcaaggacgggggtcgtcctcgttgtgcgagggcagcacatcgggagctgcaacaactaggttgccgcactccttgtcgacgcccttctgagcctgttgaacgccgcggtcaacgactacgtgggaagagctgcgacatgctgcttcaccttcaatggcttttcgcgccggttaaaacactgcttccgtgtagcatacttcccgtaagcggttatggaggagtacgactggcgcagcacggaatagacatatatcgggctccttgaaggcactagatatcgggactcttggtcccctttttttctagatagaatattgattttttgggtccccttttaccactcaagtactgaatgtctgatactaatatgtggtaatgtgatatttttggg

SEQ ID NO: 34850 - DNA, 1091 bp, Triticum aestivum
  unsure (1)..(1091): unsure at all n locations
  Clone ID: PAT_TA_34850
gtgcaggaaacaaaactttactattaattgttgaacgagaccatgagcaatgcagcctcgaccattacatgtttgcctgcgattttcaaactgatgaatttggagcagagacactgatgatgtacacataccaatcaccaggtattacagatttccaaccacctgtatatgtagttgaacactctttctggtatctgaaactacacgaactctgaaaaaatgagttagatgttgtcacagactttggaaagaggccatcccattttagcggatggaaaaatatttatgagctaacaattgatgatatttataaacctgtttcactataaataagaaaataatgcaaatcaaaagatactcaagcctgcatagagtccatcgatatagaaaaaccattgtggctgtaacactcagttactcacctaacagagntttgatcctgctcacacttattccagctttccgttgcttttctcaatttgatccatgcacgtagagaaaggagttcgaaggaggaattaaacacacgaagagagagagagagagaggggttaatagagaggaatcttctgcaatccacagggcagtgcacaacgtgactacctctacctggtgcaaacccctttgcatcctccgtagagcagagcacaaccaacagctctgtagcgatgcaatgcttctgttacctgtccaaaaagtaaacccttcttcatcctcgccacatggagtgcaggttgggcatcgcactcctaagatcttttccttcgacgcgttgtttgtacaagtcaactaggatacatggtgattcctctgttcatgtgacaacacaacaagtggcttggaggatgtggncctctttggaataatgtacttcacatgatgggggcgancttctatcaagaacatccatgattacggnaatggatcaacaaacggctgagcaagaaatatcaaaatgtgaacatgcattgttccctaaacatactatnntgatancaagtcanacaattaggtacttaantngatacatacatctatngcccaggtaattagntacaatgtantgtttgcacngaaaanctaggagttga

SEQ ID NO: 34851 - DNA, 1023 bp, Triticum aestivum
  Clone ID: PAT_TA_34851
aggcaccggcccgcggcgagctcggcgtccggcgacgtgcaggaggagccgggcctggagcggcggacggagacggcggcggagacggagcgaggcgctggtggtgatggcggcgggggcggccgccccggggcggggtgctcggaccgggtgaagatggtcggcggggtggccgacgggaagccgcgccgctgcgggagctgggactagttttacgggggccgctcgaccggcccgactggcggcggcgcagtggacgacgtaccggggttagataggcaggttgcggagggggccatgttttagggcttgtaccgcttcgccaaaccccgcggcgccgtcggccgcccgcatgccctcctcggctacgcgctagtgctcgcctcgcttggcatcggctccgtcggggagccgcaggtggccatgcacgtggagccggaggcgtcgttcctggtgcagatcaagaaccccgagcagcgcggcgggggccggggcgggggcggaggcggcggcttcggcgggctgcagggcaagcggaaggccgcgttcccggagcacctgcaggggcggttcgggagcaaccgctacgcgccggccgacccgccggacctgctcaactacgaggggtgcgagctgctgctgatctcggcgtccgacgacgtggaggaggagctgggcctggagctgcagacggagacggaggaggagacgggggaaggcgctggtgatggcggcgagggcggccgcgcctgggccgggtgctcggacctggtgaagatgttcggcgaggtggccgacgtgaagccgctgctcagcgggagctgggactagtttaaggttctagctcaactagcagcagtccagtagactacttagcgaggctagctaggtaggtcacagaggaggccaggttgtgtagcttggcggaagctcgctctgcagtctgcaactgtaacgcgttgtttccatgtatcgggtatcgcagcagtgttcaactatttgtgtgccaaaaaaaaaaaaaaa

SEQ ID NO: 34852 - DNA, 435 bp, Triticum aestivum
  Clone ID: PAT_TA_34852
ggtcgaccccatctacctaatacgtctctagaaaaacggttttgagaacattttagaaggttcctatccagtttttaccattttggggatcctcgtatatggtttttgactgttttttcattattttttcctttttttctttttagtttatattatgttaatttttttccaatatacaaaattttcaaattttcaaaagttatttggaattgtgaaacattgttaatgatttccaaaatgtttacaagtttcaaaaattgttttttggaattttaaaaagttcttatttttttcaaaaaacgaatagaacttgtaagaaaatttcttttagaaaaaaagaacaaaacctattcccaattttaaaaaagtgtttgaaattttcaaaaactgttgtggttttccataaatttattggaagtttaaaaagtacaaaat

SEQ ID NO: 34853 - DNA, 820 bp, Triticum aestivum
  Clone ID: PAT_TA_34853
atgttttgcatggattttataactacacaatgtttctgatttaatgagagccaccatgcgttcctggcttccccggcgatgccaacatggcatggcaggacccagtggccatcttcggcgccttcatggacttcgtcagcgccgacctctgcttcatcatctacggccacgacccctttgccgtcggcatcatctggcaccttggagtgcaaattaaatgtgttcatggagtggggtgtaattgtgatttgtgcaatgggtttagagtggaaggggctgtcattcttgtttagcaggggctgcaagttctatctctataagcctgacttgcagcggcaacaacagattcagatgtggtaagctcattcattcattctctcaggagaagaggaccaaattgattcaaattttgtgttctgatcctaatgttgcgaggtttgcgatcgcatgtatggtcgggactgcatgggtccggcgaccaattgcttgcatctcttgctgtatggtgatgatgaccggctcttgttaaatccaatacgactgcacttcttcgcttcaggaagaagatacagaagaacaaggctgcacacaaggagttgcctgattgcaggcagcggtgttgtaatatgaatcaagcttgtgaagaaaaattttgttactttaatgacacacacttgcattgtcaacattgtccgttttgctgaatgtacttgcttatccttctactggactaccattggttcactgtttccacatcccacattcgtccttccagactcatccccgtgaccctttgcatcatccttttccgtgccctctg

SEQ ID NO: 34854 - DNA, 1338 bp, Triticum aestivum
  unsure (1)..(1338): unsure at all n locations
  Clone ID: PAT_TA_34854
gaagtccagccgcgatcccaaacccactacccacctgaccgcgtcatacggggaaccacgagacccacaattcgatcccggccaggcggaggagagccaaaaccgaccaaagccctgcagccagcccgcgatccccaaaccccgatccatcagtcccgccgccgccgcggagcacgatgctcgatttggacacggaatggatccgcaagatcttcgccgcctcctcccagcccccgccgctccctccccgcgacgccgcggcccctccgccggcctggttcctgctcgagccgctcgggtacatcgccgaccacgcgaacgccacctccgcggaggcctcctccagcacgggccacaccgtccgggtcacggtctgcgccgccgacccgctgggcctctcccacgtctgcgtccactgcccaggcctcaccgacgccgacttctccgaccggcctaccgtcgtctgctccgagaaggacctcctcgtcctctcggtcgtcttcatcttcggcgcctacgccaaggagtggcctcaagngagtacttctgtctacatgtggcctgggcccgggcctggcctgtccctccacctgctcccaggccccttccctgcgcgtcctccccaatgcctgactgtctgctgctcgtgccccngcngacgactgtgctgctgcatttcctcctgcccgtcctgtgcttcacgctcggacgctgggtctatgacctccatgtgttctcctccatgacctggngcttggagctgtgaaggaggtggangnggggacngtgtcacctgntgccagagctgagngtgtcccanatcatagcttccaagtgtgattctgctcgtgagaaggcactgngtgnggatgggtttgatctctggagtggggatttgtggtctgcnaattgtgctcgaanaaatgcccngtgcttgcggttcatcccgctgccccgatgaatgcctggccacaggnagggcccaagtnatcccgtggccattcggaacgtctcctgaaggangttntggtccaagtatgtncgcagaatagnaagnaaacnntccnnagggccntgatccctggatgacaaaggcccctccnatgaacttgaacncactcntaannaggcanaactgttgaacaancccacannnaangggcttggaacgcctgacctggaacngngcccngttgccccntnnagccacgggcccggatncgaaannacctcngancaccaggctacagcgncancgagncacagnancataccaaagnacaangatcnaacncaccgccccagcngacacggcgnncanatcaaaancncncnnac

SEQ ID NO: 34855 - DNA, 685 bp, Triticum aestivum
  unsure (1)..(685): unsure at all n locations
  Clone ID: PAT_TA_34855
ctcatatggagaacactagtttatctactgctgcttgtcgttctctttcttcggccatacattcttgtggacaacatttccaaattttattacctaaaattcttgaatgcttatctatgaatttcttgctgtatcaaaggcatgactgcttcttaagaacagctgccaacatgattgaagaatttggccacaaggaagaatacagtgttgtatgtgtcagaactattgaaacgtttagctctgcagcttcactatcaaatttgaattcttcttacacatgtgatcaagaacccgatctaatcgaagcctatgcaaacttcacatctgcatttatccgctgctgtccaaaggaagctattgtcgcatctcgctcgctgcttgagctgtcatttcaaaaggcagctatatgctctacagcaatgcaccaaggagcagcacttgtagcaatttcatatatgtcatgtttttttgatgctagccttactgatgtgctggaatctccagaatgcccctctgatgaatcacgtggtgcggtgctggctcaaattttggcacgctgtggtgaaagtcataatctgcaacaatgctgcanaattggcggcttgtgtacctctgtgagagaacaatgtggaaggggatacttgttgggatccttgtgggtgctganacaacgtaattctttgtc

SEQ ID NO: 34856 - DNA, 585 bp, Triticum aestivum
  unsure (1)..(585): unsure at all n locations
  Clone ID: PAT_TA_34856
cccacacgtccgctctctttctcccctcccacaccagctgtgcgcaggagacatacgtacgtccttgtgcttgtgtgaagagctagccagctagaagcaatggggatggagaagggcaaggctgaccctgccaccttcagcatcgctgaggccggctttggagaccggacggacatcgacgacgacggacgcgagaggcgtaccggtacgctggtgacggcgacgcgcccacatcatcacggcggtcatcgggtccaggggtgctgtcgctggcgtgggccatcgcgcaactcgggtgggtcatcggccccgcccgtgctcgtcgccttctccgtcctcacctggttctgctccagcctactcggccgactgctaccgctcaccggaaccccgtgcatcggcaagcgcatctacacctaccggcaacgccctccaggggccaacctagggagttagcaaatacacggctctcctcccgggcccgatacgttaacctcgctttgggttcgacattcgggtagatccatgaaccagggcgttaattatccgcggctgttnggacggtcnaattncttccnaccccna

SEQ ID NO: 34857 - DNA, 477 bp, Triticum aestivum
  Clone ID: PAT_TA_34857
gcaagccgccagccaccaaaaatcgatcgaagaattcagagacttttggtagaggagagcagcgatggcgttcgtgcctgggtgcgtgcagtgcgggacgcggagcaacccgtgccggtgcaaggtcgtcgggccgacgctgggattcgtggccttcgtggtgacgggcgtggtggagtggccgctgggcgcggcggtgtacctgttccgccaccgcaagggccgccgcatcatgggccacccggccagggtcgtctacccccgcgtcaccagagccatccccatctaatcctgttactgatcctgattcgtcttcatcatcccctcctggctgtgcttgtgttctttgattggattccattacagggcgggggtgttggtgtgtgcttgtgttgtaaacttgtagtctgtgcaattggtccgtgtattttcgttttcctacggaaacggggtgtatgtgtgtcagtgtattttttt

SEQ ID NO: 34858 - DNA, 376 bp, Triticum aestivum
  unsure (1)..(376): unsure at all n locations
  Clone ID: PAT_TA_34858
cgcctgttggtaccggctcgaaattcnctagtcgacaattgaattcaagcccaacacagccgatgatccccatatgagaaagcccgatattaccaaggccaagcaactgctaggttgggagccaaaggtatctctgaaggaaggccttcccttgatggtgacagatttccgcaaaaggatcttggatgagtaatcaaggcaacagtgagatgaatctatttggttctgaatgctgcgaatataggcaaacgcgcttcaccaactggatccgttcagtacaattctgtgtttgtataacgaccttgtagaatcatttaaatttgttttcgtcttggtgagactggacagaagtaaccaatggttttttgtccaaaaa

SEQ ID NO: 34859 - DNA, 1671 bp, Triticum aestivum
  Clone ID: PAT_TA_34859
ccgcgtccccccgcaccagccgcccccccctccccgccgctctcccgccccgaagcagctccacaagtcccccacccacgccccgtcgccggcgcacgcgccggcgtccaagatctccaagcccgcgcgccccgggccgcgcacctgggtcggctacctcctccgcgagcagcggctcctcttcgtcctcctcggcgcgctcatcgccacctccttcttcctcctccgcccctacctcttctccctgtcggcctccaaccccaccgagcgcagccccatcttctccttcgtcggccactcgtccgacccccgcggcgtccccacgggcttccgcccgccgcctcgccgcgtcgtcgtcaccggcggggcgggtttcgtgggcagccacctcgtcgacaggctgctggagcagggggacagcgtgatcgtggtggacaacttcttcaccgggaggaaggagaacgtcgcgcaccacctgcggaaccccaggttcgagctgctccgccacgacgtcgtcgagcccatccttctcgaggtcgaccggatctaccacctcgcgtgccccgcatcgcccgtgcactacaagtacaaccccatcaagacgatcaagacaaatgtcatgggaaccttgaatatgttggggtctggcatagcgaatcgctgcaagagccttgttgactagcacaagtgaagtttatggtgacccacttgagcatccggcacgaaggaaacttattgggggcatgttaatcctataggtgttaggagttgttatgacgagggcaaaagaacagcagagactttgactatggactaccatcgtggtggtggtgttgcggtacgaattgcgcgtatttgcaatacatatggccctcgtatgtgcctggatgatggccctgtggttagcaattttgttgcacaggcactgcgcaaacatccaatgacagtatatggcgatggaaaacaaactcgaagttttcagtatgtttctgatctggttgctggattgatggctctgatggagagtgaacatattggccctttcaatctgggaaacccaggagagttcaccatgttggaacttgcagaggttgtgaaggaaacaattgacccaatggcgacaattgaattcaagcccaacacagctgatgatccccatatgagaaagcccgatattaccaacggccaagcaactgctacgttgggaagccaaagttatctctgaaagaaggccttcccttgatggtgacagctttccgcaaaaggatcttggatgagtaaccaaggcaacactgaaatgaagccattaggttctgaatgctgtgtagttcggcatactgcctacaccagctggagcccttcaccaactgtctccgttcggttaaagtccgtgttggttcatctacattgtagattctcttggtgtggcttgcgtgaaggagagaatggacagaagtccccaagggtttttagtccagtggagggaaagatgaatggcggtgtaagatagctgaagctattggattcagggagcgattggctgcagtttccgacttccagttaactcccaactgtaaagtgaattcttaatatgagtgaatggtaatgggtcgagatcgcataaataaaaaaaaaaccgatcgcctccagcccgggggatccactagttct

SEQ ID NO: 34860 - DNA, 626 bp, Triticum aestivum
  Clone ID: PAT_TA_34860
atccacggaagaactatatccacacgatcagtcacccgcacccgacgcacgaggcagccattggaggaccgacacactacacgatgcaggcggcgaaggtgaaggccaaggacatggtgagctcggccaaggagaaggcgaaggagggatcggccgaggtgcagggcaaggcgggcaaggccgcggcgaccacgcacggcgaaaaggagatggccaaggaggatgagcgcgcgcgcaagggccaggccgacgcgcagatgcaccaggagaaggccgagcaccgcgccgacgcggccgcgagacgccacggcacggccgggacgcgcggccaccacggccccgttggcacccccgtggcccccgaccccgtgtacccggccagcggctggcacccggcggcggagaagtacatctagagattgtgaggggagcagggtctaccttgtagtctgtaacctgcccgtcagtcgtacgtagttggtacacaagtgtatgctgtgtgcatgcacgcccatgtaccggaatagaatgtatcatgctgtaaatggtgccttcgatgttctagtgtgagtgttgttgtatgaagttcgatttcgtataatgacggttgcaaaaaaaaaaaaaaa

SEQ ID NO: 34861 - DNA, 356 bp, Triticum aestivum
  Clone ID: PAT_TA_34861
accgacggcgtggcgtcctacggcccatgacgagagggcagggggccttctttggaggcggaggcggatggcggttctgcagtgatggtgcacggaaggtgacagtgtggtcgtcctccgacagtgactagtctccttggctgcggcttcccgggggcaggatgtggagcttgctgagggcttcgatgctcaagcctttgcttggtgcatttgaatcccgttagtcgttctgtagcattgtgtatctttgccgtttttccttttcctttcttttgttgtttgctcggatgtattgtggtggtgattgctttataatataaagcggggggaaaccctttttcggtaaaaaaaaaaaa

SEQ ID NO: 34862 - DNA, 697 bp, Triticum aestivum
  Clone ID: PAT_TA_34862
gcgcgtccggcatctcgctcttcgacacctgctacgacctcgccgggcggcagagcgtgcaggtgccggcggtggcgctgcgattcgagggcggcggggagctgttgctgcccccgggggccttcctgctcccggcggtcggggccgccccccgcggcccggcggccgcggcgccgagcggcgccgtgtccatcatcggcaacgtgcagcagcagggcgtgcgcgtcagcttcgacaccgccaagaacaccgtcggcttcaccgccgacaagtgctagtgcgccggccactccttcgccgcgagcgagctcgattaattagcgagcgagtgattaattagcgtgcgtgcgtgcgtgcatgtggtaattaagcggggtggtgtgggggcggaggctttgggaaagggaaaggcgaaggacggaaacaaatgccagcctgtgcctcgttgcttgcttgctttggcggtgatggatgagtggtctggtctctggtctagtgtagcctaccgtccttatggtctggtcgtcctcgtcgtcgtctacctctgtccgtgtaactgtgtcactgtgtccatgggctcgagctcgccgtcgccatggatgtgtgtgcgtgctgctgctgctactacttccacgtgaacgaatttgttcatggttgttccttttttcaacaaaaagaaaagcttgttgtttattgc

SEQ ID NO: 34863 - DNA, 437 bp, Triticum aestivum
  Clone ID: PAT_TA_34863
cactaacagagcaatgtctgtaggtgtgctaacaggtcgtcctgcagaggagatgcctggttctatgggtgaccttcttcctgagctctcgcaactgcttgatcaagtttggcaggtgatgcaaggcatcgcccaggccctgtggccatccgtctccatgcccgaaggtcttggagagcttgcgatgaatctaaagggagcacggcggcgcttccgattgtggaagatatcagcctgccgtcaaggcgctagggaggcctgggccatggtgaagacgcggtacacaaaggctgaccccaaccacatggccgaggtcggtcctgtagggcccgatgggaaggagatccttgtaaggttagtatacggccaagtagagttggccgcaaagtattcctagtaggactgtaaattagacagcctgttagatggtattgaag

SEQ ID NO: 34864 - DNA, 2208 bp, Triticum aestivum
  Clone ID: PAT_TA_34864
aaaggaggtgccctaacagcctccggaggcggaggcaagcggcgcgtcacctaccgcccctcgccggcgagcaggataagatgaatccccccgcgcccgatcagacaacacagcaacaaaaaccaaatggccgaagagcagttggtagctcgcaaacctggacacggtatggtgttctgctaccaagccagcagacacggaagctaaaagaatggattctaactgatgaacaacaacaagtagtcaatgctagtggtcttggacatcttgctcttacgacaggatttaccattgaccgttccttgcttacagccttctgtgagagatggaacaacgaaacaaatactgcacatttcatgggatttgaaatggcaccgtctctccgtgacgtatcatatattctaggaatcccagtgactggtcatgtggtgacggcagaacccatcggtgatgaagctgtgaatcgcatgtgcttgcattacttaggagagagccctggaagcggagagcaactatgtggattgttcagattaacctgggttgtacaggaaattccatcaactgccagaaaaccccaccatcaatgacattgcattcagcacccgagcgtaccttctatatttggttggctccaccttatttcccgacacaatgagggggtttgtatccccaagatacctaccacttttgggggatttcaggaagatacatgagtatgcttggggggctgcagcccttgctcatttgtacagaggattgtctgttgcagtaacaccaaatgctactacccagtttctcgggagtgcaactttgctcatggcttggatttacgagtatattcctttgactcaaccccaacaaaagaatcagaacacgttgctgccccgggcatgccgatggaactttggaggaacaacacgtgggcagagaaagaaagttatggaatggagaaaggatttcgagcagcttcagttgtccgatgtcaactggaatccttacaaggacataaatccagcgattgttccaggatattgcatcgcagcagataacatttgccactctcggacatggctaatcagctttaacataaaagaggtgtatgtacctgaccggttcaataggcagtttgggagggaacaaggtcgcctctatcaggtgccaatgtgggcaagaagaacttggagtaaggggaaagactggagggttgagtatgctcgtgagattgaggacttccatcagttggttggctgtcgttttatcccttgtacggaagctaatataaactccctcccgagtgagtctatagctggacagactactaccagatgcagccggaatgcatctcaaaacttctctatgatggttgaagatttgaagaatgatctcccggtaattgatcgttatctggagggacaggtactccctgaagaggttgcaagcttcctagagagggtgagcacgatgatcaaaacttactccccaccacagagcaatgaaaggaaagatgaagcagctcagagcaagaatgtcagagcaaagaatccaagaaagagggcgaggaaaccttcgctctctgaagatccttcaagccctcaggactgcggggtagaccggtatgcaggtgcgctggtgccttatcaggctggcaagtgtgacagggtgttggatggcaccgtgcctctgctaaacagaggggaagcgttgaaggaaaatgaggtgatggatccctggcaaatgtcgcatttgacagcagagtcgtcttcgtctggagactcgagcttgccggaatcaaggaggcggaggtgtgaggaatccggagccccgaggagcaaccagggcgtccgaaggagtggaaggatgtgcgtgcagctcaaaatgttgaagcacagggacggggttggggccgaggagaccaacccgatcttcctctgataagggactgacgctgcccgtcgtttggtcttgggcattgtacaaagtagtggacctgtcgtcgcgctgccgcagacagtttactgttttttatgtagcgtttgtatgcctttggtcgtggtgactggtgagtgaaaacctggcctttggcatgcgtacatgagtcgtgtaggctggtggggcaaggtagatgccgcgcaacctttgtggcgtatgcactgctatccttcctctcccagttaatctgcggcacttgcgtttaaaaaaaaaaaaaaa

SEQ ID NO: 34865 - DNA, 1003 bp, Triticum aestivum
  Clone ID: PAT_TA_34865
agtctcccgctggaccctcattcccccgctccactcccgcccgctcccccacccctccacggcaatcggccgctcccgtcccgctcgcttcccaacccgccggcggcaatggcgcccctccgcgcccccctccgccgcgctgccctgccgcgcgcgcccgccccgtcgcgcccctcgcgcccccgcgagctccgctcccgcccgcgccagttcttcgtgcgcgggcgcctccgttccgacccgtgccgcgcgggattcgagagcgcggcccccactttgatgggtgcgagcgaagctggtacgagagttcacgcccagatttaccgggccccggccacacctgcatcgccggatcgaagcttagagcagagtgcaagtcgagatctacgtgggccccgagcagcagcttcgagagtcacaccgaccacaccggtacctacaacatccctgtgggccgacgacgcatgagcacgagcctctgcggaagtctgtcctcgtcagcagcccggacacggcctcgttgccaagacagttgctgggcgggagagggcccctgtcttcctcaacaacaacaacggcgtcgcgtccaacgtccgtttggcgaatgctctggggtttgagaaggacacccctctggctgcatgcgcgcagatcctcaagatgtacgaggaggtcgatgatcgcgtctgagcactccgagctcgctatcgtgaaacaggttaacgtattactaaagccgtcgtgtgaaatgtcctgaaacatctatttatatgtgttaccaagaccagaagtatcgctgcttgtgtgcttgacattatggcgtagcgcttgagtgtgtatgttgatcgctggttcaggttgaaccacgaaacttgtgagctagtaaatcagacatgttggttcagcttagcaggctaatgttatgagattgttgtttgtctaaaaaaaaatgttatgagattgttgtttgtttacgagatatgaaacaaagattgaacacaaa

SEQ ID NO: 34866 - DNA, 641 bp, Triticum aestivum
  unsure (1)..(641): unsure at all n locations
  Clone ID: PAT_TA_34866
cccggnctcggcgtccgccttctctcgctgcgtccctctttctatccccatcctatgctgcttacactgagaccagccgttgttgcttcaacgttgccgagccagcgggatttgccgcgctgggagttggcttccgcggtgagcgtcgttcccaggctgccggcgtgtatcaatcttgtgactacatgcagtctccacaaagccgcaatgacgggagggctcctactcatctgcgcgcttccggaagtccgacgcccccagctccatcaccgccgctgtccgtggcgggcacacgtccgcgtgctgccaggagctccgcggcgggcatggctcctccgccggggatccccgcacctctgctccacaaccgccacgccagcggccctggcgggctcttcgtcctccccatgctccctgcgcagtgggtggccggcgtggccacagagggcgcgattggtgctcgccggggaagacggagccccggagcaggtgccgggggattccggcgtgggggcgtgcgaagagcctgacggacgacgacctggaggagctcaacgggtgcgtggatctgggggttcaattttgtagcagcagaccccctccccccttccctccccgccgggactgacttggacgcccga

SEQ ID NO: 34867 - DNA, 680 bp, Triticum aestivum
  Clone ID: PAT_TA_34867
aaccagctggtgctcgccatgcaaaagtggaagatgaccggatactggtgttgatcttacgaagatctcattctcacgtcgatatgattatgaagacattgatattgaaacggggggcagtggcagcgatgagatggaagggacagccgatggatgggacagccttcgtttctagacatacagcgaatacagatggacaggttccggcagttaagagaagtggtatgacactagagccggggccgaagactctactatgacacttgagtcagggccgaagaactgcgaaattgcatatctcattgttaggcataagaagtgtgtcagctttaaaacacgcactgccatctcgtagagaagctctcagtagtcagtgcatgatcagatagatgccggtgatatttttttgtggatagctaagctgatgagctgattaattcagaccaaatctggagaggcatgaacaaaatgcctttcatgcttcttgaactgaactgcttccatcagtgctttccaccattttgtgtccgcagttcttttttaatgaattggtgcggcaccctacctcgtctggattttttgggtgctattttgtttcggatagatgctaccaatatggatagctaagctgatgacaggaactgaatgctgcttccatgggtgttttccaccaatttgtt

SEQ ID NO: 34868 - DNA, 642 bp, Triticum aestivum
  Clone ID: PAT_TA_34868
cccacgcgtccgcgccgaaaaaccaattccatgctccagcagcacgcaacctccaattctccattatagtattgctcccgctagggttccagccgcctccatggaatccgcggccgtctgcagatccttcaccagccgccttttaggtccgcctcgcctcccgcagccgggaatgctcggtctcgggcgcgtctggccgcctgcgccgagggtttgagttattgcatgtggtggcaccaagcatgaggcgacaactgcattacttgcaaggaagttacaaaatctatgggtcatcataatcgtgactttcttgcaagttgtgcagttgctgtctcaagcttgctgactccgtttgccagaccgcaatgtgaaataggaaatttagtcagaacttgtttccagatgtaaaactttaatcggatatctctatacttaaaagagtactagtggattaaggatacaagagtgcatcctaagttgcaatggttgtatccacgggaagaacaattatgtgtctacgagaacctccaattgatgcaccatgtgaagtcatgttgacattttcttttctctttggtaaggttatggaataaattttattttccctagtattgtgttagtggtgtatatattcactaaaca

SEQ ID NO: 34869 - DNA, 717 bp, Triticum aestivum
  unsure (1)..(717): unsure at all n locations
  Clone ID: PAT_TA_34869
cggacgcgtgggcgacaacttgttttagataaggaaatgtccaatcccaaagctattaacaaactcaatgaagatgacactagttctaatatcacagcagtatcaaaggcaaacgggtctgctaggggaccccgatcaaactctggttcattattaaagtcatctccaaacaggcatcgactacaagctaatcctgatgactgggaacatccttctgccacaaataagttgaattctgctagtggatctggcaattctaaacgtacaaagtctgcacattcactatcccctcccacccagtggggtgggcagaggcctcagaagatttcccgttcagcaaggaagtcaaatctagtccccatcatcacaagcactgatgggacattagtatctggttcgcttgaaagtccatctatcagtgaacaatctgctgggttacccaggcgtgcgtctataaatgcttcacaacaagccaaacggggagatcatgggcactcaactggacctgaaggaggcgagtttggatttgctgagaaaaagttgagggacaaaagcaaaagggctggtgaactggatgatggccactgtggttntcaaaagactgcaatgcttgggcatcctnccaaaaagaataagttttctgctgatgaagatattggtgatgcttcacgaagacaaggaaggattggtcgtggttttactccaaccaggcccagt

SEQ ID NO: 34870 - DNA, 427 bp, Triticum aestivum
  Clone ID: PAT_TA_34870
tggggttttcgacgggattgggccggggatttttctcatggagaaggtaataaacttaatttgcgagatattcactcatctcttatcgcagtccgtccgtcactgttaatcaaccggcggaaatcgtcgtggaatcatttttgttctagcttattcgtgggtgttcattcatgtgtgcatagtgcgagcacaaatccggcaactgtggtagtggccagtcggaaacgaagttctatctcacaattctggatgacttcagggagcgctcggtatgttcaatctcaacgtaccacggtcggcatggcataaatttgtgaacatataccgtctgttgctacgttatctatatatttgcatcaaatctttgttacattatctatttttaattctatatttttgtactttgcgtgcatctatatatggatat

SEQ ID NO: 34871 - DNA, 1078 bp, Triticum aestivum
  unsure (1)..(1078): unsure at all n locations
  Clone ID: PAT_TA_34871
cggncgcgtgggggtatatgtacggtatagacctttttttgtgaatagctagtttagttacaagggtgtatacaaaggtctgcttataggttgaaaaagcctgtagagatagcctagatagccaagaagatatacgtattttatagagctagctaataaagcttttgttaacttcaaataggctattgaatgcaacggcaaataaagaagaagaaagtgccagagctaagagctaatatattcccagtctatgcatggataaaggaatgataagagctatgagcagtttattaaactacactacggctaatatatataaggacaaatcaactagaaaaaaccgttgccaaagaaaccatttgtttaagcttattcgttcgcgctaggctaaaaaactagatagaagaactagaggccgccaaggtcttcaaccattagcaggtaggattctttgcttactacttgaagcagaaacctagaagaggaattctttctattctaaaatccatcttctttccggtccgcttcattcattcccttactaataaatccaattcatcgctaatggcgaaactagcctgtatgtacactgcacaactaaccgttgcttggtaggttcgatcagctcttctcattcttccgtcgacatctactaaggcttcagcttaagtgggttcagccgccccaaatctgactcgatccagggttatatatcataaagggcttcgacaaggggtttgattcgttctttgagcaaaaagataaggtcggaataccggagttctttctttgcttccaagaacatagattccttcttcaacccaggtcatgaccgagggcgggtatctcactcgcatatctagagcccagcatctctcctgaacgacaccttctgcagactctactggtggtatttcccgaggcgagggtcaatatgtgcattcatatcggtcaggaaacgacaatgactcttcttctttccgggaagctatgggcacctcacaattcttatacgacattagtggaagcgaacattcgtagcattcattgtcaccgatcattgacaaaagaagaaaaa

SEQ ID NO: 34872 - DNA, 521 bp, Triticum aestivum
  Clone ID: PAT_TA_34872
taccacgcagcaccctccctccctcaacggccgctgctgttgctagcccccctcccaccgtgcagcgcagcgcgatccagagcagatcgaggccaccaacaagcctccgtcctcctccgctcagcacccgatccacctcccgtgtcatgcacggagcatgcagggagcctggcggctggagttcgccggccgttggcgccctcctcccctacgaccggcacatccaccctctagctcacctcctcgcgctgatggccggctcgccaccggcgagcagcaccaacagcaggaccgccgccgcacctcaccgctctcttctctctccctctggccttccatctcctttctcccgtcctcccttttctctcccgctcatctctcacttctctcgcaggcacccaacgcatggcgtgcctcgccccattcctgggctcgggcggagcatacgcccgccgcgacgcatctcctgccttggcttctgcggagtcagcgccggcggcaagcggcggggcattcccggc

SEQ ID NO: 34873 - DNA, 1537 bp, Triticum aestivum
  Clone ID: PAT_TA_34873
cggcacgagcgccgacttcctcgccgccgcggccttctcctgcgcgctgctcctgctcctctgcctctccctcccccgcctcccgttcccgctccccttccacctcccgctccgccggcctcgccgatccccgatcctctggtccatcggctcctctccctccgcctccgcgtccgcccccaccaccggccatttcgtccaggtgtacagcaacggcgatgtctacgagggccagttcaaccgtgggcggtgcaccggcagcggcgtctactactactacatgagcggcaggtacgagggggactggatcgacggcaagtacgacggctacggggtcgagacctgggccagggggagccgctacagaggccagtaccggcaggggctcaggcacggccacggcgtgtacaggttctacaccggtgatgtctactccggggaatggtccaacgggcagagccatggatacggtgtgcacacctgcgaggatggcagccggtacatcggggagttcaagagaggtgtcaaacacgggctaggccactaccatttcaggaatggtgacacgtatgctggggagtacttcgctgatagaatgcacggtttcggagtctacagctttgccaatgggcatagatacgagggtgcatggcatgagggcagaaggcagggcttaggcatgtatacattcaggaatggagagacacaagcaggccactggcaaaatggagttcttgacaccttaagcacccaaaatattgtcccagggtcagcaattgccgtgaaccattccaaggtcctcaatgcagtgcaggaggcaagaagagctacagagaaggcctacgatgttccaagagtagatgataaggttaacagggcggttgccgcagctaataaagcagccaatgcagctagagtggctgctgtgaaggctgcacaaaaacgcattccaaataataacgatgatctaccgttgtcaatagtgtgaggatttagccaacataaggttggcacgaagctgctccgcgatgccatcacaatacaaatcgtctggcagaagctttgatttcctcgataggggtgttgttgctctgccaccggtccatgacgacacctgagcgacgcccattgcatcagagcttcggaagcagagttttctgccatccctccaatacatctttgcggtgtcttttgcgatgcagcagaacttctgcgccgagagctttccgttgtcgaaggcaatggattgtggtcaggtagctttccctctgcttttcttcagtgtaatatccatcctacgttagagatgcgatgatgatgtacaccctcggttgtcagagacaaatttctcccctgctttaagcatgtatagaagtatagaaccctacgtttttcgtggtgccggctgttgaggttggagttgcaatccgcccgctgttgtctgtatctctgtagcagaaacgcataaagatatcatgcacgaccatgattcatcagcgcctccgtgccggaaatgtggccacgtaaaaaaaaaaaa

SEQ ID NO: 34874 - DNA, 730 bp, Triticum aestivum
  unsure (1)..(730): unsure at all n locations
  Clone ID: PAT_TA_34874
gccggccggtctggaaactcgagcggttctctcgtgtgcggcggcggcggcggcggcggcgacagatcgaggacggagacggcggcggcggcggcagatcgtctgaaccaggtttttgcatttgttgctatctgatggacgacaagagtaacgtgaagaaggaaatagatggctcccttgcgccccgtcctcgcaagggaggacttaaattcgcacccaaaaagcctccaaagaaacctgcaaaggttgtcccaaaagcggagcctgttgaggagagcaaggatgaaatcattgataaggaattgttgatgaaactgaagacatcacagatcactgatccctttggaagaagacctaagattgagaaaaaagaaatcaatacacaggttgcatttgggcaagggaactcttcctacgcaagatcttttcctacacggaaatattcggcagcgccaaaagcaccaaaagaatatgtggatccatgggattatacccatagcgactatcctataactctcccacttaggaggccctactctggagatcctgagattcttgatgaagaggagtttggagagaaatcggccagcagagctcaggatggcgaattaactgcagcagaagaacttggattaatggattggtccgacacaccacagttactcttcttccagttacctgcgtctcttcctttaccaagcaaacggagtctgntgaagaaccaaatact

SEQ ID NO: 34875 - DNA, 450 bp, Triticum aestivum
  Clone ID: PAT_TA_34875
attccagggtcgactcgaactcaatccctctcccgcttactacgccgtggccccgcatgctgtagtactcctacaaaccataccgccgcacgcatcatcagttttcttcaagaggacgagggagaagcggatttgtagtggaggcgctttaaaaaaaggatttgtagtggaggcccctaccctagggtgccctaggtagctaccgcacacatcattggttttcttttttctttatactcttgcgccctagagtgaaatgatggttgcttcatccgtccaacttaatgcgggaaaggtggggctttgtgatttgacccctcatcgctcatttactactattgcggcgctacgaccggggtgcctccaagtccaaccgctgctccgaactataatttggtgcatcacgcgtggaacaagatggtggatgagccacatgttggccaaaggggt

SEQ ID NO: 34876 - DNA, 1669 bp, Triticum aestivum
  Clone ID: PAT_TA_34876
tcgacttcaacttttcgtagttgtccatgtccgttctaaagtaaacatcaaacatttcttgcatgtcctttcgaacttacttacccatacattcgccaaacgggagtgagcatacctccctgcttttatcgtgtagtctttcgcaacaatacagagacatagatagcaaggggactggttcgttaaatacaaagtgagaccctactgcgacagaggtgacaggcgtaacaaggccgccaccagctgacttcttcctgcgcgcgacgtagttggcgttccggttccgcttccctctccccgctgcgcgtgcctacctccttcgcgcctgcagcttcaccttccactttcctctccccgttgggcttacctcggcgcccaaccccccagacctcatcttcccgcacgcttgccttcttcgatgcagcatctcctcccccctggggcattggcgtggaataggatgcgccttgacgacttatcctccgccttggggaagcgataggaaaccttttgtccccagctgtgtctcacgcggttcgcaagaagccctccattgccacacttcgcccacagtttctgtcccattttgcagggtccccccgtagcaagcatgacacctcaagaacccacctatgcaactgacgtatttgcatgccacctggtgccaagagacgaagaccaatctgtgggataacgttttgcatggcatagctcactagtaacacacgctacgagtggattcagattaaggacctcagggcccaatctctgctcactcgctctcatcatctacaaaagatacactgacaccctccccggcctcgctttttatatctaaattatccaactgttcagtgcatgaatcagtatcaattatgccctcaacagtatcagcatcgcctaccccattctccccattagatagttgatctccagcaatttttggttcattcccttccagagattccaagttgtcagtatttgaccttgttttctctggaacagcagaagggccatccactgaatccaatccattttcagacaagtcattatcttcatcgactgatggagcaacagaacttgtatcaaaactttctccagatgccttgagggcatctcgcctcgctttcctccgcaaatattttctgtgcgtggtgcggccaacagcaggcaaccaaccttcattgttctcatcatcttcccaaggaatacatgcatctttctttgaaggctgaaactcttcacccccttgtgtctcagaaatactgttggtatcacttgtagggatttcttggttctcaaggtccttcagtgggagtatccgagaattaagattcccgcctgcctcggacatcttatccaatgcttcccactcttctaggttgggcacattagaaccccagcctggcagcggagcctcttgcaatgtcctgacactgaccacatgcaatggaggtgggtgctcccgcagatggctggtaccgtggacctcagcctccaacatgtaagctagagcgataatcttcatatcaacatctgagagtgtctggagatctcctgtttccctggcaaacttgacaactcgcttgacgaactcgggcgcgggctcgacggtctcgacgggggtgggcaggagcgccagcctccggcgcgcggcggcgtcgcgcac

SEQ ID NO: 34877 - DNA, 725 bp, Triticum aestivum
  Clone ID: PAT_TA_34877
ccacgcgtccgtgccgctgccccaccaggacgactcgccgtgccgagggcctgggaggccgctcccctccccgaggatgttcgacggggactgcaacggatcggccgagttcctgggggctgcagggactggagcggacgcgtgggccacgtttccaagatttatgccccaccaaactgttcaaaaggttcacgagcacaatgacttacggtcagctggcacacatggggccacctgtggccaacggagaaagacatataaagagaagttccaggatggtccaactgaaactttgaactttaggttgaatattcctgctaaaagtgccccgagcagcgggttttcaagtcctgtacagagtcctcgaaggttgagtaatgtagacttctcatctgctgcaatatccatccaaggtagcaatatattgtcagcaccatcaccatggtcttcagatcaatcaggatcttcacccccttccacctcacctgaaaaatttgtgggtggccaggagcgatctcctcactctagtcctttgagaagtcctgctcgtagatcaagatacccaagtgcacctccatcaccaatgcatacaaacttgttcccagagaaccacacttctcgtcctgagggcaatccgagtgccaatcttcacccattacctcttcctcctgtttcaatgagcccaaagcaaacaaattttggccacccgtcagttccaaaagttg

SEQ ID NO: 34878 - DNA, 417 bp, Triticum aestivum
  Clone ID: PAT_TA_34878
tcccgggtcgacaaatcaactaaaggagaggctaagggctgcttatgcggacaaacaacatgccgaatggcaggaagccgctggtcatcatgtatcgacacaaaccattaatgagaagaacaaactaccggatgcaaatatcaagcaagccgaagaactgaaggatttaagagcccaactatcggatgctttcaaggagaacaggaagctgagaggcagcatattcagtatgctctttaacctgactgtcacatggtctcctgtttgaaaatttgacaagtttacttctgtaggtgtgctaatcagacaccccgaaggagaagtgtctggattccaaggcgaccagctacaagagctatcaaaggtgcacgagcaagcacgaaaagcattgaggaacatggctaaacatttatggcc

SEQ ID NO: 34879 - DNA, 689 bp, Triticum aestivum
  unsure (1)..(689): unsure at all n locations
  Clone ID: PAT_TA_34879
cttccaacctcacccgctccagggccgaggcggcgcacgaggtccgtcgaggaggtggagcgagccgcgcctgagccatctgcgccgtgtatcgtcgtatcatctactaccaggaaggaagagaccgatggccccgaactacgagatggccgcctccatcctgctctgcgccgaggacagcagcagcatcttcggcttcggcgacggcgaggaggcggcggcgggagcgagggcggaaggctctccgtactgcggcggcgacgacgagttcgcagcgggtttcccgctgccgtccgaggaatgcgtggcccgctgggtggcgacggaggcggagcacatgcccagggaggactatgccgagcggctccgcgccgggggcgtggatctccgcgtgcggatggacgccgtcgactggatatggaaggttcacacgtactacggcttcggccctgtcactgcctgcttggccctcaactacatggaccgcttcctctcgctctaccagataccggagggcaaggcttggatgacgcagctgctatcggtggcgtgcttgtctcttgctgccaagatggacgaaacttccgtgcctcagtccatcgacctgcaggtggccggggacgcgcggtacgtgttcgaggcgaagacgatccanaagatggagctgctggtcctgagcacgctcaaat

SEQ ID NO: 34880 - DNA, 464 bp, Triticum aestivum
  Clone ID: PAT_TA_34880
gcaggcgtccgaaattcccgggtcgacctcttgaccctgctgggatatcgctggtaccctcagtacactgtgtacgagatctaccgcgagttcaaccaggagatgtatcacgctaaggttgatatctatgatcggcagaacaactccacccacgagttgcatgcctttgagggtattggagtgactgtcgagatggcagtacaggaggttgcctatgttgctatcaccagcctccgtagagggcatccacgcttggaggagactgggttcagatacttcccgtacccaccagctggggatgatactaggcggtacactgctgtgtgtaccccttacgtgagccgccggtacgacccttagtatatggttcgatacaatgaggttctggatcgcactgttcgagctttgactgttgagctgtacgccacgcgtgcacgccactacgacactctggagcagatgcg

SEQ ID NO: 34881 - DNA, 715 bp, Triticum aestivum
  Clone ID: PAT_TA_34881
cacgttcaggtggacggatgctgaggtaggcatggccctttctaagtttccaccggtgctgacgagtgataaggaatcgctgcagctcatgtctgagttcctcatctccgaggtgggcttggaaccggtgcacattgctcaacgtccggcaatgctcactcacagcttggagggccggatcagaccccggtactatgtcataaagtttctcaaggaaaatggattgctcaagcgcgacccgagctactttactgttttcaaggagtccgggaaggcattcaacaagatgttcatacaccctcataaggaagctgcacaagaccttgaaaaagactacgatgctgcttgcaaaggggaagtgcccactaatttcagattcacataagccaagaacgggctctgatgtaaccgtgtgctggttgtccgctgctgtatgtctgttagatgctgggttggtggttgttaacgagtgatcaagctgataattggatccctgggatactgatatgtaatgtcaccactccagcccgagaagaaaccatggattggttatgggaactttttcgtcctcattcatgttttaaacacatgtattggaactaataactgtgggatcatgccatactgcatgcacgaaattagtttctgtcagatcaggccaccctggggggccccggacctctcgccttaatgagcgattaccccccacggcgtc

SEQ ID NO: 34882 - DNA, 402 bp, Triticum aestivum
  unsure (1)..(402): unsure at all n locations
  Clone ID: PAT_TA_34882
acccggtnccggtaattcccgggtacgtacccacgccgtcacgnatatcccaatacagttcactatgtgaccagatttttggaaggattgaaatctccagtatgccttgcagtgagtattcagcaaccaacaaacgtggatacagcttaccagttggccattttgcacgaagaactggggtttggcagtggttctagctcctctctgtctccctcacgtcgaactattgctctgccacttccttccccaccaattttgcacctaccaacagggtgtctgatgggcgccatgttactgaacctgtcagacaatcgaactctgagcacaagtggggagcattgcgtgcgtactgtaatgtatgaaatatgccctagaggcaataataaactggttattatcata

SEQ ID NO: 34883 - DNA, 631 bp, Triticum aestivum
  unsure (1)..(631): unsure at all n locations
  Clone ID: PAT_TA_34883
gtacccggtccggtatatcccggtgtcgtacccacgtcgctccggngacaactcgatcttgcaaccagtgcttccccagctccaccaaccaattcagtcgtaaacgatccaagacagacagacgcggcgagaaatgggctcgttgccggagcagcagcaggtcgtcttccgctcgacgctgccggacatcgccatcccggaccacctcccgctgcacgactacgtcttcgagcgcctggccgagcgccgcgaccgcgcctgcctcatcgacggcgccacgggcgagacgctcacggtcggcgacgtgcaccgcctgtcccggcgcgtggcggcggggctgtactccctcggcgtccgccacggcagcacggtgatgctgctccttcccaactgcgtcgagttcgcgctggccttcctcgccgcgtcccgcctcggcgcggccaccaccacggcgaacccgctccacaccccgcccgagatcgccaagcaagccgcggcgtcccgcgccaccctcgtggtgaccgagccggcgttcgtcgccaaggtgcggggcctcgcgggcgtcaccgtcgtcgccacgggcgacggcgcccgagggctgcgcctcgttcgccgaccctggcggccgctc

SEQ ID NO: 34884 - DNA, 432 bp, Triticum aestivum
  Clone ID: PAT_TA_34884
taatttattcgtctatatggagatggagcagaaggtcagctatgtatgccaaggcagtgctaaaaacaataaaactacagcaatagcgacaaatgctctaaaaacagtaaacatgagacattaatacctgattagcggcagcagcatcatcgacatcgtcctcgtcatcagcattgaagtcagcatcatccttttcctctggattaacacgagaccacttctttgcaggtggaaccttgcgcttcacgccgcatttcttccccttaccagatgcaccagcaccaagtaaagaaggtgtagactcggcagtggcaagcacacgaggactacagcgtggcgtaccaccaaggcctaacccttcatcttcaacaacttctgcaggccttgaaatacgtgggctctttcgaggagtaacttcaccaactactagct

SEQ ID NO: 34885 - DNA, 737 bp, Triticum aestivum
  Clone ID: PAT_TA_34885
ccgggctcgtacccacgcgtccgaaaccctagccgaggacgacgccgcaatcgcgctgcccaccatgtccgccatggatcgtctccccatggagctgcacgccgagatcctccgccgccttccgccgcggggcatcgctacgtgccgggccgtccgcaagggctggcgcgccgccgtggactccaacgggctgatgctcgcgatggagcaccgggtgccgcaccacgtcggcggcatcatcatcaacttctcctacgaggaccggccgtacttcttcccctgcggggccggccctacgggcatcggccacgaggccacggcgcttgatttcatgatcccaccggaggtggagacggggcgggggatcgtcctcgaccaccgcaacggcctcctcctgtacgagggcgagtacgcggtgtacgtgtgcaaccccgcgacgcggcggtgggcggagcttccccctttgccctcagatctccccggcgcctattacctcctgttcgaccccaccgagtcgctgcactacagcgtcttcttcttccccgagcccaacaaacatgatcagtcgatggaatggccgccgtcttcgtacacaacgaaagtgtactgctcgagaagcggccagtgggatgacatgacatttgtccgagaaggagatgcaacaacggtggccatgtgggcagatcgaatcaatcaacgaaagcgccacgccgtgtactggcgaggggcattctatc

SEQ ID NO: 34886 - DNA, 525 bp, Triticum aestivum
  Clone ID: PAT_TA_34886
tggacttggagggccactcattgatcttgctggcaattttgttgggatcaacatttgttttcatggtgatacgcaaaggcctttgtttctaccaaggatattgcttcgtcaacgcttgcccacgcgtccggtgctcattcctggaaaaggttatggagagaaaatgccaccttattgtgcaggtttgttaatgggaaaaaccagcaatagcaggcagggatcttatgaacctcctccaggtgcttccagaataatcccttcaggatttatggatacctgggagtggctagaatccatgggctaccctaaaccaccaccacttatgctggaattgaatgggcgcctggttaggacatttgaggaagtgtttgggtggttacatgcttggaaagttataaaaactcatatgttgcacggcatggaaagatgctgcagagctgataagaagaattcacataccaacggtactcactgtacgtcacgggatttacactatcgtacttttccactgtttttttaacgcac

SEQ ID NO: 34887 - DNA, 800 bp, Triticum aestivum
  unsure (1)..(800): unsure at all n locations
  Clone ID: PAT_TA_34887
gcaatctatctctgatatagagaagaagggagttcagagcttgtcaaggatgacgacttgagcaaaatattccaggaatacccatttctatttgcccgtgctggtgatctgacagttgctgatgtagataaccttttaaactcttacaagcaactagtacttaagtacgtcgcactctctaagggcatgggtgtcacccctgaaacggtgcgctgtcagtctggtcaagccggtgaaatcaattgggtgaaatacaaacagtgagaagtgaagaatgtgctgttcgttcttagtataccaagaggcgataaccagccgcggagcagaatataaaaattacccctgagcagatatgccgcggaccttgatgccacaattgtacctgctgatccgagtggtgatcagaagacactaaaagatgaatcatcagattagccagagcatgcgtaagctgatcgtctcatttgttaattgaaatacagagaaagcgcttttttttgcagttcgttcttataccaatgggttataaggggccgcggaacagaatgcatatttcccctgagcagatatgaatccgtccttgatgccactattgtacatgctcgaaactagaaagcagtaattaactaccaatgaagatggaaattcattctgctgaagctagatccagatccaaacatttngtaattgatccttggngctcttgattntgntgtcagttggactttgtggtgactgccatttttgttaactggtactatgtaactaggatttccataggggcagttagntattcgtgc

SEQ ID NO: 34888 - DNA, 927 bp, Triticum aestivum
  Clone ID: PAT_TA_34888
atacggcagcgagaagacgacagagcggatcttgataagccatcagagaaagaagttgacactgttgtcaagccatcagaggacagcatggctgttgaggagcctgtcaccgacaaaccatcagtggaagatgaagccagtgctgagccatcaaacgacagaatagatgccgagaaaccatcggaggagaaagaagacgacactgtgaagtcatcagaggatagcacggctcttgagaagccagccactgacaaaccttcagaggaagaggaagaaggcgcagccagcgagaagccgtcgcacgacgatgctgtcatcgaggcgccatcgcacgacgacatggactcggccaccgacaaaccctcgcctgccacagagacaaacacatcagcctgagctcaccgggacaatggttagccgagcacagacatccctgttagtgagcttcagtaaacagtttttaaccgggagaaggatcgatactaccgttgtttgatagttttgcgtgccatttttatttgtttttgtctgtacaatgcttgagttgtaaaatttgagggggaaaagagagaaggatagggagggtatttacttggtttactcactcacaagcaataagcccctccccacattaggaggagggcagcattgtggccttttacctttctacgacagatatttctgttggtgtggtcttggtttgttgctcatatttttgttgtatatcagatgatgtacatgattgtttggttcagattgaaaagaaaaagaaaaaacggtagggtatttacttggtttactcactcacaagcaataagcccctccccacatttggaggagggcagctttctggtttttttttacgacagatttgtctctgttggtgtggtttggtttgttgctcatatttttgttgtatatcagatg

SEQ ID NO: 34889 - DNA, 538 bp, Triticum aestivum
  Clone ID: PAT_TA_34889
ttgctactgccctctcttccgttgcgagaacttccatggtaaaagcgcaggacatactcagccttggcagctctgctaggatgaacactccagctacacagaaagggaattggaaatggaggataccaagctgtgtcagcttcgacagccttagcctcgaagaagcaaagctgaaggagttgcttatgctgtacgaccggctgtgaagttctcggttctccagcactcctgtgttctctgtctcttcaggcttggaactgccagacggtactgccataaactagcagccaaacatgaaggatctggctgctattgttccgtgggatgttggcacctgtccccgaataatagggctgtgttgatcggttgcaaattaacatgcttgaacttgaagcgtcttgcatctttacaatttgctattatggtgtatataggtagtcctttatattcccatttcgtctatgtctattgtaactcatgagtcttggaaactcttaataagtgggatatgtgtatcaagttctttttacatttcaga

SEQ ID NO: 34890 - DNA, 643 bp, Triticum aestivum
  Clone ID: PAT_TA_34890
actggtaggacaatattttgatctggtggaccatgaaaaggtccgtagcttccgaatacagaagcaattgccatttagtactttcaaggaggaagttgcaaaggaatatggcatcccagtacagtttcagcgcttctggctgtgggctaagaggcaaaaccatacatacagaccaaatcgcccattgaatcctcatgaagaaacacaatctgtggggcaactgagggagatatcaaataaggcacagaatgctgaactgaagctgtttttggaagtggaatttggactggatttgcagcctcttcctcctcctgagaagagcaaagaagatattcttcttttcttcaaactgtacaatcccgaaaaagaagtgctttgttttgtggggaggctctttgtaaaggccttggggaaaccttcagatattctgagaaaactaactgaaatggctgggtttaccccggatgaagagatcgagctatatgaggaaattaagtttgagccaaatgtaatgtgcgaacatattgacaagaagcttactttccgtgctagtcagcttgaagatggggacatagtctgtttccaaaagtcacctaaagcagacagtggtactcaagtgcgctatcctgacgtcccttcattt

SEQ ID NO: 34891 - DNA, 701 bp, Triticum aestivum
  Clone ID: PAT_TA_34891
cgcactttgttcgtgacccaatcatccgctcgtgaacaaaccgtcattgtccaaatacttgagatcccaccaaggcatctcacctgatgaaaaggagtttctgcgcatcttgtataactgcaacttgactacaggacgaatgatgcatgtaatggcagagttctatggatctgagatgatggtgccgttcggaccaaaggcaataacaaatctttgtacaagtttccgtagagatgacacaaaggagggtgatctgattgagacaattgcgcacttcaaggatatacaaaaaaccgatccagacttcttctataaggtgaaatatgatgaagaggactgagttgtcaacatattttgggtggacggcttagctcgaaaagcttatgtggaggcgtaccacgattgcatatcgtttgacaccacctacatgaccaacttgtacaatatgccgttcgcgcccttcatatgaataaaccgacatggctaatctttcatgctgggttgcgcgtttgtgaggcgggagttggcatcgagctttgattgggtctttggagcattcctagaggctatggatggcaaacctcttgacaacttcatcaccgatcaggatggtgcgatgaggcagtcaatacagagcatctttccaaccaccgtgtacccgtgttgtcgatggcacatcatgaaaaaagctcaggaaaaag

SEQ ID NO: 34892 - DNA, 592 bp, Triticum aestivum
  Clone ID: PAT_TA_34892
agacgaagaatccgaagacgacggtgaagagaagaaacataaaggaactgaaggtgttattcaaatcgaaaatccaaacctggtgaaagcaaagaatataaaagccaaagaagctgatcttggaaagacaactgaactctcgaggcgtgagagagaggagatcgagaaacaaaaatctcatgagcgctatatgaagcttcaggagcaaggcaaaacagaacaggcgaagaaagatttggaacgtcttgctttaataaggcagcaaagagcagatgctgcaaagaaacgcgaagaggagaaagctgctaaagaacagaggaagaccgaagcgcgcaaataaccgcgtaggttgtggaggctgtgctgtgttggctggacatttatttctatgcatcttagtatatttaaaccctggtctctattgcatcatctacatttccataaaaaccgtgcattgacaagtgtaaagtagtcctgtcggtgtggcttgctgtaaacttgagcttggcagggtacacatttagtgagatcagcttatgtgagatttgctttcactcaaattggtatggaaaataactgttgaaatttaaaa

SEQ ID NO: 34893 - DNA, 1000 bp, Triticum aestivum
  Clone ID: PAT_TA_34893
gccggccgggattcccgcgtacagactaggcgacccccgcttcccgtcccctctctcctccacacgcctctctccctctcccctcgtccgccgccgccgccgccgccaccatgggcaggggcaagttcaagggcaagccaaccggccgccgcaacttctccaccccggaggagatcgcttctggaacttcagggcgtccacgctcgtttaagaagaatgtagctgaagcagaagaggaagaggaagaagtagaagaatctgaagaggaagaatccgaagacgacggtgaagagaagaaacataaaggaactgaaggtgttattcaaatcgaaaatccaaacctggtgaaagcaaagaatataaaagccaaagaagctgatcttggaaagacaactgaactctcgaggcgtgagagagaggagattgagaaacaaaaatctcatgagcgctatatgaagcttcaggagcaagggaaaacagaacaggcgaagaaagatttggaacgtcttgctttaataaggcagcaaagagcagatgctgcaaagaaacgcgaagaggagaaagctgctaaagaacagaggaagaccgaagcgcgcaaataactgccaaggtggtggaggcatgagctaagctgagctgtgttggctggatatttatttctatgcatcttagtatatttaaaccctggtctctattccatcatctacatttccataaaaaccgtgcattgacaagtgtaaagtagtcctgtcggcgtggcttgctgtaaacttgagcttggcagggtacacatttagtgagatcagcttatgtgagatttgctttcactcaaaaattggtatggaaaataactgttgaaagttaatgtgtttgtaggcccgagctgatacgtaactgtatgagcaaaaaccaaagcctcctttcccttcagaaccgtgcattgacaagtgtaaagtagtcctgtcggcgtggcttgctgtaaacttgagcttggcagggt

SEQ ID NO: 34894 - DNA, 962 bp, Triticum aestivum
  Clone ID: PAT_TA_34894
gcggcacccgcctccgttcacctgtggcagaagccctggcggcggcggcagcgggtgtgaacaccaggttaactgcggtggcggaggcgggggcggccgcggccgcggcggcgagcacccacccggtggcgatgacggtcctggggcgagggacgtgctcggcccccgaggccgccgcccgcgcccgtgaccccgccccgtggctgctggacggccccagggcacccctcaacttcccgtaccctccgccggccagactggttaaggaggtgattgctgcaccgaggcaccgcagccacggtcatgaggcgccgctctttcaggttgttacattgccaccagaccccacatcaccgcctccaccaccgcccaagctcgttgtttactttcccttccccttcgaagtgcccgccagcaacccccctccagtgccggcatacccgttcctgcacatgccgcgtccggcacgagcacggctcagcccgcaaccagcgcacgcgcctggtccaaagccacagccgccgatccaaaggatgaacgtcatggtgcaggcagaaagctgcttaagctcctcaaggaaaaccctaggggcttcttcgtctcgctgcctggtgctcaagaaacccaagctggtcgtccttcccgtcacccctagtgctcctacagaaggaacgggtgacaatttcaccaagccgtggtatttccctgattttcctgttgtttagcctcggccgggtgaattaggcaccgagatctcatagtcatgtgccatcatgatccatgggagatctgaatctacctatcatataagtttttcattacaacaagttgtattttcattaatgttttagtgtgtcgtaccatataatatgttgactttcatgtttgtttttcccaatcatatgtaatcaggtaatctatgttgtttgtttcatcaatcttgtctttgcgtttttttgcca

SEQ ID NO: 34895 - DNA, 830 bp, Triticum aestivum
  unsure (1)..(830): unsure at all n locations
  Clone ID: PAT_TA_34895
gctgattcttctggtagttgagcatcgtctggggaatttgccatttacagagaagcaggtcgttacacctacaggttctgtttattcaggagttgacttctgcaagaagctttgtggagtgtcgattgttcgaagtggtgaaagcatggagaatgctttgcgtgcttgttgtaaggggataaaaataggtaaaatcctaatacatcgtgttggagacgacggacaacaactcatatataacaagctgcccagtgatattgctgaacggcatgttctacttatggatcctgtgctcggtactggtaactcagcaaatcaagctatacagcttcttagaagtacaggagttccagaggaccacatcatgtttcttaatcttatatcagctcctgaaggaatccattgtgtctgcaagcgattccctggtgtgaagatcgtaacatcggagatcgacgccgggttgaatgaggattaccgtgtcgtgccagggctgggtgaatacggcgatcgctacgttcggcacagactaatcagctaccaatgccgcttccatttggcggcgaagcgatagacggggtagagctaacaggagatatactggtgtttggttgcttgtataccggcagacgtggagcggaggcantcactctggcaaccacttggaggtaccaacaaggacacatgagtgagcgtgcattatatcataattcatagtggctaagctagacactttgggctttatgttcatgtgacgagctttgcctttttgtgtgtgagttttgaggcccttggcatgataataacttgctcctcagcagttataaaaaaaa

SEQ ID NO: 34896 - DNA, 533 bp, Triticum aestivum
  Clone ID: PAT_TA_34896
cttgatgttaatgttcctgggagtgatggtctcactatcagaagatttttctgggcacaagacagggttgactctctgtttgcttatgagggtgctgctttccaggcaattatatacttgcagcgtttgtatgggtttgtcattgttgattacaattatacacccatgaccacctatcgagaccttgctcgctcagcggttattctagctacatcgtcggttagatctaccattccagttgcttctggtgatggctccgtcgctgtgggtgacgtcgatgttgttgcgcagcggcggatgctacatgctggcttggtttctaccgcctgtagcttttagggggtctgtttgtgttgtgcttgttgctcgtttgtcgggttttttccttggttgattatcatgtatccggagtcttgtgtgtgcttatgatgagatgtcggttgtaatgagatatggctatttactgttcttacctatgtacctggcgttcatgccgcttatgagtaatatagctgctgtttaaaaaaaaaaaa

SEQ ID NO: 34897 - DNA, 1428 bp, Triticum aestivum
  Clone ID: PAT_TA_34897
cgtcgggcccgggctcttctcgagtctaccacaagtccgacgaaccaccaccccggccatggcaaccacccttgccaccgatgtctgcctctcggtcgcgcaccagacccgattcgccctccgcctcgcctccgccatctcatccgaccccgaatctgctaccggcaacgtcgccttctccccggtctcactccatgtcgcgctcagcctcattactgccggcgctggcggcaccacccgcgaccagctcgtagccatacttgggaacgagaatgcaggcgggcccgagggactccactcgctcgccgagcaggtggtacagttagtgcttgccgatgcgtccatcaccggcgacccgcgcgtcgccttcgccaacggcgtttttgtagacgcgtcgctctcgctcaagccttccttccaggagctcgccgtgtgcaactataagtctgaggtccaatccgtggacttccagaataaggctcctgaaattgctagtcaagtgaactcatgggtagagaatgtgacaacaggtctcatcagagagatcctccctgaagggtctattgactacaccactagactggttcttggtaatgccctttatttcaagggactttggactgagaaatttgacgaatctaagacaaaatacgacaagttccaccttttaaatgggaacactgttcaaacaccattcatgtccagtacaaataagcaatacatttcatcttccgacggcttgaaggtacttaagcttccatatcagaaaggtggagacaataggcaattctccatgtacattcttcttcctgaaagacgtgatgatctctggaccttggccaaaaggttgagcactgaatcagagttcatcgagaagcatataccaacggagaaagttgtagttgatcagttcatgcttccaaagttcaagatatcatttggatttgaagcaaccaatttgctcaagagtttgggtcttcagttgccatttagcagggaggcaaacctgtcagagatggtgaattctcaggtggacctattcctctcatctgttttccacaagtcatttgtcgaagtgaatgaacaaggaactgaggctgcagcagcaactagtgtagcgatcgaacaacaacagatgcccattgtgatggacttcgttgcagatcaccctttcctcttccttatccgagaagacgtcactggtgtggttctcttcatcggtcatgtggccaatcccctcgtgtcttcataatatgtttgccctaaatatgtgtgttggcagttgcctcaactattacatgtaagggaagggtttcaacatccaataaggttgcttgtgcaatcaatccaataaatggttctgattttcagaatgtcttgcttgttgtgcgaggtttgcagaagggtggtaatcaaggattgttgtgg

SEQ ID NO: 34898 - DNA, 2365 bp, Triticum aestivum
  unsure (1)..(2365): unsure at all n locations
  Clone ID: PAT_TA_34898
ccacggaaaggctggccgcgtcagtggtgtagtggtacgctagcagccagccgcagtatctctagcatcgtagtgccgcggattgctcttgccgttcgcacttcaccaccatcacaatccccgcagcctttttcctcaacagatttcgtccgggctcctgcaaaggggcgctgaggctcttgagtgctgtgcgcggcggaagcaagcccccgtccggttgtcttcttcccccgccagaggacaaggagcggtcacaagggatcaccgccagggcccccgggccctgccttcataagcgagggagggacgcaagcctgtggagtgcggtgcagaccagcgccgttgcttctttctttcttcttcctctcgtcgacggtgcgaggccagcatggggtcttgtcgctgccgctcggcgacggtgcgaggccagcaaggggagatgtcggaggtgaagccggaggagatcagccacccggccatggagcagctgcaggggttcgactactgcatcgactccaaccctccacggggggagcccctcatacggggcttccagcactacatcctggcgctgggcacggccgtcatgatcccggcggtgctggtgcccatgatgggcgggaacgacggagacagggtgagggtcgggcgctcgctgctattcgtcaccggcatcaacacgctgctgcagtcgctcttcgggacgcggctgccgacggtcataggcggctcatacgccttcgtcatcccggtgatggccatcgtgcaggactcctcgctcgcagccatatctgacgaccacgagaggttcctccagagcatgcgggccatacagggggcactgatagtgtcgtccagcattcagatcatccttggttacagccagctctggggtattttctccagattcttcagtccgctgggaatggcgccggtggttgcgctgctcggttttggtctcttcgaaagaggattccctgtggttgggcagatgcgttgaggttggcctgccaatgttaatcctctttgttgtgctttcccagtatctgaagaatgtacagataagagagatccccatactggaacggttctccctgttcatctgtatcgcattggtctgggcgtatgctcaaattctcactcccggtggcgcgtataatcatagcaccgaggtcactcagatcaactgccgcactgaccgtgccaatctgatctcttccgccccatggattaagatcccataccccctgcagtggggggcaccaaccttcagtgccgggcaatcgttcggtatggtgtctgcggttttggtgtcgctaatagagtccacagcttcttacagcgctgcagctcggcttgcaagtgcaactccacccccagctcacatcctgagcagaggcatcgggtggcaggggattggcatcctcctttgtgggctctttggaacagggaccggctccactgtctcagtggagaacgtggggttactaggatcaacgaggatcgggagccgccgcgtcatacaaatctgtgctggcttcatgatcttcttctccatgctggggaaatttggagcgctgttcgcttccatcccgttcaccatctttgccgccgtgtactgcgtcctgttcggactagttgctgcggtggggctctccttcttgcagttcaccaacatgaactccatgcgcaacctgttcatcgtcggcgtgtccatcttccttggcctgtccgtgccggagtacttcttccgctacagcatggctgcccagcgtggtcctgcgcacactaaagctggatggttcaacgactacatcaacaccatcttctcgtcgccgccgacggtggggctgatggtggccgtgttcctggacaacacgctggaggtgaaggacgcgggcagggaccgcgggatgccgtggtgggtgcccttccgctccttcaagggggacagcaggaacgaggagttctacagcctgccattcaacctcaaccgcttcttccctccctcgtaaacgctcgagggataaaaggaagaaaggacatggtttctttcttggctgatgcgatcatgtgcgcggctgttcggatccgagtgttgttgagcagtggaaatagtagatgtgtattacctctagctggtcattgtttcattcgttcattttctttgttattatatctatatgcttgtagatcggggtggggaggtgccggctcggtgaaccaaccctgcctgattttagcagttcctgttttagaccattccgcaaacaagatcatgtatgtggcctaccgtggtgtgatatagttgtactccctcccgaaatgctcaatggagagctcggcctccgngaggccaaattta

SEQ ID NO: 34899 - DNA, 867 bp, Triticum aestivum
  Clone ID: PAT_TA_34899
gcacgagggcgtcaaacgagtctaaggtgttgttgcttctgaatagttacgttacggatgtattcccccttctgtacctagacacccagacaagatccttccacgcgccaaacccaccaatgggaaatctccacgttcgactacatctaacacaacagttgaaaataaaaaaaaacgcgagagttcaatgcgacaaaaaacatgagtttgaaaagtttttgactcttgtactgttagcttaaagatacgatatgcgtactgtagataatctcaaacatatgttgctcaactttagaagatatagaaaattcttccgttgtttttctatgtctccagcagtcctacgtctccataactagtaggacatcggaactgcaagtacacgctccccggagggcccacttccagcctctccactcgtttcccgggtaatccagacccattgccaccgttgtgcaggtcaactcaaagcgtggcgacgagtggttgattgatttctcctttcggttaacctcacatcttgggcttggtttgttgcagaatcaaaaagcccaatccataacggggatgaaaaaaaggagagaagcacgggaagaggtgcttagtagaagaggtagaatgtaatgtggaaaatgagataaatgtgagaatagcaagtagtaaagcatgagagggattcagattttgttttcacattctcgctgtacacgtacctttggtctgtagatgccccgtaatggatcttaggaagtatgaatggttaatacctacaatggtgcactatgcatctttggccggtttttttgcatttttaaatggttgtggagcaaacctcggccgcgaccacgctaatcacttagtgaattc

SEQ ID NO: 34900 - DNA, 682 bp, Triticum aestivum
  Clone ID: PAT_TA_34900
ttcccgaggtccacccacgcgtccgcacacgcgtccgtacggctgcgagtagacgactgacgggggagaagagatcgagagaagaatagtttgatcatcttgtgagaaaaataatggctgctccagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaacggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaaatcttaaagttgttagcgcatgtgtaatcatgtttctataaatgtttctgtgttgttctctttctctctaatgttgtaaaactcagacatactttgaatttataagacttctagtgtttgcaaaaaaaaagaagaggataaagaaa

SEQ ID NO: 34901 - DNA, 1039 bp, Triticum aestivum
  unsure (1)..(1039): unsure at all n locations
  Clone ID: PAT_TA_34901
gtttaaatggaatcatgaatgagattgctgaactagatcaaaggaatatcattgagatgcacaactatctcacaagtgtttacgaagaaagggatgccccggtcagcactcatcactatgctagcagctctcaaccatgcgaagaacggtgtcgatgtagtgtctggaactcngaggtgcggacacattttgcaagaccaaattttaagagggtgctgtctaaggtagcctccaaacatccttatgccaagataggagtgttctattgcggagctccagttctggcgcaggaactaagcaacctttgccatgagttcaatggcaaatgcacgacaaaattcgaattccacaaggaacatttctgaaaccaggtaaaccgcacaataggaaattagcacaggattgtgttgtatgtatgtcgtctttgcttgttgcgcgcctgactttggagagcaagggaaagaatcacctagtgctttctcggtgcaccggtcgccagttaggcaatgcacactgctttgcttaagatactcgagaaaggaagctggggatcagctggtagtacatacattacacatcaatcatggattcagaagtatatattacagtcgcgccggccagggcagcccctctgtaaaatctcctatatgcggatgcggagtcgacacaaagacgctgatctcctgaatatggtttatggttttgactacatgctgggtgatgtgatgtaggacaatagggaaggccaccagaggcacaaggctaagtaactgtgtatatttgcttgtagctgagttgtcaggccacaagtttgtttgttctcacattgtaattatacacagacggaaacacaggcagggagagtacagtacagtttgattcttttcttctctttgtatgtaaaaagtttaggttggtagtgattgggtccggattgaggacatgaatggactacattcgagcttgtgttgtttgcttgtgccacgataggataacatgcattctttttcatggggttgtgtgatgttgagaccccttc

SEQ ID NO: 34902 - DNA, 461 bp, Triticum aestivum
  Clone ID: PAT_TA_34902
acgcctgcagtactgtcgtagcttccgggtcgacgggtccttggtgttggtgggttcggtaaagtttaccagggagagatcgatgggggcacaactaaggtggctatcaagcgtggcaaccccttgtctgagcagggcatacatgagttccagactgaaattgaaatgctgtcaaagctccgccaccgccatcttgtgtcgctgattggttactgcgaggacaagaatgagatgatcctggtctatgaccacatggcccatggaactctgcgtgagcacctatacaagacccagaatgcgccgcttagctggaggcagcgtttggagatctgcattggtgcagcccgtgggctgcactaccttcacaccggtgcaaagcacaccattatccaccgtgatgtgaagaccacaaacatcctcctggatgagaaatgggtcgccaaggtttcagattttggtct

SEQ ID NO: 34903 - DNA, 1639 bp, Triticum aestivum
  unsure (1)..(1639): unsure at all n locations
  Clone ID: PAT_TA_34903
cccacgcgtccgcttatgggttgctgcgttttctgcaagcgtcggaggaaagcgtgggccgctagcggcacgagtgacggtgagcctggttggcaagggcagttgctgtatcctagatccctcaatacatcctcaggcaggtcgtaagctacagggaggaattgtatttctttgccgtcgaacctgtggcgccatttctcctttgcagagatcaaggccgcaaccaaaaaatttgatgagtcacggttccttgatgttggttggttcggtaaagtataccatgtagaggatcacgggggcacaactaagctggaggtaaagcgtggcaatcccttgtctgagcagggcatacatgagttccagacagaaattgaaatactgtcaaagctacggcccctccattgtgtgtcgctgattggctcctggaggagaaatgggtgaccaaagtttcggatttgggtctgtggaacattgggccgtcgattgagcacctactagggagcaccgttgtctggaggccttgaaggatgcctccctcctgaccagttccgcaggtcgcgcaccaccgagaactctgatgtctcttcaattggtggcgtccagagcgacgccatctgtgctcggcctgccttgaacccgactcttgcaaaggaagaagtcagcctggcagaatgggcattgcactgccagaagaagggaattctggatcagattgttgatccctacctaaagggaaagattgttcctaagtgcttcaagaagtttgccgagacagctgagaagtgggttgccgacaatggcatcgagcgcccttcgatgggagatgtgctttggcaacctggagtttgctcttcagcttcctggaaagcgcggaggtgcgcggaagcttcggctgtggggtctgggatgacgcggcactgccccaaggaatggctagtctgaaagaacctaattaatcgctgaccgaaacaagaaacaccacgaccaagtcctcctccctaagctgccgcgaccggcggggagcggggttgccgacaatgggcatcgagcgcccttcgatgggagatgtgctttggcaacttggagtttgctcttcagatgcaggaaagcgcggaggagagtggaagcattgggtgtgggatgtcagatgagggcactcccctcgtgatggttggaaagaaggatcccaatgacccatcaattgattccagcaccactacgaccacaacaacttccctaagcatgggtgaccaaagtgtcgcgagcatcgactcggatgggctgacgccgagcgcggtgttctcacagatcatgaaccccaaggggcggtgaggtaaaaatctgggtctgcttttcagtcagtcaccgttggggcctgcctaatttattcattcagcatattttcatgcgtttgtgctcttgctgtctcgcaagttatgcattagaagtcaaaaaattgttccatattagatatttctgtcttgccttgtttttttttcttcttcctcttcttcagtgttgtaatgactatgcttatttgcatgttgttattgtaccaccactgctatgtgttgttgatccaacatgtaatactgtatgagaaaaagaaagtgtgcacgaccaananaaaaagnngggg

SEQ ID NO: 34904 - DNA, 1776 bp, Triticum aestivum
  Clone ID: PAT_TA_34904
cggccccagcccgaccacttcccctcgccccccctccccccgtcgccgggtggtggccccctcgcccgctcctccgccggccgcctgcgtcgccgcggcggccgcgcctccctcctcgccgccccgcccccggccctccctctgtcccccgctgtctgcgcccgcctcctccgtgacggccggtgcgttaagctgcccccggcgctgcccgggtgccccgtggtggggcggcgcccgtgtccccctgtgggtgcccgggcggctcgtgctcctgccgaggtcattggttcccgggagccggacgcgccggggggcgcgctcctccgcgggaaacgcggcgagttaaagcggatttatgatgtagtggagtttgtgctacatgttcaagaaccatacttcactcaactcagtgctggatccaagaacgttgaagggaggttagcagctggtaattacaacaggattacacaaggttctttgttgctcttcaataaatgcctcttgcttgaggttgaggcagttagaaagtacagttcgttctctgagatgctgcaaacagagacgatctcaaatgtccttcctggtatttcatcaattgaagaaggtgtcaaagtttatagaaaattctacacagaggaaaaggagaactcttatggagtcttggcaatatctgtctcaaagccgcaaatccaaccttacataaccatgactgagcttcttgctggattgggttacgatggattaggtagactccttggtctggcaaacacatcaggaacagttccagatggactgcctcctccaaaatccatgttgatttcatcttgtatgaaactacacaagccaactgtgtgttcagctttagcaactacctctcagttctattgaatgctgccccatccaaacactttgcagttcttgaatattaccaagcttccaccttgtgaaatttctcttgtaactaagaataatggtgttgcattgtactggaggtgaaaagttgttctttaactgatgctgcaagggcattggccaaacatgttcacaggagtagggatgggtggtggggctgcctccatggaagtgcaccaaagaagaatcatatgaaatctgaaatggttgaccgtttaacttgaatttgaaagttggataaaagtttggacaaaggcacatgacacatttgattttgaaattcgtgttatagtgtagtatggtcattgtgatgttaaatacaaatttggatcacaagatgagaaatgacgtactcgatagctttcccaaagaagttatcgatttctaggtcttattatgtgtgctctccagcttcgccatgtttcttgttaatcggttacttgactgttccttgattccttggatatgattttgcagttcattggattcttggagccttacactccagatggctttctcaacggttggaaacactagagtgcgatctgagtgatgtacactagttcaaatgttctgtagaatggcggaagatatgttgtatgtcttattcaaggtcgaagggaatgtcttttgtaaggcctgaaggtgtaagttataacttatacgatgctatagtactaaatctgttttttttcaaaatctgtgtattaaatatcttgagtcatcgttgtgtgtgtgtgattcgtatcaaactgttccatggcgaaaattgtaatgttggtacccatcagctctgaaagcatcagaccatcagacagatttctatgttgtactaacttgtaaggtgtttatacatcaatcgct

SEQ ID NO: 34905 - DNA, 1091 bp, Triticum aestivum
  Clone ID: PAT_TA_34905
attcggacgaggctcttcgaacaactgcaaaaggaacagcagtcacttgagcttggtgagctgaagcagagggtacatgaactcaccgaagtcaaagctcaactcgaggctcgcaatcagaagctattagaggaaagtacatatgcaaaaggcttggcttcggctgcaggagtggaattgaaagcgttgtcagaagaagtgaccaaactcatgaaccaaaatgagaagcttgcttccgagttagcatcgcagagaagtccaacccctcgcagagtaagcaatggaccaagaggtactgctaggcgagagagcatgagtagacgaaatgaaccagctagcagaagagatggcaatgcaagagaagagagggagagagcgttagaaaccatccttgcagagaaggaacaaaaagaagcagaactccaaaggaaagtcgaggaatcaaagcaaaaggaggccttcttggagagtgagctggcaaacatgtgggttctagtggcaaaattgaagaagtctcgtggggatgatgaccatgaggatttggaggccaaatataatggctcctgagtcctaatcaaacgcttgttttggcttgggtatgggcttttctgtatgtatgcaagattggtggtttgggtcggttttctttgtgaattagtgtcgtcccctgtatattcttgggctaatcaaagttgtgagtagtagtggagagtggtgtgctaacaactgctgagagcttcctaccattgctgtaatgagattttggaattcctagaacatggtcgtgataatgaagagaaacgtctctggtgcctgtaccagatgtgagatgtctaacgtagtaacttgtatttcatctgttcgtcctgcaattggattggaagaatatcaaactggaatgtgtatattatagaagaatgtcatgttggttttgttgaaggatagttgtatgatcaaagcataacatcctgttttcggaaatgccatgttggttttgttgtgctaaaaaaaaaagaaaaaaaaaaaaaaaaaaaaaaactccagcccccgggcggcgcccacggccacctcgtacctgcccgggcggccgc

SEQ ID NO: 34906 - DNA, 833 bp, Triticum aestivum
  Clone ID: PAT_TA_34906
gtgagagatacaaagcatgcaccgaatggcggagttgtgaatgatctaaatggttcgacaaaggaggttgccctgaacgaagaattggttgaaaatgaaactaaaccaatgccaaatgttttcattcctcgtgatagcagcgggaataaccaacggatgcttctggcacctagtacttgtcacccctcctcccctgtcacaaaaggatattgtcaatctggtgccttggagacacaaccagataggattattgagtttggttctttgggtcctttctcattgacatctccctcgccaaagtcaaacaaggcctcaccaaaggcatgtgcagacgcctctgcattggcgttacagagctatagagccaagtgcaacccaaagcaagtcgtaagaattttacagaaaatgagacctagagcagttggccccaatccatgctatttcctgctgagaattaaactaccatacagatgatcatcatttaactaggagcaaaagaagagttaacccagttgatgttcacaaacatgaccatcgtaatagtatacatctaccttgtaaagttacatcgacaccttgcgtttcttgctttcgtgtctataggtaaaggtacttaggattaattctaagagccggttcgaactactccccacttcttactatttgattgattagtatgaggtacattttgtcaagcaaatgaacagaaggcatatgtattattacgagtgaagccatccatacaagttaagatattaataatcctgtatgtggaattcaagatatagagaaatgttattattcttctgcaaattggttgcttgaccaaatgt

SEQ ID NO: 34907 - DNA, 1074 bp, Triticum aestivum
  Clone ID: PAT_TA_34907
gtccctacagcacaccaacaaagccaatcgagcagtagccaacacaaatccaccatgaagaccttcctcgtccttgccctccttgtcgttgtggcgaccattgaacccgccaactccgatattctacgtagtgatcaaccacaacaatcatttccacagcaaccacaacagaaaaccgttcagtccttttttgaacaacaattgatctcatgcagggatgtcctgttgatgcagtgcaacatactggtaccgtccttcaagtcacaaatattgcaggaaaatgtttgtgcggtgatgcggaaagagtgttgtgagcagttcaggcaggtccctgagcaatcacgatgcctggccatcaatagtgtcgcgcatgccattattttgcatgagcaacagcaacatcagcaacaacaacaatactcatggggcgtgggcacgttcaagctacctcaacaacaatacccatcgggccagggctccatccaacctccatttgaggcaataaggacgtttgtcttgcaaacactaccaacggcgtgcggtgcgtatgtctcacaatactgctccaccaccaccggctcatttggcggcttctttggtaactgaacaagagctataattctagatagatcgattgtttgccgttgcttagtcgatggttcgattgatgtagcgacgacaaataaagtgtcatgcaccaccgtgtgcgaacctgacatgtactagttttaattggaaataaaagacaagcatatttcttgtttgcataaggttgaattaattaaattcaaggcggcccgtggtgagatgctcccacttacaatccctttttgcattaacgtgccaattgtgcagtgttgtaatccgctcctttatgttgtgtagtaatttgaacataacccgaccggccccaaaccttgggcaatttttcacgaattttaaaggcgccagggggaaccaccattcccccctttttcgccaagcttgggcggttattaagccgaaaaagagccccggcacccggaatcggcccttttccaaaacaagtttgcggcaacacttggaattgggcag

SEQ ID NO: 34908 - DNA, 1225 bp, Triticum aestivum
  Clone ID: PAT_TA_34908
gcgattgcttaggaggcttctagcttttgatccaaaggatcgtccctctgctgaagaggcattggcagatccatactttaatggactagcaaaggtagagcgagaaccatcttgtcaaccgataccaaaaattgaatttgaatttgagggtcgtagagtaacaaaggaggacatcaaggaactgatctttgaagaaattttggagtatcatcctcaattactgaaggagcatatcaagtggaacagacagacgaaactttgttcattttaagtgctgtcgaccaattttaagaaacgcttcgctgaactccaaggaaaatggtggcgaaaatggttcagctgtttcatcacagaggaaacattcttctttgccaggcaatccttcaacccccattagacgtgtaatgacctgtgacagtgaaaactcacaggatatgaagatccaagaagcttaccatctgtactccctcggcaaccaaaatatgaagcaccgcactctcagaaccaagtatctagtgggttaatgcttgatgcgacaggtccaactcccaacacaatatgtacatggaggagtatatgtagactccagaacagggaacttacttctatctgcatcatggtataagggttgatataccaggtgaggagtatatgtagactccagatcagggaacttacttctatctgcatcatggtataagggttgatataccaggtgacagtatcgcacaggcagtctctgttcctcatggctcagttctggctgtatgttgcagcatggcgtttccagggatgtttcgagcctagggttatttggcattgaatcatggaggtctggcttttttatttgttagtcccccaaatcatggaggtcgaacctaggattccagcttcatcttgtacatgggatgtttcacagcttctttgcaaccgagccccccaaatgtaccacacagttggatcataatgtgcctcctagggattgagttgcaaagctcgtttattctgaatgctgaaactttttccatgggaagctgtgaggtggctaggtcaaagaacatgatcgccgcgatttacttcaaccagttgtttaagaaatactcctacattttaacgcgagggaccttgctgtgtttagcagtgtgttaaccaaagaaacttgcatataatctgaatcatttccaatagttgctgtaaagaaatgcgcgaaaggtgaatgccagag

SEQ ID NO: 34909 - DNA, 738 bp, Triticum aestivum
  unsure (1)..(738): unsure at all n locations
  Clone ID: PAT_TA_34909
ggaccgccgttcgaccagagcgccgcctgcctctgttcctcccgcgcagcgacccggcggccggcgaccaaggcggtgcccgcggcgaggtcttcgcagcctagggttcggcttcactcctcctcctctccgcatctcggtcttcacccaggcgcggcggcggcgccatcccgcccgtcagctctcgtcacagaaacacgccgcaggaaacaatctgaatcaaggcacggcatcggcgtgatgcttttcctgaggccgtaacctcaaaggttgccccaatttgttaggcaggtggagcgagatgtcgagactgtaatcaatgttctgcagccaggtccaataggaattgtggagcataagttcactgatgcagagatccgcgaggcgcaagtcactgtaaggagtgctgttgagaaatggcgaaggaacagtgctctggagagaaatcttggcactggttcttttcataaatcgaagtagcgctctatgtcatgacttggtgcagcgcaccaatactgaaaataaaagtgtgccatggttgcaactgttggtcttggtgtagttaatgtgttttctctgtcagtgaaccaatgcaattgatcatgatatacctcctcgatgatctattatcggcaaaagtacactctgctcaagtttctgaaattattcttctaaactttggtgttctaaaaaatatctcctcaaagtatgctttgcagcactgtggattanatgtgg

SEQ ID NO: 34910 - DNA, 2022 bp, Triticum aestivum
  Clone ID: PAT_TA_34910
ccccgggcgcggtgattgacgagaagcgtgggcacaaattggtgatgtctgtggaatgggcggacatcagcgtcgacgactaggagtgcgtggtcgtgcccggagcccggtcaccgaagctgctcgtgacgaacgagaagacggtggcgctggtggggcagttcgcggccaaggggaaggtggtcgccagcatcgaccaggggcacctggtcctcgccacggcggggctcctcaagggcaagcggtgcgcgagcggagtgcccatgagggtggtctacaacctcgccggcgcgacgtcagtggagccccaaggggcggtcgccgacgggaagctccgtccggcggcgagctggccggaccttgccgagttcatagctcgcctcgtggatctcttgggcatcaccgtctcgttctaaagatgcaactgcaatgcatctctccgtgatctgtaataactttgtgaacagaacaccgaacactgtcacactctgcagatcacgacctagggtactaaccccatccccctgccgagcgagggcgcgtccatcatcgggatctgggagagtggccatggacaacgccagggcgatgcctggcagcccggacgccgcgcgtcccgaaagctgggtcaagtctgcggcgcctcctggcggggactctgggatttcgcccaccgggggggacgagaggccgtgtaaaggcgacctggcgcttagcgggggttgctatggcggtggcaggaactagtcgcggccactttgaagagccggctgcgagcaggagcggcgaggaaagaagccccggggcagtgggccgtcgggcggcggcgacgcggggcgcacgagcaagtcgcgcgcgattgggaagatgttcttcaagacgaagctctgctgcaagttccgggcagggacgtgcccgtatgtgacaaactgcaacttcgctcatgggatggaggagctgcgcaagccgccccccaactggcaggagatcgtggcagcacacgaggaggcgacggaacagagagaggagcaccagatcccgatcatgacttcgtccaacgtggtgcctggtgacagcgtgtctggcagggcgtacaaggggcggcactgcaagaagttctacaccgaggagggatgcccctatggcgacgcatgcactttcttgcatgatgagcagtccaaggcgcgtgagagcgtcgcgattagcctatcgccgtcggttggcgggggcagctacaactctgctgctgctgccgccgcctctccaaatggaccgacaattctgaagccgtcgaattggaagacgaggatttgtaacaagtgggagatgactggctactgccccttcggtagcaagtgccactttgctcatggagctgctgaactccacaagtatggtgggggacttgtcgacattgacgggagggacattgcatcaactccggattcgaagcaggctgcggcatcttcgaaacttcctgtggagactgctgctgcatccactgcggtgccccctcatgcagacgtgtaccatttaggcagccagtcacagcgttccgccttggccagccaaaggtccgggcagctacagaggccaatccagaaatggaaaggccccgacaagatcagcaggatctatggtgattggatagacgaaactgactaggaagaggagcgccgtgtctgtctcctttacccagtttagttctagttggcattgcaaaaacctagtgctggaagagtctgcgtgttgtaagactaaaacattatgctgccgcaacttgtattgtgtctgttgtatgctgattgcagtgaactcgccgctgggagagctgtatggatggtagtgttctggtcttctggaaatctaaaagactaaaaaaaatatttcgtttcctgtctcctttacccagtttagttctagttggcattgcaaaaacctagtgctgggagagtctgcgtgttgtaagactgaaacattatgttgccgcaacttgtactgtgtctgttgtatgcgtgattg

SEQ ID NO: 34911 - DNA, 420 bp, Triticum aestivum
  Clone ID: PAT_TA_34911
tatatatgtggccgcaaaccaggagaatctgtgggtgtccacccacctacacaataagctgttgcagcagcaatatatggtaggtttgcgtgagagagctagctgtgtatcttagcaactccaacagcaacagatccttgtagtttaggaattcaagttgaggcaattggagcttcatatcttgggctaagaaaacaataggagctacttgtgagaagtatcagctcagcacaatgcaactgactgatgtttttcttaggctgtaacatgtgtatatgtactgttgaagcaatcagacaaattgtgctgatttgtaagtaatattgacaaactgaacagagttctgccaaatatgtaagtaatagtgaacaacaatggaaatcatgattggtcgaaaaaaaaaaaaaaaaaaggccccta

SEQ ID NO: 34912 - DNA, 2154 bp, Triticum aestivum
  Clone ID: PAT_TA_34912
gcgatcctgatgaggtcagctgcaggtactttagtagtatgccctgctagtgttcttaagcagtgggctaatgaattgaatgacaaggttagtcaaagtgctaggttatctgttttagtctaccatggtggtgcaaggaccaaagatccaagtgagctggcaaaatatgatgtcgttgtcacgacatacacaattgtggcgaatgaagtgcctaaacagaatgctgatgatgaccaagatcaaaagaatggggaagaatcttctgttggtaataaaagaaaaccaccaagcaaatctaagaaaaggaagaagaaacttaaggattcagatattgaccttgacagtggcccagttgcccgggtacggtggtttcgggtggttcttgatgaagctcagacgataaaaaatttccgaactcaagtggctaaaggctgttgtggactaagagcaaaaaggagatggtgcttatcaggaacacctatacaaaattcaatcgatgagctctacagctatttccgtttcttgaaatatgacccatattctacatatagctcattgtgtacaatgataaagcacccaattgctagaaatgcagtccatgggtataagaaactacaaactgtgttgaggatagttctcctgcgtcgcacaaaagaaactacgataaatggagaaccgatcataaacttacctccaaagacaattaagttgcaaaaggtggatttcacaaaggaggagcgagctttttatttgacactggaagaacgttctcggcaacagttcaaggaatatgctgctgccggaacagtcaaacaaaactatgccaatatccttttattgttgttgcgccttaggcaggcttgtgatcatcctcttcttgtgaaggggcatcagtcggtatttaaaggcgatggttctatagagatggcaaaacaactttccaaggaaagggtaatagatttgcttgcaaggctggaagtgtcagcgctttgtgctgtatgccgtgacacacctgaggatgctgttgtggcgatgtgtggtcatattttctgctatcagtgtatatacgagcggataacaactgatgaaaacatgtgccccgtccctaattgcagaaacacgttaagtactgaatcagtattttcatcagggacattaaagatttgtatctccggcaagaccagtactcatgcgatagcgagttcatcagcagacgatgagctatcttctatcagtcaaagcagttacatctcctcgaagatacaagcaaccgtcgatatactgaattctatcattaacatgcatgcccttacagacagtgataccattgaatcaaatccaaaccgagtatcccctgtgaaagccattgtcttctcgcagtggactggcatgctggatttgctggagttttcactgaacagcaatcttatacagtacaggagactagacggaacaatgtccctcaattcaagagataaagccgtgaaggattttaacatcgacccagaggttagagttatgattatgtcattgaaagcgggtaatcttggtctgaacatggttgctgcttgccatgtaatactccttgatctttggtggaatccttatgctgaggaccaggcaattgatagagcacacagaattggtcagactcgtcctgtcactgtctctcgtctaaccattacagatacggtggaagatcgtattttatctctgcaggaggaaaagagagcgatggtcaactctgctttcggtgaagacaaatccagtgcccacgctactcggctcactgtagatgatctgaggtatctgtttaggatatgattgggaggaggagatgatcccttgttgcgttgctagctttggaaagcgtcaaagtggtggcagcatgtacgttgcttgcaatctacctatgttccgatcgatccagttttgtccctgccccgccgaggatccagttttgtcatgctccgatcgatcctacatgtgacatcggatggccagctagctagcatgtctagtgtaacgtacttgtgtccctgagaccctgagggggccgtctagtgtaactgccatacccccgccctgtaggagaattcttgtgcgctctgttcccctgtgatgacaggagagatccatatgtatagtgtgtca

SEQ ID NO: 34913 - DNA, 692 bp, Triticum aestivum
  unsure (1)..(692): unsure at all n locations
  Clone ID: PAT_TA_34913
ccacgcgtgcgtgtnnncatctgaaaatgatacttcatagggtggcagttatgcatcttcattgcgaggtaccccgtactgagatatggcatagtctgaatgcaaccatagttggcttggcaagtagttgtgacacacctgcgacagcccatgcaattccttggtgtgttgggcttggtattgtcagaggcatcgatgtgcaaaggggcctgttatatgttatcactcctgttgctgttgaacatcttcaaagcgtagatctgctgctgcagggtctcattgagattccgcgatctgttctgcaggtcaagggatgcgagtcgccctacatgtccaccaatgtgcgggacaagataacggggaaggatctctacgcgagtaatctcaacagcccactgcccacacaggatgacggcgattccgattcggatgcagatactatgtaaaccttgcatcatgttcgtcgcttcattttcgctgggagatgtatggcgttcgttctgcctgacatctcggagacacaacatgaaattttgatggcggaccatctttttttgtgtacccagtagtgaattttttgctcaccttgaantttgaactgatttttctgccttgtggtatggctgtgcgctgccatacttgtagcaaccgccgggtacanatccctggncaancaaaaagaaactgaatac

SEQ ID NO: 34914 - DNA, 740 bp, Triticum aestivum
  Clone ID: PAT_TA_34914
gaaagatctaatggaggaaccatgtcagtcgatgaattatacgattggctcgaaggtcagcagactgccgagatgtaaacctgaaccctgtgtcaaggagaagagagaattcttaagacgcataggatttgtcgaaggctcggaagatatggagaaggcactcaaagctatccgtggaaaaggcacaaaactgcaagatcggtacaacaaactagtggagaaagggttagacccaaaacatgtagcccacatggtgaaggttgctcctcggattctgaatcagaagacggacgcccttgcttataagatatccttccttgtgcatgtggcgggttatcccctgagtgctctccctgcgttcccacggtacctagagttcactgtgcacaaaagcaaacttaagatgctgatgtacagttggctgctagaaagggggctggctgcaccccaacttactctaagcacggtcctagcttcctcggaaacagaattcatcaaggctcaccatgtatataaggttcccatgggtcgtgaggtttggtcgaagctcaagcgggagggaggtagcttccggcaagagaagatcagatggctgcgacacaggtgcaacttggacgatagtcgaatcgaatgcatgagttgagcttccttcttttccttctttctgcccatctagctcaatactacattattcacatatagtacaaccttctataatccctgccttctcacatattcct

SEQ ID NO: 34915 - DNA, 957 bp, Triticum aestivum
  unsure (1)..(957): unsure at all n locations
  Clone ID: PAT_TA_34915
cgttgtcttcccgagaacactcctcgccgtcaccagattcactaccagaagcgtccgcccctgccgccgccgccttctcccgctccggcgtcctccgcgcccgctcgcccccctcatcatctgcatcagcctcattctcttttgctgtctaacctgccctgttcctaccaatttcaacgtctttcggcgacaatgctccgtcaaacgcggcatctcctacagtcccaccattacccttttaataatcgacattatgtgactaaaggcatgaaagcgaacatacaagcataacaattactagtaagtaaacccagtttaagaatgatcatacccctatagatggaattgtttcattgccacccatagcttcaacaacagcctcacttccggagaaattacctctagaagaattagtacctgatgtaagctccatatttgttctccgctgattctgttcagtctgatgtaatgacatgttagatggcccctcacctctgcggacagttcgatcagcatcatggaagccattttgagcatcttctgaaactccattcgccaataaaccacgagaagattgtgcttgttccttcggaatgctttcatctcggttggcttgcttaacagtgactgcaccgtttggtattacattattactttcccctgcacttgcaagaccagtcgtaggggttcggctcttcgattttaccacacttgcatcttcaacggcaggagttcggngttgaactcccaaaataggttccacaaatgtcgtccaggtccggccttcattcgttgtgcctagcaatggccttgttgaaggcattgttttggaaactcggtctttctccggggtgaaaacccaagatcttcgatcggtcgacgacaatgcttgtgcattgtttccttcttggaggcgttgcttttggagagcctangttgtagtacggggtgttgtat

SEQ ID NO: 34916 - DNA, 836 bp, Triticum aestivum
  unsure (1)..(836): unsure at all n locations
  Clone ID: PAT_TA_34916
gaacaagggcaacaaccaggacaatggcaacaagggtactatccaacttctccacagcagctaggacaagggcaacaaccaggacaatggcaacaatcaggacaagggcaacaagggcactacccaacttctctacaacagccaggacaagggcaacaagggcattacctagcttctcagcagcagccagcacaagggcaacaagggcactacccagcttctcagcagcagccaggacaagggcaacaagggcactacccagcttctcagcagcagccaggacaagggcaacaagggcactacccagcttctcagcaagagccaggacaagggcaacaagggcaaatcccagcttctcagcagcagccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagcaaggacaagggcaacaagggtactacccaacttctttccagcagccaggacaagggcaacaagggcactaccccagctttctttgcagcagccaggacaaggacagccaggacaaaggcaacaaccaggacaagggcacattccagaacaagggcaacaccagggacaagcggcacaangggtctatccaacttttttcacagcagccaggacaagggcaaca

SEQ ID NO: 34917 - DNA, 1073 bp, Triticum aestivum
  Clone ID: PAT_TA_34917
ctccgccttcgtcgcggcctccgccgccggcgtccccgaggaggcgcagctccgcctctacggcctctacaagatcgcctccgcgcgcccctgcaccgcgccgcagccctccgccctcaagctcaaggcccgcgccaagtggaatgcttggaataaattgggtgctatgccaacagaagaagctatggaggagtacataacaattgttgatgagatattccctaactggtctgatggctcaaaaaagaaagatggggaaaccacaatgtctgcatcaggttcgaagggaccaatgggacctgtatttagcagtttaatgtacgaggaagatcaaggaaatgaatcagaacttggtgacatccatgtttctgcaagggaaggagcaattgatgacgttaaaaagcatctggctgctggtgtacaaatcaacataagagatagcgaagagagaactccgttgcactgggctgtggaccggggtcatctagatgctgtcgaggttcttgtcaactcaaatgcggacgtgaatgctcaggacaacgaagggcagacagcgctccactacgccgtcctctgcgagagggaggacatcgccgaactgctcgtcaagcaccacgcggatctccagatcaaggacggcgacgggaacaccgcccgggacttgtgctcctcggcctggccgttcatgaagccggcaaactgacggcacaatgaacccgatgatacagagttgacgcctgctgctgctactaccactagtgccgagaaactatacacaccgtgcttggttagctgaatcggatgagccgttttaccaacctcatcgaatacactgtcaaaaggtaactcagcgcagggtagacatcttgtagtggtattttgcctgtttcatagtgtgtttgtgctgcaggccaactgtttggcaggaaatatatcagtgtcaggattcaggcctcgcggcctcatactgtcaatatgcatacatgttaagagcatctgtagcagatccctttaaagtcggtactgcaaaaaacagatcaaggtatgctgcaaaacgaaaaaaaaaaaaaaaa

SEQ ID NO: 34918 - DNA, 715 bp, Triticum aestivum
  Clone ID: PAT_TA_34918
ccggagaacgcgaccttggacgcgtcccctctcccgctacagtagaggcgacttttctggaacccccgagcagatccacccctccgtcgtcgtttcgccgggtcccctgccctccgtcggccgctgcggcggcgggagggtgggggagctttgtctcgcgtgtgtgtacagggtaggctctgttgggaccctggccggcggcgtcttggagtgggcggcgcggccggtcttcgttttgcaggtggtgctcgtcccctccggcggtggagttcttctgagcgctacggcggagcgcctcctcgtccgcgctcgcggtccccggtggccgatgcgtgcgtttatccccctctggatctcgacgcggcggatccagttgtcgacccggaagcccctgatgttggatcaagacggcgttaccagcggagcagagtggaggctccccggagttcgaggtccggcgactaccccgccgcctggggacatctcccgatccaaggttcgtgtggagatgcagcggcggcccgccaccggcacgttcttcttcgcgtcggcgacgttgttttgcagaaaggacctgtgtgtaatttctagctttctggcgttcttttctgtaattcttgtttcaatataatcagtggtttcctcacaaaaaaaaaaaacaagacaggaaatattcaatagagagtgtggcctacccttcagtaaaaaaaaaaaa

SEQ ID NO: 34919 - DNA, 1102 bp, Triticum aestivum
  Clone ID: PAT_TA_34919
cgcggccgcccgggcaggtcgatgttcgaagaatcggaagcaggtgaagaagcagagaagcatagaggcagaggaagatgaaaatgcatctgtaagaaatctgaatgctggatgttcaaggatgccagtcacctctgaatgtattggcgggcaaccccttgatataccttgttggactggaatcatgaagatcaacaataactatattccattggctgcacacctgtcaaccaaagcaggcaagaaggtgcaggaactgtcaagatcattgccaccaataatgaaagcggccaagctttctacatcggaatcatgtccaaagcactttgaggcaccggtacctcggccgcgaccacgctaatcgaaagaattacgcgagagtgatgagccaaagaaacgaagaaacccacgcgtccgttatgacgaagaggaagatgccgaggccttacaggcagaagatctgaattcccggtcttgtgatgatgatgaacatgtgatgaagcaaagaaaatgcatggaaaatgctgcagagaaccagagaagatctgtagtagaaggtaaagaagctttggggtcgggaaatttgaatcaatattcgaagaatcataagcaggtgaagaagcagagaagcatagaggcagaggaagatgaaaatgcatctgtaagaaatccgaatgctggatgttcaaggatgccagtcatttcagaatgtattggcgggcaaccccttgatataccttattggactggaatcatgaagatcaacaataactatattccattggctgcacacctgtcaaccaaagcaggcaagaaggtgcaggaactgtcaagatcactgccaccaataatgaaagtggccaagctttctacatcaaaatcatgtccgcactttgaggcatcgatacctacagctgacagcattggcttgtatttcttttcgggtgatattaggccaaataaagagctggatgagctggtgaagcatctcgctgatagtggaagtgttctagaagctgttgttggtttgaggaagctgtttctctttccttctggtgtactaccagtggaacatcagacgttccaagggaaaccctatcta

SEQ ID NO: 34920 - DNA, 1226 bp, Triticum aestivum
  Clone ID: PAT_TA_34920
gaattcggcacgaggggggggggggtcccgtcgcaacggctagtcggggcaggccttccggggccgatggacccgcgccgcgacggaggcggaggcggaggcggcgcctccggcgatggcgacggcaacaaccaaattctgtgggattggcaagagaaggagcatggcgaacctagtgatggaaatcatgatgttgctaagttcgtgtgggattgcctcaaccgagatgatgatgatgatgagctacttggattactgggaaatcaaactcctctgcgagactgccgggccttctttgatattggggatatcacttgcaaggagacactagacctggaggagtctcgggaatcaaagcggcgacgcgtgttggagtacccttctgaggttaagcagccagaagttggtgatcatggaatgtgttctaattttgtcacatctgaggtagcagagacttcattgctttgcactgatgaaccacagagtttaaactggaatatgcagctcaattcagatgatttagataagttcagttccttgtctaatgaagcatcctacgagccatcagataatcaattggataattactctgaaggagctactatgtactacacgcctgatcaaatgccttctagccaggagagcgttacatacattggttgtcaaaccgatgtgccaggaacaagtgagattgctccggtgacagaaagtctccataatgcatgagactaggaaactttctacacttcaaagtatctaaaggaagctcgatgatcaaggcgaagcaaaatgtaactacatctatagcatcccttttaaccttatcaaaccatcttgggaagaaggagatgtcactctcaaggatataaatcagcgcatccatgctcctccaaagaagcctccagaaatcctggaaacttcagctttctctgggaagccggtcattggcaagacaagaatcagaacagaaggtgggaaaggcagcatcacaatactaagaaccaagggctgagaattattacagcttatttaacagccattcccttgattgctttcaagaatttggtcttcttgtgcaggcctctatagcatttcgatttttcttggtcacaatttttgtgccatgtgttcagagttactgtggatggccaactctttgttcaaagattcagcattcatctgtggtgtattttagtggcatgcggctaatgatatatatatggaca

SEQ ID NO: 34921 - DNA, 823 bp, Triticum aestivum
  unsure (1)..(823): unsure at all n locations
  Clone ID: PAT_TA_34921
aaaacggaagccaagtggaggcatcgaatnactgcgtgcgattccttggatatttgcttggacgcaaaaccagattccacctgccagtgtggcttggtttcggcgcagcattcaaacatgtcctgcagaaggacatacgtaatcttcaagcccttaaggagatgtacaacgagtggccatttttcagggttacaatagacttggttgagatggtgtttgctaaaggtgaccctggtatagctgctctgtatgacaagctgctggtttctgatgatttatggccgtttggggagcgtcttcgagcaaactatgaagaaacaaagcaacttcttctacaggtagctgggcacaaggacctcctggagggcgatccttacctgagacagagcctgcggctccgtgattcttacatcacaacgctgaatgtctgccaagcctacacactgaagcgtatccgggaccctagcttccattcacagcctgggcctcatctgtccaaggagatcatggagtccgggaagttggccgccgagctcttgaagctcaacccgacgagcgagtatgccccggggctcgaggacaccctcatcctgaccatgaagggcatcgccgccggtatgcagaacaccggctgaagtgcaaacctgaaactgttatgttgtgtgagatggtgtggtgcagtagacgcttttggtgcatcgttgtcttttatgtatggtctggaccagttgagccaaactgtgacatttgcctgcttggcgcgttatgttaattagttactctaatattatatgtcgaactgtcttttctctttttgacatgg

SEQ ID NO: 34922 - DNA, 1142 bp, Triticum aestivum
  Clone ID: PAT_TA_34922
agatcgtccgaggcacggccggtcgtccgttgatctatctcccatggaggcgagcaagggaggcgatgggagctcgggcgcctcgccgagcaacgatgacagcacggtggaggaggagggagcgagccgtcaagagcaggaggacgcctgcagggggaactctttgtcgtcctcgtcggtgcgcccctacgtccgctccaagaacccgcgcctccgctggacgccggagctccaccactgcttcgtccgcgccattcacaggctcggcggccaagaccgtgcaactccgaagctcgttcttcagttgatgaacgtcagagggcttagcataggccatgtcaagagccacctccagatgtataggagtaagaagattgatgactcaggccaggtcataggtcatctccccttgccccatgccttccatcatcgccagagtggcgccggcaccatgttgtcaaggtttggtgctgctgcatggcctccatggagaagcttccatgaaccatattgggcccatggtcgcccctttcttggatccaagacctacaactctttggaagctgaagccgaggcggctttccttcggtcccgagctcaacatgtagctcgggctgcatctagcaatccgggattgatgatgcagtcaggctgtccatctcggaacgatcatcataccatgaaccaccagcctaaacgactgctgcaactgacagtgcgcaatgacgacgatacccatgttcttcttgatcttgatctcggtctctcgctcggtctccccgtgccgatgagggaggcgaagcggaggagatcgggctgcggctgggtgaaagaaggccctgatgagaaaggagccgatgaagaacaagtggatgagaccagcactgccactatgctatctctgtccttgttctctcctagggatgctcctaggaagatgagtagtactagtgctagtgatcatgcagtagatgagcatgctacaaggagggcaagtactcttgatctcaccatatgatctacacaatgtggtgatatctcgtggtacttgtccatacatacatatgttatatattatgtagagcgaacatatatacctatgttttaccatacatattatgttatcttctaattaatgtttg

SEQ ID NO: 34923 - DNA, 436 bp, Triticum aestivum
  Clone ID: PAT_TA_34923
gggtccaccctccgcatgatggttggaagcaaatgcaagttcataccaaaagatcgttaacaacaataccaacttgcggatgacaaggtagtacaactaccaataccaaactaacttataatctttttactcctggccctagtgttcgtctggtagaaaatcttgcagaggaccaactcccgctccttctcttgctccaggtccccgaggtggtactggtgcatcacccagttggtcctctgctagtcgaagttcttgttggtgtgcagcaccagaaccttttttgctgcccgtctgccggccgttgaccatcaccggcaaggtattgccggtcttgtgccacatcgcgtgcatgccgcactccgactgtatcttgcgacgcgtccacgtgccccttttgaacgccctggaattgggctggaagaaatgcttcctt

SEQ ID NO: 34924 - DNA, 615 bp, Triticum aestivum
  Clone ID: PAT_TA_34924
gtcttttattaacttatcttacgattgctttgtagttgacatgcgcaaagtgctacgagtcaggtgacactgtggcatcacaaccaggaataacaatgagaagttcttggcaaaacaacgcaggaagcttgagctagagaacagggtttccagagatgctcagtttcattttagaactggtagttgtgtccgcagttcttatgatatcaagcatatcggtgatttggatttgactgatccatttgcacatatgtagctacttgttctcgccggttggcctatttcattttgtgtgttgtcaaacctgagttgttagcgtgtttgtagtaccttttgagtttgtatcatctggtaccttagtagaattcgagagactattttttatgatacttttgtcagacgggccacatgtttgcaaccctgtgctagtttacattaactccggtgttggtgttatttcaccttatgttttattgcattgttcgccaacttgttatcttgttgcctgtcaacactgaatacttgcctgatttccctgaatagtgctgttgaagttatcgtttgctcaacagtgaatcactgaactctatgctgaatgtaaatcttaccattaaa

SEQ ID NO: 34925 - DNA, 818 bp, Triticum aestivum
  Clone ID: PAT_TA_34925
acagattgattgcatcaaactccaatgcaactctctgtcactcagacaaggatcatgcgcttataacaccagagactaatgccacaataatgcttgagaaaggcaacagccagctccgtactgtgtcgagtcagcagtttaaccaaaatgtttcacggacaccaagtgtgtcacaggaagcatcaagcagtgtctttgttcccatagacccttctagtgttcaaaatccacacgggcgttttccttcagccagtgcccatcatggaaatttaactttcaatcagcaaccaaacaatggatggtttcaaagaaaacctgaatctcaatctactgtagaggttagagccagggggcatccatctgtcgcagcacaacatgcccatccatctgtcgcaccacaacatgcccatccatctgtctcaccacaacatgcccatccatctgttgcaccacaacatgcccatccatctgccgtagcacaacatgcccatccacccgccatagcacaccctgctctggaaatgcacaacaggaatggaggtccacagaggggtcctcgcatagcaaatgtcgtgcatcgattcaaatgctctgttgaacctctggaaattggtactgtgttatcagggagaatgtggtcttcaggccaagcaatcttccccaaaggatttaggagcagagtaaaatactggagcatcgtggatccaaatcaaatggcatactacttttccgaaatattaaaccgcctggttgcaaaggacctttatttattggttactggtagagaactggccccaagtgaagttttcaattaatga

SEQ ID NO: 34926 - DNA, 913 bp, Triticum aestivum
  Clone ID: PAT_TA_34926
ccaagtctacccataatatagggaccgaccttgcgggtttgccaagggggatggggaccgagcaaggggaggaaggaacgggagcgggggaggggggcggggggcggcgcccgcgctcccggccccccaggtccgggcggtagacagggtccggggggggggtctggaggagggggagggggccggggcatgcgacggccgcatccggcgcggggcccgcgcccatgggcgcgcccacggggccgaggccagcgctgccggcgccgcagcagcgggcggtggacgggttctggagggagcggcaggaggagatggaggcgacggcggacttcaacgaccgcatactgcccatggcccgcctcaagaggctcatccgcgccgaggaggacggcatgatgatcgccgccgacacgccggcgtacctggccaagctctgcgagctcttcgtgcaggagctcgccgtgcgcgcctgggcgtgcgcccaatcccaccaccgccgcatcatactggaatcggacatcgccgaggccatcgccttcacccagtcgtacgacttcctcgccaccgtgctcctcgagcaccaacgggaggcgcggctggccggccgtgctgctatccccgacaacggtttccggtgacggcggtgagggccgaaggctcatcaccaggaagcgccacatgccggacccgaatcctccagcccctgcacgggggtggcggagaattcgtcctcgtgcgcttcctatcccgccgccggcggtcgttcccctccgcgcccggtcggagcgactgcgacggcggaggggctgatgattctcccacccatcaaccacgcgactaccgagcgcgtgttcttcctggacaggaaacagcgcactgacttcgcaagtgaaaactctggtggtgaaactat

SEQ ID NO: 34927 - DNA, 465 bp, Triticum aestivum
  Clone ID: PAT_TA_34927
acggatgttttggttagtatttctattgcgggtgattatttcgagggaccaacaggctgtccaactatcagagaattgtgtggtccagatgatactcatactttccatgcaagaaatcttgggcatcccattattcgaagtgattccttaggcaagggttcatttgtaccaaataacattaacatgggtgggccaagaaatgccacctttattgtgcttactggtccaaatatgggtggtaaatcaactctcctgcgtcaagtttgtcttaccataatattggcacagattggagcaaatgttccggcggaaaaccttgagctttctcttgttgaccgtatctttgttcgcatgggagcaagggatcatattatggctggaaaaagtacattcttggtggagctcatggagactgcttccgtgctttcgtcagctaccaagtattctcttgtggctttagacgaa

SEQ ID NO: 34928 - DNA, 671 bp, Triticum aestivum
  unsure (1)..(671): unsure at all n locations
  Clone ID: PAT_TA_34928
gtttgagggagtgagtgctcgagctgccgccgccgccactgccgctgctgccgatgatgttgcgaggagggaggagggtgattcgtttggcctctcggcacctggggtcccatggcttcagcactgagatatttgtgagcaggctatcattttacacaacggaggaagaatttaaaaaggtcttctcgccatttggcaccattgaggaagttcggttagtgagagacaaccaaactggaaggccgaagggatttggttttgtaagatattcatcacaagaggaggcacagaaagctatcaaggcaatggatggaagggttctacgcggcagactgatttttgcagagatggcaaaggaacacggcactggatagttaataggtcagatttttatctgcacctttgctgaacaacatgtgtctttggggcaaaccgccgaaggcacttctctctttgcatcttgctatcaagaacaggaccgaatagtgacaacatgcctatccaaatatccactcagccatctgttttgttgttgttgttgctagaagcagttatgtttcatgaacatattcatttgctacaaagcggaactgtgtaagntaaatttgtttgtgttggtacttaaattcagcacgccggagtaatgtgaactaaaaaaaaaaaaaaaaaac

SEQ ID NO: 34929 - DNA, 666 bp, Triticum aestivum
  Clone ID: PAT_TA_34929
ctctcgcgccggcgactccaggctcgcggtgaagaagagcaaggccgagaaggaccccaacaagcccaagcgcccctgagtgccttcttcatcttcatcaggtgctctgctcttgcacacgtcaggcaccgtctctggcgcggtggtgcttcttgaggcgaccgacgtgatggtggctgtgtacggcggcgaccacaagctgtccggtgagtcggctccatcttctagccctagatcccacttttccgctcctatagcatgctctgttggtttagaacactcccagcagtagcctagcatctatgcgtcctaaacagcaggagtaaaatcaccttgagtaaactagaagctaggttacacaattgtaacttttgcttgttgtagctattatgttgttgaatcctgtctgtgtcttctattcatcggttaatattatttgggtgatccgtgatgtgctgagagtgtatggcggcgatgaggatctactttgtgatttaaagtcactaatctgtggtctggtgtcatattatggtctcttatgtttgcgctgtgactctttctcacttgcgaggaaagctgtgagtgtatgtctacgatgcctacttgcttggctcacattgtgatgcatgttagcttcctgccagttgacatgtttgtacgtgcatg

SEQ ID NO: 34930 - DNA, 1218 bp, Triticum aestivum
  unsure (1)..(1218): unsure at all n locations
  Clone ID: PAT_TA_34930
ggagattcttgatttgaaatccaaacttcagtccaaggaagttgaaactgagaagcttaaataccagcatctggaagtgattgaagaaaatcgagacctaatcagtcagaaccacaaattaagtgaggaagctgcttatgcaaaagaattggcatcttctgcagctgttgagcttaagaatttggctgaagaagttacaaagctatcgatacaaaatgcaaggcaggcaaaggagttattaattgcccaggagatggcacattccagggttcctgttagaaaggggcgcccagcaggtaggggcagggatgaagttgggacctggagtcttgatttagaggatatgaagatggagctactggcgcgaaaaaagagggaagctgctctagaagcagctttggcagagaaggagcttcttgaagaggagtacaagaagaagtttgatgaagcaaagaaaaaagagctttctctagaaaatgatctagcaggcatgtgggttcttgttgctaagttgaagagaggggctttcagcatatctgatttaaacgttgatgatcggtctatcaatctagctgacataactaatgatgcaaaggaaaacaaaggtgacacaaatgtagctttagttgagaaacaagtgtcagatgatactgtgaagtcattgactgcagaagaatatagaagtccagaatttgaacctcttcttgttcgtctcaaggctaaaattcaagagatgaaggagaaggaaactgaccccctgagtgataaagatggcaattcccatgtctgcaaagtatgttttgaatccgcaactgctgcagttttgcttccttgtcggcatttttgcttgtgcaagccttgcgcacttgcctgttcggaatgccctctgtgccgcacacgaatcttagacaggataattaccttcacatagatcacttgttagcctaaggaaacttttgacgcgcccaatctctccatgtaaaatcaccaaccttatatgtttctttttctgtgtagcaaagaaggttacttttatgttccttctatgttgtattgccattcgtttgatttccctatatggctttaccttggctccttgttgtattgagaagttcagcgacttctcgacaaatgtgtatagatatgtgactcaacattgtcctcaagtaaagcaaattgatgtggcaatacatattttttcttttctttcaannnaaa

SEQ ID NO: 34931 - DNA, 1018 bp, Triticum aestivum
  Clone ID: PAT_TA_34931
gccggccggttcgggaaaccaacccaacccggtccactatccagatccagattctgtatcctgaccctgctcctgcctgcgatccccaaccccaatccaaggaccagacaagagcaacagggaaatcatgagcgccatggtcgcgtcgtcgcttaacccggaggccccgctcttcatcccggcagcgttacagcaggtggaggacttctcaccgcagtggtgggacctcgtcaagtccagcgcctggtttcgcgaccactggtaccaccagcaccagcagctcgacgatatggccgactccctcatcgccttcgaggccgaggacgccatcgccgtcgaggcttcgcagccgcagccgcagccgccagcggcactcaagattgacggggtgctcaaggcactgagcctgtcgtccccaagcccaaagggcggcgacgccctgcgtggcttctcggagaagcctaggtacaccgagaagcccaccaagtacgccggcagcccgaggagcggtggcgcaccccgcttcatccaccagcctcgctaggttgggatgccaagcttaaagaatcgagcagatcctgcgccttttctgcctgcagtgatgcattgctctgccttcttctaatacaccatctgtcccaaaaataaatgtctcaaacttaatacaactttgtactagctctaatacaaagttgagacacttatttcgagacggagggagtagtaagtagtggcgtccgtttgtatattatattaagtagaaatgaaatgacctaagaaaaaggcacaaaatgcaaccgatgtttagtgtgatttgccttgtaagttatgttctgcacagtgtgttggacaagaatgtatagtagaatgcatccttgtccaaccgatgtttagtgtgatttgccttgtaagttatgttctgcacagtgtgttggacaagaatgtatagtagaatgcatccttgttattgcgtggccaagcagcttaatgttaattactccgttatttagcctttttt

SEQ ID NO: 34932 - DNA, 975 bp, Triticum aestivum
  Clone ID: PAT_TA_34932
tccacattctccatcccgaccctccgcctgcggcccccggtccactctccagatccagtattctctatcctgaccctgctcctgcgatccccaaccgaccctgctcctgcgatccccaaccccaatccaaggagcgcaccaagagcaacagggagaccatgagcgccatggtcgcgtcgtcgcttaacccggaggccccgctcttcatcccggcagcgttccaagcaggtggaggacttctcaccgcagtggtgggacctcgtcaagtccaccgcctggtttctgcgaccactggcaccaccacgcaccaagcagcgcgacaggatggccgactccctcaggggcttcgcggccggggacgcgctcgccgtcgaggctccgcagccgccagccgccgagcggcgactcaagcattgactcgctgatgccaggcgctgcagcctacgccttccctagcccaaagggtgacgcctcggcagacagcctaggcaccccggagaagccccccaaggtacgagcggcagcgcgcagcggcgctggcgccacgcgccgcatccaccgagcgtcgctagtttgggatgtcaaagcttcccgaatcgtagcaaatcctgcgcctgcagtgatgcattggtcctcggctgccgccgcatctctcatctttcaaatcttcttctaccatgttgcaaagttggggctatccctattgtatatttgattacagtaattagaaatgcagtgagctaaggaaaaggagtcaaaagtggtgtccgtctgaatattatattaagtacaagtaatgaaatgaccaaggcaacagactacaacctgaaaccgatgtttagtgtgatttgccttgtaagttatgttgtgctcagtgcgttggacaagaatgtattagtagaatgcacccttgttattgcggggccaagcagcttaattttattattgtttacccttttctaaagataaagatgc

SEQ ID NO: 34933 - DNA, 1007 bp, Triticum aestivum
  unsure (1)..(1007): unsure at all n locations
  Clone ID: PAT_TA_34933
gtcgccggcgcgcatcctctccgggcaaaggagtgatggctgagatggcggctgatggtgggcatggcggtgggaatcacccattgcgctggacatctccaatgtcttggttcatgttacgtcgctttgtacagctcactgctagtggagtgaagacggaaaagggctttaaggaggtgcacctaaaccaggtggctaagaattgtagtgagcactttggtctttccataaccgggacccaagtgtacaatcacctccgcaagtggcgtgctaggtgggtgaagataagtaagctccgagacattagtgggtcactttgggatgataacaactatgtcatattgctggaggaagagcactacatgggccatatcaaggaccatcccaaagatgttgagtacctcaatgtgcctttagagaattatgttcagatgcttgctatctttggaagtggtattgctagaggaaggtatgcaatgacatctaatgaggctcttggggttccttcaatggtgggaatctcctcatcatttgtaaaccttgaagcttgtggttctgaatttgttgttgatgggaatgaacctggtttgagtgctactgctgctgctcatggggaaactgctgctgctcctcatgggaaggaaccatgtaaggatgcgtctagctccactggcaaaaggaagagggctagcttgatgagtgaagaagaagtcttggtcatgagcaacatgtccgaagcagtccgtgaagttgctattgctatcaagtccaccggagaggcacatcctgaactttatggtgctgtcatggagctccctggtttaccgaggatgatctgttaattgtcttggactatctcaatgagaatgccaacagggctaggagccactcattcgtgcagatgtcggaaactcgtcgcacttcgttgggtcatgcaccacctctncaaggtcaacggttggagttgcccgtgcccaagggaaggactgcccnaggnaaggaatgcc

SEQ ID NO: 34934 - DNA, 1756 bp, Triticum aestivum
  Clone ID: PAT_TA_34934
cgaccatgtagggctactcgctatcatcttactgagtttggtgaacgtgtccctcaaaatgagaaggaaatattcaacctccgccactcctcatcgaggatcacgtttgagagggcgtttgcagctttcaagaaccggtggagaattgtggacaacaagcctcaccacccttatccgtcacaagtcaaaatcatcctagcttgctgcattcttcataattggatactttagtggggagaggatgagtttgtaccacttgagcacacttggactggaaatccagcatcggatggtgtgattgacatagaacatgataatagaacctggtcacaaattagagatgattgggttgggcatatgtttgccaataggggcaattcacgtgtgtagagctcaagtgtagaactcaattctatattgtaatgtattatgtataattctaccatgtagagctcaagtgtagagctcaattctatgttgtaatgcattatgaataattctgtcatgtacccaaattgaaacatttatgtcttatttgctaccttatgttgctgtttgagctccactttatttctgtttattggttctttacttcccctctcttctctattgcgaacgtatctcgccgccccctcgcctcgcgagcacatcgcctccgcgcatcctctccgcgcataggagtgatggctgagatggcggctgatggtgggcatagcggtgggaatcacccattgcgctggacatctccaatgtctgggttcatgttacgtcgctttgtagagctcatggctagtggagtgaagacggaaaagggctttaaggaggggcgccccatcccccaggctgggactcccaaggagcgctttgcccttgccaaagccgggatcccaccgggggagcactggcacatatggcgtgctacgtcgaccaagctaaccatagtctattcggctaggtaacagccccactctccggtactgatgaaacaagggcttccggacgtccgttgcttgcctcgtatgcacgaatatcccaatggggatcaggatctcaatatgcctttagagaattatgttcagatgcttgctatctttggaagtggtattgctacaggaaggtatgcaatgacatctaatgaggctcttggggttccttcaatggtgggaacctcctcatcatttgtaaaccttgaagcttgtggttctgaatttgttgttgatgggaatgaacctggcttgagtgctactgctgctgctcatggggaaactgctgctgctcctcatgggaaggaaccatgtaaggatgcgtctagctccactggcaaaaggaagagggctagcttgatgagtgaagaagaagtcttggtcatgagcaacatgtccgaagcagtccgtgaagttgctattgctatcaagtccaccggagaggcacatcctgaactttatgatgctgtcatggagctccctggttttaccgaggatgatctgttaattgtcttggactatctcagtgagaatgccaacagggctaggagccactcattcgtgcagatgtcggagactcgtcgcactcgttgggtcatgcaccacctctccaaggtcaacggtggagtgcccgtgcccaaggcaaggactgcccaaggatggaatgcccgtcaccggcgtggaagtgcccaggggtggagtgtgagcaaatatgttccaattcaacgaagctggccatattttattgttcctgctttttttgttcctgcccg

SEQ ID NO: 34935 - DNA, 829 bp, Triticum aestivum
  unsure (1)..(829): unsure at all n locations
  Clone ID: PAT_TA_34935
gcatcgcaccgcctnccgtcgcgtctcagttacaaggtcgttgctgccgtcgcccagcaccaaccgccttgccccgattagctttggatacgcggacgaccggatgtgctccagcgccgccgcctatgggcgattccccaacgacgacgagtcgtcaacgaagctcagggacgtgatatggcgctcggtgtaggtggccatggtggacctgaagaagctggctgagataagcgatgggaacgactatgttcagccactatcagactttggtggtgtaccccggctgccaaaccatgctttgccaacctactagaggaaaggcgaggctcaccaagggatgatccttccaccggaagggtaattaatttgcatgcctgattatggaaaaaagaagcccttctgaacattacttatcctcgacgaggggagaccgaccaaaagaggtaatccttgggtgctgaacttggaatgggatattggcaagctaggtgctgtggctttcttctgtcggtgccgtgtgggtttcggtgtcttttccttttggcgggctaggttgctgcgccctcggcgtcgcgtgtttgatccttgcgggggcagttccagcgtgttgcccgtggctgcttctcacgagcttgcccgcctcgcgctcctgccttcccgttctggtgctgcggtggtcctccctttgttctcattttggtcggtgaccatctgtcccaggaatattgtgaccatgtattcgattctattgaagacccaatatatgataaggtggattttcatttgctatgctgagcaaccttgaaaaaaaaaaaaaaaaaaaaaaaaa

SEQ ID NO: 34936 - DNA, 1101 bp, Triticum aestivum
  unsure (1)..(1101): unsure at all n locations
  Clone ID: PAT_TA_34936
agtggaggccatccactcgtctcgagcccaagccgtcatctatctcgccggcggcgcctcccagcctgggtccgcgccgtcgtggaggccatccactcgtctcgaccccaggccgtcatctatctcgccggcggcgcctcccaggcgctcggttggctcctgtccgtgcccggcgcttctggcagcgtcctcgaggtcgtcgtgccctactccagggcctccatggcgcagctgctcggcaagttgcccctgcaattcacaagcaagcaggccgcagaggacatggcactggccgcgttcaaccgtgccctgaagctttctggaccaggtctacaagtaatgggtgttggatttactgggtcactcgctagctcacgcccaaaacatggtgaccacaggttttatgtgtcaacgcgcacacaaaattgcctcaggacatcacatgtaacattgtcgaagggtttacggagcagagaggaagaagacaaggtctcaagctgttttgtgcttaaggcaattgcagatgcatgcagagtttctgcaaccattcagtcagacgttcaagaacctgaaattccaaaagaaagtgtggaacaatttgatgaagaccaagagctccagcaagttattgatggtcaagtctgcatgaaagtttaccactttgctgatccaacggaaaagaacttcgacaggaaactaattctacctggttcattcaatcccttgcatgatggccaccttaggttgttagaagttgcatcaagcatgtgtgatgatgggtttccgtgctttgagatatcagcaataaatgccgacaaaccccccctgtctattgcagaaattaagcaccgtgttgagcaattcagaaaagcaggtatgcatatgactaactgctgtagtgcaaagtactacagtcatacttggattttctttcgaactatttatcacgcggcctgctattttgctatattcctagtgctcttatttgattactatgaatctaatgaatgtgctttagttttgagtttacagagatatataattntgcattcactcatatgtagtcatctttgctgatatatcgtttaacagtgattctgg

SEQ ID NO: 34937 - DNA, 754 bp, Triticum aestivum
  Clone ID: PAT_TA_34937
cttcgcgtccgcccacgcgtccggtgcaatacaacaacccccgagaggcctcgtcgcaccagcagctcttcccccattccgcgtgggggctagggtttccttcgcgctctccccgcctcgcccctcgccgtcgccggccaggggctcccgatcgggccggcgccggggcctcctcgcgggggagggcgggctcctgccggctcgccctcgcgggatgcggccggtcccgagagcaatggggaatggagccaaggctgctgatgatgttagggaagggcaactcaagctcatggaccaatgtcttgccgccacaagcccggcagttgtacatactgctcttctttggggcttggcaaacctaacctgaggctcctcaggccaagacccagcgcagcgactcctcgtaagaggaggcattcgtctgcacgtgcccatcaacaactcctgcaactattctccactaaacaccgatgacctcgtccgggcactaacctgtcctggatgagctatggtgatacctacctaccgaagtactattatagccatcactaatctttcttccttagtttccctccgtcttcactgcggttattaccactaatattatgtaaggtttattttggtttgctgtgaaccaatttggaaattggtggatcatcgtggtagtaccatttcatattgttggattctagatgtctgtactgacttctggtgaacgaatgaatgaatgaccagttatatgaaaaaaaaaaaa

SEQ ID NO: 34938 - DNA, 2597 bp, Triticum aestivum
  Clone ID: PAT_TA_34938
cgtccacgtgccattcgtcatctggcttcgcccttggcgcaggacctgagggagatgcaggagaggatggcaagtcgccagctatatgaagcttcagggagggcttacacgctctctggactgagttcgcattcctgccagcgagcgacgacgcgcggagactcgaccgggagcagcaccattgttcacgcttatcagaccccatccgtggttcagatgttacagcattctcagagccatatcccttcgcctccgggccagcagccacaagcccggccacccaggccgtcggcaaggtagttgaaccgtttctgtcgttggcagtcaaatgtgcctgacgatggcgaaaggatgtcgccttagctttcatagttgtttccttgattgttggcacatagtacctgttgatccttctgcttatttgtttagttgagacgctcgtggtgggtttaataccgaagagattgagcttggtaatgaataccgcctacactcggggactcctctgcgagctgctaccttgttcactcctgccagatgccatgcatgttacacatgttacaacattcgaagagcctcatccctgtccgtccggcccagcagccacaagcccgaccacccaggccgtcggcaaggtagttgaaccgtttcgtcttggcagccaatggcgcccacgtgccccaacgaggtccccttgtcgctcttcgccgcctccttccttgccggccgcggggcctgcggcgccttctgccttttggtttagttgagactgtcgtggtgggtttataccgaagggattgagcctgggtaacgactaccgggtacattctgggatatcagtatgtcttaccctgttctgtcagggctaatatttggcagatgccatcgcatgctggcctttctcttctggcccgtcggaaagctcccagtgctagctcagaccaggccacaggcagattggtcaatgaaagctcagttagatccccaagcggacgtgctcctgttgatcttgtcacagtgattgatattagtggcagtatggcaggcaccaagctggcactgctaaagcgggcacggggctttgtgattcaacaccttggtccatctgatcgcctttctgtaattgctttctcatcttctgcccgaaggctgttccaccttcagcgcatgtcgcattatggcaggcagcaggccttgcaggctattaactcgcttggtgctggtggtggcacaaacattgctgatgcacttaagaaagctacgaaggtgattgaggatcgcagccataagaattctgtgtgcagcatcattcttctctctgacgggcaagatacctacaaccttagctcaaatgttcgagggggcccgaaagattatagcacacttgtcccgcagtctattctggatgatacacggcgtatgctgcctattcatgcttttggatttggagcagaccatgattcagactccctgcattcagttgctgaagcttctggtggcacattttcctttatcgaagatgaaggcgtgttccgcgcggcgtttgctcagtgcattggtgggcttcttagtgttgtcgtacaggagatgcgactcaacatggaatgtgttcatcctggtgttcaactctgttccatcaaatctggtagctacccaagcatgatggcaagggatgggcggagctgttcagttgatattggtcatctgtatgctgatgaggagagggacattttgctgtcggcgaacatcccacagtgtcgcgaacagacctcactgttaaaggttgcttgttcttacagggatctaactaatgagaccatcaagcttcaagtagatgaggtgaagatcaacaggccgacatccgccatatctgaacatgtatccattgaggttgaccgtgagaggaaccgcatacaggccgctgattctatcgaatctgcgagggctgctgctgagaggggtgctcttgccgaggctgtgacaattctggaggactgcaggaggagactatcagagtcttttgcaagcaggagcggggaccgtctttccttggcccttgacgcagagctgagggagatgcaggagaggatggcgagtcgccagctctatgaagcttcagggagggcatacatgctatctggactgagctcgcactcctggcagcgagcgacgacacgcggggactcgacagagagcagcaccattgttcactcctatcagacgccatccatggttcagatgttacagcattcccagagccacatcccttcgccgccgggccagcagccacaagcccggccacccaggccgtcggcgaggtagttgaaccgtttcgtcttggcagccaaatgcgctgacgatggcgaaggatgtcgccttagctttcatagttgtttccttgattgctggacgtagtacctgttgattcttctgcttatttgtttagttgagactgtcgtggtgggtttataccgaagggattgagctgggtaatgaatgccgggtacattctgggatatcagtatgtattaccttgttctgtcaggaataatatttgggaaatgaggctggaattgtaaaaaaaaaaaaaaaaaaaa

SEQ ID NO: 34939 - DNA, 1151 bp, Triticum aestivum
  unsure (1)..(1151): unsure at all n locations
  Clone ID: PAT_TA_34939
ggccgtgggccccgccgtcccgggcgcgtggtgccgggggtgctcgcccccctcgcggaccgcgcggcaatgcacagagagattgcggcgctccgggcggagagagcacagttggtcatggcaagggagatggctcgtcgactctgctgggaagtggtctctgagaggaaaagcattgttaaaaaggctgttgtcccggcgaagagattctcggctttaggaatttgcaagtggttgctctccgtaatcttctgggagaagaagctctactaccaggtatacgttcggcttgtcagaccacgttccttgggcctcctgctgctcctcggacagatccaccacgtttgactccatggcggcgcctgcataggccacagcaatgaccacgcccgccgctgccccggggcctatctcctgtgggtgcaggccctcggaggcagacagatgcggcaatgcatagagagattgcggcgctgcggggcggagagagcacagttggtcatggcgagggagatggctcgtcgactctgctgggaagtggtctctgagaggaaaagcattgttaagaaggctgttgtcccggcgaagagattctcggcattaggaatttgcaagtggttgctctccgtaatcttttggagaagaagctctactaccaggtatacgttcggcttgtcaactacgttccttggcctcctgctgctcctcgacagatccaccacgttgagtccatggcggcgcctgcataggccacagcaatgaccacggcctccgccatcccatagccaaacacatgtaaatgcagaacttcagacgattggttaccactctgttttgcgcgtgcattgcattctttgatgatgtgtttcttttcgttttggctgagtacagcgcagtattggcgatgtaagttttggctttcaagcttcgagcttgctgtatagtgtgttattgagactactaggcttgcatagcttgtaatctggagctaactgacgtgcggtgagttgtggaacccctgatggggcgggccggctcctctcgccccaaatgatcgtataccccgccacgggcgtcgtttacacgtctgacgggaaaacctgcgtaccaactaacgcctgcaganaccccttcgcactgggtaatacaan

SEQ ID NO: 34940 - DNA, 1747 bp, Triticum aestivum
  Clone ID: PAT_TA_34940
ccgcgtgcccgcaagtgtcgacgatgctccggtgggaacagaacaacatcatctttctcataaacaacgggggttcccccgttcaggtggagacccccgtcggccctgccctcatcgtcagcaagcgggacttcccccgcctgctgctgccaccccccatcggccccgcctcctgcctttcgcccccggcccgtcccgtgctggctctccccaaggctgtcgagccagccctacgtcccagcagcggcggcctctgctgcggcgtggttgttctgctcaggcatgccgctacttgtgggcggcccgaggggggggctggcctttccgccccgggccgccgcccacctggcccccgcatgcggttatccggttgcagtgatgccttctgcaaagggacttgtgcctgagcaccattctagatttattggcacatcctggggtgcatcatccatttgagtccactgccgttgcaagggctcacggttactgtacatagatggtctcagttcaggaacctgtgcttgtatattacttcaatcgctccgtgccaggaaggagaaggccatcattgtccagccggaccgagtcgtgattgggaatgggcctgcatttgggtgtgttctgatgaaggacttcctgcatgcacttgcaacccggctgaagaagaacacagctgcctacgacaactacagtcggatttttgtgcctcagggcgaacccctttcctctgagcctggagagcctttgagagtgaatatactttttaagcatattcagaaaatgttgtctggcagctcagctgttatagcagagactggggactcatggtttaactgtcagaagctgaaactaccagaaggcctgtgggtatgaatttcagatgcaatatggatcaattggttggtctgtgggtgcaactctgggatatgcgcaggctgctaaggataagcgagtcatttccttcattggagatggcagctttcaggtgacggcacaagaagtgtcgacgatgctccggtgggaacagaacaacatcatctttctcataaacaacgggggttacaccattgaggtggagatccatgacggcccttacaacatcatcaagaactggaactacaccggcgtggtggaagcattccataatggcgagggcaagtgctatacggccaaggtccgaacagaggaggaactgaagaaggcaattgaggcatccctaggacccaacaaggacagcctgtgctttatagaggtaattgtgcacaaggatgacactagtaaagagcttcttgagtggggttctagggtttctgccgcgaatagccggccaccaaatccccagtgaacgcaccaggtcaccaaagatcctcatccagcttaatgatgtcatgtggaagttctgaatagatgttactgatctttaaataaatcatccatttgagtccactgctgttgcaagggctcatggttgctgtacatagatggtcttagttcaggaacctgtgcttgtatattacttcaataaatctgaaatcgatgtcatagccagctaaagacgcccttgattttggcatctttcttgattttgacaacagtttcaggcttgttgtgtttctgaaaagcatttgtaagacaaaacaagttgcgtttctagaatgcgaataagattcaattatgtggtgaaaaaaaaaaaaaaaaaactcgagactagacctcggccgcgaccacgctaatcactagtgaattc

SEQ ID NO: 34941 - DNA, 1178 bp, Triticum aestivum
  Clone ID: PAT_TA_34941
gggcacctcgttgagatgggtgacgtgtagtgctcgccactgcggtagaccgagtccgtcgggttcgcgcttgtgagcacattcctgttggagaagccgaccgtcccacagttgatgccgtaattgctgaatgtggggaacttcctgaaggtgcagatgatggagttgtgaactttttcaaggatggtgacatgtatcctgactggccaaatgatctcgatgagaagcctacagaggtttcatggtggatggaagctgtggagtctgctaaggcttttgggaatgataatttcaagaaacaggattataagacggccctgaggaagtacaggaaagctctgcgctacttggatgtttgctgggagaaagaagagatagatgaagagaagagctcagcactgcggaagaccaagtccataatactcacgaatagctctgcatgcaaaatgaagctgggagatttgaagggtgctttgttggatgcagattttgcgctgcgtgaaacagagggcaatgctaaggcttttttccgacaaggacaggcacacatagcacttaatgacattgatgcagcggtggagagcttccagcatgcattggacttggagccgaacgatggagcaattaaacgcgagctggctgctgcaaagaagaagatctccaacaggagagataaggagcgcaaggcatacgccaggatgttccaaccttaaggaaaatcggaggagacggcgaagagaaggattgaatcatagttttctccccccggcggaacttttggtagcttattctgggatacatactcgaactttccgcggaaaaggtcgtcgtcctagttaatatgccgtaaaacagaaccttgtgctcttcttctgcggcttagttttgctgatgcacaccgaaggatgcttatgtgttgggaaaaaaatattagaggattatttgtgttgctcgtatgacaaggggagaccgtctcccattattttgaaaaatacaggagaaaaaaaaagaggtagtcaatggtgccctgagaaaaacctgagacactggaactgagcagagcattgcttcagatgtttgctgcagcaaggcatgcatgccagaacttttcctcttgtttggtcccattgtggtcaagcctgaccgttgctacttttcaaaaaaaaaaaaaaaaaaaa

SEQ ID NO: 34942 - DNA, 1755 bp, Triticum aestivum
  Clone ID: PAT_TA_34942
tctttgtcagcgggctcctggcctctacacaccacgcgttgcaaatatgctaaacttcaaagataacattataaacaatgagggaatgcttcgtactgtacttgatgtgggctgcggagttgctagttttggaggatatcttctttcatcgaatgtcatagcgatgtctttggcaccaaacgatgtacatcagaaccagatccaatttgctcttgaaagggggatccctgcttatcttggtgttttgggaacaaaaaggcttccataccccagtagatcgtttgaattagcccactgttctcgttgcaggattgattggcttcagagagatggaattcttatgcttgaactggacagattactcaggcctggaggttattttgcttattcatctcctgaggcatacgcacaggatgaggaggatcgtagaatctggaaagaaatgagttcccttgcagaaagcgatgtgctggaaaattgcagagaaaaaaaaccagacagctagtttgggtcaagcctctgaacaatgattgctacaggagccggctcgcgtggtacaaatccaccttgttgtatccacagataatgatatagattcagtatggggtagtgacaatggaggcttgcattactccctatccagaacaagtgctccgggttggggcttcccggcctggctccttggcctgctcgattaacaaccccacctcctcgtcttgcagatttgtatgttacagctgacacatttgaaaaagatacggaaatgtggcagcaaagagtagataattattggaatttattgcgcccaaaggtaaaaccagagagtattagaaacatcatggacatgaaagcaaactttggatcatttgctgctgctctcaaggaaaaggatgtatgggtgatgaatgctgtgtcccatgatggaccaaacactcttaagataatctatgacagagggctcataggctctacacacgactggtgtgaggcattctctacttatcctcgaacatatgatcttctacatgcgtggacagtcttcaccgaccttgagaaaagaggttgcagtgctgaagatctgctccttgaaatggatcgtatactcaggccaactggttttatcatcgtgagagacaaggcccctatcattgtattcatcaagaagtatctcaatgcacttcactgggaggcagtaaccgttgtggatggtgagtccagtccggaatctgaggagaatgaaatgatactcataatccggaagaaattgtggctaccagaagcaggttcacaggactcgacgtaatcctttggtccgagtttctttggcatcgtcagcatctgcagctcaggagccaagaagcgaaggctcagttgctccctccaaattcgtgattcagtattgctgctccaggagtagaattcccagtcctactatccacgtgaagatagaatgtttctcaggatatggcaagtatccggaaggctgagctcaagccctctctccttttgttgtctccacagatactgtaatcgtaagttaatgtttgttctctagcctggttaggaaataaacctttttcttgttgagcttcagttaggtgcttcccgtccatttgttgaagcggcgttagtaaacagatttggtgcttattgtaagaagattcaactgtaaacatattttggggaaatgaggtttgccggcgggtggctcgcctcaagcctcctacgaaggtgtgcccgtcgaatgtggtgaaa

SEQ ID NO: 34943 - DNA, 425 bp, Triticum aestivum
  Clone ID: PAT_TA_34943
gagccagagaggcgagaaatggcggcagcagcacggaagcgtgctcaaaggttttcagagcagaagtttcatgaagatttcactaaagcggttcgcccagttttattaggacgctcatagccttttgctctaatagccaaaaacattaacaagttcagcatgatggagattctgaggtttgagtgcatctgcaaagttctagcttgagcttttccagattatcagtgttagttttgtgtatcacacacactgttgtatagagaagagcaaaagaatgatatgataaactcttgactgtttctttggcactatactagtactgtatattttgaccacaatatctgaacttgaggaattcaactccatgcatgaacagatttctaaagttatccacatgagaaaattaagtgtggaaagattcttgt

SEQ ID NO: 34944 - DNA, 400 bp, Triticum aestivum
  Clone ID: PAT_TA_34944
ggacacttgctgaaaatggcgaagtgtcccttcataatgaacatcaaccaatggaaggctatcagatgggacacttgctgaaaatggcgaagtttttgacaccacacatgaagacaattctattttttcatttgaagttggccagggagctgtcattaaagcatgggatatagccttaagaactatgaaagttggcgagattgcaaaaataacatgcaggccggaatatgcgtatggaagtccaggctcgccgccagagataccagcgaatgcaacactcatttttgaggtggaattactggcttgcaagccaaggaaaggttcaagtctgggcagtgtatctgatgagaaagccaggctagaggagcttaagaaacagcgggagctgtctgccgccacc

SEQ ID NO: 34945 - DNA, 809 bp, Triticum aestivum
  Clone ID: PAT_TA_34945
gttctttgaaggaccttgctgaaaaggcgaagtttttgacaccacacatgaagacaattctattttttcatttgaagttggccagggagctgtcattaaagcatgggatatagccttaagaactatgaaagttggcgagattgcaaaaataacatgcaggccggaatatgcgtatggaagtccaggctcgccgccagagataccagcgaatgcaacactcatttttgaggtggaattagttgcttgcaagccaaggaaaggttcaagtctgggcagtgtatctgatgagaaagccaggctagagtaagacatctccaagtgtttcctcttttatatttaacgcatcaagtacccaataatcagatggtggtcgacaaaatcctcactgaagctgatctgtggaggttggcacttggcagggagctaaggagttgagaactctgcctctgaatgctcgtccaccccataacatctctagacaaccatagcttttttaatcctccatttttaagagtttttgcccttttttttctgtttctatggggttagtggagcttttgctgtgtttttggtcagtagtacagttaagccagttttggcatttttttctaatacagaagttagtacccaataatcatgttaaacagcataggacatcatattggaattacataatatagcatatagcctagctaatattcttgtttacgcgatttcttgagaacacttgggagttacgtgtcatgtctattatccattttggtaataccttgtgattgttagaaagtacatgatttttgatacataaa

SEQ ID NO: 34946 - DNA, 1085 bp, Triticum aestivum
  Clone ID: PAT_TA_34946
ctcctgccgaattcgccacgcgtatcctccccgctacctcccctctgcacgcccctccccttctctcggtgaagggcttctccgcccactccgaatccctccgtcctctctctctgaaggtcctcaccgacgtgcccgccgccacggccctccctccaaatcgtcgccgacccgagaatctccgttcaacagcaaggtcatggcagaaaccatagatctaacaggggatggaggcgttcttaagacggtggtcagaaaagcaaaggatgatgctataagcccatctgatagccttccattggttgatgttcattatgaagggacacttgctgaaaatggcgaagtttttgacaccacacatgaagacaattctattttttcatttgaagttggccagggagctgtcattaaagcatgggatatagccttaagaactatgaaagttggcgagattgcaaaaataacatgcaggccggaatatgcgtatggaagtccaggctcgccgccagagataccagcgaatgcaacactcatttttgaggtggaattactggcttgcaagccaaggaaaggttcaagtctgggcagtgtatctgatgagaaagccaggctagaggagcttaagaaacagcgggagctgtctgccgccaccaaagaggaagagaagaagaagagggaggaggcaaaggccgcggcagcggctcgtgtgcaagccaaacttgacgccaagaagggcaagggaaaaggaaagggcaaatagattactcccaactgatgtattagtcgttgcatttgctgctgagtgctactgttgtaacctactccctccgtctcatcaaaaaacattttacattatgggatgtagtagtagaaaataatctgcacaaagcatagattgcctgttgccttgttggctactgtgcttcgggggagatggcgtgtgttgcccagcaccagccttactgaaaacattaaataatcacagcatcttctcttggtttttctgcgcagtcaatgacatttccatgtctgataatgtaattgcagatgtggccaaaaaaaaaaaaataaaaaaaaaaaaaaaa

SEQ ID NO: 34947 - DNA, 878 bp, Triticum aestivum
  unsure (1)..(878): unsure at all n locations
  Clone ID: PAT_TA_34947
gcttcgttgtcttcaacgccgacaccgccttctatggacctcctgcgaggccatggcggcggccgtaccggccatcgtcgcctccctcgactaccgcctcgcgcccgagcaccgcctgcccgccgcctatgacgacgccgtcgcggccgtgatgtggctccgtgacgtggcaccccaggacccctggatcgccgcgcatggcgacatcgcccggtgcttcgtcatgggcagcagctccggcgggaacatggcgttcaacgccggcgtccggaccaagggcatcgatctgagccccgctgcggtgcgcgggctcctgctgcaccagccatacctcggcggcgtcgagcggacgccgtccgaggagaggtcggaggacgacttcatggtgccgctggaggccaacgacaagctctggagcctcgcactgccgctgggcgcggaccgcgaccacgagttcagcaatccggaaaaggcggtggcacaggaagccgtggtcggcctgccgcggtgcctggtgtccgggagcgacggcgacccgctgatcgacaggcagagagggttcgccacgtggctgcgggacagtggcgtggaggtcgtcgccaagacggacggctcccgggttccacgctgcggagctcttcgtgccaagagaaggccgaggagatgttcgcgctggttccccgatttcctatccccggcctgcgctgccgcggtgcgtgtccccgatcggtgggcgcctccgtcttgcccgtgctgtgtgggtaggcttctcccccgtcgtgcggctgcgtcttgtgatcaaataatccgccactgttcncaanttgggcggtcgtttaaatnttaaaanctcactagaaaaannnaaaaaaaaaaaa

SEQ ID NO: 34948 - DNA, 1142 bp, Triticum aestivum
  unsure (1)..(1142): unsure at all n locations
  Clone ID: PAT_TA_34948
tccacccacgcccccgcaggtacccaaccctagatcggcaagaaacgcaggcagcagacaaggcgatggcggcggcgattcgacacgcggccagaaggctcagcggcggcaaggcggtttacaagcccgccgtctcgccgctggtcgaggttgagtgtcgccggctgatgccaaggctcatctacggtggccgtcagcctatcccttttcgtttccggcctttgtctgcctccgccggcggcgctgatgttggcaacagcaccctgcatcaaccaactgcaaaacctgcgcttgacctcgacgccaagagagcatggggccttcggcagataactggagtcccgaccaacaagcacgacctccttctaccaactcgctgagcttgatactagattcccctcgcgtaataagtacttccgagacaatagggagcttatccatcatcttttcagacacattgagcctaatcccagtgatgccctctggcgcttctgtcgttggcgagaaagattcaataattgcctggntatttggactgcctacaatgcttgccacttggatgtatctggattgggatggatggaaagagatgtttgctgatatccttggagttagtagcttgttatcttatctagcccaatgtttgaagcctatatagtgtctgttatcagagtaaatttcttatcggtacactttttattggctgaatgtgaaggaactgcacttcttgtagcctgacttgtttcaacagggtgcatttctcttaaagaaaagttcagtttatagacctttggccaataaaaggtgttctcctttaagaaattcaccccaatgtagagtgtaaaactactactcccgctgatccaaattaattggcgcagacttagtacaactttgtactccctccgtaaagaaatataagagctttagtgctcttatatttttttacggagggagtactaaagttgtaccaaatgtgcgtcaattaatttggatcggagggagtagtagaagtgtggactgctgcttgccttacaagcgagtgatttgtcgtcctcgttaccttaaagaagcgacatgttatctggatgttgtaatccgaatctgttctcattatatggtgctatcctttatgtgcagtg

SEQ ID NO: 34949 - DNA, 438 bp, Triticum aestivum
  Clone ID: PAT_TA_34949
gggtcgacagtcggggtggcactcgggtgcatgctcgccttgacagtcatcaaggtcgcaatagagtcggtggaggctgtgctcggcgacgctgagagagagtctatcaagcataagtccatgctgttgtggctgaagcgacttatggatgccgacatgcttgaagattttgaagatgaaaccgacctcaacctggtatggattctgtcgatttggtcactatcaatgttgatatgaatgattttgtttaataacatattaatatttttagataatgaactacatctaaaacttttttttatgtagtgaagtagatctgaacctcgctgttggagttgatctttgagtcgatgttaagtaaaagttacatctacttgttgatgccaagaccgccatttcgttcctaaatgtccctgccttcttatgtttcaccaatag

SEQ ID NO: 34950 - DNA, 837 bp, Triticum aestivum
  Clone ID: PAT_TA_34950
cccacgcgtccgaagaggaagaacatcctgcgccggttcggccgtggcgtcatggaggagacggagagaaagggcaccggtggccccgtgaaggtccaggaggtcgccgcctcatcgtgcagcgcatgatggtggaccgatgggcgtcgaagaggcacttgaccttgccggatcacgctgttgctggcgtaatccaggccggatatgtggagagcccggcgcagcaccgtctacagattgataagggccggagcttcaatgacgaatctactattcagcacacagcccaactcgacagtcactagccatgtcaacagtcgaggtggcactcgggggcatgctcgcctcggcagtcatcaaggtggcgagatcaattctaccatttcaggcaagatcaagctgcataggaaactgaggaacaatccgatctagagaacatgaagatgacgctagagtcggtggacgttgtgctccacgacgctgagagggagtctatcaagcataagtccatgcttctgtggctgaagcaacttaaggatgccgcgaacgacatctctcacatgcttgaagattttgaagatgaaactgacctcaacctggtatgcaagattctgatttggtcactatcaatcttgatctgaatgttgttgtttaataacatttgaatatttttagatagtgaactacatctaaaacttttttatgtactgaagtagatctaaacctcactatgggagttgatctttgagtcgatgtaaagtaaaagctacttatacttgttgatgccaagaccaccttttcattcgtaaataatgtccatgttttcttatgtttcac

SEQ ID NO: 34951 - DNA, 457 bp, Triticum aestivum
  Clone ID: PAT_TA_34951
tagccgtccgagattctagggtcgacatgtctatatcagtataaaaatggtacatggtgttcctgatgctattctttcttattttctgaaggagaggctggcatttgacaatacggttctgtgtgtgaattgactactggtactgcagcctgaaatttttcttgtggagcggaccgaagtaatccatcaagctagctgcattattttggcaggacatgtccgaagaagacatatatgcatgtgggtacatggatatcggcgagagggacttgggcgaatatgggtcatcgcccaaaaggaagaaacttgcagataacaatccaaagaaggcattggatttcggcagtagtgacgagcctcttcagtaggcttttggtttttctacaatttcaagctttagagctgaactattgtcccaagtagtatttacattattttcgaaccaacaatcacttca

SEQ ID NO: 34952 - DNA, 1837 bp, Triticum aestivum
  Clone ID: PAT_TA_34952
gttgtctttgtgtcgctgcctcccccctgccttcgccgccgcctacatctcgccgctactctggtcgtcggcgcggcggctccggagggggaattgcctcgagcacgacgaacgcactggcggccaccagccggaacttcaagcaggcggccaagctgctgggcctcgactccaagctcgagaagagcctggtgatccaggtgggggggagaatggttgaaggcaccagcccgatagctgataggagagggggcagctatgttgggtttagggtgcagcacactactgcctggggtcgctaataacgctgtaatcagataccccgctgaggttgggcctggccagggctgaggccgggcacaacggactgcatgtgatactggccgtggacgatattgcggatggaggcgctaagggtgccaacggatgcagtcaaggagatgggaacgttgggctgctcgagcgatgtacccgagtttgcacacaactaaattgggactcaaatggccaacctaccgatgttccagctcccgatatgggcagcaaaggacatacaatggaatggagactggatgagtactcaaagttccatcgctacgcgcctgatgtggtgaccggtgagcctgtggacattggtgggaaactgggaagagactgaagtgttagtaatggggactactgatggccacttaaaccctacttgcagagccaggcaaaggcattgtatgccagtgttttgtaatcctaaggtattttctaatgttgcttcctgggctgctcaactgatcactgaagctggcggcaaggtgatcgccatcagcggtgtcacaaggtgtcgtctagaactccaatggcattgacatagccaagctgatgaagcactcggcggagaaacgcgggatcaagggctttgacggaggagacgccgtcgacccaacctcgctgctcacggaagagtgcgacgtcctcactcccggcagcactgggaggagtcataaacaagggacaatgctgctggacacaaagcaaagtccaaaaacaatcggtcgagcctctgctcggacacgctgagagagagtctatcgggcataagtccgtggtgctgtggctgcagcgccttctggatgacgccgggcttgtgacggtgagctacttcgagtgggtgcagaacatccaggggttgatgtgggacgatgagaaggtaaaccgggagctaacgacgcacatgagcagagcattccgggacaccaaggagatgtgccgctcccaccactgcgacctccgcatgggcgccttcaccgtgggggccaaccgcgtcgcccgcgccactgtcctccgcggctgggaggcctgatcgctccgccgcccggtcatcctgctatgcccgtgctctctctgccgattcgattgggaacgcagtactaattcttaacacaaaacttacgtgtaataatctgcacccgttgcgttctctcatacataatctccgatcgcgatgcgaaagactgtcttgagctttagccactccactttcttcttgtttagctggggtctgaaaagtgtttagaaaactttgtcatttgattcctttttgtggaacaatgatatttacatcattggtcatgtgttctatatgctatgatttgtcttccttaattaaaatacctcagccataatcatcatccacttaaaccagaactgtatacttaaaaaaagagccaatgaaaagtcaagcatttagatggaaataagcatacaaataaaatgcaaaaacatcagaacataagtgtagcctttaattcaaagaacatgctatgaagatcaatcatttggaact

SEQ ID NO: 34953 - DNA, 1326 bp, Triticum aestivum
  Clone ID: PAT_TA_34953
gggtagcttcatcggccttggcggcgacggtgacggcgacggcggggaattgggattcatggcgtgcgtaggggaggaggagttgagttgggaggacctcttctttaacaaggcggcgatgctggccgcggcgcaggaggaggaggaggcggagaaggagaaggcgcgggaggcagagcggaacgagccctagtgcccagacagcccgcggcgacgcctagcgcaccagcaggtcaaggcatccatcctggagcacgaccccaagacgaagcgcaaggtctacacccgctactccttcaacgacttctcggtcttcgacatcaacgccgagtcgcctatccctccaatgcgatacaccaagaggtgtgtaaatggtttggaactccaagacactgcaaacatacttactgtcaagatagtctcctcggataaaggcttcccaatcgatgtgtatggcactatcatcgctagagacagcattgaccacaagtgcatgtacctctttaaccgcaccagggacaattgccaacctatcaagtcaagggatgaaaatttgatcttaactggcccaggtcgaggtctggtattacttgatttcatatatctggagatagatcttaaaatcaaggttggcgaggagcctctaggcgagcaaatcagcaagggtttgcttatgattgatggacgagttctgcctagagacgaaaaggttgctgttgcacatcaaactcttgagagctggtttagtattgtggacgtgaggtatgcaactcttcttaatgctgttgagggtacgttcgagatcaagttacttgagggacgattctgtggaaagatcatggctggcatcgagggcattcaacctaggattgtgatttataatagcaaggaagacggtgtggtgtcttgtgaaggacgtacagatatcacactccggcggcgagtcatgaccctccgtctgaatggtatgctcacagttggctttgcagtctgtggtggtggtggtgctgctactagaaaacagaaagttgaattcacaccacagcaccgtggtgaagagaaaaaggagatttgcttcaagtgaaggtcttctggtccttgatggactataggccgtaatcctgtagcaacatgacaagctaagttgtggtgttatcatgcttcaaatgatgtaatgaatcaagtaatgattgtagtgaactaagttatatatttatattgtcatggagtggcatatcggcaacatttgatggaagcagttatgttggaagtgtattatgcagaaatttggacgtttctgttttctgttatctactagatttcagt

SEQ ID NO: 34954 - DNA, 445 bp, Triticum aestivum
  Clone ID: PAT_TA_34954
ggtcgacagtgcaaccggaaggccgctggagccccgcaagaacgccaccaagtttgtcaaccaatgcggggccattgttagagacaacgtctcgatcgccgtccaggagtggaatgagccaaagaaggcacgaattgctggtttcacttttgtcgataagagaacaaaaaaagattgcttcaagaagcttatggaacatttcgttctacctccggaatacaacaaattcgatgaggagggtaacaagattgaggaaaacaaggagaggaggaggctagtcaaacagttcgctcttcataagatggccgacgcattccggaaattcaagcaaaatctagcccatgactttgtcaagcagaacaagactccggatttcaaaggacaatatgagaaactgaaacatgattggccacaatttgtgaagcaaaagaaatcggagcagttc

SEQ ID NO: 34955 - DNA, 711 bp, Triticum aestivum
  Clone ID: PAT_TA_34955
acctcaccaatcaccacccgtccagaggagaacgagagccatcaacgacacggcaagatgcagatcttcgtgaagacgctgaccgggaagaccatcacgctcgaggtggagtcctcggacaccatcgacaacgtcaaggctaagatccaggacaaggaaggtatcccgccggaccagcagcgcctcatctttgcagggaagcagctagaggatggccgcactctggccgactacaacatccagaaggagtcgacgcttcacctggtgctgcgcctccgcggcggcagcagaggtggataccccaagaaccttgagcccaacctccgcatccttgctcaaaagtacaatgagaacaaactagtctgccgcaggtgctatgcacgactacccgccagggccaccaactgccgtaagaagaagtgtggccataacaatcagctaagggaaaagaagaggtttatgtccaagtttgccaacgcttcctaaacgttggaaatatgctgaatcaaccgtctagcgtcatatatattggagtttaagttctgtcccttgtttgaagtcatgttggattttgctgaatcgtctagcgtcgtcatatatagtggattctaagatttgtccagttgatagtcctgttggattttgaatatgtatgctttgggataaattatctatcaaatatcctgatttatactgagttgtttatttaac

SEQ ID NO: 34956 - DNA, 751 bp, Triticum aestivum
  Clone ID: PAT_TA_34956
gtgcggcgctgccggcccggccgggaccacaccaagcacacccggcgagaggagagcgagagccatcgacgagacggcaagatgcagatcttcgtgaagacgctgaccgggaagaccatcacgctggaggtggagtcctcggacaccatcgacaacgtcaaggccaagatccaggacaaggaaggtatcccgccggaccagcagcgcctcatcttcgcggggaagcagctggaggatggccgcactctggccgactacaacatccaaaaggagtcgacgcttcacctggtgctgcgcctccgcggcggcagcagaggtcaataccccaagaacctcgagcccaacctccgcatccttgctcaaaagtacaatgagaacaaactagtctgccgcaggtgctatgcacgcctacccctcagggccaccaactgccgcaagaagaagtgtggccataacaatcagataagggaaaagaagaggtttatgtccaagtttgggagcgattcttgaacattggaaatgatgctgaagcaaccatctaccgtcatatatattggagttttaagttctgtcctagttttaagttatgttagattttgctaaatcgtctagcgccatatatatatatatattggagtctagttttgtccagtccggattttgaacctatgtatatgctatcaaatatccatattatatggagttatttattttgagagtttttacgcaaaaaaccaaaaaaaagggccta

SEQ ID NO: 34957 - DNA, 1179 bp, Triticum aestivum
  Clone ID: PAT_TA_34957
gaaaggtaaggggctgaatcaggacatatattttactttcacgtttgcactaccaatttgattcctactgtctactgatatgccattttatagattattattaaaaatcttcagtagtacgagtaagttgtcacaagagtagcaaaggaaataatttattatgttgatagcatattagcatttacttttttgccgcccttgcatgaatgacagccgtcacttttggtcagtgagtagcattgcagggctatatatataatcagacagttaatgagtgtatcagtcatcttgtagcggcagctgtctcgatcttgaactgatgttgttgtcatctgtctacctccttccttggagtggaagccggtgatgggaatgctggccttcgacctcatctctgctgtgatgacggcgctggtgaagaaggctctggagcaagggctgaaccgcctggtcctcgtcaccctccggcctggtcgctaacatcttccttgctccaatagcctttttcaaagaacggagcacgaggcccaagctcacattggaggtcctagcgtacctcttcttcagcgccgtgtttggcgcgacgctctcacagtacaccttcttctatggcttgcagtacaccacttccaccttcgccataaccttcatcaacctctctcctgtgctcaccttcctcatcgccgtcgtgatgaggatggaaccgctgaagttgaagagcatggtgggagccgcaaagatcaccggaacgctcacgtcgctggccggcttgctgctgctgagtctctacaagggtgtgccactgacgcaccaggctgccactgcacctagcccagctgctcaccatgcagcaccctccgacagcagtggcaacaggagctggatgctgggcaccatggctttgctgttcaactgcctgcgcttctccttctggctgctgctgcagacaaagctgaccaagaagtacccggccatctactccagcactgccatcatgttcttcagtaaatggcatcgacattccacagaacaaatgtcaactaggatgcgtgtgtatgtatcaaatatggcaggatttgttcctcgcgccggagtacaccaatgcaatggtgcggaggccgtacaaatttcttatttccattgctacaagtttgagtgataaattactgtaagctcaca

SEQ ID NO: 34958 - DNA, 424 bp, Triticum aestivum
  unsure (1)..(424): unsure at all n locations
  Clone ID: PAT_TA_34958
tcgggcacaatcaaactcaaaggagggacaaaaaggagcaggaaaagtgaggagccccttgatataagaatgtactccctatttggcatacgattttctctgaagccaaaattttcaaaggtttcatggtttgacctagtttatgggaaaaatatttaacatttataaacaattaaatataccacatgcatatcctatgagaatacatttcatgatgtatttgatgatattgattctgtattgttgatgttgacgttttttctataattttggtcaggctttaaagcgtttgacctgagtaaaaaaatgcacatacctttgcaaaccaaaaaggagagagtaattaaaatgcatatgccttggcaaaccaaaagggagagagtaataatatanataaagatattgtcagtggaagatgagttat

SEQ ID NO: 34959 - DNA, 983 bp, Triticum aestivum
  unsure (1)..(983): unsure at all n locations
  Clone ID: PAT_TA_34959
gagtcgggagactgtcccgcgagacgtcctgccacagattcacaaaaccagcttgccgactccaaatcaatactaatgaccataccgcgcaccgactggagccgagctgttgcgggcatactgcgcgtcgcggggccagggtcggccatggcgggctgcctgacgagaccagggctgctaggccgatactcaaggactacatggacggccaaatgccagcactatgaactccctactgacgttggcacggatgatgaggccgacgcgagaagctctaccggaatcgcagcagcagaaggcccgactgcttcagcatctgacggatcttgcagtgaggacgccgctgaacaggatgctagaacaggaggtccagacatgaggctgctgttgagtgacctcgggtaattcgacttagcagccaccgacaggatcccatgacactagacagaagaagaagcaggaagggatcagagaagcagcacaggaaaccaccgcgggaaagggaccggtccgggacttccagaagcccaccgtcagtattcccacggtcagcgtgggcggaaatgtctagtgccagtgtccctagcttcctaaacaaccacacgtcaccgttgctgctgccgggaagatggatgttgaatgcaaaaaggccaagaagtatatctacacataatatagctgggcttcttctggctgtgtgccgattactgaatctgctctggtagatggatgagatactgacgtgaagatgatttcctgataatgtgtccgaacatggagagattactcatgtttggcatgtcaaaaagattctattgctgttgtgaatataacatgggttgtgacttgtgatacgcatggcattttgtaattttccaacaatggcactcgtgctacgcatggcattttgtaatttttcanacaatggacatataactatacatatgcgaagatcaaaaaaaaaaaaaaaaaacctcgtgccg

SEQ ID NO: 34960 - DNA, 1666 bp, Triticum aestivum
  Clone ID: PAT_TA_34960
agcgtggtcgcggccgagggacgagggcccgctccccttgtttcgccctggggctacgatgaaagctgcagggccgcggagcgaggcccaccgcccccgggctctcgcccaatcggaacgctggcttggtgagtttcaggcaataatgctcgagtaacgaaccgggcactcaccgaggaggctgcacgacatagtgctgagaaagtcccaattagcatttcccgtttcgccccaactccttgggctaccatccaaagaatatacctgttggagtccgggatccccaggaagggccgctagccaaaagccgcgcatcttgtgccccccgcccccccaagctcggcgcggatgagtcttccctcatgctacgcggcgctacccgccgcggtcgccatgagactgctgtccttcggactgggcgtcgcgatcctgctgtccgtgtacaagacccggtgcaggaccataaggtggggtggctaggaggtcgggccgcacccgcttccgggcgttcccaacctcgtcatggtggccggtcattcgatatacaccagcgcgagctgcgggaagaccgaccgcgaggattcgtggttcttggagccgtaccagaagcaccccggccaggcggccaccttcttggcccacatcaaggagggggggtggagatcgcggggagggatcagggcgcgctcctcttgtttagcggtggggagacgaggaaagatgcagggccgaggagcgaggcgcagagctactgggctattgcagagtcggaaggctggtttggaaatgatgatagtgtaaggaaccgggcactcactgaggagcatgcacgagatagttttgagaatctcctatttagcgtttgccgtttcagagaactcactggaacatacccacagaatataactgtcgtaagctatgattttaaggaggaaagatttgcacaactgcacagatctgcactcgggattcccagaagaaaggttctttttctcaggcaccccatgctacagctacagcaaaggaggcagctctgaaaggcgaagcctctgtcaggtctcaagttccgacccgttccacccggccgtgccggaccccttcgggtgccgtggctcgagggagccctgctcctccggcccattgctgccacacttgggggcccttccttgggactcagtaccggaaaagggcatgatgtttggatcaaacatctactctcgctgtaaaatcccagcattcttgtttcgccccttgtctgtataaagctgacttgattagatatccctgattccatgttttctgtgcgggggagaagagaagattcttatgtgcacgagtaagattgttttcgtctcggaagcttgccacatgctccaatattgacagatttttcatttctcactcctccctggatttccactgaaaactcgtgaatttgtaattacaaatggtctgtaaacttacccttggaagcaagtgaacttataagttgtaatacaagcttgaactgcaccattaaaaagcggaaacctaaacaggaaaccttatgaaaaattttggtattcttccattgtgaaaaaaataggctgttttcgttttctaaaaaaaaaaaaaaaaaaaactcgagacctgcccgggcggccgctcgaaatcacttagtgaattc

SEQ ID NO: 34961 - DNA, 2337 bp, Triticum aestivum
  Clone ID: PAT_TA_34961
caacttagagactgtcttcgggcggtaccattattgcccgaagaccttcctcgtctttgccctcctcgctcttgcggcggcaagtgccgttgcgcaaatttcacagcaacaacaacaaccaccattttcacagcaacaacaaccaccattttcgcagcaacagcaatcaccattttcgcaacaacaacaacaaccaccatttttggcagcaacaacaaccaccgttttcacaacagccaccaatttcacagcagcaacaaccaccattttcacagcaacaacaaccacaattttcacagcaacaacaacaacaacaaatccttcaacaaattttgcaacaacaactgattccatgcatggatgttgtattgcagcaacacaacatagcccatggaagatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattactccagggctcgatggtcgatcaattaaagttttccatgaaaaagcagaacctatatttaagcttgcaggttttcacatggaagtagttaaaactactcacgctggtcatgcgaagtctcttgcgtctacttttgattttggcgcattccctgatgggattgtctgtgttggcggtgatggaatagtaaatgaggtgttcaacggtcttctcaccagaagcgatagaacagaagctgtgtcaattccagttggaataatcccagcaggatctgacaactcacttatttggactgttctgggagttaaggatcctatttctgcttcattgttgattgttaagggtggctttacaaccctagacatattggctgttgagtggctccaatccgggctaatacatttcggcacaactgtttcatactatggttttgttagtgatgtcctggaactttccgagaaataccagaagagatttggccctcttcgatattttgtggctggagtactcaaatttttgtgtctaccaagttacttctatgagttagaatatcttcctttgtccaaggacatgtccgggcatggaaaaggtacaggacaagacaaagttgaattgtctgatgtctatacagatgtaatgcgcagtcgatcaaaaagagaaggatttccacgagcttccagtttttcaagtattgactctatcatgactccaagtaggatgtctcttggggacttcgacacatcaggtggtacagcggcaagcagtgaaccgtcagagtatgttcgtggttttgatccaaaagcaaaacggcaatctatgggcagaagcaacattgtttcggaaccagaagaagtcctacgccctcaacagcatcatgcatcatactggccaagaacgaggtccaaaacaaggaccgatagaaattcagttggtgtcacagcttctaatgatacacggttatcttgggcagccccttcaatgcatgataaggaggacatttcctcgacaatatcagatccaggacctatttgggataatgaaccaaagtgggacactgggccaagatgggacacagagccaacttgggagcctgaccaccctatcgaactccctgaaccaccagaagatattgaaaccggaacatctagggaacttgtgccaaatttggatgagaaatgggttgtcaggaaggggcactttcttggggtcctagtatgtaaccactcgtgcaaaacagttcaaagttcccagattgtcgcgccaaatgcgagccatgatgccaacagtctggacttacttttagttggcggaagggggaaatggaagctgttgagatttttcatactaatgcaatttggtcgccggctttctttcccgtatgtggaatatgtgaaggtgaaatctgttaaggttaaacctggtgcaaatacccacaatggctgtgggatagatggtgagctctgccgcgtcaaggggcaggtagtatgttccatgctaccggagcagtgcaggcttattggccggcaatgtaaacagtctatttaagcaccacaagtctgccgagcttcacgagtttttgaggcgctgtatgatctgttgtcacttgtaacagttgattttgagttgtctatattatcgtttacttgccaatgagggtgggagtgactggtcgatcagacaatgttgtgacgtttcatgtatatttgagtgattatagagggatgcctccatccttttttctt

SEQ ID NO: 34962 - DNA, 662 bp, Triticum aestivum
  Clone ID: PAT_TA_34962
agaagacgacagaaggggctccacaagcgcctacctacaagtcccaacaagctctacttcacgccaagtacaaacttcaagagcacatgagaagaccgcgagacaagcactaccaagaggacgctacggctactaccaccaccacttcggcatcttcgccaagtgctatcaaggcatcttcgcctttggatgtacggcatcttcgcctacttcccacgagttcgcctacatagacatcttcaacaacaaggcgaccacctacgagcgagggcgacccttcattcttcggaagcccctcaaggaagatggtcaagcatgggaaattcccttcggtcatgcagacgagctacgaggtgccacatcatatggacctcctacaacaagacagcgacaagaaggtcgagcaagggccatccccttcgaccacggcgacgagcacgaacctcttcaacaacatgaagacgacgcccatattggactcatactccgagtcaagctacgagaccgcacatgagactttatctttggtttcggaggagagtgatgttttgccacatcctgtggcattcatctttggaggcgttatggatgaggagattgagcatgggactatcccttcaaccaaggcggcgataggagttgagcatggagacatttgcacc

SEQ ID NO: 34963 - DNA, 1162 bp, Triticum aestivum
  unsure (1)..(1162): unsure at all n locations
  Clone ID: PAT_TA_34963
ctccttccctcccacgcggtctgcctcgcccgcgaccacctcgccgccgcatccctctcaaccaccgccggcgtcggagatgcaggcgacggccgcatccttcctcgcccgccctctcccgtggccccgtcgcattggcaggagcgcgtatggggcggtggcggtgcacggaggcgtctcgccgttgccaccacggctgcggggggtacggtgctccatgagcctctctatcggcgccggttcgagcgacatcggagacagcggattcagctaccagtatgctcctgtcttccgaagataccgtgagcgggatccctacaagcttcttggtgttgaccgtgatgcatctgaagaagagatcagaagtgcaaaagacttcctagttcaacagtatgctggtcacgaagcaagtgaagaagctattgaaggtgcttatgaaaagataataatgaagagctaccagcataggaagaaaacgaaaattaatctgaaaaccaagcttttaaagcgagtcgaggaatccccgtcatgggtaaaggcatttcttggatactttgaggtgccatcaatggatattatttccaaaagattattcttttttgctttcatcgctggatggagcatagcaacttctgctgagaatggacctgcattccagctcgcaatatcactcttctcgtgcatatacttccttaatgacaagatgaagaaccttctgagagcatcgactactgggtttggagtacttgttggtggctggattgttggttctatgttggtccctcttatcccaacatttatcatcccacctacatggtcgcttgagcttcttacctccttggttgcatatgttttcttgtttctggggagcacttacctcaaatgaagcaacatcaatcttgtaaccgtaaattgtagtattgtttggaaaattttggcagttactgaaatgtctacaattgcatgtaccggcaatgttgttgaatccttcgtccttcgttcagctcagggtagagacaccggggaagccaggtgctttgttacaccagttgtccctcatttgtttaattaattgtcctaaggggngccttgtcttcgcctcgctggtccaagtgaatcgctgttatggatcacctgctgaagcttagcacaggatcaattc

SEQ ID NO: 34964 - DNA, 673 bp, Triticum aestivum
  unsure (1)..(673): unsure at all n locations
  Clone ID: PAT_TA_34964
attcggncgagggggaggagctgcgtgcggcaactggaagagcggcggcacacgcagtgcgggggaggcggagatgaccacagccggtgcgcggggtagatttggccggcctcttccagttttccgtccgctcagatgcgaccgtgatgtgcttcttcatcaccgccatcatcctctgctgagccgagccgtcagaagtagagagtcaagcggctggagagagcgttgctggagaggcagacacatcaaatctgatgctgcccgcagctttgtctatgctgttatgaagcttggccctgaagaagttatttgaggatggcgtggttaagcatgaagatctgttcatcacctttaagctatggttctgtgcacctaaagatgtgccagaggcaattgtcgccacccttaaagagcttttacagcaccttctgtgtgatcttgtccgaccacctcctcctgtactatctcctcaatcgtggtgatactatattttgcttgcttttcttttggtgataccattcatcttcttgcagcttctctaatggattaaattgttctttcagacttatagtaggaatattttgatagttgtgaatcgatttcaaagacttcccctcctcaataacaagcacatgatngggaatttacnnnnnnnnnnnnnnnnnnnnnnnnn

SEQ ID NO: 34965 - DNA, 723 bp, Triticum aestivum
  Clone ID: PAT_TA_34965
cggcgatctcggggaagagaacgagcggctgcggcgggagaactcgcggctgacgcgggaactcgggcagatgaagaagctctgcaataacattttcgtcctcatgtccaagtacaccgacggccagcagaccgacgccgccaacgcgacctccgccgccgccgacgtcgggaattgctctggtgagtcggcagagaccacggcgctcccacctccgccggtgctcgagctcttgccttcctgccaaaatgctcccacggctgccgatttgggcgcggaggacgaggaggagaagatgagcgctaggctcttcggcgtctgcatcgggcggaagcgaatgcgccacgacggcgaggaccggacgaggcgaggagcggcggcggaggtgaagcctgagccgatggacgcgcagcagccctccggaatggacggtcacacaccggacgtgcaagcctggcccatttacaggcccagacccgtgtaccaacccctccgcgcctccgacgggtcaaactgctacagcgggagtgacgaccacatcgggtccaactccaggtgagctcagctcaaaaaagaataagataactccaggtgagctgggttcaggctcgtgtgcgctagtactggagccgtacttttttttttttgagggggattggtaccgtactttgagttaattaaatgtagtctactaatccagcactaattaattagttagtaagt

SEQ ID NO: 34966 - DNA, 692 bp, Triticum aestivum
  Clone ID: PAT_TA_34966
ctctatggtagtaaactttcttactttagagacggatcagaaggcgtttcttttgcttttggtgttgaggatgcaccaaactatgcacaaaatgaagaggattaatgaaacaacattcgcgctgaagaagaaaaaggatatgttgcccatcaattctatcatactcaagaatcgccattcattttgtgaggttaaaaggattgtcctcttccttccttgcatgataaccacatcaatggattggtgttgaacataacaagttcaaggaaaattggaagtagtggcacaccagccatgaaaagtttgagagggctatgcaaccacaagaaatgatgtgctcctgtcattttgccatgatcttgtggccccattccacaggtggcacgtcagttccttaggtggatcctcagcagatcgagccgcctcacccccttgcaagcaaaccttgaccatgtctgctggcacatgcagcgatcactctacctgagttccatgactgcatatcttagtcacaataagctaaatgactagagctatttatatgatgcatctctatctatgtatcttgctttttcaaagcaatgtaaatggtttgaattgatcttatcatgaactgatctcatgcatttgttttggcctataaacgtaacatgcaatgtaatatataatgctatgtatcgacaacatgctga

SEQ ID NO: 34967 - DNA, 1166 bp, Triticum aestivum
  Clone ID: PAT_TA_34967
cgcatcgtccctcctcccccagcccatgccggggcccccgctcgctttcggctcgccccctgcccaattgaagtcaccaaaatgcttcgtgggatagcaaatgtgcgctgtgcgtggctaccttggtccaaggatgctctggaggagatgatgatgcgtggtgttctggatgtcacaaaaccaacgctggggcccatgtatggcattggtacacatcggagtattcgagaggtgaaagataagcagccccggctttgtggatcggttacgacaaatcgtcgcagacaagctgctggtttccgtgttataatgggtaatgttgaaggtgtacttacctgtaggcaagtgatgaagagccacccaatgaagaatttgatagcggtgggaatgatcttcaaaacgccaagtcacaatacgatctgggatgctcatgtgcatcgacacctctaggcggaatatgcagtagtaatcaaagcaccttccatgaccaatgaatacttggctagagaagatactgcatccaacatatctgagataagaaattcgggttcagcagaaagtgtaatcaaggacgatagttccgaaaccatggcatctccagctgattaacaacaagcacccagggtttgggcgtgccccaactcgaaggcctcctacttcaccctggatgcccctcccaatgcttttcgctgccatctccacaaaagttcctcgttctgacatggatgtaatccatggacactatgaagaattcaagaggagaaagataagcaggcccgagtttgtgagacggctaagacagatcttcggcgacaagctgctggtttctacagtaatgaggctgcaacctaaggtagtggcacccatggcaggtgctgaagtgctaccaagaggagcacccggcacgggagggagcagcacctcctgaagtagcagttcgtcgagataacagctcgtggagccgctcctagtggagagagatagagagagcacaggggaggccattaagttatgtgtcggttggttatagacaaaaactagtcggtaaactgcgagcagcctgttaagttggtgtagctttgtttggttccatgtggttggtcccttggcgtcagtcggtaactggaaacactcggtggtggccgatgctgttgtggcaaatctgt

SEQ ID NO: 34968 - DNA, 1181 bp, Triticum aestivum
  unsure (1)..(1181): unsure at all n locations
  Clone ID: PAT_TA_34968
gcaacaagcaatcaggaacctcgccggnggcatttagnatttagtattggatttccggacagatcgacatgattaccaggcagactttccatctgtggtgaatgtgtccattctagaaccagatcctattagacgcactgttgtgctggtggaacaatcactgctgtctgggcttcctcatagacatgctgagaacagattcaggatagcatcagaagcttgttttgaaggggaaggttctcactgggcatcatctgtccacatgaatgatactgctcgacataaatctggctcaaagtccacaggaaagcacaaagcagcttcagaatcgggaagaccaccgaaatcgaaaattcagaggatggctgaaccgcaggacatgccggctttgaagtttgattttctccgatccccccggcaactgttgacaagtgcagctgagttccccatcacacagtcactatccgactttggcattgatgattctgagttgacctacatggaggatctaactctagaagagactgacactgagtttgccccataccagtatgaccaagtttcccttgctggtattgaggagttggatcctctcgtggatttgacagacatcggatgagaataaatggacattttggtctagatagcatgcatgcccttctatcaagagcagagaagattttgtctctggcagggagcccaaggatatctggtcgagttgctcagccatgcatggttttggttgcaagcttggtcatgattggcgggagcggtgctgtcggcgaggccacgtgggtcctgatgagtttggagcatgggggtttgctgctgcactaatggaggcattgggggtactctctatacatgtatgtatattgttagtctaggatcctaggatgtagaagtgagtctccctccctcccccatctgtgtggagagatcgatcttgtaacttcaccatacatgtaaattttgcttagcagatgccagcagggacggaaaagaggaggcccagccctgccgtgatttcttgattgttgctcccttggccgtttaatctattcctgtcatttttcctacctggcactagaaaaaaaacgggcgtgtaccccctggctgtgaaacagatacttgggatcaattgctcttgagagaattcggtgttcaccttcttgtggacc

SEQ ID NO: 34969 - DNA, 1124 bp, Triticum aestivum
  Clone ID: PAT_TA_34969
aggtgatcgttcgcatcgccgacaaggaagtcgagcggattcgcaggtagccctagcgaaggggaccgatgctaggtatcttggtgatactctgaagcttaaagttgcccagaaagttgttggaggagtagctgacgaaggtgcagttcatagcgtgatcgcggccgaggttgaaaaaatacagcggcatgggctccctcgaagccaagacaaaggggagcgatgcaaggtatcttggtgatccgctgatgcttaaagttgcccgagggagtttgtcagtagcggtgagctaacaaatggttgtgtcctgtgggtttagtccgattgacgaatgcaaccctgtttgaaaggattccaacgatcttggtgcctccgcgttttagtcacgggcatgttcttttgacaaggtgggagatttcttagatgtcagacagggggcggatggggcccatgctcacagttaggacggtcgcggtaacaaacagggcgggtttccctccgtataaaccatcattacgggcagcaagctataatagagtcctgagactctgaaggtcaaagttgcccagggagttcttcgggagcaggtagctgacaaaggttctgttctgaggtttattccgtatacaatgcaagctgttaagcaaggattccaagatcttggtgcatcctctttgcagtcagctcatgatcttttacgagcggagactcttagattagaggtgaggaccggcgccgctcaagtggagggagggatccacgggctggtgtcgtacgagaagaaatcgttctagccccatctttgatcgaggaccggcgtaccggttctccgcgtgttccatccaaggttggcagcgggtcacctgatagtgcttgagagcagcctcccagctcgtccgtgtgggtggggctatcgatctaccactaccgctaggatggttgtaacatcatcatctttccaccatggccatggttgaaaacttttggacatcgtaatggctgtaacaataaaagtgatgtttccgtttgctaaaaaaaaaaaacctgcccgggcggccgctcgaaatcactagtgaattctaacaataaaagtgatgttttccgtttgctaaaaaaaaaaaaaa

SEQ ID NO: 34970 - DNA, 640 bp, Triticum aestivum
  unsure (1)..(640): unsure at all n locations
  Clone ID: PAT_TA_34970
tgataatggtaacagtgtagcacatgactttgaacttgactgaccgctgggccccacctcgccgcggaagattctagcccgtcgggagaaggctcagtgactcgccggcgagatgatcgtgtcggcgctcgcgacggcggtgggcgtcaacctgggcctgaccgtgctgctcgtctccgcctactcgctcctccgccgccgcccgccgttcgtctccgtgtacgccccccgccgcccctacgcgccgctcgagtcctggctcgccgccgcgtggcgccgctccgaggacgacatccacgccgccgcggggctcgacggcgtcgtcttcgtccgcattttcgtcttcagcatcaggcttttcgccgtagtcgctgtggtgggcgtcggcgtgctcatgccgataaacttcatgggggaccagctgcggctgatcgacttcaccgacctgcccagcaagtccgtcgatgtcttgagcatctccaatgtccgaacgggctccaattaagctcagcttcacttcaatgcaacgtatccaacaactgctcatacgtgccaatatattcagtaagagtacagttttattcaatcacactcggcttgagtattttatgacattnnaagccactaccttagtatttca

SEQ ID NO: 34971 - DNA, 1160 bp, Triticum aestivum
  Clone ID: PAT_TA_34971
ggcacgaggagttaccgggccctgctgcattagctcagatgaaaatggaagttgagagcctaggaatgggcagagattatggagacaacagattgcgacgatcccctgcaaagaataatagcttccatcgtcctatgtcccctatgtctccagttcctgattatgcttttgataacctacagcacatgcagaaagagaatgagtttctgactgcacgtttgttaactatggaagaagaaactaagatgctcaaagaggcattgacaaaacggaacagtgagctacaaacttcaagaagcatgtacgctaagatagcgggcaagcttcgcaccttggaagttcaaatggtgactggtaaccaacgtaagagtccatcaaatccaaacatcggcacccgctttgatggtgcacatagtcaaaatggaagcaatccacctagtatgacttccatgtctgaagatggtgttgatgatgaaggcagttgtaccgagtcttgggccaatgctctggtatctgagctatcacacatcaagaaagagaaagtagctaagagcagtgtgactgatggctccagtcggttggaactgatggatgacttcctagagatggagagattagcttgtttgccttctgaagccaacggccatgacaatgctgttgacaaaataaagatcgttgatgctgaggctgctgtatctggtcttactgagagtgatggtgttaaagatttgcagtcagtaccattgcctggaactccatctagtaaacagcagctgtccgagggatctccactcttgaaactgcagtccagattatcttccttgctggactctgaatcaccacagaacaatgctgggaaggtactaaatagtatcagaaatattcttaaggatattgaagaagaggcagatttaatgaatgtgagcaagatggttgaagtttctgaaagtgaatcattaatgaaccaagacaagaggttgagcattgggagtaagcattccatggatcaagaagttataaatgccgtcttgaagattcaagactttgttaagtcacttgatcaagaaatgtccaagcaccagagaccatcttctgattatgatgggctttctgagaaattcagcagttctctgcactagttgagaaagttctatcaaatg

SEQ ID NO: 34972 - DNA, 1197 bp, Triticum aestivum
  Clone ID: PAT_TA_34972
ctcagatcagagctcggcacggggaaagcttcacttgactcccacgcgtccggggaagtgatggcatcaattgcagtttcttcactagaagctgagctcaacaggactcaaaaagagatagaatctgtgagatccaaggaagaagatgcccaagagaaaatggtggagctccctaagatgttgcagcaagcagctcaggaggccgaggatgccaaggacgcagctcaagcagcagaagaggagctgagaaaagccaaggaagatactgagcaaaccaaagcagctgcaactacaacaagcagcaggttatgtgctgttctgaaggaaatagaagcatccaaaacgtccgagaggctagcacttgcggcagttcgagcattgaatgaaagcaaagaggccagcgacgtcgaggattctcccagaggagtgacgcttcctataagcgagtattacgcccttagcaagaaagcacaagacgctgaagaactggcaaatgagaaggtgacagaagcgctggcacaggtagagtccgtgaaaggctctgaattagagagcctagacaggctaactgaagcaacaaaggagatggatgaaaagaagagaactcttgaacttgcattggagagagccgagagggcaaacgaggggaaactcgccgctgagcagcaactgaggaaatggaggtctgaccatgagcagcgccggaaaattcaggaggccgcgaagcgtgcggttaaccccgtgagtagcccatttgtcgatccttacctgaaagagcaggattcacggctgcacatgtcaggcagtagctacgaggaccatgttccgaaccgaaagttgcgaaagaaaaagtcgtttctccctcgaatgggctcatttttgtcgagaaataccccggcacaaacataagaaaacaggtcataaaagcgcggatcgacgagctgtacattgctgtaataagttattcaatttgtcttgtaagttggtttctgtttaagctgtaatttgttggtataaacccagggggtatttttccacaaaaatcattctttgggcaactcaggatagtttttgtgaggaaaatgctcgaatgtagcactgttctgttcggaagtaccattctacacccaggagcaaatgctcctggtatgaatagtaaaattaaaaaactaaaaaaaatgttcaaaaaaaaaaaaa

SEQ ID NO: 34973 - DNA, 443 bp, Triticum aestivum
  unsure (1)..(443): unsure at all n locations
  Clone ID: PAT_TA_34973
gggtcgaccttgaactttgtgttcatgcccgtggacacgatgtaaatcttatcattaaaacttctttcaatttaatattccttttataagtgcatcttatatctgggatctgtccttttgcaatcgtggttccggccatgttctcctttaaataccgtttctcgtgcaagtttaagcacttgtcttctgcagagcaataccctagtccaaccaatactttgatctgtcatcgagtgttacactctggtatgtcgagattatcgtggaactgcataacttcttatggtttcttcatgaactgttatttctcaccaattccaattttcctgngttctgggttgtcgtcaaccgagaacaccaaatagtgaatcgagtccgcactctgattcaataactcgaagtaattttcgttgcttatgagtttaataatccttcaattcatc

SEQ ID NO: 34974 - DNA, 1109 bp, Triticum aestivum
  Clone ID: PAT_TA_34974
gatgatgaaccaaggagaagacggcaggatacgccagaagatgatgaaccaaggagaagacgacgggatacgccagaagatgatgaaccaaggagaagacggcgagatacaccagaagatgatgaaccaaggagaagacggcgggatatgccagaggatgatgaaccaatgagaaggcgacgtgatatgccagaagatgatgaaccaaggagaagacggccggagatgtctaagcatgatgagcatccacgccgggatcggccagatgctgatgataggaggagacacaattcagggtcagaccgccaccatgcttatccaaagcatgacagctcagactcgaagcagagaagtattggaaatggccggaacaatggcaattccacttctgaacaccgctcccatgctgaagtcgcttcaggagatcaacgaagacaagagagccggcagggcagggaactaggttcagaaggccgtggaagacaagaaagccagcagggcaggaacaatgggcccacaactaaccgccgtcgagggggcgtgcaccatatgtcggaagaggacagggaagctcgtctgcggcaaatgcaggctgacgctgaggtccacgaagagcagaggtggaagaggatcaagaaggctgcagatgatgatgccaaagaggcgtccacggtggctgcaaaccaattcagagggaagaacttcttggatgacgaaaagaagagtatatttggtgctgacaagggcggcagcgccaccatcgaagagagcatccgccgccgcgcctattattctcagggtggcggtgatgcccacgaggccaatgcgttcaggcggtgaaatccctcgagcgggagcacaggcttcatatatttctgtttgcagctttgtctctgttcttccttttccagtctcatgtttgtatgatgtacgatacttggaaggaattttcttgttatgtacttcctccgttcggaattacttgtcacaaaaatgaataaaaatggatgtatctacaattaaaatacatctagatacattcatttcttggctagtaattccgaacggagggagtagtactccctcatcccataatgtaagacgtttct

SEQ ID NO: 34975 - DNA, 1088 bp, Triticum aestivum
  unsure (1)..(1088): unsure at all n locations
  Clone ID: PAT_TA_34975
ggaaaaccagttggctttattcccggatgcatctttacttgctgaggaatttctacctagagcagctacgaagctgtcatctataaatcagtcctgcatggatgatttgcgtaaaagaggaccagttaagcaaaaccgtgtgcctgagctacgagaatggaaaaggaaattacaacgcatggtggacaggttgagagatagtttctgcaggcagcatgctcttgaactaatatttacagatgaaggtgatacccatctcagtgcagaaatgtatattagtatggataatactgttgaagagccagagtgggtcccatctccaattttccaggaactgtatgcaaagctaaataggatggcaggcgttgctgcagatatgtttgttggtagagaaagattcgctactttgctaatgatgcggctcactgagacagttatcctttggctctcggaggatcaggccttctgggaagagattgagcagggaccaaagcctttgggcccccttggtcttcagcagttctacctggatatgcaatttgtcatcatcttcggacaaggtcgatttttgtctagacatgtgcatcaagtcatattggatatcattgatagagcaatgggtgccttttctgctaccggaatgaatcctgatagtgtccttcccggcgacgattggttcatggatgtcgctcaagaggttgtcggcatgatcagtggaaggggtagggctgccaatggggacagggagattaacagcccgactgcctctgtttcagcacactctatgtcatctttcagatcccatggcagctcttagtttgcaggctagtctttgtaggcaggtcattgtataataagtaatatactacattctctcctttcatattcctgtgatcttactttttgggtttctgttttccttctttgttctgcatctgctgtgcaagcatagattgataattgtttgacctaggaaacaaaatcctttgcaattgtttcacgcgctgagtcctgcgagcgttgcgtcttgcatgactagtatatgacattgagttttgtatcaccggatcattccttcancaggattt

SEQ ID NO: 34976 - DNA, 1942 bp, Triticum aestivum
  Clone ID: PAT_TA_34976
cggactcgtgggcgcggcggctcatcctccctcagagaaggcgcgcaccggccggtggtggagagagggggagggtgggagaagcggccgtataaggatctctccgcgctctctcgtctctctctccggttttgtacctatctatctatctacctatacctacgtacggttcgtgggccgggctgaggagggagagaggccgctgctgctcttgttgttggtctgctcgatgatggcgggagcgacgtcagccacggccgccgcgggcgcattcgccgccgccgcagccggcgccaaggtgcgggggtccgccgccgtgtgcccgtgggtcgtcgccgccggcggccggaggcggtccggcgtcgtgcgctgcgacgccggcggggatgcccaggcggcgtccaagttggccagcatcaccgcgctcgagcagttcaagatctctgcggaccggtatatgaaggaaaagagtagcatcgctgtaataggcctcagcgtacacacagcaccagtggacatgcgtgaaaaacttgctggtgcggaggaactatggccccccagttttggaggcctctgcaggctgagttatattgaggtgactgctgttcttagtacccacgcgtccgcccacgcgtccgcggacgcgtgggagacacgccgcattcgtaacgctagctcccgtgttgcctagcgcggtactgattaccgagccgttgggagctgagagctactcggtgcagctgagtgctcctctgtcctctccactcctcccctctcctctctctcgcacgagaaggatagatagacctcacctctccctctccccccaccgtgctcttggggtagaggcgccgagatggagcatatcgcgaggttcttcttcggggtctctggcaatgttatcgctctgttcctcttcctgtcgccggtcgtcaccttctggaggatcatcaagaggaagtcgacggaggacttctccggcgtgccatacaacatgacgctgctcaactgcctcctatccgcatggtacgggctgccgttcgtgtccccgaacaacatcctggtgacgacgatcaacggcgcggggtcggtgatcgaggccatctacgtggtcatcttcctcatcttcgcggagcgcaaggccaagatccggatgctgggcctcctcagcgtggtcaccaccatcttcgccacggtggtgctggtgtcgctgctggcgctgcacggcaaggcccgcaccgtcttctgcggcctcgccgccaccgtcttctccatctgcatgtacgcctcgccgctctccatcatgaggttggtgatcaagaccaagagcgtggagtacatgccgttcctgctgtccctgtccgtgttcctctgcggcacctcctggttcatctacggcctgctcggcctcgaccccttcatctacatccccaacgggtgcgggagcttcctgggcctgatgcagctcatcctctacgccatctaccggaagaacaagggccccgccgccggcgccggcaaaggggaggacgccgacgaggccgacgaggtggaggacgccaagaaggcggcagctgcagtggagatgggcgaggcaaagatcaaggtcgacgacgacacgtcgtcgaccgttgtcgacaaggtcgcctgtaggccgccgttgcagggcgagtgacagcagcataaggccgctgcttaattagttagtagagctgttatgctaagcagatcgtcggtgtctgccttgttgatttgtttcttgacatggtacgtacgtacatttgccagaaagctggtgctctctccccaaaggccagcctacgggagagctatgagacagtactccgaaaatctcaaattgtaactgcaagtgtgaattacctctgctctgtttctgtgtgttgtactcctccaaagatcaaagttggtttttgccccctgg

SEQ ID NO: 34977 - DNA, 2162 bp, Triticum aestivum
  Clone ID: PAT_TA_34977
cgccggtggggatgcccaggcggcgtctaagtagagcgacacgccgcatctggaacgctaccacctgtcttgccaccggtagttgagagtaacgagtcgcagcgctgtgataggtctccgtgtgcacctgacccctcctctcttctctccaaccctctcctgtccgagagcgatcatggcgccggactactacatctctcccctccctttctcgtatccgagatgctgcgttagaggagatggcaaggtgcatattctgaggttcatcctatggtattcctccactgttattgctttcgccgtgcgtcactggccggtggacaccgtctgggaggttccccgaggggtacgcggcggagcccttctccgcggcgccgttcaacatcccgctgctcaagtgcctccgtcgtccgcctggtacccgtctgccgatcgtggttcccgaatcttcacccgcggtgacaacgatcaaacggctcccggttcctgtgctccgaggggacctacggttcgtggggtcgttcaggatgccacgagggccgaagagccaggctcgcggctggccagggcacctgtctgcagtgtgaatgacttggaagcggcggtggaagtcggtaaggaagaccgtgtgaagaaagaacggcaggctcaaaacatcgttcccgtgttgcttagcgcggtcgctgattaccgggacgctcggggcagagatccacccggcgcaacggagtgcccgtatgcccaccggatcagtgcttccgaactctactcgtctctgctgtcgatcgggcaagacaatttgatcaagaacatgtgaaggtccatcgcgcagcttagcccgggcatcgtgaacaagcacattcacggcccactgcggcacctcagatgcgacggcagcgacagccgcaccctggacgaaacgcctgtgagcaggcacgccctcaacagaatgttcgacctctccacgaagaaggtggtccttgaagcagaagatcaaggccaaggtagagaagacccaaagctgctaccaggagttacttggccgtcggtatatacagttatacctgctcccagtatgtcgctacaatcaaatcccagtattttgtcgtgttgaatcctccagttcgatgcgtgattgccttgcggccgtgaattacccatggtaagctcgcgtacaggccttgtacaggggtgtctgaacatggtacgtacgcagatgtcgtggtaacatgctccgcatctgagtcggggttacatacggaagagcaagcagaggcgattccgaatatctcccttgctaacggctagtgtaactttatttgcccctgtatcggtctccagcactcggcggaggagcaagactaagtgcgcgcactcaacggcatacccaatctccctctggataagccgctgcgcgaacccaagatggaagaccgggtcgggcagacccaaggcggcccactcaatcactaccgaatggctgaaactcttcgaggcttagacggacccactgatagacggttccgaccatcaaaaagctgaggtcgtacgccgacaggatcagggcatctgagctagagaagtgcctgcagaagatcggggaaggcaatctcaacatgaagaggagaaggtccatcgaggagctgagcacgggtatagtgaacaagctccttcacggcccactgcagcacctgagatgcgacggcagcgacagccgcaccctggacgaaacgctggagaacatgcacgccctcaacagaatgttcaacctcgacacggagaaggcggtccttgagcagaagatcaaggccaaggtagagaagacccaaagctgagaccgggagacacttgtccgtctgtatatctacttaatactgctcccagaatgtcgctacattctaatcccaatattttttttgatcctccacttgctgctgagttcttcttgtgccgtgaattagccatggcagcccccaaatgtgttgtagagaggagcagggaagcatgtttgctccaaaactgcctgtgtacattaattactgtggctgctgtggttagagcccaattttcaagctgtactataatactgtactctattggacgaaataaagaggaatatatcagtgtgttaatggatgcattcgttttatataaaaaaaaaa

SEQ ID NO: 34978 - DNA, 1610 bp, Triticum aestivum
  unsure (1)..(1610): unsure at all n locations
  Clone ID: PAT_TA_34978
acccaagctcccagatgccgtcaggaaggtccctccccacgcgtccggtccgaactcttcgttagtgcgaccaaataaagtcaacacagagaacaaagactctagccctgtggaacaagctgcctctaaaatagacaaaggtggagtagcacagaaagaagggtcgggaactgttcgcacatcccccggacctgtgaagagaaaagcaacttctatcggtccaaagattaaacggttccggatcgataacgaggaatccatggaattgaagataacatgggaggaggctcaagaattgcttcgccctcccctgaaggccccttcggttgttattgttgatggccatgagtttgaggaatatgaggagccaccagtacttgggaggaagacatattttgtgactgaccaatcaggtgagaatcatcagtgggctcagtgtgaggattgttccaaatggcggaaactgccagtagacgcccttttaccctctaagtggacctgctccgacaataaatgggatcctgaaaggacgacttgtgtctctccacaagaggcaagcatggaggaacttgcagaactgattcctataaaagcaggtgctgcaaaaaaggctaaacttaggatggatactgatagtattgatgtttcggatgggctggacactctggcaaaccttgctattcttggtgagggcgaatctcttccgtcccagccaactaccaagcacccccgacatcgccctggctgctcgtgcattgtctgcattcagcctcctagcgggaagggaccaaagcacaagcagacgtgcacctgcaatgtatgtatgacggtgcgccgtcgttttaggacactgatgcttcggcgtgagaagcgtgcgtctgagaaagaatcggatgagctacctcgcaagaaagagcaaggccagtcgagcgagtcgattccacaagatcccctgccggctagcaccagtcctagtagcactccccaggaggtgagcggaaatggtgatgacgcggaagaagccatggagcataccatggcatcctctcctatgaagaaccagattgacctgaacatccagcctgaacgggaagacgagcaatcaccaaaatcagatgcggtcggtgcaatgagacttgcgcgagagaacgcagcctagtgcggctcaccgtagtggcgaaagtggtgatagataacagcagattggaaactgtctataccaatggagatatgcggcgcctggagttgtagtgtaggtgttattacattttccatacaaaaggatctagctagtttccttcctgttgcgggggacatatttcccagtgttgatgctatatcgtgtataccatagatcagtcggttggtgctgtaggcaggccccgttgtaggtgttgcctaccctgtatgtatgtgtattgtaaaagcagcgcttttcggcaccatgtcagcggcataatttattcatgtatcgactcaaccatccccaactagtatgtgcttnctaatgtcgataacaaacactatagttnctgtggagcttttgcggtgggtgggtcggggggtggggggcagtgtctgctttaaaccctcgtttgttcgtggacgca

SEQ ID NO: 34979 - DNA, 865 bp, Triticum aestivum
  unsure (1)..(865): unsure at all n locations
  Clone ID: PAT_TA_34979
tganccncnnnnnnnttctgattacgccaagctcgaaattaaccctcactaaagggaacaaaagctggagctccaccgcggtggcggccgctctagaactagtggaccccccggccggcccgtttccggcgccggagcagatggagaagaagaccgggatggccaagctttgggcgctttttcttgtggttttggtcctcgcggggagcgcgcaggcggcggccgaccggaacgtgagccgtggtggtatgaggcggcttgccggggcgccgggcgtaccagtgcctatcaccgtcctcacgtccgccgtcgccatcggagcagtgtgcatggatgggacgccgccggcttaccacatggattggggcttcggtgcagggaggaaccgttggatcgtccacctagagggaggctcatggtgcgagagcgtggggtcgtgcctgtaccgcaaggcgagccgcctcggctcgtcgaatctcatgaacaggcagatgtacttcggcggcatcttgagctccagccccgccgagaatcctgatttcttcagctggaaccgggtgatgatccgctactgcgacggcgcgtctttcgccggcgaaggctacgacgcgcgctcggggctctttttccggggccagcgcatatggaacgccgtcatccagcacctcctctccatgggggatgtcctccgcggatcacgtgctgctgacggggagctccgccggggcccttggcggtggtgctgcactgcgaccagntcggcggcttcttcgccggccggggcaccaccgtcaagtgcctcgccgacgcaggattcttcctcgacgccgtcaacgtcgccgggtggcgtaccttgagatcctac

SEQ ID NO: 34980 - DNA, 1867 bp, Triticum aestivum
  Clone ID: PAT_TA_34980
gagggtggaaacaggaacatgagcattcaggtagcttagatgatacagatcggaacagactaaccaataatgataatgagtatgcttcttctgcaaatgatggagctgaggatagctggaagtctcagaaaaagaaacgggataaagaagaggatgacagtgaattggaaagtggcgatccttctaataattcgaagaaaccaagagttgtttggtcagttgagctccatcaacaatttgtaaatgcagttaatcacctcggaatagacaaagctgttcccaagaaaattttggagctgatgaatgtccctggtttaactagggaaaacgtcgccagccatttgcagaaattcagattgtatctgaaaaggatagctcagcatcatgcaggaatggccaatccatatggtgtgcctgcatctagtgctcaagtggcctccttgggaggacttgatttccaagctttggctgcttcaggtcaaatccctcctcaagccctggcagctttgcaggatgagctcctaggacgacctacaaacagcctggtgttgcctggaagggaccagtcatctttacgacttgctgcagtcaaaggaaataagcctcatggagagcaaatagcatttgggcagccgatatacaaggtccagaataattcatatgcggcattaccccaaaacagctctgcagttggaagaatgccttctttttcagcttggcccaataacaaacttggtatgtcagattcaatgagcgcactgggtaatgtgaataattctcagaatagcaatatggtcttgcacgaattgcaacagcagccagataccatgctgtcgggaacccttcacactctagatgtcaaaccttccggcatagttatgccatctcagtcattaaatactttcccagctagcgagggcctctctactcatcatccttccttgattataccttctcaatcgtcaggttttctaacaggcattcctccatccatgaagcctgaacttgttctcccaacttctcaatcatcaaacagtctgttaggtgggattgatctgattaaccaagcttcaaccagtcagcctttcattagtagccatggaggaaatcttcctggtctcatgaatcgtaactcaaatgtgatgccatcacaaggaataagtagctttcaaactggtaatactccatatctggttaatcaagaactctatgggaatgggctctaaaccacctggtgttctaaagactgagagcactgactctcttaaccaaagctatgcttatgccaaccatatcgattccggcttgctgtcttctcagtcaaaaaatgcacagttcggttttctgcagagtccaaatgatgtcacaggtggctggtcttcttttcaaaatatggatggctatagaaatactgttgggccaagtcagccagtgtccagttcgtctagctttcagagttcaaatgcagccctggggaaattgccagatcaaggacgaggaaaaaatcttggatttgttgggaagggtacttgcatcccgaaccgctttgcagtggatgagattgaatctccaactaacagcttgagtcacagcattggaagcagtggagacatccctgacatgttcggatttagtggacagatgtgaaggcttcttggatttgtaagtagggtaatcactggaaacaatttagtggtttgatgaatggttgctcttatttttcatttcatcttcttttttctctgtaattggtttataaagggaataatttgtgacagcatgttgaatcttggtttatagaaagttgttcggtttaaagaattttgaattaaaaaaaaaaaaaaaaaaaaaaaaaaacggacgcgtg

SEQ ID NO: 34981 - DNA, 1231 bp, Triticum aestivum
  Clone ID: PAT_TA_34981
ccacgcgtccgtaccgagggcaagctcaggaaagccgcaggcccagccggaggctggttcactgactacaactcctttttccctcctaaattctgctgtttaaaaaggagggtgaagccctccccaaaccaaagtctttacaggaaaaacggctaaggaaaccagggggaaacccaccatttctgttttgctgctgctgctgctgctgctcctgattacttctttctacctgagaagaaggggtgaggaaggggatgatccatgtacaatggtcactggtgcttgaacggcccttggtcttcagtatcatcatcctcatcgtcgctgccgctgcctgatgggtcatcctccctcttccgcttgataccctgcgaggacgacggctggtctgcgccaccctcgtcgtcatcatcttctacctcgtctctgtgctcatcaacatcatcagggtcgtggatatcaaagtccactgggtggactacagccacggcttgggtcgtcacaattggtaaaacaagatattctggatggtttctgggttaagctcccaagcatgaaagcaaggagaggatgtcatgctgtcgctgtcctgggagaagtcctatatgctattggagggtatgatggggacagcatggtttccagtgttgagatctttgatcctcgcctcaacgcctggaggatgggtgatcccatgagcaacccaagaggatacgcctctgcggttacttttgatgatagcttgtttgtcctcggcggtctgcggtccaacgaacagatactggacactgtggaagtctacaatgtgaactccggctggtcagtgccaggtttcaattcaatagggaagagatcttttgcatctgccattgtcatgtgatcggattcgggagtacagtgctcatctcaccagtctcttaacattttgccggcatgcaaggaacagtaaccccatgttttccgaaaagcagttttagggctcattgtctcacccttccctttgagctccagttatgtacagcgaaaaccagaaactcgacatgcaccacagtttagcaaccctcattcagccgtgtacctttaaccatgcatctcatggaatgctgagacatgtagaatgttctgaattctcgttaaaccaggaactatccatctttaggaatgcaaaaccttcgcatggaatgcaataccgttaggatgttcgaatgcaatttgctgctgccgtatctta

SEQ ID NO: 34982 - DNA, 1685 bp, Triticum aestivum
  unsure (1)..(1685): unsure at all n locations
  Clone ID: PAT_TA_34982
tcggcacgaggctccctcccacagtcccactcccatgtcctctgccatcccatcccccgcgcccccccccacagccgccactccccccccccccccaccccaccctccttccgcgcgcgccagtccccaataacccgggacggagagccggccctccgcgactccttggccgcgcgcacgcctcctgcatgccgctgtgaccgtgagtcgtcgccgtagtgatctatccagccatgtcgtcgtgctgagtggtgggtcggcgttcggggtctggccgtgcgcgcgcggctgggcggctgcaccgccggccgtgggacggcggaccggcacggggtggcgggcctgtgtcagggcgtgctggcgccgcggagctgccgctgagccgtgggtgcggcggtggcggcgtcatgcgggccgatgcgccccgtgaagtccccgttcgagccggcgccggggcgcgctataagacgcttacgcgcgttccccggctgcatcttcctcaagtaccatacgttcctcctcgtcctctggatctggtacctgtctgtggagagaaacaacaagcaaacttgcgttaagctctttgcagagttgtcaaattctgccaagaacacagcccccgcaccgatagcctcgtttgtcacgaaacttctgatatcctttcctccagatcagaagatcatagagcatccaggtatcctggacaagcctctgaaacacgaagggcttgtgtggacgattgatagtagttttacaggaagatttgtgattgagatagagtttctggacctcaaagttgcagattcatctggaggtgaacctgcctcgatctgggcctcacgccaaatcaagcagtcttcagacaacaccgcgctgtcatcccttgcaagggatgctgcaagaaggcatcctctgcgacatcacgatcaacgccgacgatggcagcatcagggcgcaccgggcgatcctggccgcccgctcgcccgtctttcggagcatgttctcgcacgacctcagggagaaggagctctccacggtcgacatctccgacatgtccctcgacgcgtgccggggcttcctcaactacatctacggcgacctgcgcagcgaggagttcctcgcgcaccggctggccctcctcggcgccgccgacaagtacgacatcgccgacctcaaggaggcgtgcgtcgagagcctgctggaggacatcgacgcccggaacgtgatcgaacggctacagacgggccacctgtaccggctgcagaggctcaaggacagctgcctcaggttcctggtcgacttcaggaaggtgtacgagatgcaggaggagttcagcgcgttccttcagacggcggacagggacctggtggctgaggtgtttcagggcgttcttgcggcgtggagcggccggtgagcgtgggggagcggctgcctctgcgtctgggggtggtggtggtggtgttccattggtggtgcattgttgtgctggattcttgctggtgcagcttgtaaatagcgcgtgcaagccattgtttgttggcgatatagtaaaatttaacgtgtatacctcgattggattttgttcttttatcatatggtaatccaattcatgtaaaaaaaaaaaaaaaaaaaaaaaaactcgagggggggcccggtacccanttcgccctatagtggctcgtatt

SEQ ID NO: 34983 - DNA, 1186 bp, Triticum aestivum
  Clone ID: PAT_TA_34983
cggacgcgtggggagcgcggtcttactggcatggtttcgtatgctgagatcctggctggaggaattctaaggctacaagtttctgaagctgaggttaataatatcaatattcgctttctggacagaagaactggtgaaccaactactggaaaaacaaaaccagaaaccatactccagcagcttaccaccaagaagggtcaggcatacaatagagcacaagtgaaaagagatgttgaaacaatactcactatgggaattatggaggatgtcacaataattccgcagcccgtgggagattctaataaagtggatcttgtcatgaatcttgtcgaacgcaaatctggtggtttctctgctggtggtggcatttcgagtgggataacaaatgggcctctttctggattgattggcagctttgcatattctcagcggaatgtttttgggaggaacaagaagttgaatctctcactagagaggggccaaatagattctatatttcgtttaaactacactgacccttggattgacggcggcaatttcggcacctccagaactgtcatggttcagaactctaggacccctggaacacttatccatggtggggagcatcctgaccatagtcctattacaattggacgggtaactgctggcattgaatatagtcgacctttcaggcctaaatggagtggtactcttggattgatatttcagcatgctggtgctcgtgatgacaaaggcaaccctatgatcagagatttctataacagccaattaactgcaagcggcaatccttatgatgacacgttacttgctaagcttgaaagtgtctacacagactctggagaccatagctctacaatgtttgttttcaacgtcgagcaaggtctgcccattcttccggagtggcttagtttcaacagagtgacagcccgtttgagacagagctatgaaattggtcctgcccgacttcttctaagtgcttctggaggtcatgtggaggggaacttttcgcctcatgaagcatttgcaattggtgggacaaacagtgtaagaggatatgaagaaggtgctgttggttctggccgctcatatgcagttggtagtggtgaagtctcttgccgcttgtttggtccgttggaaggtgtggtattttggtgactatggtagtgatcttggctctggtcca

SEQ ID NO: 34984 - DNA, 1032 bp, Triticum aestivum
  unsure (1)..(1032): unsure at all n locations
  Clone ID: PAT_TA_34984
gccaccaaaccnnagaggagaaaaaggagaccctcgctcgcctaactccattagccgatagccatgcccctcttgatatgccaccggctgctgctgcttctcctcttctgggtcgccgcctcccatggcgattcatctgatgatggggcttacgacccctccatgtgcctgaatcaaacttacacctgcggagaggtgaggatcagctacccgttctatctcgccggggagaccaaagatctcaagggcaacgccaactcctactgcggataccctggcctggggatcctctgcgacgacgacaagcccatcctgcagctcgacggcatcgtcaactacaccgtcaagagcgtcgacggcgcaaccgcgaccgtctctctagccgacccgaacgtcgacgacgaccgcaacacctgcccgagaccaagaatcgatcacaacatcactttgcaaaagagatcgctgctgtactttcctgacagcgcggtcgattaccttatcttcttcatcgactgcatcttcaactctaccttccaccaaccgaatagcatctacccgatcagctgccaaggctttgatgctggtcctcgtcctgggctatcgttcgtgcttccggatgatgcagtgcccgccggcaactgggtgcaagcgtgcaaccaagtcatacaattgcctgtgcacaaatacggcgagatcaactttactgaccatggatggacaaacgggagtggatatgccaatcttcttcgtcaggaattccagctgggatggaacgagagcgggaggcccactgcatgtacccagtgcgagggagccaattccaagggacggtgcggtcacagtcggaccggggatttcataggctgcttgtgccctgacggcctagtacactccgataatacttgcagtaaatcccgtcgtcaatactcgaagaaaacaacgagaatatatataatagcagtcagctcgagcatacctatgctatgtctactcttctttgcgttctggttgggctacaagaagtacggatgc

SEQ ID NO: 34985 - DNA, 792 bp, Triticum aestivum
  Clone ID: PAT_TA_34985
ggccagccccgcagagcgttgcttcctttggttgggtgggtttcgacccacggaggtcatcaaggtaatgttgaagcaagtggggtctctgtcggaggggcagctcctgggaatctacaacctccagcgctgggtgcaggagacggaggagtcgctgaaccacaccatggggaccctccagcactccctctccgacaccatcgcctccccggaggccgccgctggcaacttcatgggccacatgtcgctcgccctcaacaagatctcctccatggaagccatcgtcaggcaggcagatgggctgaggcaggagaccctgcacaagctgcacggcatgctgacggtccgacaggccgcccactgcttcgtcgccatcgccgactacttccaccgcctccgcgccgtcagcaccctctggggctgccaggccacggcacgacgagcagggcccgccggcgccgtagaagaagaccatgggcacaagcaacagcagcggtcgattgattgcgagatttagcttaatttattaaggtccagcatatgcatgcatgcacactgggagagagggtgtgcgtgcatgcacgtgtgggagttcagctctcggtcgatcagcacatgtgaaacttgcaacttaattttgtaaggtgtacatacagtgttagctgctagccagagaagaatgctagggtattagtgtggtgacttaattccaaccatttttcttcctagctaactgattttcagcaactattggataatttaagttcatctagagcacaattgagttggata

SEQ ID NO: 34986 - DNA, 901 bp, Triticum aestivum
  Clone ID: PAT_TA_34986
acaatctcttcccgccaactgggattgaggcatatattcgtcgttcctcggccttctcgggtcgtaggactgataacaagaaaagatctcttactcgaggaggatggcaataccgcgacaacagagctccagtcgaccagtgtaaggtctatattatctacttcttgcaagctgagcttttcgttctgcgccgcaatgcgcagaactgaagttagcaactctctcaatatcgcactggaaacagtgagtagattctaactcgatgctattgccatgctcgagcacataagtgttcggatacgtctcactgatcggattcactaaaccgcctgcctattgacggtggcactctatgccgcgctggatccaccggtgcttgtctagagaagcattacatcaccgaaataggctggcgacatttggatgtggtgcagcaacttgtcgattctgttttgggttgacttgggactgtttcgtctttgcagagcctacctgaacggtaaaacggcaggggggagcgcgcacctggagcgccctcttcttgacagcctgatgatcggaggagtaaatacatagcacaacatacagagcgtctcaaagataattttgatagcaagcagttaaccttattccaccgcatgtcgtgatggtacacaaaccaagcaacgcccagcgagctacagacgcaggattcttcgaggttgatgatgcaacgggaggatggccccgtgcggtggtgactaattaggcgattgtaaacaaaaaatgtttatagactcactgatgtccgtagcctatgtaaaccacgagaaaattgaaattctttcgagtaaattgcttctctgtggttgagatgatataacaaggaagatatagcaggtcggaatcatcatgtccgttg

SEQ ID NO: 34987 - DNA, 976 bp, Triticum aestivum
  unsure (1)..(976): unsure at all n locations
  Clone ID: PAT_TA_34987
gccaaactggtgatggagcaatgtgtagcccgtttagacgtggctttatttaacgccatcctccgtgaatcagagaatgagataccatctgatccaatatctgacccaattctcgactccacggttctgccaattccagctggcaacttaagctttggatcaggcgcacagctgaagaatgcggttggaagctggtccagattgttgacggatatgtttggcatggacggtgatgactctcgcaaggatggccaaggtgcagagggagatggtgatgtaagaagagatggagctgaatccaattcttttaagctgctcaatgagttgagtgatcttctcatgctcccgaaggacatgcttcttgagaagtccatcaggaaagaggtctgcccgtcgattggccttccactagtaacaaggatactctgcaacttcactccggacgaattctgccctgatcctgttcctggtttagttctggaggagctgaattctgagagcttgcttgagcgcttcacagagaaaaatctgatcagcacattcccatgcaccgctgctgccgttgcgtaccgcgccccttcatcggaggatgtagcagagaaagtggcaaacaccagtggcaccggnagaggtgcatcaaagggcctcgatggtccagaaggagggggtacaccagcgacgacgacctggatgacctaggctcccccttgatgtccctctacgatcggagctccccgccctcgccttgtgaatggggtcgcacattttcagtactcgccaagagggcgccgtggcaaatgtaagatacgagctcctaagagaagtatggtcggagcgccgtgattgagcgagcgacctgcaggacttgtttngggctgttgcttttgcgtaaaagggcgaacccaagtgttggnggggcgtgaaagattttgctttttgcatcccggcaccgaagaatcaaanaggggatgatggc

SEQ ID NO: 34988 - DNA, 1503 bp, Triticum aestivum
  Clone ID: PAT_TA_34988
agttcatactcctcataattctatagcgtccaactacccagtctctcatggatccaatagtcaaccaggggtggacctcatccgaggtagaggaggcatgctcactcattgctaggctcaacaccaacaaaatcatgtacgacgacaacgatgacaagaacaagaagcacaactacatcgtgaattctctccatgcattgttcccttcaaagaccatgaaacaggtaatagatctttatgttgatctcgccatggaaatgcatatgatccagcggagggaggggacccatgttactagtggtagcccacaaaacattttcaccttttgtgaccctgtcaacggtaactatgagctaccgagggaggagaatggtgctagcaacacacacggtctctacaccatgggtgaccatgcgaatgaaaactttggggtacgagaggaggaggcaacaatcatggacaataatggattgtcctttggttgtcctatggagaatacggggatcacggtgacgggtgaggcaccgctgatggcagacaataacaagatggaggtgttggagaacaatatttccatagaccaaccagttgttgccgcacatcaatggggtttttggaccgacgaggaacacagcatgggcggccttgttaatgaaaactttgaggcacaagaggatgaggatacaaccatggatgataatggattttcatttcgttgcggactggaggatacaagaatccggaagacggaggaggctccgatgatggtagacaagaacaagatggtggtcttggagaacaatacttccgttgatcgaccagttgttgccgcacatcaacgaaagttttggaccaaagaggaacgcaagtcatttctttatgggctggaagtctatggccgtggcgactggaaaaacatatccaagcacttcgtcaccactaagacccctgtccaagtttcaagccatgcacaaaagtttttcaagagaatacagaaaaaggcatcgtcagggacaaagcgttacagcatcaatgatgtcaggctccatgacaatgagctattggcagcaaataatagttctgtcccccggcaagccctttctttcaccggcctcaacaatgacccaagctttaggttgcaggctccgacgagctcgttaacagtcatgaacaaccaagctcagtgctccccttccatatataatcaacaagtgggtcagcagccaatgtggcgtgagcagcagatgatgggttctgctgcagctgttatgggcggggtaggaaactatgtgcctgatggccaacatgggccagcttatttttatcttggcaatgtatgaccaagatgtagtagatcgtaggcttgggccatgtttggaatgctagccaggcatgtgtcccgtgaataaacggactctcctcctaaagatggcaacatgacatgctcgccgccttgggccggcatgtggggtttatatagctctgtttttatatataaaaccc

SEQ ID NO: 34989 - DNA, 744 bp, Triticum aestivum
  Clone ID: PAT_TA_34989
acgacagaatggctcgattggtagtaacccccgtgccgaacatttcacatcataaagttgtggagcctcgctcccattttcatcacataccacaagcacggggtaccaacggtgtgtccggtgccctgtgaaaacagtcatggccgccctacctggcacgaccccgtcccaagagagagcaccaactctcccccgtcactagtaatgcgggctccaagctagtatcggtctaggtactcaataatgccctttcccatataagggtagagtggtcgcgcatgtaaggttggaataacggtcgcaactccgaccaatccgttttgaaaacaacacacacctgccttggcacaccacttcgtcatcaagtggtcacccatctcatcatctccctcgggcataagtggcacccgacggggttttcgaaaagtcctttgaaaatactttatctccatcactatgcatattcccgtccctttttgcatagcactactttagcatcctatctactcccaccggcataaccatcataagaaggtaggggcatgcacaatgcaagtatcaacgaggaagtagcagaggcgaccaaccaacatggttcaccatctcatcatgattctgatgcaacaataataagggctatatgacttgcataaaaagggtttcatagacatggtcaaatggccgcttgcctgttgtaacaaagtcttcgaggtcttcaaatatctctggcccaacttcatgcat

SEQ ID NO: 34990 - DNA, 1026 bp, Triticum aestivum
  Clone ID: PAT_TA_34990
gcacgagcacttgaggtcgcgtcctcggacacagttgacaacctgaatgctatgatcctcgacaacggggccctccctccggccccgcagcgtctgagccctgcgggcccgccgccaacgtcaaggcgaagatccaggacaaggagggcatccccccggaccagcagcgtttcatcttcgctggtaagcagcttcagaatggccgcaccctggcggactataacatccagaaggagtccacccttcacctggtgctcaggctcaggggtgggatgcagatttttgtgaagaccctcaccggcaagaccatcacacttgaggtcgagtcctcggacacaattgacaatgtgaaggctaagatccaggacaaggaaggcatccctccggaccagcaacgtctcatctttgctggcaagcagctggaggatggccgcaccctggctgactacaacatccagaaggagtccaccctccacctggtgctccgccttcgtgggggcatgcaaatctttgtcaagaccctcaccggcaagaccatcaccctggaggttgagtcctctgacaccatcgacaatgtgaaggcgaaaatccaggacaaggagggcattcccccggaccagcagcgcctgatcttcgctggtaagcagcttgaggatggccgcaccctggcggactataacatccagaaggagtccacccttcacttggtgctccgtctccgtggtggccagtaagtgcctggcaatggagcggcttctctgtgggttgggttcacaggtcttgtgtctttgatatgtcctcgaatggtgcctgtgtctgtcgtcctggtcgtttctatgtttctaccgtagtgtgatgcatcgttatgttcggttgtttttgagaattgctgctgttgtgaacagctttggtgaacttgataaataagtgagccctgaattgtgtctgcaaaaaaaaaaaaaaaaaaaaaacaaaccagctcgagactagacctcggccgcgaccacgttaatcactagtgaattc

SEQ ID NO: 34991 - DNA, 671 bp, Triticum aestivum
  Clone ID: PAT_TA_34991
tggaaagaaaccatgaatggccggacatactctgcttgtactgctgatagctgtaagtgcccggatgggttcaaaggggatggaatccacgaatgtgaagatattgatgaatgcaaggaaaggactgcatgccagtgtaaggaatgcaactgcaagaacacatggggaagttatgagtgcggctgcagcggaggcttgctgtacatgaaggagcatgacacatgcataagcaagagtacagcagcacaggtaggctggaacttcctgtgggtcgtcttcttcggcctggcggcaacaggaattgcaggatatgcagtgtacaagtatcggatccggaggtacatggattcagagatccgtgccatcatggcgcagtacatgccccttgagagtcagggagagattcccagtaatgctcaccatattgagatgtgaagaacaacgccagagcggcttatggaacgaacattttttgtctggcatgtgtgattgtagcgatcttattgtacagcatactaagacattctgtaaatttctagattaatcactcaaagtgccaagacatagcggactccttgttgcttgcgcgaggatgtttaaatcgtacagttcaaagttcaaaatcattacatacataacttcacggaaaaaaaaaaaaaaaaaaaaaaaaa

SEQ ID NO: 34992 - DNA, 1090 bp, Triticum aestivum
  Clone ID: PAT_TA_34992
ccccgaaagttcctgcccaacgccgccgctccccctccgctccgttcccggagatctcccgaaacccagcgcccaacgccgccactcctccgccgccgcgtagccggagagatgtcgaggctcgcggccgccgccctccgcggcgccctcaccgcctctggggcacgctcgtgctcgatctcagtggcattttcccctgcatcctctcgtctcttctcaaccgacgcatccggcgccgtagcgggatcacaggtcgactcatcgtccggcgaaggccatacctatggaaacttctactataatttttcttgtcccggctgtcttggacatgaacatgcttgagactgacattaaccatgacctttaccaacgtgaactggatcttgtatgatgtgaagatagaatggaataagaggtcatatccgcagggcggatgattgcatctgtctacgcttgagagactggagacaggagaacggtaaaggaccgaatgtacagtcttgagacgttggagggtgagtagtggtgactcgaaacacatttgtatgttagaatggaaatgttgtacggaggcccggaaacccttcaagttcatgagataaaacgattctaggctggttctacgtatctacctcctacattcgaaaactttaatactagatgagggctgcgagccccgaggatgtaggaatggtgaaggttaagttcgggtcgaggactgcaaccaaccgatttcttcattgctaaaacaagggttttctttctgaacaatcctgttaccatgcgggttattcagtaatctttcagggcttatcatgtggatgtctcctccctccactcaacctaggatctgaagcctattggctcatgtgatagagatgtgtacactccatccaacctgacttattactggtgttttctctctagtttttccttcgacgacattggtagccaagctcgcttgtttgttcttagttagcatgcatcactttctcacacgacagcattatcgaatcaatttaatatataaaatgttaaaacacaccactttcttgctggcttgcagctggaaaaaaaaaaaaaaaaaaaa

SEQ ID NO: 34993 - DNA, 986 bp, Triticum aestivum
  Clone ID: PAT_TA_34993
gtctgggaagtacgatatgctcattttcggcagacagatgagcttcttgccgattcggggtggcactgcagttttttgtttccggcacatcagtgattttgccttcaagatgaaagcttatagccatgtggataggattagattcaagtacttcctgaaccctgagaggattcaagatgtcatttgcagaggggcggatctttttgacatgcttcctgaagagtatacgttccaagaaatcattgcgaagttgggcaacattccaagcacattctcttgctgttcatcttcctagttatctcgcttcagaatgttgaccggtaccggtatcttctccccgggaactgcaggagagaaagtggctaggttctgtggtttactttgcaagctgttgtgcatgggtggcactgcctaagctgcttgagagtggttggctgttgcaattgcatctgatatgattggctaagttggacggttgcttgggctagtggtaatggacaagttcatgattttgtgccgtgtaatggaacattggaggatatgacagcatagcgcatgcttgatcattaccttcccagaagagctcaacggtgtatgcttaccaccagaagtcattgccattcatatttcctccctgattgatgtgtaaactcagagctgtaatggagaaatgaacactatgtgagatttcagatttatatgctgtacaagtggccttaccctgctgatgattgcatttgtacttagatgtccgggtaagtacaacttcctcatgttgcggctgtgcacaggcttgtatggtgccagtggcaaaagaaagttgcagggcaatggtggtaacccttggactgacatatggacatgtcgaaatcttggtgcttggtaatggttgtatcatctgttcagtttttcccgtgcatgttttcctgccccttgttttccaagttattgcttttgtgtcacggggtcttgtaaaagggtctggt

SEQ ID NO: 34994 - DNA, 640 bp, Triticum aestivum
  Clone ID: PAT_TA_34994
gtgatctgccatggcgagaaaggtttcttaaccgatgggcgcaagagttttcctagtggacacacgtcgtggtcttttgctggacttggatttttgtcactatacttatctggcaaaattaaggcgtttgatcgcaaaggtcatgtggcaaaactttgcatcgtgattcttcctcttcttcttgcttcgcttgttggggtttctagaatagacaactatcggcaccactgggaggatgtgcttgtcggtggcctgattggatatatcatggcagtgctgtgctatctgcacttctttcctcctccatatcaccatcaaggttggggtccctatgcgtacttccacatgctggaagagcttgaggtgcacaattcaaataatgcacaaaaccagcagtctgcaggtgagcatcatatcggattgaccggccaacaccataacgggagatcaagaaatgatttggaatctggaagtgtgtaactcacccctctgtggaaccgactagcataccttgtacagtaagcatgcgttaaaaacttttttatgtgtgcactaagcaagtattagggagtttagaactagatatgtgctatctccccctcatgtttgtgtacaaaagtcactcgctcagtatattctg

SEQ ID NO: 34995 - DNA, 1039 bp, Triticum aestivum
  Clone ID: PAT_TA_34995
tcccccacctgggcggccgcacgcgtcgtaccaaagggagggaggaaaaaggatctccactccactccgcctccccctccgccccgcacggttccaatctggttcccggcccagcaatcgaggatggggaagaaccaggcgtacaaggcgatgcagcgggcgcggctgggctcgtcctccggcgcccccggcgaaggggaggaagacggcatgacggacggttcatttcattctccagagtggcacgcggcgcgcttggccagcctcaacaagacccacaccctcacgtgggaggagttcaagaagaagcagaaggacgaggagctaaagagaggtgaggtggaggctgacaaagataaaatgatgagagagtatagagctcaactggatgctgaaagggcccaaaagcttggtcgtggaagagacgttgtaaagtcaaaatcatcatcttccaagaaagaaaagaaggaaaaggacgcaaagaaacggattaaaaagaggaggaagcacagaagttcgtcagaaagttccagctcatcagaatcatcaagtagtgatgatgaggacaggggttcaagaaaatcccgatcccgatcaagatcaaagcgaagtaagaaagataagaagcacaggtcccgatccaagcatgccggaagtgacagcgaggaggaaggccctgttcgcctctcgaaattctttgggaatgcaaagaactagatgctatatcgatacgcccaataccaatttgcttgctcctgaggtcatatcattttgaatcgtcaattggtgggtgttgattgtattctattgagatgactctcagaaggttgtgggaaccagtttctgtgttgtttctcaacagaatgtttggtaactggaggtttaggtgttgaaccattatatggtatcctgcaacttgtaagaaatgtcaaatcattgttacattgttgtacttgatggatagtgacagtattcatattcgatttgaactgctttaattcctcgaaaaaaaaaaaaaaaaaaaaaaaaaaaaaaaaaa

SEQ ID NO: 34996 - DNA, 677 bp, Triticum aestivum
  unsure (1)..(677): unsure at all n locations
  Clone ID: PAT_TA_34996
ttgaanctggaatttntgcggaaaagttaaaaantnnagttgatcttnatcagtcagaagtgacaggaatttgtcccggcttaaattgagctcctttgtgataaatgtgttggggaactgagctatcgaggcgttggtcttggcatgttgagtcctgtcggcatttgatgggtgttgtgccaangntgaagcatgttctttgttgacaaganccccctttcccttgtgaccggttgcaatattcatgngcnagcnggngtttgagggcngaattaagcccnggttaatcttntcacagantttgttgagtgttttgcaaggtgtagtatcggattggttgttcctcctgttgattcaagcattgaggcacntatatcaggaacatggaaaggaacgttttctcccagcttgactgcagatgattgagaaggaacttggtttccaagcttttaccaattttgtctctttttaggcggggagctccttgccgccgtgtaatggaatatgtcacaacttttatatacagcaatgtctagtttgcttacttaccaaagttgtgacatattcctggcacttgatcacatactcccatgatatactgctgaaaaattttttttcagtgaccatagtaatgctgttatgctgtcaaaaaaaaaaaaaaaaaaaaaaaactcgag

SEQ ID NO: 34997 - DNA, 1029 bp, Triticum aestivum
  Clone ID: PAT_TA_34997
tggtggggctgtccctcggtcaaatccttcgtcctgcggggtgctcggcccgttggccccggggtcccggtctcggcgtgccgtgagcgtcccccgctgtctcccggcctcggcgcgccctggcaggggttccccatttccactcgcgtccaccacgggctgcgctctccccgcgtgtgagcgggacgtggcagacgccgccgcggtcctcgtctgctgcatcctccacccggggggtcccggtcccgcaccatctccccgtctcgggtccgcgccccccccgccactgccgtcctccctccgtccctgtccccctccaccgagtctcgccggccccgtccccttgtgccctctgagttcactgtcctctcgtcgtgcgctccaaggcctggcgttcatcggtgagtttttttttcagtcagggcctcaaagtagatatgcaaactggaattccaagatgagcatttgaggaatgaagcatgaattttgttcagttcagttctgaaagtcgacgcaccttggaaggtggtacggtcttggacgggtatatgcaagcaccaccatgtcgaacatcctgcagagcagaaacagtcactagctgcagtgatgaataaacagagaggcgattttggatccttgtgatttgctcgtactttgctaatctctcgtggtgccggatcagccctaatccaactccatcgattcctgcaaaaccacaattactgaagacagttattccatttcttctctttcaagtggcaaggaacaacaaagtgacttgatcaatgagaaaatgtttggaagctcctccaatcatccagccatatgtagttggtaccagccacacaaaaagagagatttggcaacaagttcataggatcactagtaggggtagggcattttggagaccgagctccatggaggcctttatttagaaaaattttaaaattcaaaattttcagtttcaaaaaatctgaaagataatacacatgtatgcaaggatgtaatgtgcatgtgtaaaatttcagg

SEQ ID NO: 34998 - DNA, 732 bp, Triticum aestivum
  Clone ID: PAT_TA_34998
gcaagatcgagtgcaagcgacagcagatcgagtggtcagagcaaacggtgagcgcgcgctacgtgattggtgaaggaaatggcgaccatcaaagccaaggtccaggacgccgcctcctccgccaaggccggcatcgataaggcgaaggccaccgccggcgagaaggtaaagaaggccacgacgacggacccggagaagaagcgcgaggcggaggagaaaaaggaggaccgcatgcacaaggttaactccgacgagcgcgatgagaagggggaccacgccgccgagaggtccgggaggcgcaccatcgtcaccggcacctagttagcttctagctaggcccgactacagcatgtagtagtagcgtaacctcggttttaagcgaatcgaggaatcaaaataagcggcagtccgtcatagaatgtggttcgattcgatccttcatcttctgggcttataaatgtgatgcttcgaaaaatgcgacccgtctacatagtcctctacgatcatatatactcgaacaatctttcaccacaaacaaaatttcacacaagtctgttgtgatgatgtcttagtcgatgatgtctgcttcattgccgacgggctacgttctgtaatcgatgagacactcaaagacagagaaattccaaccagccgggtgggttggaagtttttggtcattgtgtttggtgttggtggttgcagcagggatcaacactcgtataagaagttttt

SEQ ID NO: 34999 - DNA, 652 bp, Triticum aestivum
  Clone ID: PAT_TA_34999
acatccgttgagctcccgtccgtccttcctcaaaaccctggggatggagctgagcggtgccgccggcaattaatctgctcctccgtctcctccaactccgaccacctccccctcccctctctccggcagacctcagccttagcgtcctcctgatgggtcgcacagtcaagaaggccggcaagtccaagtcgaagaagggcaagggagcgaagaaggctgatgcttcatcgtctgctaccgctgcggtggcttctggtccggcaaaggtgtggcaaccaggtgtagatgcactggaggagggagaggagctccagtttgatcccgaggcttacaactatctccgaggatttagtattggctggccttgcttgagctttgatgttgtgcaagatcaacttgggcttgtccgatcagagttcccacacacattatatggcgttgctggaactcaggctgaaaaggctccatggaattatattggcgttttcaagctttccaacataaacgggaagaagcgagaacctataccatcttcaaaagttgatgctgacagtgatatggatagtgacagcagcagtgatgaagaagaaaaggaggaaactaatgaggatacaaagcccattctacatctaaaaaaggtggcccatgcggg

SEQ ID NO: 35000 - DNA, 1884 bp, Triticum aestivum
  unsure (1)..(1884): unsure at all n locations
  Clone ID: PAT_TA_35000
gnggggtagctcgggacccccgtcgcggttccnaagtgtactcctggtgtatcaagcgtgggggcgccgcccgccggctcctccgtctcctccaactccgaccacctccccctcccttatctccggcagagccaattaatctgcgcctccgtctcgttcacctccgccagccaccccgggaagtcctaatcgaaagcgtcctcgtgatggaagacggcttatacttcatcggctggtacaggtcgggtagcttctggggaggcaagggtgctgaagctacatgttctgctgccgctgcggggactgctggtccggcttgggcgtggcacccaggagtatatgcacgggtgtagggagaggaggcccagtttgatccttgatcttacgcctatttacgtggatttagtattggctggccttgcttgagctttgatggtgtgcaagatcaacttgggcttgtccgatcagagttcccacacacattatatggcgttgctggaactcaacctgaaaaggctccatggaattatattggcgtattcaaactttgccacataaacgggaagtaacgggaacctataccatcatcaaaagttgatgctgacagtgatatggaaagtgacagcagcagtgatgaaggtggcccatgcggggcttgtgaggataaaaagcccatcctacatccaacaacagtggcccatgctgggtgtgtaaacaggatacgctcaatgactcaacaaccacacatatgtgctacatggggagacacaggtcatgttcaggtttgggacttcaaatccttccttaactcagtagcagattcagggccagttgcacacaaagaagacgacataatccataatcatgtacctttgaaaatattcaatggccataaagatgaaggatatgcaattgattggagtccacttgttactggaagacttgtttctggtgattgcaacagttgcattcatctctgggaaccatcttcgagcacttgggacgtagatacaaaaccatttgttggacactccgcaagcgttgaagatctacagtggagtcccacagaaggcgacgtatttgcctcttgttcagtggatggaaagatatgtatttgggatgttaggacagagaagaaaccctgtatgtctattaaggctcacaatgctgatgttaacgttatctcctggaatcggctagctagctgtatgatagcttcaggatgtgatgatggcagtttctcaattcgtgatcttagatttatcaaggatgacggcgcagtggtagcgcatttcgagtaccacaagcacccaattacatctgtggaatggagtccacatgaagcatcaactttggctgtatcatctgctgatcatcaactcacaatttgggatctttcattggaaaaagatgcagaagaggaagctgaattcagagcaaagatgaaagagcaggcaaatgctcctgaagatttgcccccgcaacttctctttgttcaccagggccagaaagatttgaaagaattgcactggcacccacaaatacctggaatgatcgtgtcgactgcagcggatggcttcaacgtgctgatgcccagcaacatagacacaaccatagccggggcagacaaacctactttggcgccacttggctaatgcaaggcttatgaaatatctgaatatccttctaggctaaggacaatactgcgagtatctatctgttttcagtatcctgtattttatgtttctctgttttgtgaagacgaccgtctcagtttcatgtaatagatagtggataattagtcatcctggatgatactcacccaattacctgatccagatgctctacttttgacgccaaaacggaaaaaaataaaagttcaat

SEQ ID NO: 35001 - DNA, 1009 bp, Triticum aestivum
  Clone ID: PAT_TA_35001
attcggcacgaggcaaatccccaaaccctaaccacagcacctacctcctccgccgccgccgccatggcaggagcaggagtcggcggccgcaaggctcgcaactttgcgacctttcgcctattcccccgcgacggtgccgccgaccccaacgaccgcgtcttcgtccgcgtcgacaacaacgcctacaccatccccggcttcggcgacgacgaagacccttccctctcgcccaccgccgccgccgaccaattcccttcctccacctctgggcccctccccgaccacgtccgccaagcagatccttgagctcggcctccccgacgatggctacaactaccttctccatctccgcgagctgcggccctccgctgtggcctcctccttcgtacccagccataccgcccgcccagagcaacttcccctgggacgtgaaggcctaatgatgcaaagcaaaggtggcgggttgcttctggcaaggtcgaggaagagttggacgaggggaggaccatgtgtaaggtggccgcaaagacggcaccggtgaggcgagttgagaaggccgtcgaccctgacgttgcaaggttgctcgatgagagcgaggatgagggtttggaggaggatttcgtcataatggcaaaccaagccgaaggggatgatatggaggatgaaggtgaggaagaggggggtgggtgtgttcagtgatgtggaaaatgatgaggagttcgaggatgaagagggcagcaacaaccatttccaccacaacaaccatatccacagccgcaaccatttccatcacaactaccatatctgcagctgcaaccatttccgcagccgcaactaccatattcacagccacaaccatttcgaccacaacaaccatatccacaaccgcaaccacagtattcgcaaccacaacaaccaatttcacagctgcagcagcagcagcagcagcagcaacaacaacgacaacaacaacaacaaatccttcaacaattcttgcaaccagctggtc

SEQ ID NO: 35002 - DNA, 643 bp, Triticum aestivum
  Clone ID: PAT_TA_35002
cccaaataaggatttagcagacccttctaccgccaggaattttatgcctggccgcatgtttattctgattaccgaatcctgcggcagccacaaccttatggatttgacaatcagttttatcagataaatagggatacctgtttccccattgagagaagagttcagttccccttgaagatgctccctcaaggttaccctcatgatgcacaacttcaggaatttcaatattttgtggttattgactttgaagcaacctgtgacaaggagaataacccacatccacaagagatcattgagtttccatctgtcttggttaacagtgcaacgggacaattagaagcttcctttcaaacatatgttcgaccagcatatcatcaaaatttgactgacttctgcaaggagcttactggtatacaacagattcaggaggacagaggtgtacctctgagtgctttctcaaccaatactggatgataaatgggaaaaaaggaacctgaatccacaagcacttctggtccaattgtctccaaaagaaaatagtgccaaaccccacgatcgatctggcggcagctggagctggaaaggggcaccggccttttcagtggagcactgggccttcgacttgactggctacataaattta

SEQ ID NO: 35003 - DNA, 1174 bp, Triticum aestivum
  Clone ID: PAT_TA_35003
gaattcggcacggcccccggtggatcccgcccgtcgccgccgccggcccttgttggtgctgccccggcagttgcaacttcgaatagcgctgccaccaccgcctcctccctccccgccagtcccggcgcctgcggcaagcgctcctgggcagctccctccacccacctcctgccgtcagatcccctcgctgtagcagctgattggcagtgaacggggcaagatgtctggcggaaatcctgcaggcgtggataacactttccgtaggaaatttgacaaggaggagtacttggagcgagctcgacagagagagcgggatgagaaggatgaagcccggagaggcaaggataggggccctcctgtgcaaagacagcctttgaagcatagggattatgaagttgatcttgagtctcgtcttggcaaaacccaggtggtaaccccaatcgcacctttgagtcagcaggctggatactactgttcagtatgtgagtgtgttgttaaagattcagccaactatttggatcatataaatggcaagaagcatcagagagcattgggcatgtctatgcgtgttgaaagggcgtcactcgaacaggttcaaaaacggtttgaggcacttaagaagaggaaggacccagccagcttcagtgaacaagatttggatgagagaatatggaaacagcagcaagaggaggaggagaagaagcgtcagcgcagagaaaagaagaaagaaaagaagaaagagcaggctggccagaatgaacctgaggacattgaccctgatgttgctgctatgatgggcttcggcgggttcggcacctcttcaaagaagtgaaaattgctgcttcaggtggcgccattccgttggtctgtggctgctgaagacgtcgccgtggctctgtgcacctggatctcagcataggtcagacacagctctgatgcagtgttgcgattagtgtactggagcttgttgcaaccgctacctgataatgtcagcgaaacgatacttgatgctggaacaattcagcttctgtaatcggtgaccggtgatcatttgagaagcatttcatctttgagaaatgagacgactaattcgtctagatgctgctgtatcatttgaggggcattttatctttgagaaatgagataactaattcgtttagcctgccagaaaagc

SEQ ID NO: 35004 - DNA, 836 bp, Triticum aestivum
  Clone ID: PAT_TA_35004
ttcgcgggtcgactaggcaagttatttttagggattccgccaccgctagagtaccttgctctgcaattaagagggggtcagatgtggattgaacctgttgccattcgcagccagcttaatcatctcaagaaactgttcattgcaaacgtggcaatgaactggggtacattctggattctcaccctacttgctgccgcacctgccttggagtcgctccatgttcattttgactcagagaaggcgagtgcttcagtattactagatgtgcaagcggaacaccatcagcaccactatcacctgaaagaactcatggtcgttggcttcaacggggtggcatggcagacgggctttgtgaagcggatcatgcaggcatcgccgatcctggagcatgtccacctgctggacgggcacgtcgtggaggatgaagaacgggaactcgtcggcctggagatcgtccgccgccgccgggagtggcacgagtgcgagagattggaggtgctcgacgaactgacagacgggatcagttcgctgcatcccaaaatagttttggaatgacttttggtagaagtgttgctgtgccggtggccttccgttctgtaggacttgtaggtgtatgccagggcctaatgattatgttatgctggcttggaagaaagaacatgtgtttgtattgggtatcttgtgctttacttttgctcgattatccaaaggattgatgtagctgttgagatgattgattccgtggctgctcatgatgtggcttgaaatcaccaattgtacgcctaaaagatatttttcctttgcctttttgaaagaaccaaaaagttcacaagaaa

SEQ ID NO: 35005 - DNA, 1594 bp, Triticum aestivum
  unsure (1)..(1594): unsure at all n locations
  Clone ID: PAT_TA_35005
tgaacctcatggacatgtttcttggtcagagtttcagtatgttgttgatgactatggagacattttctttcaagtacctgatgatgggaacatcttggaagatgatgatgcaaacaaccctgtgacagttttgatcggaacggatggtgccattatcggtgaaactagtgcggtaactagtgatttcagcgaccacgtggtcgttgaggattctatggacatgcatgataacgacagcaaggttgacacagaaataacggatattcttatagagtggggaatgccagtgacgatgcgttcaatacatcctatatattttgccaagtgtttgacaaaggctgttcatgataatcatggggagaagattgataatccatcaaacggtgtatctattgtaggatacctgagacctgcttttatagaagaagagtcttatttgaggagtttatttggtgctgaatgcagtgccgatggttattcatctaatggnagaggtgcttctcagcttgctcatagttgcttttatcactcatgtgcttctatccangttatttgttctaatgagagtcaacctaacagaggaatacaacagagaaccccagccagcttctggaaccaatggcctaattgatggtgataaatcgagatcggacatcaacatacggaaagtagcattgattcaaccatctacagctggaaatgatgtcaattgagctgttttctgtctatggtaagcaggtaaagcatccctcttcagcccaatgctttcagttgacaagtaaaggatacttcaatcgatgtattactttgtaaagtgaaaatggtaaataatcagcatcatttttcttggccggcaccagatcatgttgattgttgcagtttatgattgatccacaagactttcaagatgcagaaccagatcttctttcaaatcatgcttcagacattataaaacgcgtcaaagaaaacagtgatcagtgtaccatggctctaaggtccctctgtagccggaaaaaaggccttacagtagaggtgtgtttctgttcagtaatgctttactcaggttcgatactccttagtgggttattgtgcatgatgaataggaaaattcttaccatcaactgaactttggagttgcactatcatactatacctgaaatttattcctgaaaaaataaagattcctcaaaaatacggtgcctgaaatttaatcctggtgatatgtgtgaacttgcatatatttgaactatcatacttcacctgaaatttaatcctgataatatgcatgaatttacatctagtggaactatcatactttacctgaaatttaatcctggtaatatgtgtgaatttacatctactacaatatctgaaactaatcattcttatgtacaagaagctctgctttgcctataaacttaatacttcagtgtagaaaatggcatcaacagacattttctccttgtttatattttgtgagattataacagtacctttccgtatgttggttgtgacagtgctgtttctaccttgatgacacgatttgattttctcatagagctcagtcttattcattttgcaggatgcaagtttg

SEQ ID NO: 35006 - DNA, 1081 bp, Triticum aestivum
  Clone ID: PAT_TA_35006
cagactacagaggcagcgaagaagagggcggacaaggcggcggcggtgatccgaagccaaatcgaagcgagctctgcatatgcgcccggcacatggcggcttcctcgctgtgggacgagctggtggtggcggcgtcgacgggggggagcagcggcaccgtggtgtccatttgcgtgttcacggcggtgctctgcctctgcctcgtcgccggccacctcctcgaggagaacaaatgggtcaacgagtccatcaccgcgctcatcatcgggtgcattgttggggctctcatctttctgctgagcaagggcaggaactcgcacatcctgaggttcgatgagcagctcttcttcatctacgttcttcctccgataatctgcaacgccgggttccaggtcaagaagaagcagttcttccataacttcctcaccatcatgtcctttggggtattcggggttttcatctcggtcgcaatagtttccgcaggtttctactggctccttccaaaagttggttttggcaaacttgacgcggtggattatctagcactgggagtcatattctcttcgacagatactgtgtgcacgctgcaggtcataagccaagatgagacaccgaggttgtacagcttggtcttcggagaaggagttgtcaatgatgcaacgtctgtggtcctattcaatgctataaagaatatggatatcactaagatcaaaagcggggcggtgctaaaagttatcggagatttcctctatctttttgcaactagaactatccttggcgccacaatcggactgttcactgcttatgttctcaaagcactgtattttggcaggcactcgactgaccgagaggtcgctttaatggctctcatggcttatttatcgtatatgttagcagagttgttaagtctgagtgggattttgactgttttcttttgcggcatcgtcatgtcccactatgcatggcataatgtaacagagagctcccgaatcacgacaaggcacatatttgcgacactatcattcatcgctgagacctttatctttctttatgttggaatggatgcccttgacatggataa

SEQ ID NO: 35007 - DNA, 969 bp, Triticum aestivum
  unsure (1)..(969): unsure at all n locations
  Clone ID: PAT_TA_35007
gtacaaatctaccagtgcaagatacattacttgtcaaaggtattcggaaggcttggacatccttcagtcaggagctacaatccagttgaagcatggacagataacttgcggtgctgaactcgctgtgctgttcgtggacactcttgtcaaagggcaatgtccttataatgaagaaactttttgatcgtgtcagaaagatatacngaggcgttccccaggataaatatgccccatttccttggagatgattatgacgatgatgggcagaaattatccgaagctatttctgctgcaaaagtgcgttctgnaaggttgttcatcatttctaagagcagctctcaggtggtctgcnggagtttgggacatcaagaaacggatctcctgatctngcatgttatgttgggtgaatacatttattccgaatctccagaaacggacatgactaaagtatcaagtcattttgtgcgcggtaacgatcctaaaaaatttgcttctatgctggtaaactttatgggcaagtgctaccctggtgaagatgatactgcaattgcacgcagtgtcctaatgtatctatcactagggaatctcagagacgcaaatttacttatggatgggatgaaggagcagctaaaatctgctgacatggaacttccaaaaacagctttaattgagtttatcaagtatcttcttcaaacgcttgaaagagatgcttaccctctttttaggacacttcgacaaaagtacagcgcaagtacagatcgagactctgtatttgaggagttattggatgaaatagctgcaaaattttatggcgtacggcaacagaatcctctggaaggacttttcggtgaaatgttcaaggtgtaattgacttgaaacgaactttatcatcatgtccttgccttcaatgcaatgattggttttcagctaaaaaaaggcatccattggccaaaataatacatttgtggg

SEQ ID NO: 35008 - DNA, 805 bp, Triticum aestivum
  unsure (1)..(805): unsure at all n locations
  Clone ID: PAT_TA_35008
aggggaaagaaggggcctgtgaagagctctcgtcatgactctaaagatgagaagcccagaagaagcaagtacaaggatgattcgtacagtgactcggagagtgatgtctcgcacagtgattcagagagcgactatgatcgaaaaaagaaaaaatcctctcaccacggttctaaagatgataaacaggcaccaaaaagcaaagagaaggaagccagtttggttaagaatgttgataagcgcaagagacatgattctgattcggatggttctgctcatgataggaaaatacaccttgatgcagctgttgctaggaaggatcattcccgtgataaaccgacgattgacccaagcagtgatgaatataaaaacaaaaggcctgtgaagacttctcgccatgactctgaagatgagaagccacacggcaaggtccctcggaaggaaaagtatgccgaatcagagactgactcagagaggtataccagtgaaaagatgaaagccgtgagaacaggaaatctgacagaggattgaagaatggtaatggtcagaaccatgctaaaagggcttcttacaagaatgagttagaggaaaggaaaaagggtcaagatgggagaaggaaggaagagagaatggagcaggagaaacaaaaacagagggaggaagagaggaaagagttggagaagcaccaaaacatagagagaaggaagggaagactagtagtaaaaatgttgataagcgcacgaggcatgattctgattctgattctgattncgatggatggcanagacaccctgacacaaggtaaaaa

SEQ ID NO: 35009 - DNA, 1008 bp, Triticum aestivum
  unsure (1)..(1008): unsure at all n locations
  Clone ID: PAT_TA_35009
gnaaaaaaccaggacaaatgtaagagacctgtacacaaggatctgggtttctctacgagcagcagaatcgagatctgatagactacaaaaattacaggacggggagctcagtgtgaagaacaagactcaggttagtttggtgttctttcatgtgttgagacctcagctcagcaacgaccagttttctgcagtattactcactgctctcttcacttttttttttgaattgaatgcctgccagtgtttctcctgcttgcgctggctaaaaaactaatcaacttagttgcatgttgaactgtaatttcgtggattgcctttggtggtgatgcattgtgttttgtcctcttagtatgcaaagttaagtgcaccgtcacgtaatatatgagtaattaaccatggtttaggaagtttcaagaggttcagaaagcttatgaggaacttgatttttgttcaacgtggatgctcatatatacatttttgtctcttctctgtatactttgaagaatgaagaaaaagaacgctctatgattaggtaacaatttaatccctccgattatagacgtctatggccgtttctttctatatgttcatgagttacaaagaattaatttattgaaacttaagataattagacaacaatacattttgagtatattttggataggataaaggaggagattaattccatttcttgtatcaatggaatgatgtacggaaaagccgtctttccggtatttgtgttttggaaatgccctcttacatgttatttcacttttagtccaacatgtagctgctcgtgatcgatgcgcttactattactgtttttcgtgttcgcttctctcacaaaataggggttgcaagtttgagtaccttctcaaagtatgctactgaatctatctatggtaagtctgcaacctagaatttgctcctgcctactacatttacaatggtttcatcaagaataattatgccctacgtggtacaatgcccttacactttcagatttag

SEQ ID NO: 35010 - DNA, 1600 bp, Triticum aestivum
  Clone ID: PAT_TA_35010
agccccggccccagtcacaaagctccttccttttcctcgcgcccgccttctcctcccctggaatccggtctctgttcccctgtacagtcggagcggcgtggaacagggttgttggatctgaccgagagaaggagggggcgactgcctctccgacctcgcgccgccaagcccaggcagatgctgcccaccggcagcagcaggcctcagcacagccctgcgccgagatctagctccttctcactcagggacctctttgttccgacgcgcacccacagccacgtccgtcagatcatcatggcagcgcccctcacggccatgtgcttcgtgttgctcacccagccgccctcccataggaagactcccggcgtgtgctcgatccctgtacttggagtagcgcatatgttggtgatgggtggccgctggctacatagaaacgcacgcagctcttcgactgctcaaagactccttcagagtcaccattgtggataatctttcaagatcaagaattgggggcggtcaaggttcttcagaacttgtttcctgatcctggacgattgcagttcatacatgctgatttaggcgatccaatagctgtgaacagaatattcgcagagaatgcatttgatgccgtcatgcacttcgctgccgtcgcgtatgtgggctgagagcacgcttgagcctctgaggtactatcataacatccatgatgtcaaaaccctgatctactctagcacatgtgccacctacggggaacccgagaagatgcctatcactgaagaaactccccagtttcctataaacccatatggcaaggccaagaaaatggcagaggatatcattttggacttctccaagttgaggaaatcagacatgtcggtgatgatcctgagatacttcaacgtcatcggttctgaccccgaaggaaggctgggtgaggctccaccacccgaactgcgtgagcatggccgtatatccggtgcatgcttcgacgcggcactaggaataatcccaggtttgaaggtcaaaggtaccgactacgaaacggctgacgggacttgcgtaagagattacattgatgtcaccgacctggtcgatgcccacgtggaaagcgctcaacaaggcacggggaggcaacctggcagaaacagctcagccacccggagagaggcaaagttggcgtagacagtggtggcttcggaggaggcaactcggtgaaggagtttgtgtaggcttgcaagatggcggacccggtgactacgcggaagtgtacagcttccctcgccgccccggtgactagctgaaagtgtcaagcaaccacaccgaactgcaggagagcctcagggtcgcctggacatggcagaagaagcaccggagtggctatgtagcgtcgggatggcatattttttgccgcgctggctatgcagactcgggcagatattttatttggcgcgtatcgcagagatagcagttacacataatttatatagcgtgtatggtcatttgttcaattcctgtgattttattatattttgatgtgggaagttcaccagttggttataaatatcgatatgttctttcactgaaaaaaaaaaaaaaaaaa

SEQ ID NO: 35011 - DNA, 1179 bp, Triticum aestivum
  Clone ID: PAT_TA_35011
gtctcaaatcgtgtgaataagttacaggagcttcagggtgaagatcaggaaaggcttgcttggatactatcctatatcacacatctcctgtcgttgttggcgcgcaacagctccatgtccaagcagaaaagaaaagaaaaagaccagaccatccgtggaccaatgatcccacaggctgtgcaccgcaagctgttgctgatgttcacggagccagggtcttcttccttgtcgacagagaaacacgagcttctggtcaattacattttagtactcacactttttgctgatgacttcagatctgaacctacggatatatgtgtggacctgaaaatgaaccgccagatgcttaaaccatattatgaccagctgggatgcaagtcggtgtcaacaggtgcttttaaaccattttttatgacgcttccagcacccctcaagttcccacaacaagtcacaaggagaaggcggcgaaaataaccatctcagtattggtttccatttgatatggttgtgataggaaaggtatgcattgccaccgtcgaaagaacctatgtgccctcagctcagtttcaccaatgtagtggagaaaatgatgacagtggttgttctgtttttgttttctattgtcgcttgggaattgctacaagagaggaaccatattacggagatcacggagccagggtcttcttccttgtcgacagagaagcacgagcttctggtcaattacattttagtactcacactttttgctgatgacttcagatctgaacctacggatatatgtgcggacttgaaaatgaaccgccagatgcttaaaccatattatgaccagctgggatgcaagtccgtgtcaacaggtgcttttaaaccattttttatgacacttccagcacccctcaagttcccacaacaagtcacaaggagaaggcggcgaaaataaccatcttagttattggtttccatttgatatggttgtgataggaaaggtatgcattgccaccgtcgaacctatgtgccctcagctcagtttcaccaatgtagtggagaaaatgatgaaggtggttgttctgtttttgttttctattgtcacttgggaattgctacgagaggaaccatattactgatatataatttgcttgctaccgaaatttgttttttgatgctacatttggtataccacct

SEQ ID NO: 35012 - DNA, 558 bp, Triticum aestivum
  unsure (1)..(558): unsure at all n locations
  Clone ID: PAT_TA_35012
aantggtcccattccttcccatgtttttgtcagaactttgatcatgtgcatattgagtttatgtgttgattggatgtctttgagnacagtgctgctttttggttgtgctgcacttactcatgatgcacaaggatggagacagagacgacccattgcnaccgccgttgagcacgaggctttcccattctccaggctcccttcgtcacccatagatgccgtacccagactgaccagtcgacctgacatttcatttttcgtgccccccggtgcttctaacatcgttccaatgcaagcgcaaccctgccatgccgcggagcaattcatgtcagcatccttgatcttattctatatacatagtgttcctttaggctttaggggaaaaagctcatgcagtgtaaccgtcagattcagatgggtagtagtaccgctgctgttacggtgcttgctggttcagttctggtttagcgaggctgccagcactcttagatgtaaaaatctagttgccagattaagtttttttttcctttgtccaacgaaattaagcactagagaataaaa

SEQ ID NO: 35013 - DNA, 357 bp, Triticum aestivum
  unsure (1)..(357): unsure at all n locations
  Clone ID: PAT_TA_35013
cccacgcgtccgagaagctcaatgcccacgtcccctcgctggtccctgctcgacggccctatccatggtaattcagtcaactatctgcacttgtaattaagaagaccaagaagtggacatggatctgaatggagaagaggatgaggatggcgaatgacttgtgcatcttccatgatcagaactagatctgtttatttttctgtgatggtcatggtctgacttgtatgattggctggtagtttttgtttgcatggttacatggttaaatattgtacagatggactagttgtagtctatatatgttgtgtcatcctgattgtttttgtttgcatggttgaatattgtccggatgcanna

SEQ ID NO: 35014 - DNA, 552 bp, Triticum aestivum
  Clone ID: PAT_TA_35014
ccttctccggcgagggcggctggcacttccctggcggcggcgcgcggctaacgccggtggccggatggagaggcaaatccaggctcaccgtcaccggatgccgccgctcccctagccccatcttcccctgctggtctttgagggagcagccagcacaacggccacctcgtcgctcttgctcgacgactttccctgttggacgattggccggtgcgggacaacacggcaagccggcgggcagtacctcgctggtccctgttcgacgccctactagtcgacgtcccaatgcagcccgtccgcacctcctcgcttgacgactacttctgtccgtcaactaacctttttctgttatttgtttatactcatcgattcatagtatctcctgtagctcagcttctctgatcgatgcacttacagagttactgtactaggcttagtctattcgatgcacttaccctttttccgatcgatgcacttgcagagttacagttagtctatttgatgcatagctttagtagtcagtacttagcacttgcagttacagtagacaaa

SEQ ID NO: 35015 - DNA, 874 bp, Triticum aestivum
  Clone ID: PAT_TA_35015
cttgttattgtattaaagcaaatttgtcattctcagccaagattgtcaacaagtgtgcattagcaagctgagatttcagtttcacttcctcttagaaactgtgatatctttctgttattttcagatctgcttgctctgcatggagcgagagcatagtctgaagaacttctctgatgaaggtgatgggcttcaaaaaaattctgctataactgtggtgaatctgccgtttgaaattacagggccatggactccaatttgcagtgacgaagtttatatcatgtttgtgctcagtctgttatttccctttatcaaacacatggatctacagcacactaatggcaagtttggattcacggcgtttgcggcatccgcactttaacttcttgctggatttggtgggcaacgatgtcatttgatgtagaactgagcttgaacgccgatgctgcctctgcctgctcaagacactggcaaagtcgcgtggccgaacgcagtcccaacaggtggctgcactacgacaagcgggaatggcgatgaccgctacatcttccgcggctaccgtgagaggttgtgggctgcgtcgagggctctactgcgatggcgatctgatgatgaagcagatgaggagctgctcgagcaggatgatgaaggcgagcatcggcacgatggggttggcggagcgtgcagatgaagctgcagcggcaagtctcgtggctgaaatacaacgacatagagtggagcatctggtagatacatcgtctttagattgcttgtttatttgctgagtttgattcacttttggacaaccatcgcatgtaatgcatcttctaaccaggtatataacctgctgccaccccctaaaaaaaaaaaaaaaaaa

SEQ ID NO: 35016 - DNA, 640 bp, Triticum aestivum
  unsure (1)..(640): unsure at all n locations
  Clone ID: PAT_TA_35016
atctgatcaaggaggtgaagagatgggtgcccaacctgtacatcaacaacagcgactacatttgctgcttctacgttgaccgtagtggcgtacccactgttactgcagagaagcgtggcgatggtcaccctgaggcacgtgccaaggtttttgtgattgctaaaggtcctcagaaatttctaaaagctcatgggctgcagcaatggtggatggatgattccgagctccatctggctgtgaatgagagcaagctcatgtataagcacctcaagtccctgtatgtgaaagaaacgtagcgaaaccaatatcattgtgatctctgtctcctgttgtctcctgttctgtagccaagtaaacttttaaagctctcatgaagctatccagttcctgcaaaccttttagtcagttaactcgtatccaaattaactgtcagtatgaaatgtgagtattacattatctactactaccttctgaaggatnangcgttcctactgttgtgttgctttgcctcctggcaagacatcgaantaaccttatccctggaaccagaaaacatatgatatatatcaagaaccatanncaaggaatgtntaatgttanaaaaaaanaaanaaaaaccanggggggcccggtaccaatt

SEQ ID NO: 35017 - DNA, 1659 bp, Triticum aestivum
  Clone ID: PAT_TA_35017
tcccgcagcccggccccgtcgcctccgtcccggcttggcttcttccacccgtacccgtagattgatttccatccgggtcccttccgttccacggcaagtatccgtcgcacgattcaggcccacccctcgacgtcgtccatggcgctgcagtacgtggaggcgcagcggcaggcgcggccggacctcgccgactggtacgccgacctcgccgacctctaccagcgcaagctctggcaccagctcaccctcaagctcgaccaattcctccagatcccggccgcacagactggcgacacgctcatacagctctacaacaatttcatctccgatttcgaaacaaaaatcaatttgctcaaactcgcccagttcgcggtcatagggtcgcgccaatatcccgacaaggatgccgccatcaccttcctcgagggggataatcacaaagcttcgtgagaccagggagctgcggatcaatgagcctatccttcacgtcaagatgcagatcgcggcaattcacctcgacaaaggggaaccacaaggagtgcaagaacctgctggaggaagggaagaccaccctggatggcatgactgatgtggatccaacagtccacgctagcttctactggatatcgtctcagtaccatcagtcctaccaagcctttgctgcgttctataagtcctcaaagctgtacttggcatacgcacctttcgttgcagccttgctaggcgtccaaggcgacaacttcggggaattgttagcttaccctattatcaatagtattattggtaccaatgtggagtgggtctatcacacgttacaatgctatcagcattggcaaccgagctctctaccatctaccttgtggggtgcacgatgctgatcttagtccacagcctgcattggctgcagaatgaacagaaactgcttgagaagatcaatattctgtgtctgatggagataatcttcagccggcccatcagaagatagaactatcccattaagtgttattgccaagcagactaagctttcaaccagcgaagtggaatgtcttcttatgaagagcctctcggttcatctcatagaaggaatcatcgatgaagtcgacagcacggttcatgtttcgtgggtccagcctagagtacttggcatcccacaggtgaaggcgttgcgtgagcgcctggactcgtgggtcggcaaagtgcataccacactgttgtccatcgaggcagagacccccgatctcgtggcggcttagcttgttggccaaaaatgattctgaataggctttggttgtcagcaaggcggcggtgtaaaacgagagaccatctggctgtgctgcgcgtgctagctgctcttttcttgataacgaaaacttgttgccttgggtgtcctattggtctggacttgtaacttccttctatcatcacggatcgaaacagagaaatcataccggcagagggtgtcactagttttttcctgttgaactttataatctgtaatccagcggtttgacatttcttcttcttccattgtgctatcgacatggacacgcaggaaaatcttgctcattttcttatgtttgtgccagacaatgaagccttttcaattctggctgcgtacggtttctaaccatacaacgcatgggcctcgtttttaattgc

SEQ ID NO: 35018 - DNA, 623 bp, Triticum aestivum
  unsure (1)..(623): unsure at all n locations
  Clone ID: PAT_TA_35018
ggcggccccggtcccgtcctccgtggcggcgtgctcgaccgtcggcggggcgctgtggcgaggcggtgttcgtgtggcgaggacgggaggaagaggggtgagggcggaggcggcctacttctgggacgcgtcggtgccggtggagatgggcgagatcgacagcatggacaagctcgacgccgcgctcgcctcctccgccgagcaaaaccagcccatcatcatcgactggatggccagctggtgccggaaatgcatttacctcaagcccaagctggagaagatagcaggagaatttccaggagtcaggttctactttgtggatgtcaataaagttccacaggccgtggtgaaaagagggaatataagcaaaatgcccacaattcagttgtggaaggatggagaatggaaggaggaagtgataggaggccacaaagcgtggctggtgatggatgaggttagagagatgatccacaagtacaagtgactgattacatactcattatactgtatatagaggttggagatgatctcctcggacactgtaacccgatcaataaaactatattccagctccttaatacagcagagctaaaaaatgcaaaaaaaaaannnnnanannaaaa

SEQ ID NO: 35019 - DNA, 844 bp, Triticum aestivum
  Clone ID: PAT_TA_35019
ccgtccattactactacacctctcaacatctgctctttggttccacagcttccttcgacaccttcgtccagaaactctcgcggacatggcggccgggaagcgcaccatcggcctcgcgatggactactcgccgtccagcaaggcggcgatgaggtgggtggtcgagaacctggtgaaggccggcgacaggatcatcctcatccacgtcctacccaagggagcagacgccagccacaaggggctctggaagagcaccggttcacctctgatccccctgctggagttcatggagatgaacgtgcaggcgcggtacggggtcaatcccgacaaggaggtgctggagatcctgcaggctgagtccaagtccaagcaggtggaaatactagcaaaaatatactggggtgatgcaagggagaaactttgtgaggcagtagatgatctcaaggtcgactctgttgtgcttggttgcaggggattagggcccttaaaaagggcactccttggaagcgtcagcaattatgtcgtcaacaatgcaacctgccccgtcacagtggtgcgtggacccaatggatcacttgcttgaagatgtcgcttctagaatgatggcctagtttgcgtgttcattggtccgtcggcgtacgggcaaatggtgctatttaagacaatagtgatattttgccttttcggaacctttgctatccttgtagtgcaatctcagtgtgttctcctctgttatctcttggttatactacatttctgttgtttcttacatactatttgaaaaaaaatgcctacagacttgttcagtgggcattttcgtttaaaaaaaaaaaaaaaaaaaaaa

SEQ ID NO: 35020 - DNA, 902 bp, Triticum aestivum
  Clone ID: PAT_TA_35020
caaagcgaggccaagccactaacagccacagccttgcggaaagactgaggaggaaaaagataagtgagagaatgaagcttcttcaggatcttgttccagggtgtaataagattactggcaaggccgtcatgcttgatgagataatcaattacgtgcagtcattacaacgacaagttgagttcttgtcaatgaaacttgcaactgtgaaccctgagcttggctttgatattgagcagattctatccaaacaagtgatgctttctcaggacaggcgccttggtttctatggagctgacccaggatcaagcgccctcattgctcatttcaaccaaggaatgatgcatccagacatgatgtgcaatgcttccaatccagcgggtgctctgcacggaacaattcacgacatctccatgatgaaccagatgcctgagatgtgggagactcttcagaacattcctcatataaacttcaaaccctgctgtggctgcggacagcagcaccaacaatgctggtcccatgaagattgaacagtgagttgctggtatgattctggagttgttctgtgaaccgtaaagcgcttgcagaatcaagttttgtatagatggatgcctaaccattagttaccggtttcctccccttgctgcccgaccccatagcgtacggtttatggtatggcatcgaaggatctcgtgtacagctgggctcaagaactgctgattccaccgtaaatttctattgcgttagctcgtcgaaagcaggaaccccgtgttatttatgaatttcaagcttgggatcaattgtggatgccctaagcgtactaagtagactggcttattagtattgccgtaagtagtgaaggacttttgttaagagtttcagagtttcataaatcatgccgtaag

SEQ ID NO: 35021 - DNA, 561 bp, Triticum aestivum
  unsure (1)..(561): unsure at all n locations
  Clone ID: PAT_TA_35021
aattccattatatttaacaataccacatgtactcntggtgaacaggttatgggcaagattcataggctggtcaagatttgggcgatcttgtcgacaaatcaagggaagaaaagtctggaggactttgcaaccttcctggaggtgaaaatgaggactccattggccatcagaagtggctgagctaggacaaactgaagatcacgaatgcagaacaagtgaaccatgactccccctactccttgcaagatggttgcaggaagtgtggtggtcagcccggcctcggtgctggaccccaagtgatctccgcagccttcaacagctatgccgatgaagttcaggagggatttctgtgagctcgacatgtttggcccctgaagctatccagctcccccttagccccagttttgttaaggatgaaaaagatctataataaactataattcccttagtttctcctcctcttagttgctgcttgatagctctatgagcatctagttgaaaaattgcagtttatttttgcacctttaccctcattttaggggagactcgtttgttctaaat

SEQ ID NO: 35022 - DNA, 1435 bp, Triticum aestivum
  unsure (1)..(1435): unsure at all n locations
  Clone ID: PAT_TA_35022
catggatgttggcagggctgtgcttgtgcagaatgagccacggacaagactggatgcagggacatgggggacgatgggtgttgggttggggtactgtgttgcggcagcagtggccgagccagaggggctcgaagttggtgtggagggggcctctcgatgcggtttcagtgccatggagattgagactctagtgaggtaccaggggcctgttgttgtgattgtcctcaaccacaatggcttcaacgctggtggcagaagcggcctggctgaactcgcgggcccctacaaagatgaccctgccccaacctccttcgttcccggcgcaggttaccacaagatgatggaagccttcggaggaaaaggctatcttgttgagacaccggacgagctaaaatccgccctgtcggagtcgttccgcgccaggaagccggcggtgatcaatgtcaccatcgacccctacgccggcgccgagagcggcaggatgcagcataagaactgaatccctgtggacacccgaggagctagatctggaacttgtttctcgctgccccaagaaataattaagcccttctggtgcctggatagtttcgccttcaacccgtggcatcgtgactttgtgtactgtgtgtattgtgtttgtggacactagcaattgtatatttgtaccataattcaagtgttggcggtagagtgcaaaccaaacacatgcccggctccggggacttggggggcgatgggtgtcgggttggggtactgtgttgcggcagcagtggctgagccagaacgactcgtggttgctgtggagggcgactctggattcggtttcagtgcaatggaggttgagactttagtgaggtaccagctgcctgttgttgtgattgtcttcaacaacaatggcgtctacggtggtgacagaagaggcccagatgaactaacgggcccctacaaagatgaccccgccccaacctccttcgttcctggcgcaggttaccacaagatgatggaagccttcggaggaaagggttatcttgtcgagacaccggacgagctaagatccgccctctcaagagtcgtttcgcgccaggaaaccggcggtgatcaacgttaccatagatccctacgctggcgcggagagtggcaggatgcagcacaagaactgaagtgcctgttgaaccatgtatatcctagcactagcagggggtgcaggtgcgatgttgaaagggtctttgttctgtattgcagctggcctgttgaaatcgaaatggacactcggggaactaagatctgaacctagttctcgctgcccctgtaataaggaagcccttctcttctggtcctggatggtctcgccttcactggtagcacgtgactttgtgtaatgtgtattgtgtttgtggacactaagcaattgtatacttgtanaatttcaagtgtt

SEQ ID NO: 35023 - DNA, 1095 bp, Triticum aestivum
  unsure (1)..(1095): unsure at all n locations
  Clone ID: PAT_TA_35023
tgcgttccnccgattnccnggtatgntgccccctccttgtcggggcgggttgccccgccttgtgccgtctaaggccgtgggtggtcgcctcgtgcctccaggtgcgggcccgaggttgcggtttgcttggccgtgctcgagcgccggattctccgtggcgccttatctttatgactgtgacactgcttaccggtgtaaggggccccccgtaaacgcgcgtcggattgcttctggactcccacagtgacactaggatgttccaagcataacttgagctcctgcctaggcaacatgcgttgcaacatgcaataaaatcaaatgaaggagtgtggacaaagacaaagttatatatcaagcaaattggatgaaggcgtgtggacaaagttatatatctaatggtcgaccatgtagtttactactatggcctgcttttgatttctatcataccaaaccttgcttaggtaatataaaacgggtttaatttggactttaccaaaggcaagtaggatctcgtttttttagtcctatttataagttatatgctgtggggatgttgttccgtccattgataatgcaatattctatatggaatatttcaatgatattattaatggcttagatatgtcagaacccggaaaataaaaagagaccaaaaaaaactgataattgatctggctttgtaaaagcggcagggatcaaatagtatcatatgtgccattgccttcgaaattgaaaaggggagactgtcgctcactgtccatcagctttagaatcgcaagtgcatcattgtttacacataaatcgttctatacaatgtatctaacggattgacggcatcaggttaatgtgacatgtcgcctatgaagttgatcgacaaggcagctgaatgaagcaacttattagtatgtctaatagctatggctatgtagttttttacctttttatgtgttcctgctcttggtacttcctctctcatgttcgtgatcttagtaccaaacttaatttcaagtggttagtttttgtggtctcatgagcgcactaaatcgaatgctgccttatttctcgtgacgatgtcaaactcaatgatgttttgct

SEQ ID NO: 35024 - DNA, 1161 bp, Triticum aestivum
  Clone ID: PAT_TA_35024
gtttacatctctatggccgcctcccatatttgtgccaccccagaatccattgcctaaagagccttcgccatggcagaccaccttcaagttcaacaacaacaccaacaccaactagagctcccttcggggtttaggttccaccctaccgatgaggagatcatcacctcgtacctggtccccaaggtgctcaacccaaccttcaccgcgatagcgatcgcggaggtggatctgaataagaacgacccgtatgagctccccaagaaggcaaagatgggggagaaggagtggtacttctactgtcagaaggaccgcaagtatcccacggggatacagaccaaccgggccacgaaagccggctactggaaggccactggcaaggacaaggagatcttccacccactgcccactctcatcggcatgaagaagacgctcgtgttctataagggcagggcgcctaggggggagaagaccaactgggtcatgcacgagtacaggcttgagatcagcaagcagcctgcatatggcccatctaccgccatcgccaaagctgccgccattaatgcatcttccaagaaggagcgtgtggtttgcaaaatcttccataagaacattggagtcaagaaggtggtgaccccgtcgtacgccatgcacatgcccatgttcataggaggagagcagcaacagggctccctcaactcatgtacgttcccgcctcccatggactacggggcatcgttgtcgctggcgcctccgttgtttttatttgaagattttttgtaccaattgcatgccgccaaagtcggcttggcgatgacgggcagcttggtgctccccatggtgaacaacccccaccacgagatgatgggcggcaacccaatggtgtcctaccaacaacaacagatgatgcagatgcagatgcaaatgggtgcagaccagtgcttcatggttggggttgagcctgggagcgagtcgtcgtccatggtgtccagagagggcgttgaccggctgggcaacaacgtccaaggcaatggcgccacaacaaccattgacagttaatatgggtatggatgaaatgtggaagtactcatggtcagatgatccaagacaagatatatatgtatgtctgtatgcatgaatcaaccatccatcaacagattccct

SEQ ID NO: 35025 - DNA, 628 bp, Triticum aestivum
  Clone ID: PAT_TA_35025
tggccgggagtccgccgccaggtcccgccagaggaagcaggcttatataatggagttggaagccgaggttgcaaaactgaaggagaggaatgaggcattgcaggaaaaacaggtggaaatgctacagaagcaaaaggatgagatcagagagtccatcgaaaagcagcttggaccaaaggcaaagtgtttttgcttgcaacgaacgctgaccgcaaagtggtagcccgaagctcaatacaaccttgacagccagtggagtatctggcttccttagatgaacaaggtttgtacatatcagccgaagcaggagtctccagctgcccccgtagtttgccgctttcctgctgctacgggtccatggtagcgcgaagctcaatacaaccttgacagcagcacggtctaagtccttggtctctcgaacaaccagtgttcataaatgaacaaaaagcaatctccagctgcccccgtagaccctcgctttcctgctgctcctgcggcggtcgttcggtttctttagttggttcctgggtgacaatttaagtcctaggtctctagctttgctgctttcaaaatgaacaaaaagcaaagtatctaatctgtttaatccctaaaaaaaaaaaaaaaaaac

SEQ ID NO: 35026 - DNA, 641 bp, Triticum aestivum
  unsure (1)..(641): unsure at all n locations
  Clone ID: PAT_TA_35026
gaggaattcggncgaggtgaacttgtgcaggagttcctcctgcagcagtgtaacccagaggagaaactgtcgttactccagtcagtgatcccgttcctccgaccaaagacctcgcaacagaacagctgccagttgaagcgactacaatgttgtcgacaacttgcacatatcagtgaaccgtcccgatgcccggccatccacaacattgtgcatgccatcgtcatgcaacaacaacatgtggatagaggtttcggccagcctcaaccacaacagttgggccaggaaatgcccatgcagcctcaacatcaattgggccagcactctatcctacctcaacaactagcccagtaccagttggttaggttacttgtgattcagacccttcctatgttatgcaacgtgcatgtcccgtctgattgctacaccattactgcaccatttggtagcatgactgcctacaatggtggacaatgaaatcacaatagttgtactactagatagatggaccttcattgtttactcgattggacgatcgatgtagcaatgaaataaaataaaatgccgtgcaccatcaaataaaaaactccaaccagtacaaagttcaaacttgggaataaagggcaaacaaaatattccacgtc

SEQ ID NO: 35027 - DNA, 2171 bp, Triticum aestivum
  Clone ID: PAT_TA_35027
tcgcccctgctgaggcctccggggcgtggtgtgcggctgcctgaacggttgcccctctcccagcccgtggtcgacgtccgtctccgcgcagcacccgcgtctcgccggattaatggaagtgcaggatcatctttcgaggacttccagattctccatggagacatgcaaggattaaccgatactatggctttcctgacaagtttatctgggcttgttggaaacgagtccgaggatccctgagaagcaatcccgagaaaggactgctgcttctgtactctttgacttgcaggaggatatatatgttgcaagagcacctggacgattggacgtcatgggtggcttcgcggattcgtccccccggcgcgtcctacagaggccccttcgagaggcctgtcatgttgccattcatgacgcctggtcctcccacgctggtcctgtcgaggccttcgctggctgggctgcttgccgatcgacctggcccgtctttccacattgtagcttttgcctctgagtggagtaaccgggcaccaacattggctacggtccggtccgatcttgcgggtggtgacaaaccaatatcatatgagaaggccaaagaatatttctcccaggacccatctcaaaaatgggctgcctatgttgctggaacagttcttgtgttgatgactgaactaggtgttcaattcacagacagcatgagcattttggtttcttcttctgttcctgaaggcaaaggtgtctcatcttctgcatcagtggaggttgctacaatgtctgctattgccgcagtctatggtttaaatattgctccaagggatcttgctatactctgtcaaaaggttgagaatcacattgttggagctccttgtggtgtaatggaccaaatgacatctgcttgcggagaagccaacaaacttctggctatggtttgccagcctgctgaagtgaaagaattggtcagcattccaactcatatacgattttggggtctcgactctgggatacgacatagtgttggtgggactgattatggatctgtgagggtaggcacatatatgggacgcaagatgattaagtgtgctgcatctgacctaatttctcaatcctttccgtctactcccacgcaatcgtgcgacgcttctgaagaatatgaaaaatatggtgtggatcttctgaaatctgaagcttcactgcagtatttatgcaacctaccacctcatagatatgaagctgcctatgcaagagatattcctgagttcattactggggatgaatttatggagaaatatggagatcacaacgatgcagtaacagttattgacccaaaaagatcttacagtgtgaaggctcctactagacatcccatatacgagaacttccgtgttgaggccttcaaagcattgttaacagcagccaaaacagatgagcaactttcagcccttggagaacttatgtatcagtgccattacagctacaatgcttgcgggcttggttctgatgggactgataggctggtgaatctagtacaagaaatccagcacaggaagaccacctcgcaacatgaaggcccgagtctatttggtgcaaagatcactggtggaggttctggtggttcagtttgtgttattgggaaaaatagcctgaaaagtagtgaagagattttcgagatccagaaaagatacaaagcagccaccggttacctaccaattgtcttcgagggttcgtctcccggtgctggcaaattcggatacctgaagatccgatggcggtcggcataacaaccgcctgacttccaacatttgtcaagacaagacatatcgaacaacatggcacttcattccaccagtagattagacatagtagtgtagtagtggtacacaataatgtcaacaatctggtgcaaacttgcagagcaagtgccgctgttgaatctgtaaaggatgcttctgatcaaatccaatttgtcactaggcaaattagatacgaacatgtgattggtcctggaactttgtaggttgttctgcccatggctacgcgcagatattgccgaataaaaatgccaaaattgcaagcatgtgttggtttggcatacaaaaaaaaaccaaacctggaacaaaaaaaaaatattaaaaattatatacctaataaactcttatatttaccaaaattaa

SEQ ID NO: 35028 - DNA, 869 bp, Triticum aestivum
  Clone ID: PAT_TA_35028
gcagatcaaacggctgggccacgcagatgtcatctttcatcagctagacatcacggatgcttccagcatcgctcgactcgcagatttcatcaagacccgtttcgcgaagcttgacatcctggtgaataacgccgcaactgatgggattgagcatgtcattgatccagtttatggcttaacgcccggtgatgaaacgttcaatggcatggatgcgggccagaggatcgattggatgtggaccagctgccggcagacgtacgagactgcgaaacagggcctgcagacaaactactacggcacaaagcgggtgacggaggctctcctgcccctgctccgatcctcatccgacggaaggatcgtcaacgtctcctccaacttcggattgctaagctttttcaggaacgaggagctgaagcaggagctgaacgacgtcgacaacctgaccgaggaggggctggacgagctgctggccatgttcctgaaggacttcgagggcggcggggcggaggcgcgcgggtggccggccgagttctcggcgtacaaggtggccaaggccgccatgaacgcctactcgagaatcctggccaagaggcacccggagctgcgcgtcaactgcgcgcaccccggctacgtgaagacggacatcaccaggaactccgggatcctgacgccagaggagggcgcgcgcaacatcacgagcgttgcgctgctgccggaaggcgggcccaccggcaagtacttctccgaaggcgaggaggcatccttcgtgtgaaagagcatctgtagtactcctcgttggtggccctctgctgtggtgcgcggtgggctattctgcacagtccagtgcataaataggtcgatgggttcgt

SEQ ID NO: 35029 - DNA, 767 bp, Triticum aestivum
  unsure (1)..(767): unsure at all n locations
  Clone ID: PAT_TA_35029
gaggaattggctccatggattgaggtgaaggctgattgggttctgtcgaggacaccattgctggcaatcaggccaccagatggtatatccccgtcagaggtcgtggccaagatgaatgaagggctgagctctgggaaggtgaagaatgggcaatatctgaagatgtacttgaaggaggatttgccttctcgcctgcattactcggaaagctataggataccaccaattattgggctggtagctgaaggttataaggtagagatgaaagtatcaaagaaaaatgagtgtggaggggcgcacgggtatgacaatgccttcttctcaatgaggaccatattcatcgcacatgggcctcgtttcgaagagggtaaaattgtgccctcatttgtgaatgtggagatatacaatgccattgcttccattctcagtttgaagccagctccaaacaatggctccagttctttccctgaaacagttcttttaccgagtgaatgatcaccggtgtatgtgagggctgtggttctggaggaggaaaacccactgatggtattatcttccggttgtagttgtatttgtacactatttaaattcaaattctgcgacgtgcagctattcgctactgctaatactgcaagcagagaatccttttccttaaggatgtcatttgccaatgcaaatcacatctaaccttttcatcttctgtgatgctaaatgtatgatgccacttcttttaagtcccatgttttctgcttctcgtgactaggtcn

SEQ ID NO: 35030 - DNA, 1285 bp, Triticum aestivum
  Clone ID: PAT_TA_35030
ggcctttttgcagccattcaccatcaaaatgtggtgcatcacagggctgttctttcttgtcataggaacggtgatttggctgcttgagcacagaatcaatgatgagttccgcgggcctccagcgaaacaggttgtctccggctcctggttcagtttctcaactctgttcttcgcgcacagagaggacacgagaagcaccctcggccgcttcgtgatcatcatatggctcttcgtggttctgatcatccagtccagctacactgccagcttgacctccatactcaccgtgcagcagctcatatctccaatcacagggatcgatagcttggtcgccagcgacgagcccatcgggtttcaagtcggctcctttgcggaaagttacctcgtgaacgagctcggtgtctcgagacacaggcttaaatccctcggttctccggacgagtataagcaagcgcttgagcttggccctgccaatggaggcgtcgctgccatcgtcgacgagcgtccctatgttgagatcttcttgctcctgcatcccaaattcgcagtcgtgggctcggagttcaccaaaagcggctggggcttcgcgttcccgagggactcgccgctggcggtggacctgtcgacatccatcctggagctgtcggagaacggcgacctccagcggatccacgacaagtggctggcgaacgacgtggcggggtccatgtcgcagaacaacgagctggagtcggaccggctgcaggtgtacagcttctcagggctgttcctcatctgtggcgtggcgtgcctcatcgccctcgccatacacgccggcatcctcttccacaagtactgtgagcaacggcggcaggtgtcggccgacggcagctcccgctccagccgcagcagtttccgcgcgttcctgtcgttcgccgaccgacgggagatggacgcccatatagcgtccaaggacaaggcggccggagaccactccattagcgcggcgtcgagtagcagcgtcagcactgccacgtcgtgctagagggaggggcggacggacggctgccggttagctttcaacgtagcaagtgcgacatatagcagtaaccccccaacgtaagtactgtactacttaattagcgctgtgctgcaaatgttctctcctcgtgctgcagaattgtagagatgcgtaagctgttgtgcacatggagcaacttcagtacacgttcccgagaaacttgctcttgtaacttctgctgcgtcctggcgcttgctacgtcgcgctgatatagctatttgcttt

SEQ ID NO: 35031 - DNA, 465 bp, Triticum aestivum
  Clone ID: PAT_TA_35031
attctagggtcgacggagctgtaggtcggcatggccattgtggagtggcagcagcagtatgcagggatagcaccgggctttacctgggctcttctcttgttgtgtatgcaggtattattgacccgactcttctcgaagcatttgcgtgtagagaagctcttgcacttgcagaggacctgagaattcagatgatgcacgttgcttcagattgtgaggaagtggtgaaggacattaagcaagggtcgggaggatatcatggtgccatcatccaggaaataattgctaggaaaaatgatatgatttcatgtactttcactcatgaacgtagagtttttaatttcgaagcacataatctcgtcaagtttggttgtaatttaggtgtaagtcgtcatgtttggttggggtctcctcatgaccaaaacattgtacctttaattattgagcagtaaagacgtgagaattccc

SEQ ID NO: 35032 - DNA, 1322 bp, Triticum aestivum
  Clone ID: PAT_TA_35032
cggacgcgtggggcagtggtataatacaatttggcgagtatatatactgatgtgattagggaaagtagagaaaaacggcaacgtttgttgctaccctgtgaaaaactgcacttgacaggcatgttcaccaaatagaagtatcacttgattgataataccatatgttttgttttattcttagcaactaattaacgggcacctaactagtctcttcaatttacagaactgagtgaaccgtgcatgtatattattaatgactgctcaagacttaactttgcaagctaggcttagtgcggcacctttttctgtataaacaaagtatttatgcagtagatttctcttcttgcttctactggttcaataatgggctctttctacagcctaaatatattggctaacaattggtgatgtttgtgtatgcacgaggctccttcctccgcccccgggccgccgccgccacgccgcccgcacgccatcccatcggactcgagcagatcggagggagatcttccttctctcgctcttccagaatgcgtatctttgtcaagacccccaccggcaggacaatatgcctcgaggtccactcatcagacaccctgtacactgtcaaggcaaagatccagcagcagtaccacctcgtctttgatggggtgcagctagaagacaaccgtacattggccgattatggcatccaacatgactctatgattgacctccaggaaaagatgcaaatctacgtgacggagacgtggggaggcaggaccatcacccttgaggtcgacagcctagacaccattggtaacgtgaagtccaagatccagtacatggatggatttcccaagagccagcagtgcctcatctttgccaacaaacagctggaggacgataaccgcaccttggctgaccacaacatctggaaggagtccaccctcctccttgtcctccgctcgtgtaggccaggagaaagtagaatgatgcgcatcttcgtgaagacgctgactggaaagaccatcactcttgaggttgagagcttgtataccatcgacaatgtcaaggtgaaaatctacgagaaagatggcactccccctatacagcagcgcatcatctttgctggcaggcagctggaggatggccgcaccctggcggactacaaaattcacaacgaggatacccttcatttggtgctccgccaatgtggttgctgagctgcatggcctgccattcaacaaccagttttatgttgcaggagccttccttacaataatggtgcgttatcagtgaactatcattctagtactctatggtagtatacatgtatgctc

SEQ ID NO: 35033 - DNA, 845 bp, Triticum aestivum
  Clone ID: PAT_TA_35033
cgggaccattccgtggtactccctcttaaagaggcatcagagtctaccaattagcctccgtgccccccctattccaccagaatgcgtgttctgctaatagagcttgtataaaagtcgttttcgccaataaattttttctactctcctttttcctcagcaagctgatatctcattatggaatgttttttgcattgcactcgcatgaggcgtttattcgacaggataggtttcgtcacccgataagattaattcatcaccttggaattcaagagtgattttatttaccatgttcttgaggcactacaggtttttcttgctaagaatgattcaagaatgggttttctagcctacttgttctatatccaggaaggacaaagttctttttgaaaatatctctctcttttcgcttatttttgtatttgaatgttttggaattataaagtttgttcaccagattcttctttttgtgggtttggtaggttatttgatggtaggaaaatgtttgtaacttaagtatttaataagttaataggatagaatcttaattatttcgtatgtggaaatttatcgtatggggaagctattagtgtgtggatatgagattcatgctaataaaacattatcagaaatctctcatttgctttttaactactatctttttatataccttataattatcacactacttggttcttttcattccatcctatttttagagatctatcacttgctttcacaatgtccctttcccatctttaagctcagctgagcatttcgacgagcagttggcgcgcgccaagaaacagaagaagaaggtgacgtggagcttgcacgtactgggtgca

SEQ ID NO: 35034 - DNA, 944 bp, Triticum aestivum
  Clone ID: PAT_TA_35034
gaaggcacttatcctgtcacgattgaagaataaagaggtcatgtgagtcttttgtgtttcttgagcttcgagaaagatcaagttcggcgtaatcttttttgctgtcagacaagaacttcaaattatggtgcctttgaaccgtagaagcaacttagcttagagcataacccgtacgttagtgtagaacatgttattggctaccacttatgttgagtggtgtgaaactcgcatcctatctgtatgctagactgaaatgtttggaccgtagcagccacatagctcgggatgatgaagttttcaaaaagccaagcgcgaagaactgtaactgagttttcaggtagtctcctctctggctccaggcgttttaaggaatcataccatactcttggaaagccattgtgtgctcaaactcaaactttgcaccattgtgtgaattatcatggatgagttcatcacgaccactctgctccgtccatcatatgttgaaccattgtgggaagcaagcatgtttgattcccttgcccatgagtcctgcgacattgcagaatggtggccatggccaggcccaggcatctctatgcaattctgcggagtctacataatgctgctgaactgacgtgcgactttgcaggctaaaggtacatcatgtgatccttcagacttgctgattggatcaagaaagtttgtgggatgtgagctcctccttccttatcaagatgacaggtcaggctgggcattcggttaaaccgaaccgaccggttcggttcttcgggttttgaacaaatatggttttcaaaaaatgattaccggttggtcatttggagaactgctaagcgagaattcggtgaaccgagattttggttcaaccctcggtttaagaccaaacatgaatatatgcttgtggttcctactcttatgccaagacaagtagcggataacacaag

SEQ ID NO: 35035 - DNA, 678 bp, Triticum aestivum
  Clone ID: PAT_TA_35035
ccgcggcagagctcccgggcgactgggtctccatgggggagcgcacccagtggctctggtactccgtttacgcaagcaagcaggtgagctggcgcactcgggtcctggtggtatccgactggacccggaggttcatattcgggagggactcgagccggatctaggcgctctgattccaggatgcaatgcagcaaaacctctctgtacaggcactgattgggcaaataaggaagcaaggctgtctgtctgttgattgttcctttctgtcctcccaacggagccatcatccttcgtgtgtggcatgtgaatatgtgatggggttctcttctcttctctggatgtggttggttgtgaatctgaagcgtacctggcgcgatgaactgaccgagtgcccacagttcacgcgcgaaactgcggtcaggacaaatggtttgtccaacttgtagataaatgtgcaaaatgcgtgtgaatttggtgtacatggctctgttttttctcttcttattttgaactggctctgctgtttttccttcccatgtttatttccattctaagtggacttcctcattacttggaacccctattatcatgtgggatattattataactaacaatgaagattattcacgcgattaacatccggtttttttacgccgtccaaaaaaaaaaaaaaaaaaa

SEQ ID NO: 35036 - DNA, 1499 bp, Triticum aestivum
  Clone ID: PAT_TA_35036
ggcggtgttggcgtaaggcgccccgccgtccgctgaagggggttgattcaaccggtgaatgatgttgggggaaggctgatgcatcctcatctgactgctgcttttctgtcatagactggaccagtccggcgtatactgataatgcttactgtcctgaaggttgcagcgaagaagggtggtgaagagcctccactgatagttttcccatttgtgccgtaatttatcctcgctatcttttagtgaacgtcatcgtggacgtgatcctataccttgggaagcggtgcgtgagcctgtccagcgcgctgttcgcgttcctcatgctggacacccacaagtacaggtctgctcacaacaagatatcgtccccgctgttccccgtgctgctgtgctgggcgcttgggtacgtggtggcacagctcttcttcggggtggtggagacgtcggtggagacgataatcctgtccttctgccaggacgcggaggagcacgacggggaggcgcagtacgctcccccgctgctcatggagacgttgggcgacacgagccagctgcagaggctcacgcaggggccttgatttgacccagcttctcggcattgatctactttagtagtgtagggttaccagaggcagctggttgggttgaatggctttgaccataataatacgcactatgtagtactactattaattaactgcgttgttaggggctaattgctgccggggctgcatagactggaccctcatgtctgtaaatcgaaatgcctacataatgattgccatcacggggaaagggttcttcaaagcttcggtgctcgcgaccggccttataatgaacaacatactgcgcatcgggaaggtcaacgtgatcggggacgtgatcctgttcctggggaagctgtgcgtgagcctgttctgcgcgctcttcgcgttcctcatgctggacacccacaagtacaagtcggcgcacaacaagatatcgtcgccgctggtcccagtgctggtgacgtggggcctgggctatacggtggcgaagctgttcttcgcggtggtggagatgtccatcgacaccatcatcctgtccttctgccaggacgcggaggagcaccaggggacggcgcagtacgcgccgcctctcctcatggagacgctggacgagcagggcgagctgcagagactcactcaagggccctgaatctctctccctcgcccccgtttctcttctctgtgcctgtggttgcctggtccctctcccgcgctgctgtagcccgtcggagcgcgagcgctggcctggtggtgatcttggccgcctggcgcccgggcggccgcctgttcgggttgtgcggcgttcgctcccggtatgtacgtgtctgatgtgtcgcccctgattggcaaaagtgttgcgtacgagtacgatgatgtactttgctgatgcgatgtctggcgaaggttggaaattagttgcttgaatgtggtggtggtaaaaaaaaaaaaaaaaaa

SEQ ID NO: 35037 - DNA, 1247 bp, Triticum aestivum
  Clone ID: PAT_TA_35037
cagtaattttgagtatctaatgattcttaatacccttgctggacgatcttacaatgatttaactcagtaccctatatttccatgggttctggctgattatgcctcagaaaatctagatttcaacaagtcatctacttttagggatctctcaaagccggttggtgctttggacgagaaacgatttaaggattttgaagatagatatcttaatttctgtgatcctgatataccgagtttttattatggatctcactactctagcatgggaatcgttcttcattaccttctcaggctcgaaccttttacaaccctgcatcgtagccttcagggtggtaagtttgaccatgcagaccgtcttttccagagcattgacagcgcttacagaaacagcttgtcaaattcaagtgatgtcaaagagcttattcctgaattcttctatatgccagagtttcttcaaaattcaaattcatatcatcttggtattaagcaggatggtgaacctttaggtgatgttgagagaaaactttatttgtattttattccagaagaattcattcacatcaacagagaagcacttgaaagtgaatatgtgagctctaatctccatcactggattgatctcatatttgggtacaagcagcggggacagcctgccgttgaggcagcaaacatattttactatgtgacatacgaaggcgcagttgatctggaaaacatggatgacatgttacagaaatatgctattgaggatcagattgcgaattttggacagacacctatccagatttttcgtgtgaaacatccaagaagagggcctcctatcccaattgcccatccactgtattttgcaccacagtcaataacattaacttcaagtgtttctagcacaatcagccatatgtcggctgtactatttattggcttgttggataacacaattatactgatgaatgagggactcatattatcagtgaagctgtggttgacaacacggatgcagttaggtggaaatttcaccttttctggacccaggaaaatttctttggggttggttcagatgttatctcccctcgtaaaattggcactttcctggctgagaacgtcaaatttggaagacagctcttagcaactatgcaaattaacagcgacaagtatttgattttatgtggaaattgggaaaacagtttccagataatttctctcagtgatggaaagaattgtgcagagcatcaggcagcataaggatg

SEQ ID NO: 35038 - DNA, 1577 bp, Triticum aestivum
  unsure (1)..(1577): unsure at all n locations
  Clone ID: PAT_TA_35038
gattttctttgcacaaagcttgcagagagagaaatctttagagcttaaagccactctttaatccacccccacttttattctctctctctctctccaacccatcatctctcacaaacaccccaacgcagcgagcgagtgatcgagaagggaattaaattccaagacaccgcgggctctcgctcatggccgccatcatggcctccataaccagcgagctccttttcttcctccccttcatcctcctggccctgctcaccttctacaccagcgccgtggctaaatgccatggcctccaccggtggagcggccggacgaagaagaggcggccgaacctgccgcccggcgccgtcggctggcccttcatcggcgagaccttcgggtacctccgcgcccacccggccacctccatgggccagttcatggaccagcacatcgcacggtacgggaagatataccggtcgagcctgttcggggaccggacggtggtgtcggcggacgcggggctgaaccggtacatcctgcagaacgaggggcggctgttcgagtgtagctacccgcggagcatcggcggcatccttggcaaatggtcgatgctggtgctcgtcggcgacccccaccgcgagatgcgcttcatctccctcaacttcctcagctccgtccgcctccgcgccgtgctcctcccggaggtggagcgccacaccctcctcgtcctccgcgactggctgccttcctcctcctccgccgtcttctccgcccagcacgaagccaagaagttcacgtttaacctgatggcgaagaacatcatgagcatggaccccggcgaggaggagacggagcggctgaggctcgagtacatcacgttcatgaagggggtggtgtccgcgcccctcaacttccccggcacggcctactggaaggccctcaagtcgcgagccaccatacttggagtaatagagaggaaaatggaggagaggcttgagaaaatgaacaaggaggcctcgagcatggaagaagatgatcttctcgggtgggcgatgaagcaatccaatctttcgaaagaacaaatattggacctcttgctgagcttgctgtttgccgggcatgagacatcgtcaatggcgctcgccctcgccatcttcttcctcgaaggttgccctaaagccgttgaagaactgcgggaggagcatcttgagattgctaggagacagaagctgagaggggagtgcaaactgagctgggaagactacaaagagatggttttcacgcaatgcgttataaacgaagaccttgcgggctangcaacgtggntcaggttcctgcaccgggaaggtcattccagatgtgcactacaatgggtatnacatcccnagcggatggaaaattctgccggtnttaacggnggttcatctccactcctccctttncnaagaccccaacaacttnnacccttgggnatngaanggcaaccccttcgggggttgnncaaaaaaattaacttnaatcccctaacgnngncggaacgaaggtntncncccggtccggagctcgccnanctccaagggggggncccggtaccn

SEQ ID NO: 35039 - DNA, 650 bp, Triticum aestivum
  unsure (1)..(650): unsure at all n locations
  Clone ID: PAT_TA_35039
gccgggttgtaatggggaacgtagaaatagttcaccatggatctaagcagcaccagcctagtaacgagtattttgatagcggtgtagatgacctaaaaaacccgcagcattacattgtatgggatatgaatctggatagtcacatctattctgaatttgtagtcaccatcaaattgccatctaaagccaaagattccctcttcacacaagaagattgtcacgattcatctgatgcttcactggtcttgagtccaagttcggccgacagtgtatcacaggtgaggttctttacattgggagttgagtgggatggtactgtcatactagagtcaacttctgttctcatacagacaagttccactgttggagcagcaggagcattcagttattcagattgcgtgtctgactcaacaattgacctgtgcttccattatgagattataacttcgagctgattgtagtcttaatgtttgatagaaatctccaaatatgataagtttcctgttattaccaatgtcatgtcagttatgttgggtgagtcacaaaacaccagttgacaccgttcttctgtgtggaaacaggacatgaatcttgagggatctncagcattgggtggtcagtatgaagccccccatgtagggagatcaatg

SEQ ID NO: 35040 - DNA, 488 bp, Triticum aestivum
  Clone ID: PAT_TA_35040
cgtccgggaagcggtacagccccgctgcatatcatgctgatgcctgccacacctctcaatcgcgtgagcatgctactggaaactctgatatcaggtggtatgttggtgaagatcgcaaggcgaacatcgcgtgccacttcaacaagcagattttacagagctatcagaactacatgaccagtgcatcacctaagcgtattctgctccgccaaagtggcaactggaaagaatttccagaaaaaattgtcaagctggctcaagttgatttccggacaaagaagaccatcacagaagtaggataccagaaccagctatttttgctggactttgtccacatgacattcattgactcaaagtcaggtcttcagaggccaatcgcctggattgatgacaatggaaggcgttactttccagaagttcttaatgaagatcagatagtatataggaggatagattttggcattggacatcatgtttatgttatagct

SEQ ID NO: 35041 - DNA, 2792 bp, Triticum aestivum
  Clone ID: PAT_TA_35041
gcccccccctcgccttcgcccccgcccccgcccccctgccgccgccgccgcgattctccgagccgagtccttgctttgaccagccacgtctcgccgccggccgcggcgagcgtcttcggcggggtagctccggcgatcgtagccgggggataaagtgggctccgtaggggagtcctagggggggtgacagggggttagatcgggcaagatgaaccgctcaatatcctccgccgtgacccctgctgatgctgccgctaaccctaggtttcctactcttttgcccttatctcacccgaccgatattctttttctgctcgtcgatattgaagtagtctatgctccgatgttcctccattagcttagtgtaaatattagacttcatggggttaattttgctagaagtctttagtctctgcttggtgttcattacggcttgctacattggcggcgttaatcgcaaaaggctccaattactgcgttcagaatatagttttccacgatatgtgcaccgaatacacccacactacatcgtgagaaagccggccacgctcaataactgttatgaagacttcaaggccactcaaataagcagaattgacctaggtgaagaggctgcgtctcatagttggtgacagaatgctggtctccacaataattcggctccaagataagttgcctccgatggtgaagccgggaagcacgcaaagtagctccatccaaaggaaacggaggatcaggttgacctataggttgggattaggaggaaggaactggtcaggcttcgttatcatgatatttgggatggaatgtagtcattcgagattttatgtccgtctgtctgtgaatcatgccgctctgtctgtctgtcaggtttatgtagctgcaaagaggaaactgagccctaatttaagtgtgaatataagaaaggtttcaaaaggatatcgctcctggatttaccctcctagtttgagcttagcctaaatgggcatgtgatataattgaccaatatggagcatcagagtgttccgcagaaagctcaaactttgagtccagtactgaagaggtttccagtgataagagagttagagccgagaagggtatcatcaggaaaataaattgtgatcatagagaaactgtgggagagaatgaaccacacacttcgctgcctgcagtctttagttgtcaaccacagcaagataagctgggcgggcaatcacgtgctcaaggaactacctctgttgtgcagaagatgttgctgcagggaatgggtactgctattggttccaaggatattattggaatccaccgaacgccattcttgaataattatagagaagaccgctataatctcttccaaaagcaggcagagattactaaatctcagcatggtaatgcaaatgtgcgttatgcttggcttccttgctcgaaagctgctgtggatgaaatgatgctgaatggcaccttgcaaattaaaaagcccactaggtgtccaccctatggaactggcgtactccttgcaccagctaactgctccattaactgtgtgaattactctgatgttgatgaaaatggcatcatctatatgatgctgtgccgggttgtaatggggaacgtagaaatagttcaccatggatctaagcagcaccagcctagtaacgagtattttgatagcggtgtagatgaacttaaaaacccgcagcattacatcgtatgggatatgaatctgaatagtcacatctattctgaatttgtagtcaccatcaaattgccatctaaagccaaagattccctcttcacacaagaagattgtcaggattcatctgatgcctcactggtcttgagtccaagttcggccgacagtgtatcacaggacatgaatcttgaggcatctccagcattgggtggtcagtatgaagcccccatgttaggaggatcaatggcaaaagctccaagtacaccttggatgcctttttccatgttatttgcagctatttcaaccaaacttcctcgcgagaaaatggacatgatcaataactgttatgaagaattcaaggccaagaaaataagcagaattgacctagtgaagaggctgcggctcatagttggtgacagaatgctggtatccacaataattcggctccaagataagttgcctccgatggtgaagcgagaagcagcagatgctccagccaaggcatgaggtcagtgaccatggtggattggaggaaggaactggtcgacttgttatcatgagttggaaaggaatgtagtcttctgagtttatttgcgtctgtatgaatctgccgctctgtctgtctgttttagtagttgcaaagaggaaactgttatacttgtgaacctaagatggtttcaagggagaagaatccttgtttaccctcctagtttggtttttgtccaatcaacattgagttttagttataaataatcatcattttctgtcaaaaatccaaaataaaatgcctccgatggcgaagcgggaagcagcaaatgctccagccaaggcacgaggtcagtgaccatggtggattggaggaaggaactggtcgacttgttatcatgagttggaaaggaatgtagtcttctgagtttatttgcgtctgtctgtgaatctgccgctctgtctgtctgttttagtagttgcaaagaggaaactgtccaagtatacttgtgaacctaagatggtttcaagggggaagaatccttgtttaccctcctagtttgttttttgtccaatcaacattgagtttagttaataattgccattttctgtt

SEQ ID NO: 35042 - DNA, 612 bp, Triticum aestivum
  unsure (1)..(612): unsure at all n locations
  Clone ID: PAT_TA_35042
attgtcgccaggcgagacaaggacagctagcaagagagcaaggccatgtcaatggcggacgagcagtacgacgctggcccgcgcggggcgccgcatgggctgctgctggcggtggtggtggggctgctggttgggtggccgcttttcctaagtgacggcgctgaggcggtcaccgatgccatcgccgagctgctcggccccgtgggcctgctcctcctcccggtggggctcctcctcctcatccacctcctctcctccgaccgcgcccctgacgtgttcgagtttggcggctcgcccgacgccgtgcaccacgtcgggggatcccccgtcggcgtggcgctgatgctggtcctcatccttgccctcctctactaccggtccgcgctcttcggtggcggcggaggcgacgacgagtaggcgcctaggcgctcgccagtaggtactaggtagagcctgatctcggtgtggctggttggttgttcagacttgcgagtaggcactccagcaggcagcagtaaataaaaaaaagtgagaactttttaatctcgtcccggtgtcgcattccaatcttggtccaactgggcaggacaaacaaaaangtggaaactgatn

SEQ ID NO: 35043 - DNA, 775 bp, Triticum aestivum
  unsure (1)..(775): unsure at all n locations
  Clone ID: PAT_TA_35043
gctgaaggtcttaatctgtcatacaatcctcttagtcttcagataggaaatttcatggacctctcgacggtcgtctttggtcacgccatcctctttcttgtccataagaaatctcatggatctgctcctatgaaagtctttagtggtcgtcctcctgcttcttgtggctactagaggacccagggaccagtgcaagtagctttggcgagggactgcaagtcacagagctacaagttcaaggggatgtgcgtgcgcgatgacaattgtgcaagtgtttgcctgaccgagggtttccccagaggcaagtgcaagggctttgcatgttcctgctacaaggattgctagatggccctgatttgtctattgcgtacatgcttttgtgtaataacaattgaataaataatagtagatctatatctatatgcttccgtctaataactgataattaccgaataatagctcgtttgagattcatgaacggttacaaaaaaaaacccgagggacaaaccgccgcccaatggcgacctatagtgagtcgnattacaattcactggcccgtcgntttacaacgtcgtgactgggaaaaccctggcgttcccaacttaattgncttgcagcacattccccttttcgccagctggcggttataaccgaaaaaggccgcacccgatcgnccnttccaaanagtttgcgcaaccctggaatggcgaaatggcaaaattgtaaagccgttaatanttttggttaaaaaattcgcggttaaaatttttggtaa

SEQ ID NO: 35044 - DNA, 731 bp, Triticum aestivum
  Clone ID: PAT_TA_35044
gcaatgcagagttttggggattatatgcaagatggcataaaagcaagggcagcctcatggcatgctcggaagctttgttgaagcaagttcgatccctccagggttctggattatggcatgatcaggagaagttcactcagtatgctcaagcttctctgcaactttgtaaggtctatatcgagatttcctccacgactggaagcagacgagaattattgtcagctgagatgcatcttaaaggctccttgaaacaggcaacggactgctccggtacggaggagtataaatcacttaatgactgccttgaccaattaaggggcctgattggcgatgcatagagttactgatatcttggttgtgaatcaaggtcatcttgtcatatggtttatcacagaccctttacagaaaaagtttttttttaccgaaaaagcagaccctttataaatgacaagcatcgtcaagtcgcatcacccgatggtctatgctcaagttcggcacgaagacaccagaccctttatttactcttgttctgttattcatgttggtcgtttgctcaatgtttcagcgcacaatccagcttgtagctgtgaacactctgttaatcaggtttatcatgtgtaatcccagactgtatttgggagaaatatttgtactgttgcttctgtttgaatgaaagtgttgtcgtgctctcaaaaaaagagtactcaaaaagtttgttcttaaaaaaaaaa

SEQ ID NO: 35045 - DNA, 1675 bp, Triticum aestivum
  Clone ID: PAT_TA_35045
gaggaattcgggctgagactgtgatatacagaatcttctactccataaatagatctggaaatggtcatcttacccttagagagctaaaacgtgggaatttagtagctgcaatgcagcaattggatgaggaagaggatatcaacaaaatactgagatatttctcatatgagcatttttatgtaatctactgcaaattttgggagctggacacagatcatgatttcttgattgacaaagagaaccttatcagatatggaaatcattcgttgacctatagaatagtcgatagagtcttttcacaggtcccaagaaaattcacaagcatgaccgaaggaaagatgggttatgaggattttgtttacttcatcttgtcagaggaagataaatcatctgagcccagccttgagtactggtttaagtgcattgatcttgatggcaatggtattttaactaccaatgaaatgcagtttttctatgaggagcagttgcatcgtatggagtgcatggcacaggaacctgtgctttttgaggacatactatgccaaatgattgatatgattggaccagagaatgagacatattttacattgagggacttgaaaaagtgtaaactctcgggaaatatattcaatatcttatttaatctcaacaaatttatggcgtttgaaactcgtgatccattcctcattcgccagggagcgtgaaaatccaactctaactgagtgggatcggttcgcccatagggaatacatcaggctgtcgatggaagaggatggtgaagatgcttcaaatggaagtggtgatgtgtgggacgagtcacttgaagctccattttgaatcatgcctcacactcctaattggttggatatggatgaaattggttgggaagttgaagaagtgtaaaggttttggctagcctgcggaggtcattgcaggctctaagcagtttcagtaacaccaaagactacttatcagttttactgtgcaggtctgatttgatattatcagttgtccagttgtgcaaacatttttgcttgccaggaagaatgtggaagttgatgtgagggcctcctgcatattgacaaggcaacaacctcaacagtctcaaagctgaagtggggaaacttctgtgctctacctttttctcattgtgttctgattgttgctttaggggggatgccagtttattcaattgctgtgctcgaattttggagctgaactgttgatgtttggctgccattttccttgttaatctgtgggtgtgcgagcaagcaatgccatcattaacttcgatcatcgtttgtaacttcctggttctgatttctgttcagtttggtatggcgtttgttgcgattcttggtacattttggtaggtggggaggggtctcaaaacatggatgtgagttggtcatttgtaacattaacaagtaactatgcatcaggtgcataaaatctaaacaggaaagtagtttccattgttaatccagatttttgtcgtagcataaatttataggatgtttcatttgtatatgctgcgatactgtcatctggtattttgcttttcaacttgtggaactctgcagttgtccaaagctttcttattagttcagtgccagttatggtaccgtgttgaaatttgttgtactatatcatgtatgcaaacatgtcgtacaat

SEQ ID NO: 35046 - DNA, 1231 bp, Triticum aestivum
  Clone ID: PAT_TA_35046
gcaccgggccgggcaggccgcacgggcgtcgaggtgcttgctgctcctggctatcttcctttcggcgcagccaacggggcagagcggcgaggaagggccggcggttcccgcgctgatggtgttcggcgactcgctggtggatgtaggcaacaacaactacatcttcaccatcgccaaagccaacttccctccctacggcagggacttcaaagaccatgtcgccacaggaaggttctgcaacggcaagctgcttgtcgatttcatagctgaaaaggttgggttcaatggctctccgccggcctatctcagcccgcaagcatcgggacagaaccttctgcttggagccaacttcgcatctgctgcatctggctacaatgaccatgggactctgattaaagccatctctgtctctcaacaattgaagtacttcaaagactaccaagctaagctggtggtggtggctgggagcagccatgctcgctccatcatctccggctcactctacatcatctgcgccggttcatgtgactttatctacaactattacatcaaccctttcctcgacatgaaccaaaccgctgaacaattctcagaccgcctcgtcgggatgttcaacaacagtgtgacgcaactttacgatatgggagcccgacgcatcggcgtgttctccctgccaccctttggttgttttcccctggcgatcacgttgtatggtcatgggaggagcggctgtgtgtctaggctcaacaacgacgccccaatattacaacatgaagttgaaagctgctgttgactcactatcaaagaagtaccatgatctcaagattgtggttctcgacatgtatgcgcctttgtacaacctcgctacctctcctgtatcgcaagggttcaccgaggcgaagcgggcctgctgtggcacagggacggtggaggcgtcaatcctttgcaaccccctgttacctgggacttgtccgagcgcacagacatatgtgttctgggacgtttggcatctgtcagaggcagcaaacaaagttattgtggactctctcgtagatgaaatcaacaacctggttgcataaacccactagattgtacagtagacatgcaggcttgatgctacattgcttcaagtatccagaaagaaaataatagcggtggactaagatgtgaaaagggcatcaacccgtgtgaagggcctcaacatttactttgcaaaaaaaaaaaaaaaaaa

SEQ ID NO: 35047 - DNA, 946 bp, Triticum aestivum
  Clone ID: PAT_TA_35047
gctcccgcaccggcgctggaccaatgtggggcgcgaaaggccgagcgagcgagctatgcacggagccggtccgacgaggtgctcgaggagcggcagaggcgaattgtggtgcgccggaagttcagcgtggcgttcattccgtagcgggcgaggcgggtgcggaagcggcgcgacgacgacaagaaggcacgcccgcggccgctgttttttgtgtgcgctaacaccgtggacgtcgggcccggacgcgggggcccccactttctgaagagggacgcatttaccgagctgtggatgagggcggcgttcctggcggcccggggcgtcggccgccaaaccgtggcgggggtgaacgcctacattcccaggggcgattctgcattctgcggtgatgagcgcagggagctgtacagcaagtggaaaatggcctgctcccgcatatcccgcaggaaggccccgtcgaacaagtccagcatcaacaggggctcgtgcggcgggccaggctaacccattagattctactagctcttagtgatgtgccatacatacaggtggtacaatctctgcagcatttaaggcaaacccatttgtatacaagctgcccgtagaaaaaataagtgtcatagacatatgtggtacaatctccaccatgtttaagccgtccgtccatgtatacaagtacaaggtagtagtctcaaataatggtccaataatggtcggctacgtccccgtttcatgagtcagttccgccgcttcgtggttgacatggagctgcgagatatttacctcatactcagtccaaggagtaggaccaccctccctcatgcacaatgacggcgttctttgtatgccatgttgagaggtctcgcacccatactatctgctacgcagcttggcctcgaccaccgtcgatcattgccccctccttgtggattgtgtgccctgttct

SEQ ID NO: 35048 - DNA, 1038 bp, Triticum aestivum
  Clone ID: PAT_TA_35048
cttccctccctccgccagtttccagccgcgagcgaacccgacgcgagtgcggttcgagggagagagaagaggggactagcaccatggccgccaggctgctgctcctctccttcgattgcccggccgtcgctggcgggcggcggtctcgtctgtctgcaatgccacggatgtcttccggtgctcccctcgtgcggcccccagcctcatccgtcggcgcgttcgcggtcaccgccgccagaggcaacctgccgcaccacacctccgtggttgtggagggtggtggagtttacactgttggtgactttatgactaaaagggaacaactccatgttgtgaaaccatccacttcagtagatgaagctcttgagaggctggtggagcatcgaataactggctttcctgttaccgatgatcactggaatttggttggtgtggtctcagattatgatctgttagcactggactcgatatcaggaaatggacaggctgaagctgacatatttcctgaggtggacagcacttggaagactttccatcagatacaaaagctcttaagcaaaaccaatgggaaagtagttagtgatgttatgacttctgcacctcttgtggtgcgtgaaactactaaccttgaagatgctgcaaggttacttcttgttactaaataccgcaggctgccagtagtcgacagttcgggcaaattggttggaatcatcacaagagggaacgtcgtcagagctgctcttgagtttaagaaaaatgttgaagggagtctttgaagtggaactgtagatgatcctttccgaaggtggaacttgaacatattgctagtaggcaagcatactgaaaaaattgtttacacaacatgctagtttaattgcagttgggatacatgtattgtgagcatcatgcatcatccttaaatttcaaaattttgaattgagggaattttcaaagcctctgctgaaaccgcacaacccaatttatacccttctctgtctggacaaatcctcaagaaaatgcgttgtgcaattctgtcat

SEQ ID NO: 35049 - DNA, 857 bp, Triticum aestivum
  Clone ID: PAT_TA_35049
gtctgttgttgccaggggcatgaatttctttgactggtaattttcctttataagattgattagtttcttttcattaatgtcttgaaaatataagcctgatgctctgcttttatgaacatgaaacacaagtaccttgataatattcatctgcacgccctatattacttttacaggattcccatgttcctaaagaatcatgttatttgcatcacttttttttgaggaatcaccgccggtgggagggtccccacctgtgtatatacatattactcaaagtgacccaaggggcttggtgttagagagaagttacaaggccacgtatatctgtgaggtgggatagttgcgactgggcagccatcttatcactcggttctttaaaccgatgagtccaaagttcaaagtcactacagatacttcgaacagcggtcgacttgctatgatttttattcctgaagacggtcaagagtcccatatcttccattgaatcggtagaagaatctctggccaaatgcaagtttcaaaggtcagccggcgtcgaggtagcccaaagatcttggaaccgagcagggaggacagtgcctaggcgcagccatatggatgcagcccttgggcaagcaatgaacaaatgctgtgtgccctctgaagtggcattacatcgtgggcaagctgtggcggttgcaatgtgcttatcaaagaggttgtccctggtgtttagccgacctctaaacaagagccaagcaaagatcttcagcttgtttggacagcggctgcgccaaataagatccgcatggtcacactcatcttcctcatgcataataatacccttggagcttttgaggaattttttgccatgtatg

SEQ ID NO: 35050 - DNA, 1079 bp, Triticum aestivum
  unsure (1)..(1079): unsure at all n locations
  Clone ID: PAT_TA_35050
gtggctgtattgatctcccgtgccaccaatctgaccgatggctccacttcgacttcgtcaactccactgactatctcgactacgtcatactgcaaccccgatgcccactggttatgcagtaacatgcttctgaacaccaggttgcaacttccagctttcgccgacggaacttcggctncattgcttcttagaaggtggcttggggcttgttttcttctgaccgattgggctgcgacatctcacatggatctttcactgccttcatagacctattttttattctctcgtcaattctacatgtctgctcgtccattggcatggtgctagatggtccctgtttagttaatccaaggtaaatcatatgcataaccatggaagggcacatactggcctcaggttgtacaaattcatcgcaaggccgggtcagttccgaaagttcaaaggggaaaaaatccatttgaaagctggaaaatacattactcgctgtaaaacttgttagtactttcctgtttgcaacgcctcctccgacaaatactaaatactatagtctctatgcaaattggcaggcaagcctggctagcactacttctttgagttcggagcccactgtgtgtgtgggaaatacaaaacattttctgctgacggcaaaagaatgtactttagcacacactttcctaggcgaagtctccatgggcacatggatgctgatcatgatgagctaccaatcagtgcagcagacgggaccatcagtgtcatggccctctttatcatgggcatcgacaacagggctacactcacaaagaactggagcagcttcttccataaggcaaacatgaagaaaggatgtgcatatgctttcgccttcaagtgcgcgtacaagggcctctgcatggttgtctatccaatctaagcaggtcacaatagtcctttgctacgtaacttggtattactataagtaccgatcgagacttttatatctggcatcattttggatcttatgtaagaaaattatgataatcctgtccgtatgactatcatcaatccgtacttatatccnacgtacacgtgcctgcgacgnc

SEQ ID NO: 35051 - DNA, 807 bp, Triticum aestivum
  Clone ID: PAT_TA_35051
tatacgaccggcataacttcagcaaacgtgagagttttacccataaaatgcttgacgggtgggggcttgccaccgatggaaaaattatatttggcagtgatggcacctcaaagttataccagctggatccagaatcacttgaagtgacgaagacagtaacagtgaaatatcaagacaatgctgtttcctttattaatgaactggagtatataaatggtgaagtatgggcaaatgtctggcagacagattgcatagctagagtttcccatgaagatggccaagtggcgagctggatctttcttcacgagctgaggcagcaattgtggaattctggcaacacggccattgatgttctaaacggtatagcttgggacgaagaaaagaacagactgtttgtgaccgggaaattgtggccgaagctctacgagatcaagctgcgcccggtcgacgggccaccggacgggtctgtggagaggctgtgcccaagggcaagcttttattgatgacaagtgtcgacgaggatgccgaggcaagattatttgttttgcctcggcgaggatatgtacatgtattatgcctcctggtcgattcgaggggatcggcagttggaagatagatttttttttgctgtgacttggtagtggcgtggcgggagctagctgctcgtcagtttcatgttggagcccgtgcagttctgtgtctgatcatgtatgtgttttcccctgatgtaaaagatggctgtctcttgtaaagatgatgattctgctgtgaagaaatctaatacgaaaagaacaattcattcctgac

SEQ ID NO: 35052 - DNA, 1023 bp, Triticum aestivum
  Clone ID: PAT_TA_35052
tcttcctcctcccgccccccggcgccggcctcccctccgccgggtttctcggctggcagctgcgcgccatgaactccactctcttcatcatcggcgtcatagggaacattatctcggttctggtcttcgtttctcccatcccgacattctggaggatcgtgaggagcaggtcaacggaggacttcgaggcggcgccgtacgtcctcacgttgctcaacacgctgctatggctctactacggcctcaccaagcctgacggcctgctcatcgccactgtcaatggcttcggcgctgtcatggagaccatctatatcgtcctcttcctcgtctacgccgccgaccatgccaaaagggttaaaaccgcaaagttggtggcagttttggacatcggttttttcggggttgtgttcgcggccacaacattcgccattggagggcttgacatgaaaatcatggttattggattgatatgtgcttgccttagcgtgttcatgtacgggtccccactcactgccgtgagaacggtgatcgcctcaaggagcgtggagtacatgcccttcttcctctcattcttcctcttcctcaatggaggagtctgggccacgtatgccatactcgacaaagatgtcttccttggggtccctaatggaataggctgcttcttgggcggcatccagctggttatctatgcaatatacaggaacagtaaggtcggctctcagtctcaggacactcatgaagcatcatatgatgcttcgacatctcttctgtcctcctatgccggcagacatggccaaaacgatgtatccactcacgtttagtgatttcgaacgatgtgccgaatattactactatagtgattgtgtaaaattagtagagtgaagtccaatttttacctctctacttgatatttgtaaagctagctagttatcccatttatcagttttcatccgaataccctatttaacaaaagtttcgcaagtttgtatcccaattaccgaaagttttcccgttttgtcccat

SEQ ID NO: 35053 - DNA, 1804 bp, Triticum aestivum
  Clone ID: PAT_TA_35053
cggacgcgtgggcggacgcgtgggggatgtagctggttgtgatgaagctaaacaagaaatcatggaatttgttcatttcctgaaaaatcctgacaaatatgaagcactgggagctaaaataccgaagggtgctcttctttgtggcccccctggcacaggaaagactctccttgctaaagctactgctggagagtctggtgtaccgttcttgtctatatctggttcagacttcttggaaatgtttgttggtgttggaccatccagggtgagaggcttatttcaagaagctcgggaatgtgcacctagtattgtatttattgatgaaattgatgcaattggtcgtgcaagaggccgtggagggtattctggtgggaacagtgagcgtgaaaatacgttgaatcagttgcttgtagagatggatgggtttggaacaacagctggggttgttgtacttgctggcacaaatagacctgacatcctggatcaggctttgctaagaccgggaagatttgatcgtcagataagtattgataggccggacataaatggccgtgaacaaatattccgcatctaccttgcaaagctaaaactggataaggagccgtcgttctattcacaaagattagctgcgctgacacctggatttgctggagcagatattgccaatatctgtaacgaggctgctctaattactgcaagaagagatgagaagctgattacaatgcagcattttgaatctgcaattgatagggtaattggaggcttggagaagaaaaatacggtcattagcaaactggagcgtcgaaccgttgcttaccatgaatctggtcatgctgttgctggatggtttttggagcatgcagagccactccttaaagttacaattgtacctcgtggaacagctgctttaggctttgcccagtacgtaccaagtgagaatcttttgatgacaaaagaacagttttttgacaggacatgcatgaccctaggtggccgagccgctgaggaggttttgattgggaagatctcgactggtgctcagaatgatctggagaaagttactaaaatgacttacgagcaggttgcagtatatggcttcagtgaaaaggttgggctcctatctttccctcaaaggtatgatggttttggaatggacaagccatatagcgggcagacagcatccatgattgacactgaggtgagggaattggttgccaaggcctacaacaccactactgagctgataaggaagcacaaggacaaagttgcccaagttgcagagctgttgcttgagaaggaggtcctccatcaggatgatctggtccgggttctaggggagcgcccattcaagccagacgagccaacaaattatgatcgcttcaaacaaggtttcatggattctgaggacagtaagagtgctgaagtcgacccatcatcatccgttggcgaggcagtgccaacataacttggacaacaccgcattacgctgcacataaagatttggtaactttatttggcatggctggctgtataaatgaatgcctttgtcaagccctagaactcctattttgctaatcgagacggcgtcgactctccgctggttatcctgcaattggcactccaaaacgccgtgcgatttttccttgaatcctgttacccagctctgctgatgaaaaacctttgtttctgtggcactgtgcgctagctagaatgttctgccctgtttgttttcctctgtagtttcgcttctttgcatgacaatggcaatttgttggagcaatgaatcaaaaaaaaaaaaaaaaaa

SEQ ID NO: 35054 - DNA, 1031 bp, Triticum aestivum
  Clone ID: PAT_TA_35054
ggatactatccaacaatttcatcataaggcagctctttgagtcttgcatgaagatggggctgtatgactcggcacggccactgctcgagacgtatgtcggtgcggcggcgaaggtggacatgatactgtacacttcaatcctcgcacatttggtgcggtgccaggatgaggacagcgaacgggcaatcatgaacatcctgagagtgagcaggcacaaggcgcacgacttcatgtgcgggttgttcaccgggccagagcaaaggaagaagcccgtgctctcctttgtccgggagttcttccaaggcattgactacgagaatgaggagagtgcggcgaggtactttgtgaatgtgctcctcaactacctggtgctcatggggcagatgaaccgtgcacgatgcatttggaaggtcgcttatgagaacaagttgttccccaaggccatcgtattcgaccagcacatcgcctggtccctggacatccggaacctgtcagtgggagcggcgctcgtctcgacagtgcacacgctgcaccggttcaggaagaggatgctctactacggggtcgtgccgcggcgcatcaagctggtgacagggccgacgctgaagatggtggtggcccaggttctggcttcgctggagtcgccattcgaggtgagcaaggttgtcctgcgcgcgcccggggactcggtgcttgagtggttcaagaagccgatcgtgcagcagttcctgctcaatgagataccgtcgaagtccgacgtcctgatgcacaagctgaacgttatgttcccaagctcggcgcccgaggcccggtctctggcccttcccaggtcccttggcatgtcacgctgatggtgccagtgtgtgcaaacagtaagcattatgtatactactatagctttttgccaaagcatgagaacgttcactcgtctctctgtttgtacgtgtacaataatgctaaatttcaaatggtttgtggtaccataatttttggagaaaggagagataatgcaaatgcgcccctcctgttgc

SEQ ID NO: 35055 - DNA, 1841 bp, Triticum aestivum
  Clone ID: PAT_TA_35055
cggccgggctgggacaaagagagaaaagaaatgaagattttctctctctctcttaccggccacgcgacgaccatggcgctggggacaaccgagccgctcctcctccagcccccggagcagcgccggcgtccgccggactggctcgcgtgggggctcccggcggcagttctgatactgctgctactctccgcctccggtcctctccgtccgccgcttttccgcgtgccgccgccggagaccgtcccgctgaccctgctcgccggcgcgcaggagaagggagcggtgtgcttggacgggaccccgccggggtaccacctgcagagaggctctggcgacggatccaaccgctggctcatccatctagagggtggaggctggtgcagcacaatcaaggattgttccaaccgcagaatgtacgcgcttggttcatccaatttcatgaaaccgatacggtttgccggtgctgggatcctcggcggtgaccagctccagaatcctgatttccatacctggaactttgtaagacctgcctactgtgatgggccgtcgttttctgcagacgctagcgcttgtgccacgtccggaaaaactggataccacacagggctgcgtagatctggggcagttctcgtgcgacgctttggaccacgatcctccaatgctacaccggccctctttgcacgcggttattccggtgttctcctcaagccgattgagtgcgattgtttcctctcactgtttcatacgggtggggctctttgaggcttggcggacccccactttcttgctgaccactgcgcatctcccgtagcggcgccgattggttctgcttccatctgcatcgtcgcccctgtatgcgttagcgaaaggtagtgcacagattggaagcacacttcacttacgaggattgcgcttctaccgcgcgggcattgacgaactcttggaaaaaggacttgtcaacgctacacaggccctgcttccaggctgttctgctggtggcctataccacgatactgcattgcgatgatttcagtgcacggttttctcgcaatgtttcggtaaaatgactctctaatgctgggttttttcttgacgtaaaggatttatctgggaaataagtccttttggtctgtctatgatgacgttgttcacctccagagtgttagagacttgattgcccaccaactgccttcccaacaatgatccaactgaatgtttcttccgccgcgtagcattttaagagcatccggacccccatgtttattctcaactctgcgtatgattcatggcagatacgaaatgttcttgtaccagtttaatcggctactgataagtcgtggtcgagttgcaaggataatatccggaactgcagttccacacaaatcaaagtccttgatggcttcaggaacacaatggtgggtgcattcaaggttgtcgaatataaggaggactggggattgttcatcgattcatgcttcactcactgccaatccctatatggcatctcttggaattcagaaatctccccgaggcttggaaataagagcattgcagaggccgcaggagattggtaccatggaaggagccaaggagagaaagagatagactgcgagtatccatgcaatccaacatgcagcggacagttgcctccatgatttattattagatcctgtcgagattaattatgtcaaggaggcaaatgcagatagcattatcttgtgatgtccatcatagtgaaaggctagtgccaatttagaatgaaaataagtatactcagatgaatgacaatgcgtcaagtaacaaagttcccatttgtgcgaaaaattaaggttatccacatt

SEQ ID NO: 35056 - DNA, 1286 bp, Triticum aestivum
  unsure (1)..(1286): unsure at all n locations
  Clone ID: PAT_TA_35056
gactnacctcactatggtggatacttcggatattcctgtagaaggtcctcttggcatcttaaactccaaaaccaatgaacatcatactttggagtttaggaataacgagctctttgtgtcagagttgcaaaacacaatagataaaaaatcaaaacagttggatgaggcagaaagtaaacttagctctgtgatgggcgaagttaactctcttaaggaagaacttgaaaatgctcgtgttctacttgacgagtctcagattaattgtgcgcacctggaaaactgcttgcatgaggcaagggaagaggctcgtaccaacaaatgttccgctgatagaagggctgttgagtatgatgctttgaggtcatctgctctgaggatacatggtctgtttgaaagactaaataattgtgtcaccgcaccgggcatgtctggctttgcagactctctgcgaactttagccctctccttagcaagttctgtaaagaaggatgaagctgattctaccactcagttccagcaatgcattaagatccttgcggacaaggttagtttcctgtcacggcagagtgaggagctgatagaacgctactcaagggtggaagcagcacatgggattcttataaaagagttggaggagaagaaaacactggtcaacaatctatatagtaaatttcaactggaaaaacaggccagcaaggagaagatatcggttgggcatttcgacgtccacgagcttgcggtgtttgtccggaaccctgctgggcactacgaggcgatcaaccggagccggtcgaactactacctctccgaggagtcggtggccctgttcacggagccccaccttcctcggcagcccgcctacataatcggccagatcgtgcacattgagcggcgcgcggtaaagcacaccgaccagaacgaagcctcgccgcgccctggcggccatcggcggtccgcgctgaacagcaacccctatggcctgccggcaggccgcgagtacttcgtggtgacggtggcgatgctgcctgacactgctgccactgctcgttgaagcaagaacgccttcctgatcctgcctagtcatggctgctgaaatgaagggagaaaaaaaacctcaactgtaaatatacagccacttgtttaaagtttatttatggctttgctcagttgcttcgtctgcgtttgcttgctgccttgtgtacataatgctcggattcctgtgtaaatatgactcggccactgctgttattatcagcttnggttcgttcaaggagactaaataatag

SEQ ID NO: 35057 - DNA, 1743 bp, Triticum aestivum
  unsure (1)..(1743): unsure at all n locations
  Clone ID: PAT_TA_35057
gctattttgtggaaagggggccctgaatggtacctagaatttcctgacagaagccagtggtcgattttcaaacaaatgcatgatgaatgctatagtcataacatcagagctgcatctgttaaaaacattccaatccctggtgtccgcttggttgaaggtcatgatgataatgaggttgtatcgtttgtgcgcccccaagattatctttgccatatcggaccagatgttgaaatggcccttgacgaatcccgtttgatatatgacatggatagtgacgatgaagagtggatttcaggatggaggaagtctcagcgagataagaacaacactatgtctgagttaacagaggatttgtttgagaagatcatggacaaatttgagaaatttgcacatacccataactgcagtgcgctcaccattgatcagattaggaattagatgtggataatgtaccgctggacatcactgaagtgatacatgatcattggcatgacaagaggcagaagaagggaatgccgcttgttcgacattttcagcctgttatgtggaagatttatgctcagcagctacaggaatgggaatcggcagtaaacagaatgcagggttcatcaaatgggtaccaaggaaagaggccgccctccaaacctgcactctttgccttctgtttgaaacctcgtggactccggcttcaggtatccaaggggccgaagcagagatcacataagaagcttatgtactctggatgccacagcttttcgagagagcaggatggcttttaccgacaagcttcaggccggagaaacggcgaatatgttggggatgggaggacatatgaatcctatgacggtggttctcttaattcaccaacagggtactcccccaggttctctatgagaacagattcccctcgcacgtctgatgcttcggacagaggttctactccaagattcaggactaacagtatgaaaaggaatgcaagctttgcattctctgaggatcaccaaccgtccccgtccttccgcagccagaaaataaggcgaggaggcgtgcctgatcactggaacactgcaatccatgagtaccagaactcgaagcaggcgccccagagccaccgtgtggacgtcgaggagctcaagctgcgtgacgccacgagcgccgcgcagcacgccgcgacgatggccaggctcaagagggagaaggcccattgcctgatgcacaaggcggacctcgccctccacaaggcctcggtggccgtcatgatcgcggacgcgatcaaggcgtccagcagggactcgtcgcgggcggcggacagcaggagggacgacgggcggtgacgcctcgttgtcgggcgtgagctgatgcgtgcggacgcatcgttttgtcgataggatcaatgcagtagatagcgtcgggccgtagaaaaaccaaccttcctccaaaccccaaaccagttctgtttgatccttttgtacatgtgatatttcttcctcctccttaccttgtccagagtcttgtctggggatgatggctgatgcctcccgggtggttaactgtgttgttggcagagacggttgttgatagggcaggtagctgttgttgcatgatttgcattctcattgttgttgtaaaggttgcttcttccatccaagggaaacggctatggcttgtgctgccagccgctaccctgcccaaagaaaatgaaatatgaagagaatagttgaggacaaaaaaaaannaaggaga

SEQ ID NO: 35058 - DNA, 921 bp, Triticum aestivum
  unsure (1)..(921): unsure at all n locations
  Clone ID: PAT_TA_35058
aggtcggccaagatatcacagggcaaaaggtggtcatggataaatttgtcaacatacaaggggattacaaggctattgtacacaatcccaatcctctaataccgccaatatttgcttcagatgagaacatatgttgctccgaatggaatacggcaatggaaaaactcacaggatggtcgagaggagaagttgttggtaagcttctggttggggaggtatttggaaattgttgccgactcaagggcccagatgcactgacaaagttcatgattgttcttcacaacgctataggagggcaggattctgagaggtcccccttttcattctttgacaagaatggtaaatatgtacaggccttattgaccgcaaacacaaggagcaaaatggatggtgagaccataggtgccttctgcttcttgcagattgcaagccccgaattacagcaagcctttgagattcagagacaacaagaaaagaagtgttatgccaggatgaaggagttggcttacatttgccaggagataaaaaaccctctcagtggtatacggtttacaaactccctgttagagatgactgatttaaaggatgaccagaggcagtttcttgaaactagcgctgcttgtgagaagcagatgtccaagattgtaaaggatgccagcctccaaagtattgaggatgggtcagtattctgatattagcccattttaacttcacttggtgtgtagtaataataataataataataataataataattaccgagtgtgatgnccttttccctccacaacttctgcttggactctgaatagtttcaacgttagctggcactaattntgtttgattaagcatgtaagaaagataagggattagagaagtaagtacatcagacactgatagctccattccttgtcttggcacctc

SEQ ID NO: 35059 - DNA, 1669 bp, Triticum aestivum
  Clone ID: PAT_TA_35059
cccacgcgtccgcccacgcgtccgcccatgcgtccgcccacgcgtccggaagacggggaggaaggattggaggtggtgacgccgatggtcgtgttcgtcaactccaagagcggcgggcgccacgggcccgagctcaaggtgcgcctgcacgagctcatcagcaaggagcaggtcttccatctttcttctgtgaagccttctgattttgttcgctatggtttgggttgtttggagaggttggctgatcaaggtgataactgtgcaaaggacatccgtgcaaatttgaggattatggttgctggaggtgatggcactgttggttgggtacttggatgtctccaagaacttaataagtcaaaaagggaaccagttcctcccacaggaatcattccacttgggacaggaaacgaccttgctagatcatttggatggggtggctcttttccctttggttggcgttcagctgtcaagcgatatctcaacaaggcagtgtctgcttcggtcgtccatcttgacagttggcaggctgtgattaggatgccagagggagaaataacagagttgccacatgcacttaagaaagcggaacctgctgatcagctggagttcagcaaggcaagtggcagtgagttaaccgaaagggcttcttgctataaaggagtattctacaactaccttagcattgggatggatgcccaagttgcatatggcttccaccatctacgagatgaaaagccatatcttgctcaaggaccagttgcaaataagttgatttatgctggatatagctgcacgcagggatggttctgtactccttgtacagcaagtcctcagctaaggggacttcggaacattttgcggctttacattaaaagggcaaattgttctgaatgggagcaaattcaaatgccttcaagtgttagatcactagtggtcttaaatctgtacaactacggcagtggaaggcatccatggggtgatcttaaaccagattatcttgaaaagaaaggttttgttgaagctcattcagatgacggtttgattgaaatatttggtctgaaagaaggttggcatgcttcattcgttatggctgagcttatcaaagcaaagcacattgctcaggctgcagctatcaagtttgaaatgaggggaggcgagtgggatcgagcatatgttcaaatggatggcgagccatggaaacaaccactcatccaggaccagtcgacaattctggaaataaacaaggttccctatcattcccggatgataaacggggattcatgagatttccctatgtcaatcagggttacactctagatcggtaggctatgtacagtttaggagcacctggagctagaatccatagagatggctcagctgcagcgaagatgatgcaatgattattggcctttaccaagccatgggccaatcatggcaggagcacaatgcgccaacatgtactggtgtatcaaatataaattatgttgtatcctagttcctttttttgggaaaagaattcgaacttgatttgtattgttttcttgtctctggtaaacaaccagatgaaaacccccatgtaagattaagttattatgctttgtgttcaatacaacaattcttttccctccgagacgatcctttgtggtgatgtcaaaaaaaaaaaaaaaaa

SEQ ID NO: 35060 - DNA, 1105 bp, Triticum aestivum
  Clone ID: PAT_TA_35060
tctgcgtcggctttggcggctttggcgcgacatatagagctgaggttgcacctggggttttggtggcagtaaagaggctttctattgggaggcaacacggtaacaagcagttccaagcagaagttgaaacccttgggcggcgtcaccatcctaatcttgtcactctcatggggtaccatatcagtgaccaagagacattcctgatatacaactatttgccaggtggaaacttggagaggttcatacaggagagagctaagaggcaaattggttggagagtgctccacaaaattgctctggatattgctcatgctcttgctttcatgcatgatgagtgctccccccgcattctgcaccgagatgttaagccaagcaacatattgctcgacaatgacttcaatgcatatctctccgattttggattagcgaaacttcttcgcaactcacaaactcatacaaccacaagtgttgctggtactttcggttatgtcgcgccggagtatgcaacgacatgccgtgtgtctgataaagcagatgtttatagctatggggttctgcttcttgaactgatctcggataagaaagtgctggatccatcgttctctccatatggaaatggtttcaacattattagctgggctaataagctaatccaaagcggtagagtttgcgagttcttcgttgagggcttgtggaataaggccccacatgatgacctggttgagattatgaagctgggggtcctgtgcactgtggagtctctttcttctaggcccaaaatgaagcatgttgttcgtcgtctaagagaactccgtccgccttcttactagggaagaacaagaatggagttcaccagggcttgtggcgcagtggtcggtcgtctgttccgcacagcaccgattccaggacaagatgcacatgtcctctgtgttataggaacacccttagtatggttagcaggataacaataagacttctttgtgaagaggtctaaacatgtttattcccccaccgccaaacaccgtcttgatatcggtggtaccgttgtgatcgaatttgttggtcgttgaatgtgcgccgcaaccaaggttttatgtccaaaaaa

SEQ ID NO: 35061 - DNA, 1473 bp, Triticum aestivum
  Clone ID: PAT_TA_35061
ccctccatgcgagctcattggatccctttcggtcaatggggctaagacggcaaaagtgaattacggagctaatggctgggttagtcaccaagtcacagacttgtgggcaaaaacatcaccggatgctggtgatccttcatgggctctacggccactgggtgggccatggcttgctacacacctgtgggaacactacagttttacaatggacagagaatttttggagagaacagcgtatccacttttggaaggatctgcctcctttctgttgtcctggttgattgaaggccaagaaggctatctggagaccaatccttctacttccccagagcattattttattgctgcagatggcaagaaagcatctgtgagctattcaacaaccatggacatgtcaattattagagaagtattctcagctgttcttctgtctgctgatattttaggaaaatccagctccgtggtggctcggcggctgtgagcggcaccgcctgcgcgccctccgaaaaaaattggtagagatggtaccatcatggtttgcgcactactcggtaaggaccccgagcctcagcacaggcatgtatctcatctctttggtctttatcctggacataccatgacacttgagcaaacacctgacctctgcaaagctgttgccaatactctttataaaagaggtgacaaaggccctgggtggtctacttcatggaagatggccctgtgggctcatcttcacaacaagtaagcatgcatacaaaatgattctgcagctaatcactttgatagacccaaagcacgagcatgaaaaggaaggaggtctatacagcaatttgttcacagcgcatccaccattccagattgatgcaaattttggattcccagctgcattgtgcgaaatgcttgtgcagagcaccgggagtgatctgtacctgctccctgctctgccccgcgacaagtggccccatggcagcgttaaaggtttgagggcccgaggcgggttgacggttaacatttgctggaaagaaggtagcctgcatgaagctcttgtatggtctggcagcagcgggaattcgcctgcgcttgcgaggatccactatggcgaccatgctgccgtgatcagcgcctctccgggtcaagtttacaggttcaactcggagttgaagtgcttggagacttggcaactgtgagaatgtgcgtgtgctggttctgcagtccgaaggcacaatctgttgcgacaaaatttattgaattctcagtgagaacaattatagagctatcctaaggcagaacctgttgtgacaaaatttactgaattctcagtgagaacaataatactcacttcttcccaaaattgaaatttgatactaaaatgtgacttgatacattcgtatataagacaaatctaagacaagaattttgggacggagagactcgtaatgaaaaaaaaaaagtgaacaaatatggagcgatgtc

SEQ ID NO: 35062 - DNA, 797 bp, Triticum aestivum
  unsure (1)..(797): unsure at all n locations
  Clone ID: PAT_TA_35062
cgcctgccggatacggtcctagattcccgggtccactccgcctctgtacgtcgagcaactgaaggtggaccccctcgagagctcggttgtggcattaccaccattaccacccctcgagcccagccagatgctcgactccgagaagggggattccgacgttgcaatgtcttgctcgtccgtgtccattgggcaagtggttcctgtaggtgatatggttgtcgcacccagagcattggctcgtgtgcctggggctctcatagcaaaagagatttgtcatttcctcgctaccttggacgctgctaaccctggatccggcaagacgattgggtgtctccttaaggagaaggccatcagggataagaaaagtggtggtgctagctctcgtcctgtcgtcttgaaggagaaatcaaacaagtgcagaaccaagaagagtggcgctatagaaaaggcgtccgtgattgcttgatggatagctctcagtgtttggacatgtcatcacgggtgtgctcaggtctgtggcctttcccgatgttgggtcctctagttaccttcgatatgtggaggctcacttgtgaagttgaatttcatgtgcaagcggattgtaggggtggcgtgatgggggagtttgtctgtctttctttgtggtcttgtggtcttatgatttgggagtagtccgcttgtatcatgagattgtgacttggttgtccttcatggccaagcatgtaacggtcttcgcctggttttccataaattaaccaggcaactctcttcttcttaatcaanaataagaaaaaaac

SEQ ID NO: 35063 - DNA, 848 bp, Triticum aestivum
  unsure (1)..(848): unsure at all n locations
  Clone ID: PAT_TA_35063
cttttctttctcttccccacccgttccccccacgccaccgtcaaactccagctgcggtctcccgcggcagccccgccccgctccccattcctccccccacccaacctgcgaccgctcccgctcaagaagaaaaaacccgagcttggcgagccgcctgccggacggagagctggtggtcggcggaggggagcggacggcatggcggggcacgcggcggtgcgtagctgcgtgcagacggcgctcaaggcggccaactccctcgtggggctcgccgggatggccgtcatcctctacgcgctctgggtgctccgcgcctggtcccagcaggaattcactagtgattagcgtggtcgcggccgaggtactcttctcagcctgggaatcatcatgtgcttgctgacctgctcgggccgcatcgccgctgaagctgcaaacagcccctgactgtcttgtcacgtgatctttgtattcttgcttgtgatactggaagctgcaatcgccgtcgatgtatttctgaatagctactgggaggaggacaaatcccaccagacttggctctaattgaagttatcataagacagatccttgcagcgcaacacgcagggtgaatcagatggcatggcgttcaaacaaagccatatttttatttagtctactatataatgtactgctatcactatatggcataaaagaacccatataaatctgttatcctgggactgccaagtggcttgctttttggtgtatcaagtgtatttttgaactgggtgaagaaaacctaccaccatatgtaatccnacttgggtactacgggtaccaatggtctatgaagatgcatgtattctggg

SEQ ID NO: 35064 - DNA, 1722 bp, Triticum aestivum
  unsure (1)..(1722): unsure at all n locations
  Clone ID: PAT_TA_35064
tcggcacgagggttggatacaatactggcattgattggtgagcaattcgaatatgataatgaaatttgtggagcgatccttagcgtgcgtgcgaagcaggaaacaatagctatatggattaaagatgctaccaatgaagctgctcagctaagcattggcaagcagtggaaggaaattcttgagtacaaggactcaattgagttcattgttcatgatagtgatgcaacggcagtacaatgctggtcttccacgtttcccgatgatccccttgacgtcatctacaacaaggtccccagtcactgcagccgcgtgcgctttgctgccgtctgcaggtcgtggtgcactgcagcttcgcggcaccctgcactgcctgaacttccgtggctgctcctctcaccacgcgaccgtgacacaacgaagcgcctgtactgtcctgaggacagcaagaacctgcgcatctcgctcccgagcgatttcatcagcaactggttcgtcggctgtcatggtggtggctgggttgcatcatttgaaccgccaccgttcaggatcttgaacattttctccagtgttgaggttgcgctctccgagaaacagaagggaatcgtttgcccaggccgccttggccagatcatcatttggaaaatcatcttctccaaaccacccacctcaagtgactgtatcattgctgccatcaccgacaatcacggcattgcgctctgcagggttgggtctccgaacggtgggtggacgacaaaaggagatgtaagctacaccatggagcttgcagacatcgccttctgcaacggtgagctctatggcctcacacgagacagatgggaacttgtcaagtttgtgatcggcgttgacgaagacggcgcgcctctggtcacggccgtggatcggctggtggtcacccccgagcaccagcagcccccaagtgtctgggccaaccgggtggatgccagctacatttttgagctacacggcaagcttgcgacggcggtgaggtccccatggtcacccaacctcagaccattcttcaaagtgttcgaactcgttgacatcgaggccagcgaggggatggcacatggcgcacacaaatgggcagaggtgatgagcttgggtgactttgccctattcctgggtccaaacagctccaaggcggtgcatgtgtcagcagacaggcgcggtggtgtgaagagaaaccacatctactactcctaccatcgccgcttagcgcagaaggaggtccttctcagcactgacctggtgttcctgacaagctccaatgctgatggtgattccgtgtactacagggaagatgaaagcttatccgcagccgtgggcggcgttcataggatcggggcagtaggatactatgtcaggggtagccctaatcctccattgtggcttctcccccaagcatagcgttttttatatatatatatatattgtattgcttagctgctgcacatgttcgctgtataaccgtaaatgctctatggtttcaaccatgttgtatttagaacaaatgtacagcaattataatcgatctgtactcgtataaagagaagaagtagggaacttctaaaaaaaaaggggggccggtaccaattcgcccatangatcntatancggctcanggccgcgtttaaantccgactggaaaaccgggtaccaantaacncttgagaatcccttccaagtggntaaacaaagncc

SEQ ID NO: 35065 - DNA, 703 bp, Triticum aestivum
  Clone ID: PAT_TA_35065
cgcacagcaactcccgaccccgacacccagccggccagccgcctcgccgtcgcggcgtcgccggtcgacggccggagcccggagcccagtcgtccaggaggctccctccaacccttcccggcttcccgcctccccttcccggcttccctccgtcccggccacccccctgcaaagccccaccacggcggcaacaagttacaagcgagcaaactgaccaatttaagatgtggcgagccgctgttctgctatgcttcattcttcaaggtgccactgttgctgctgataacgagacatggggctacgttgaaattcgtcacaaggcgcacctattttggtggtactacaaaagcccacatcaggatgtcctcgccagtaaagccatggccaaccaccgtctggttggccggcggtccgggagggtcaggcgtcgcgcgtggcaacttctgccggatcgggccgctggatgtcaatctgaagccacacaactcgacgtggctgcagaaggctgatctcatcttcgtggacttaccagtgggtgttgggtatagctacgtggaggacccaagcgtgctagctacgacggacgtgcaagttgcttctgatgccaccgagctcctcaaggcacttaccaaggagatacccaccttgcacagcagcccgttgttccttgtcggcgagtcctatggtggcaagcttgcagcga

SEQ ID NO: 35066 - DNA, 729 bp, Triticum aestivum
  Clone ID: PAT_TA_35066
cccacgcgttcttccacgcgtccgctcatccgctgcggcatgtccgttctgctcgttgcttcatcgctgacgctattattgagatatctaacctgatgcctcacatagctcagaacacccagtcggaacctgcaggagccatcttcaccttaatctgaaaatagaaggttttccttttgctagacctctgaaaaatctgcagtggagtagttgcgcggattacctgttctggtctgtttttatggaggtttagcaggcctgacttaagatcgaaccctgacggtgtttaggcatggtccggttggagagcttatttccagcgttggaggtcttttcagtttttctaaagacttgtccaagttaaaccacgagaatgtcatgggcttgcttggctaccgcggagaagggcattctttcaacggcactgtcgattgctagcaaactgtctattgtgtcgttgattgatatccagacttactgtttttcgttcagtttaagggctctctaggcttaagatctttctaggataattgtgtcattgaatctaaaggaggcgcaaaacttgagttgcctgcatatgagtttgccagttcaccgaaacttagaataaagaggggaactttctccgttttgttgtttttgctcttctcagattttaggctgggtgtttaacatatatgccacacacttaaattagatctcagtgcaagtttaaatagggatgaatca

SEQ ID NO: 35067 - DNA, 581 bp, Triticum aestivum
  unsure (1)..(581): unsure at all n locations
  Clone ID: PAT_TA_35067
ggtcgacccacgcgtccgccccgcctccacactagcagacactgcccccggccgcctcctcctccctccctcccccgtctctcctcctcgtcgcagcgctgccaccgggccgggccacagggggaccggcggaacataccaggggggaaaaactcgccaaaaccctagatctcccgcgcgcattgcccttctatgaccctcggcccccactgagggcacggccatggcctccgcggccgtcatcccctcccccgccggcggngccgtgcccgtgcacggggccgccgagcccgccggctggctcatggacgagcgcgacggcttcatctcctggctgcggggcgagttcgccgccgccaacgccatcatcgacctcctcgtcgtccacctccgcgccgtcggcgacccgggcgagtacgaccacgtcttcgccgccgtgcagcagcgccgccaccactgggcgcccgtcatccacatgcagcagttcttccccgtcgccgacgtcgcctacgcgctgcagcagtccggctggcgccgccgccagccgcccccgcaccagcacggccccgtcgtctcgccgg

SEQ ID NO: 35068 - DNA, 1747 bp, Triticum aestivum
  Clone ID: PAT_TA_35068
cggcacgagggatgttctctcagagatgttaaatgctattgatcctggtaacagagagggtctaagccgcgagctcattggccaccttgtcccccagtgtcgctctttcgtgctctgggcggctctgcccgtccacacccccgccgatctgcagctgctaagcctgggcccttctttggacgatgggttgccgcgtgtgctccctttccgtcacgccgttgccgccggctcagcggtccggggtgctttgccaagtccccctctggccccggcgtaggcgtcccctccagcttggcctgcggggccacggcagcccgctcaaaggtcctctgaagctgccggtaaggtttctccatttcagcaattagcacttcctgcccctccatcatccagcacctcaaagcctcctggagaagcatctgttggccctagtattgacctactcagtggagatgattatttcaagccagaacctgtgaattcccaagcccttgttcctgttggcaattcccctgcagcttctgcttcaggccacaataccttagatcttgtagacatgttttcgcaaagcgatgctagcaataacaatcacaaccctgttatatcgtccccaatattgaactcaaaccctaatctctcggcaccacaagcatatcctgctccacagcatcctgttccaccacagcagtcttcattttccaatgggttgacctccaatacaatcccaacttatggtcaaggttctgacctaaactcagcaagttcgtggaatgggcagcttgctcaaggaatgaatcaaccacagcaggcaccaaattatggtcaagatgatcaaagcagcgacctcccaccaccaccctgggaaactcagcctgcagaaagcgatcagttccaagctggtcaacctgacaggttggcaatgccaccaggacaattcggaggcattccaccccaacctgttcaagttggtcagcctgggcaagtttcactgtcgcaaccattgctgactggacaaccaggcgggatgcagtttccaccgggatatgtggagcagcctggggctcaacatccgcaatcaatgccaaacacgcaatatgggggcatgtatccttcaatgcaaggcaaccaagcaggcggcatgtatccccaacagatggcaggagatatctaccagcaacagatgtatggtgggcagatggcggccggctatggctatggtcagcagcctggaggctactatgtcccaaatgctgcatacgggtatcccagtgcaaacgacctttctcagagaatgaacggacttgccatgcaaaacaacggcttatatggcacacctgcgtcttcttcccttcagcaggctaataggccagcaagacccgaagattcactctttggtgatctggtcagcattgccaaaacaaagcctagcaaaactgctgctaataaggccggtggcttgtaaagatgaatgagaatccttgttagcaccatttctgtcacagcgatagcttctgctcatagtacataagttctttgggaagtccccctattggggagtagtaggcgagttatagattttgaaattcatagcaagtgtggttcggtataatcctatttttgtttactcggaagccattatattttgttcacttattgcaagcgcagggttctcgtgaatcatcagaaattcttctgtacataaattcagtttcttttgtgtaccttcttttcttgggcaaaaaaaaaa

SEQ ID NO: 35069 - DNA, 511 bp, Triticum aestivum
  Clone ID: PAT_TA_35069
ccgtccggctcctcaccaatacgcccatctcttctcccgatgctgccctctagccgagatcccatggcgcgctacgtcgccgctccggctggccggctgagaggtgcgcacagcctacaacatgaatcgggagagccatgtaccatcgcctcccatggatcttccccggctccggctccctgcctcccatggatcttcctcggctccgcccccctggcctgaaggcagataaacagcggtggcctttgcgtgatccaaggtgacacacctgcagctggcagcggatagctcgatgccctgttgctctccatcctaatcggctccccttggccttccccagctttggccccggctgccggtcccctctatccgcccgacggccgtccctctactgcagcgctcttgaaaaggtattgcacgcaggtctgtggtgaggactctgatttgggtgtctaccttcttgcatgagtgtgccaggaatttagaacctgcatcttttcttcagtatacc

SEQ ID NO: 35070 - DNA, 689 bp, Triticum aestivum
  unsure (1)..(689): unsure at all n locations
  Clone ID: PAT_TA_35070
tagagcttaaactctgcactgtcctcgcccgcgcctcgcttcgctctgcccgcgacgccccgcgccctcgcgctcccgcctcccccctcgactcctgcttgaccgcccttgccttcgtccagccagtagggccagctcgaaccgtgtgcaccaggaagaaggccagcccaaagttgatgaagggagaaagccaataggatgccctacaaatcgatttcgaacaagtttactgcagtacctgacggcctctcacagtctgcaaccagccaaccacctctactggctgctgccactcctcatattggctaggaacacgagctctgggctctggcggcagcacaaggagcagggcagaggagcaggacctcgttagcgtgcttcttgctgcgcgccagtcctcggcgccgggggcaaggggcggggcggggtcgggatcctcgatgccgcaggtggcgctggtgctggaggtgacgctgttcccccgctcgctggcgtagccgctgctgctggggctgggcggaccggcgtcgccggccatcctcctcctcaaacgagcccctggaactccacccccccgggcgcggcgcgtcacggtcaccctcgtcttcgtnctcctcgggngaatctcgtgggcccnacnggcgcgcgaaagtctgcgggnaaggtcaancgtgtatcctttggnaatc

SEQ ID NO: 35071 - DNA, 641 bp, Triticum aestivum
  Clone ID: PAT_TA_35071
gaggaattcggacgaggatcggatgggtccggtgggtggccgagggatcatggggaacggagggatggtggctccaccgccaccaatgatgcatcccggagggatgatggggcagggatttgatcccactggctatggtgcagccatgggaaggatgggtggagggtttggagggttccctggtggacctggtggtgcaccattcccaggcttgatgcagccattcccacctgtggttgctcctcatgtgaacccagcattctttgggagaggaggtggtatgggtgccgggggtgttggaatgtggccagacccaagcatgggtggtggttggggaggcgaggaacaatcaagctatggtgatgatgcagcatctgatcagcaatatggagaaggtggaagccatggtaaagagaggccaccagagcgggaatggtcaggtgcaccagaaaggaggcgggagagggaaaaagatttgcccccaccgccagaattgccggagagaaggcaccgtgatgaacgggatatgggtcgtgagagggaaagagagagggacagagaggagatagggaaagggagagggacagaggagatagggaaagggagagggatagaggagatagggacagacaccgggatga

SEQ ID NO: 35072 - DNA, 958 bp, Triticum aestivum
  unsure (1)..(958): unsure at all n locations
  Clone ID: PAT_TA_35072
gaattcggcacgaggccgcctctgctggctgcacctgccgcggcgttcattcagcatcgacgcccggcgccggcggctacctccccggaggaccacggcccccccccgcggccgctttcttttcgctgggattcttccccccccttccccgccctcccgtctctccaccccccccccgcggcaccccccccttgccgccccacgctttcccccgccgtcgcccccggcctcggtgacgagctcccccctccccacctgccgcctgcgctgtcttactcccgccatccatccagccaccccccccatcccgtttccacgcgcagaacacgctccgcccccctcctgcgggccgtccctccgcccccccctccatccgagccggggctcggagttcgatggtcaagaaaggaggacgtggagcgaggcgttcttggtggccgcgcacacggggcaggcgttcacggcgggttcgcacgcgccgcacagggacaggtgccggcaacggagcagcagaacgcaggcgtcccacggtggcgtccgcgccatcaagctccagcaccaagccaagccactctgccgtcatctggacgcatgccatggcgtccgcgccctcaagctccagcaccagcctcgccttcctacgccgcgccgccgttgattcgtataaacttcaagggcttttatgcaaaacaaccatgacggacgacagaaacccaattctctttattattaggttgaagacacgagttgggggttcaacctttgtcctctcgatgaagaagatggcagtcagtgatgatgggcctagtgacctaggaaccattttgtctctttttttccctattttcatgtagtgatttcatgattgtgtgatttttgtgattttcattgagtggtgttgtttatcttagttgaaactctatctctaacatgcaattcagccgtcctttgcgtnncc

SEQ ID NO: 35073 - DNA, 655 bp, Triticum aestivum
  Clone ID: PAT_TA_35073
gtacataaactcctaaagctcatcgagaaaggtagaaacacaaatgtgaaatcttaatcttttggttctgaggtgttggctcttgtccccatatggtgtagtgtgatgagacaacaattcttattaactgactttggtctagcattagttggtaccacaaaagtaaattagctaaggtttcaaaattggatgttgtgttttcctcttacagtgtagagccaataagataaaaggttgattttaatctcagttatgcatctcctgtgtctcttttatgctcattgatgctacatgcttgcttcaggcaggactatgttagtttacttcccattgatattttctataggagcatgttttctttacctattttatttgacctacagaaatgttcccttgctttggttggatgggtgtagcagctgcaagcattggatgcacacggaaaactcaagcaacttcgccaccctgaaaactccagtaagatcgcatcgtattttttgtcggatcacgaacgacttcaggctgaagaggaccatgcgatgcaagaatgattattttgggcgcgctcctatggaagactcatgtaattgacgtctagaacactgtcagttcagcggttgtcatcatgcaagcaattggccgctgatctgcttgc

SEQ ID NO: 35074 - DNA, 677 bp, Triticum aestivum
  Clone ID: PAT_TA_35074
ccacgcgtccggcttaacctgattgtcctgggtcttttttgtgatcatttattttcactgttaattttcatggcagattagtcattgtgaactagtatcagatcatagtaatttgaactataactttgtacagtaccattgtttctaaaatacagtcatgtattcacagctttatactgaaatctaatctgccatgtctaaaatacagtcataggttcacagatacaaatgtccaaacatgatcaaaagtatctgaacagtgtacagtttctcagcaccaaacttctgaaattacagcagtactactctttttgtttgaacaagtttttcctaaatggaattcatagcttcctcatgcctcccctctcatccccaaacttttcttggccctgtgttgtagctatagctgcgaatttctgagcactaattttgcaactagttttcagaatctagtgttccagaagtgttattcctgtgaccataaactagtaattcatatgtgttcatagtctagttgttcctagagtttctcctgctccatgctatcttttctgcctgtgttctaatctttttctgttaagttgtgctcttcagcatatgtgaatgatcctcacagggagcttgtttttctttcagatgtcatgaggtaggagagagatcttggaggagtgaatgca

SEQ ID NO: 35075 - DNA, 728 bp, Triticum aestivum
  Clone ID: PAT_TA_35075
aagtcgccgacaggccggtggctgcctcaatcctcaactgcttcattcctctgcctaaattcccccgaaataaaaacaaaaaaaccgtcaaaatggtcaaggctgtgagcgttcttcgcggtgactccaaggtctccggtaccgtcgtcttcgagcaggagtctgagtctgctcccactaccatcacctgggacatcaccggtaacgaccccaacgccaagcgaggattccacatccacaccttcggtgacaacaccaacggctgcacttctgctggccctcacttcaaccctcataacaagacccacggtgctccttctgacgagacccgtcacgttggtgatctcggaaacgttgagactgacggccagggcaatgccaagggttccgtcactgattctcttatcaagctgattggccctcacagcgtcattggccgaaccgttgtcatccacgctggtaccgacgatcttggcaagggtgacggcgaggagtctctcaagactggtaacgctggtccccgacctgcttgtggtgttattggtatctccaactaagcaattctgaactgaattgaacaaaggaaaaatgctattgcttacttagtggcttttgtttagcaaatcccagccacgagtaatgatgtgtctcatgatattcgatagcaacaatcaatccaatttaagtgattacagaaaaaaaaaaaaaaaaaaggcccctagccccta

SEQ ID NO: 35076 - DNA, 1285 bp, Triticum aestivum
  Clone ID: PAT_TA_35076
tcgaacccactgccgtccgcaagcgccaaggactaacccacggataccattattttatgcacatgcttcaaggaattcatcacttctcaaagaagattttacatgcgtctccaaagtggcagtgattcacttggctctgataatgccaaagtaaaaccagcacgcttcatcaaaccctggtgtaccaccatcttcattgatgtcattcatgacaaagaatacatcaacttctggagttgtgttagaggacttcgattcccagttttccaatagattttatcacagccatttggacagccctgcaaacatcaattcctcatcaatagcagcagctgctgctttggctgcgaggtcattgtacattcttgctactggtgatatgaccgtcgatctcatgacactgaacactataaaagtgaacgtcacactggtagaagaattgattggatgtctactgacctgtgatcccggtctttcttgtggcatcgcgaagagcttcatttctccaagcaatgcctgcccgagtcactatgttggtgttttccaggactcaccttctagcacgcagtttccttcatatgcagatgatacctcccggttcatatggaacttcttggcagacagaacttctactttggcaagcaatgtaagctcttgtactgggaagtgcaacaacgaaagtgaagtatgcgtagggggagaagtggagggtggaggccggtgcgttgtatcgacaacaaggtacgcccctgcctattcaaccaggctgaagttcgaggacaacgcctggcacgttcttccggcaaactcttctgaccccatgggtgccgcggaccccatatggaccgagagctactggaacaccatcagcctgagggtctacgcggtgcagtccacgacctccgacaggctcatccttctcgccgggctcgccgtcaccgcggcgtcgtacctcgggggtggtcgtcggcagagcgtacatctcgaagatcacgaagcgagactaaaaacatgacagcgtgtatcatatagaactgacctggcaactttgtagggatggaccgagtatggatgtaattcttgagcggtagcgatgcagacttccaccagagcatatgcatatgcatgtggcctgggtgggttgccgtgcggatgttgttggtaggtactgtagatgctttggtaatgtgcttcgagcaggctacttgcgtgtgcatagtggacgacaagtgcatcatgttgcggttttcgtcccgcacaccttccaaaaaaaaaaaactctcga

SEQ ID NO: 35077 - DNA, 786 bp, Triticum aestivum
  Clone ID: PAT_TA_35077
ggatgtgcttacaagaatctagagagcaatccagatatacagggacccgccactggcctccatcttcttgatgaataatggcaagtacgtcatccacaaggtgaatgacagtgagcttggggttttactcggcgatgactggatgaagcagatgttaagccgagtgcgccggtggagtatggagtaccagcgcggggcttgggcgaaggtgatgtcggtgctgcagaccggaggctctgggttttctggtctcccacccaaggccatgcttcagaaacttcagatgttcaatggctacttggaggagattcgggcggcgcagtctgagtgggtgatcacggatgatcagctgcgcgccgatgttaaggcagcaatagcagattcggtgctgccggcatataagggcttgattgctaggctgagatcatctccagacgctccgcaggatttgttcatcaagcataccccagaggatgttgaggcatgcatccaacatttgtttgaaggaattgggaaatgattggttatcttgtactgtagcatcttattggtcgtgcctgtgattttcgtatcatcattaatgtactgttgtggccgatatctgaagttctgaacatggataatggggaaataatggtaccactttgggtttgatggtgttttgccatgaggttaggctttatattagacgcgcaaatcattgtcttctccaactgtgtaaattattgtaggcatttctctgtcagttgttaatggtagtcttattcaaaacaaaaaaaaaaaaaa

SEQ ID NO: 35078 - DNA, 832 bp, Triticum aestivum
  Clone ID: PAT_TA_35078
tcggccgaggagtggcggggcaggcgggcggaggggccgggcccacgcgtcgcgaggcgaggcaggaggagagatgagcggggacgaggttgcgaaggccaaggctgccgccgcgggcggcggcggcgtaggggagtacgggacgttccatggtccgcccagctacccgcccccgcgcccgcccgtcgggcacccgcagcccgccccgccgcccggcctccacggccagcgcgagcccaactcgcgccaccgcggcgggtaccaggccgggaacgctcaagattacgaagcaggtgcccgtggacataaacatgaccgccttccatgctttggtattggcatgggctggtttctattcgtactcggtttctttcttggtgccatcccctggtatgtcggagcatttctgttgtggtgttccagagtggattacagggagaaaccaggatatgtggcatgcacaatagcggctgtccttgctacaattgccgtcatcatcggggcaactgctggagctcacgtttattgatgtcagtctacattgtgtcactgtacatattgtacatttcatggatgaagaaagatgtcatgtcgcgtcttctgcactgtatttgattattaactttgaatattcaatgcatgacaaggagaaccaagtccttgttatggtcacaaataaatcagattgagactaccttgccttgtgcatgcttgggactaccttgccttgtgaatgctcaaataaccttgattttgaaaacaaatgatgtagcttcgcttggcgagcaacggctttcttatactgtactaacaatggctttcttgtactgtt

SEQ ID NO: 35079 - DNA, 695 bp, Triticum aestivum
  unsure (1)..(695): unsure at all n locations
  Clone ID: PAT_TA_35079
ggagttggtcaatcggagatacttggaagaaacatgtagcggcaataaagataggcaaagctttctatccctgttccttcacagtattggatgctcccaacatggaattccttttcgggcttgatatgctgcggaaacatcagtgcataattgacctaaaggacaatgtccttagagttggaggtggtgaagtgtcagtgcccttcttacatgagaaagacatcccttcacatatacgcgatggagagaaatcgtcgaacctagcatcttctagccaaggagcagctggagaatcgtcaaaggcacgtgggaagactcctgatgtgccaccgccatcctctcctgcaggagctccagctgtaattcctccacagggaggagattttgaagcgaaagtcataaagctcgtggaacttggatttgaccgggcatctgtaatacaagcactccagttgtgcaacggcaacgaggatcaggcagctgggtacttgtttggtggttagagtctttagagcagaccttctgctcaacattttctcgatttgaacatttatacacacacactgatcaaggagatgtggcaccctccatttgaggaactaaaactttgtgtgtggcaaaatacaggcttggtagggatgattcgtattctgtctcagttanaaaaaaaacgttttctttctaaaaaaaaaaaa

SEQ ID NO: 35080 - DNA, 693 bp, Triticum aestivum
  unsure (1)..(693): unsure at all n locations
  Clone ID: PAT_TA_35080
gggaaatatttttgagaatataagtccggtttagaacttttaaccacgacagctgaaaaaacaaagtaaatacatcatatatattcagtataatgtatatttagatattcatggcgctgcataagcataattcagttccctgggagcactagctgctggcgtatacatgtatttcttgattctaataagatgcaaccaatcttagaaaatatagtaagcacctatcatgaaattttgaactggtgtgatatgtctctctgttaataactatcatgcttgcatagctggttgatttatttgattataatcaaactggactgtcattattttaagaacctgattatccagatgaaaaaatgatcaaagaaatacatgtaccaaagtcacatctgtttagaccatgattaggcatacaattgctccttcaaattattgtgatattatagtgctctttagtctaacaaattatgtattgtggtgctgcaccttcttttctcttctttccaagacatactctgcatggggaagttgcctacttgctatgagcttcagacgtatcattagccgctacacctttcgaaactatgaatgtaatgcttgtaatctgcctatactttgcaggactttatttgtgacttatctatagcttgcaccaagacgcatctccttgactatcgacaaacacttaaggan

SEQ ID NO: 35081 - DNA, 579 bp, Triticum aestivum
  Clone ID: PAT_TA_35081
tgctctctttgctatgctttggcacaaaaaggcagacatcaactactacgtgtgcaccatcaataaaatatttgccaagccaggccagcgcatgtatttccaggtccactatatggaagagaacctgctggagtacattgatctacatgatgatacactcatcgccaggctcatagatggcatctactcgccgaatgtcgcattatgctaggaactgacaagagggccactaccaccaccaactggtctgagttttgtcgccgtgccaacattcgcgaaggagacatctgcgattttcatttcaaggttactgcaaagtgtcgccttgctctcactgtttactgcctctagatggaccatcaacgacaacgcaagtcgtctctgaatataatctagcactcttaagtacaactaattatgctctatgatgtgatgaacctacagtctacttttggacactgctatcaggtacttttgaagatccaacacctatgtcgttgcctatgtaaactctgctgttgtcactttccataatgacactcttgtgtacaactatttatttctattgctattctcttc

SEQ ID NO: 35082 - DNA, 1215 bp, Triticum aestivum
  unsure (1)..(1215): unsure at all n locations
  Clone ID: PAT_TA_35082
tggtttggttgacaccatggatctggatgtcaaaccttctgtgcttaattctgagagtagctcaggagtgcacttgggtggccatgacaatggccataaggcttctccactctatccggttcaagtgcagcatgctgcagatatagataatgatgaaaaatccaccaggtgtgtgcttccaagcacctcaggaagcaagggtggttatttgtcatataaaggtgactgtagaacaaggagattgttgtccaccaggatgaggaaggcagctcgtaataagatgtgtggagagctgcccaataaaggtagcaagttctgtggaaagaagatatccgctacacgtcgaagggcgcagatgcaacgaatgctcaagacaaaaaaagtagttgaatgctactctgcacagccatctgatgaaggggtcctaactgaaaccagtgggacatcatgctccaggggaggtcaggatccaacttgtgcttctgagtccagtcaaagaaagccatgtgcttctgagggctgtaatgtcaagttcatcatcaagtctttcaacattcctgagctatcaattgaggtccctgaaaattcaacagttggttcattgaagagaattgtaatggatgctgttactagtaaaattgagggcagcctcagtgtcagtgtgctacttcaagggaagatcattcaagatgacaataagacgcttcatcaggctgggatttgccacggggcaaaaccagatagcataggcttcacactggaatgtgaagctaagcaagattctcgtccttcaggactagcacctgaagagatggactccgctggtccatctgttgtgaatccgttgtcgaagataaagtttgaacagccttttataagctgcactctgggtgattatccctatgaaggggctgcgcaagtcaggtcagaaatctgccaagcgatcgtcccctatgggacttcaaacccagacgcgctggccatcgtgccagttgttcccaggtcaaggcagagggacttcgggcaaaggcgtaagcgcaggcccttctccgttgctgaggtggggagtgctggtggaagctgtggagctggcttggtttcggcaggtggaaaaacgtcaagaccaatgcgtttcgcgacatgaggagaggaccctacgtcacctcaggacagttggaagaacctgttgcacacgcgagcatccnccgcagctcg

SEQ ID NO: 35083 - DNA, 3497 bp, Triticum aestivum
  Clone ID: PAT_TA_35083
gccgccccacccctccgctcccccccaccccgccaccgagacgactgacgccggggcagagatcgaaacacgacccagtcgcgggagaggccctggatcctccctgcccgcccgccgcccgacctccctcccctcccgacacggtcgcccttgcctgggctgcctcgacgggagggcgggccgcgtcgagaagccatctgtcttctctatcttcccgctcagggcacgcacgacgacgctcaggacacgcgacgatctggcgttaggtcggtctgcaccatcgggcctcctgccactgcgaggaagcaatctctgtcttcaaccattcattcgatgactatgacaacgacgatgacgataccccgctatccgtcaagaggccgtcaaccagcacggccgcccccctcgaaagcgtggaccagccctcaccctcgacctccagggtctgggcagcctaacagtgcgctcgcacggcgtcaaaaggaatgggcagtggatgggggcatcctgagtcgcccccgcctcaaaggtgacaagtcagatgattcagatgatgacaagccacttgctttgaggaaaaagcctgacacgaaattaaagaaagttgtcacaggaggtgagaatgcatatggttcagaagatgatcataagccacttggtatgaatatcaactcagcaaaagtggcttctaataatagcacaaataagaccgttttgttgaagactgcaccacttaagactctgcaacctgatgatgattcagatgatgatcataagccacttgttcagaggttcaacccagcaaaaggggcttctaataatagcacaagtaagcccgttttatttaaggctgcacctaagattgtgcaatctgatgatgattcagaggatgagaaaccacttgccagcaggttacccactaatgctgctccaaaaagtagagctagcacctctgattcagaggatgagaagccactgtctgcccgattttcaagaggtactgcaggtacatctgcgagtatctcaaattccaaggacaagctcccgtctaacaacaaggggccaagcattaattcaagtgctccccggaattcagttaaaaggccaagtgataacaataatcaaacaagttcagctcttaagaaggccaaatcttctgatgcttctgcctcaggaagtgtcaaaagagaatccaaggatgatgacaataacagtgtacccgtcgaaaggaaactgacaccgggggagtcttcaaaaagcaagccacctgtaaagaatattgtaaagaagagtcctttatctgttaagaaggacaataagacattcaaaacaaaaacaaagaaaacaatgaaaagttcccagttctcaaaatcactggagggtgcctccaggatctggcggtggaaagaaatggtctactttggagcacaatggtgttattttcccccctccatacaacccccatggcgtcaaaatgctttacaatgggcaacctgttgagctgactccagaagaggaggaggttgcaaccatgtttgctgtgatgaaagacacggagtacgcagcaaagaaaacatttatcgtccgctcacgcgtccgctggaaaaaaattcttggtaaaaaccatatcatcaagaaatttgagctttgtgacttcacccctatttatgaatggcacctcagagagaaggagaagaagaaacagatgacatcggaggagaagaaagcattgcgggaagagaaattgaaacaagaggagaagtatatgtgggctgttgttgatggtgttagagagaaggttggcaatttcagagtagaaccaccaggcttgttcaggggacgaggagagcatcctaagatgggaaaactgaagagacgtattcgtccaagtgatattactataaacattgggaaaggcactgcagtcccagagtgtccaatagagggagaaagctggaaagaagtcaaacatgacaatactgttacatggttggccttttggaatgacccgattagccaaaaagatttcaagtatgttttcttggcagcaagcagctcactaaagggacagagtgacaaggagaaatatgagaagtcccgaaaattgaaggatcacatacacaacattcgtgtaaattacacgaaggatttcaagagcaatgatgtctcaaagaagcaaattgcagtggcaacatacctcatagataaactagcccttagggctggtaatgagaaggatgatgatgaggctgatactgttggttgttgtacgctgaaggttgataatgttacctgtgtgcctccaaataagcttcagtttgacttccttggtaaagattctataagatatttcaacactgtagaggttgaattacctgtgtacaatgcgattgaggaattccgactggcaaaaagaccggagatcctgtctttgacaagcttgatacaacgaaactaatccatcatctgaaggacttgatgcctggccttactgcgaaagtgttccgtacatataatgcttcgattaccttggatgctatcttgcatgaagaaacagaagatggaacccttcttgaaaagattgctgtctatcaacgagcaaacaaagaggttgctataatctgtaaccatcagcgtgctgtgtcaaagtcacatgatacccagatgactaagctgaatgaaaagattgacgaattaaaggcccagatcgatgagctgaacaaagatttgggcaaagtgaagagaggaaagcctctaggcaacggtgcagatgggaagccaaagagaactttggcacctgaagcgattgagaagaagatctctcagatagaaaccaagatagagaaaatggagatggataagaagacgaaagaggatttgaagacggtagcattagggacatcaaagatcaactaccttgaccctagaattacggtagcatggtgcaaaacccatgaagtccctattgagaagattttcagcaagacgattcttgcaaagtttggatgggcaatggacgtcgagccggatttcagattctaagagtattggcttccgggtgagccaatggccccttggtaaattcgattcagcttccaggccttctcccggacccctaactgcaactagtagtaaaggaagagctcggtgtttgtttttgaagtctccctgctcctggaagatggaagcacccggcattttctttgtaggcttttttttctctacccatcctctcttctgtacttgctatggcccaattgcctaaagtcgtgtttgcatttgggccgacgaattttagcttgttgagaactgatggacattcattttataccgcatcaatcacaaatatagatgacctgtcagagtgatggttgtggatttatttgaacgaggaaccaaacggtggcgtgaaacccaggaccctgccgctcggctcctgccctgcccgggcggccgctcgaagtgtttgttcatggtaaaaaaaaaaaaaaaaaaaa

SEQ ID NO: 35084 - DNA, 610 bp, Triticum aestivum
  unsure (1)..(610): unsure at all n locations
  Clone ID: PAT_TA_35084
ctggcgtgccgctgtttctgcatggttgaacctactgacaacggtcattgctatggttgtgatgtgaagcaccccaacaattctgctgcatatactggcgccaaagctagctctcagtgtgtatgttctctgtttggtaatatgggattgccggtccgcgacgaaagcttggaagaggaggaaagaagggtaaggcgtttctacgagacccagggtctcgatgatccggatttcgtggagaaagagagaccgagggcacagataccagtcaaaccattcagccctgctgattgtgtgcttgaatatcgggccgtgccaactacgagggaagactaagttaagtagggcgctcaagtggaaggctatggaatcccttttgaactttcatgtgactgaaggaacatagtactgtacagtatgttttagacctttagtgttaagcttgtcaggctgtaggctcaagtatgttctgttgctaagacaccaaaagggaaaggacgtttggcttgagatgttagtggttgctcatcagaattggatccagagacaatctgataggctgtctttcaaattcgaaaccacttgctgctaaaaaaaaaaaaaaanaaan

SEQ ID NO: 35085 - DNA, 1449 bp, Triticum aestivum
  Clone ID: PAT_TA_35085
gctttggagacaaatactttgaccctgaagaatggttgaggggcctcagtgcaatggcagcagtgtttagggacacaaaaaatgttgtcggcatgagcttgcgtaatgagcttcgtggcccctatcaaaagctcggggcgtgcttcaggtatatgcaacagggtgctgaagctgtgcatgcagcaaaccctaatgtccttgttattttgtcgggcctggattttgacaacagtctctccttcttgtccccaaagcaagttaagttgtcatttactggaaagttagtcttcgagcagcattggtatggtttctcagatggaactgattgggaaaattggaaccaaaatgatgcttgtggagtggctgttgagtccataaggactaaaggactctttcttcttcaacaaggatggccgttatttttctctgagattgggtttgacatgtctggcacgcatattgctgacaatcgttatcttacatgcttcttaagtgtagcagctgaaatggatctggattgggctgtttgggctctcgaagggagttactatatcagggagggtattctagcttacgatgaaacatatggtttgctaacatgggattggtatacagctaggaaccccagcttcattgaaaggatcaattccctgcaatctccatttcaaggtcctggtctacccagcagtcacaaaccgtacaaggtaatatttcatcctctaaccgggctctgcgtgttggtggaatctgcgaatgtgcttaagctgggtccgtgcgatgaatcgaacgcttggaactacacctccgcgtatgagcttgtgctgaagcacaccgggcaatgccttgaagccaagtctgtgggtgatactgcaaagcttggggctggctgcagcaaatcctgttcaaagtggcagctaatatctgattcaggaatgcatgtttcggccgaactcactaagaatgggaccagagtgtgcttggaagccggtcctgacggcgtcatcaccacagatgaatgcaagtgcctgactgaagatccaacctgcgaccctgagagtcagtggttcaaagttatatcgagtagtagaggcataccaggtgaggcctctgttctgcggttgccatctcttggaccctggcctccaacctcaagttcatcgcggtagcgacttgaacacgcatcatgcatgtatctagttgaggacaaagttgttcaggccaattcgacgatcgtaatcttgtgatctgggaagttacacgcaaaatgtctgcaagttcacttactctagtgtgtataatgtgtcaccctttaagcacttttctttttctgtcaaaacaaaccacttgtatgttgcttacgttgttgggttcagaataaaactaccagagaatctagtgcttgttggctagaaaaaaaacaatgatataagcttgctaagggcgcccgtt

SEQ ID NO: 35086 - DNA, 1366 bp, Triticum aestivum
  Clone ID: PAT_TA_35086
ccccgcggccgacccccggcgaggaccgccgcgcgcacttcgaggcctacggcgacatcctcgaggccgtcgtcatcaccgaccgcgccaccgggaggtccaagggatacggattcgtgaccttccgggatccagattcggcgaggatggcctgcatggatccctatccggtaattgacgggcggcgtgccaactgtaatcttgccatcctggggcgacctggaccagctgtgccttttggacctataaggccggtcattccatacaatggaggtgcggcggttccaggaggcatgtatgtaccaagcccaacatatcagcaacccccctacaactactcgcaggctcttgtgtatcccccttatgggccatcaacgtatggacccgaatacttgtatccacagcttgctcgaatgcctatggtccatatgttggacaacagtatgtcccggtgtatggtggtcccagaacagtagggccagcggtttacccatatgggcagttcggccaacctgtgccaagtgatcattcttattcacctggctatgtgccaggtcaccttctcccactatctaatcaaaatgctgcaaatgcgcgtgcatcagcggttcagcaacaatatcctccaggagctccgcgccctcagcaacagctcttgctccctgctcgcgtgcaacagttcccaccaaacaacgtctccgaacaaatgtcgggatgacaaaagggatgccggtgacaaattggaggtatcctctagtctgcagcaggactaagaacagcagtactgctaattgggcggcgtgcttcttttcttgcaaactgttttctttttcattcttaaaggttgtccttatccatggttacttgcaacacttataatgtgaatgttaagccgctccgttggatggggcgggaagcacagagcaagagctggagaatgaagccactcttgctctgttcagtcagtgtcttgtacattccccatcccctgcaggaattctgatagctggtggtctgtgcctgggaccaaactggatgcccgaaaagggagttcgggacatccaacctgtgtatagtagtagtagctcatgtagggttcaaatcttagaacagttcaattctttcggtcgcatctggttcatgctgtgtatatccattctcgtccttctcgtatcatgtgtgaatgtggtgtataggtccttcaatgtcatagtgtctttctgttggctatgtaaattattatccctaaactgaacttgtatatcagttacatcaccgtgtaattaaataaggccaattctaccctgtaaaaataatatgattcgttgcaagttgcaacgcatggaagaattgcagttgtctatat

SEQ ID NO: 35087 - DNA, 693 bp, Triticum aestivum
  Clone ID: PAT_TA_35087
ggagctccacctgcagcgacatccttcattggaaatcttccctctctggttatctccacaagccatgaggcagatggtggtgtgatctgtccagtctgcaaagacccgatgcctatcagaactagagcaaaacagctaccatgcatgcatctatatcattcatcgtgcatcttgccgtggcttagttccaggaatacatgcccagtttgccgatatgaacttcctacagatgatccagaatccgagaggtctgagcgagctgcaacaaatgaaagagatgtccttggggtggaggaacacacccatctgcaggaaattggtgaagaaggttctgatgaacctgaggttgaagaaactcaggacatgtttaatgatgcagtggaagtgactaatacaagtgaacatggtgttcatgttgctgagcagtcaaacagagcacgtaaccaccgtcgatggctgtttattgcagttgctccagcagtaagctttgtcggtttagctctggttttgtgctttgcaaatcctaccagtagtggtagaaggcgactgtgtcgtggatcccagagtgcctctgcagcacttgtagaccaaaaagaagttggtggtccatgttctagatatccagtacatgtgtactgatcccaaatttactggtgtggtggtactcgattgttggcagtgctttctctgtaa

SEQ ID NO: 35088 - DNA, 1015 bp, Triticum aestivum
  Clone ID: PAT_TA_35088
ctgggccctctctccgtcggggcgcgccgcgcccagccatccgccgtccgccgggccgagcgccccgccccatgggccgccgggcgggccctcccccctggcgccgaccccccctcgtgccagcccccctgcgcagccgaaggcggcccagtccctcgcgaccacacgaaccgaccagtactccagccgcgtcttccgactgatgggcggctccggcccgccagcggccccacttgggccgagggggctgttgcgtcggtaccaaggaatccgctcatctgaagtgaaactgggaattggacgagcgctcttctactcggctgcccggacctgccctcaaggtctcagctcatgagcctcctactcttccttgtgaagcagcaaatgcaacatacctaaagggaagcattcgcacactcacgtttggcatgttccataagcagacctgtcgtcattggttgagcgtcggttcatgaatgccaagcgcatcctatcaacatcatcaaactttgggctctggcagtttgctctgtttgtgaggatgggtcagtagtgcgctcaccaagtggacagcggtagaagcaacactcaaaaggagcgacacaacaaagacagaggacgacatcgagcggaggctatatagaatgattgcaggttttaaccaagaagtcctcaataggtggactggctcaaaatggagaagcatgctggtagcttttctgttgattgtattaagcatttaagttcgtagcaattcataacgtcaaatagaggggatgctttgttaaaaaatagtgccttgttcggcttgatgtggcgtgctgcccatatacgtccttaccccatttcctcctcacatatggcctgggttttcggatagcaagacatatggacttatggagacagtttgggggtgccgattctctctctctctccccctcttgctaatagaattatgaacagccgataagagtaatattatagaccttctctcctcaatcctaccatgtattat

SEQ ID NO: 35089 - DNA, 736 bp, Triticum aestivum
  Clone ID: PAT_TA_35089
tcgagccagggaattactggtaccatgtgtgtgagggtgaggcagagcgtgtgctccctccgccgcgccatgccatacgtttggcaccaagtttgatgagcattgttgatgatatcatctcaagtatgcagcaagacttcgattccgtccacggttggtggcagtgttggggacctcatccagcgaatcgaggatggtgttgatgtacgaaggcaagtgtacattgccggagaggggatcaacacggtctccatggaggtgcttaaggcaaagtacaacaacttgcgttacctggatgagtttcagaggctctggagaaaagacagcaagtggttcttggagatgaagaggctcaatggtggagttcctgtgaagtttgatgggtacatgcgtgagctggttgacagggaggtcttcctcaagggcaagaagaaggtcgaggtgctccactgattgcttctccaagataaattgttggaggacacggcatgctttttccaagtgaatcgtgtatagactgtgtctgaatttgttgtcaggtttagggtatagatgatccagtcagtaccacttcaagagaaattttcgtaaccagcattccagcaacgtatagctccgttctgctaagagtacctgttccgatcaattagttcattagcactaatcactgctcatttcctgtaaggaattattgtactaattcacacattcttttggctattttagttgattcatg

SEQ ID NO: 35090 - DNA, 1505 bp, Triticum aestivum
  Clone ID: PAT_TA_35090
aggaattcggcacgaggagaaggagatccggagctctggaataccatcgccggggacggctcagaggatgacgaagaaggtgttagaaccttagatgatgataatttcatcgatgacactggggttgacccagctgaccgttatgacaatgataatgatggccactctcctcgacgttttgcacaggcagaggaagctgaagaggacgacgaaattgagcggctctttaagggtggtaagaagaagaagaagaatgaccgaccacgtgcagatattggtcttatagttgaacagttcattgctgagtttgaagtagcctctgaagaagatgccaacctaaataggcaacataaaccagccattaacaaactcatgaagcttccgctcctcatagaagttctctcaaagaagaatctccagcaggaattccttgatcatggaatactcactcttctgaagaactggcttgagcctctacctgatgggagcatgcccaatatgaatattcgatctgctgtactgaagttactatctgatttcccaattgatcttgagcaattcgacagaagagagcagctcaagaaaagtggcttgggaaaggttattatgtttttgtcaaaatctgacgaggagactacttccaacagaaaattagccaaggaactggttgataaatggagtcgaccaatattccaaaagagcacaagatttgaggatatgagggcatatgatggtgaaagagctccttacaggaggcctcagatgaagaagccttcatcaagtagttctggaatggaatccagagacgatgatcttgatgctgacttctctcagcgcaagtccgggcaaagtggttctaggcagcatgcttctaggccagaagcatcacctttggactttgtcatccgtccacagtccaaaattgaccccgaacagatacgggctcgtgctaagcaacaagttcaagaccagcgccggctgaagatgaacaagaaactgcagcagctgaaagcgccgaagaagaaaaacctccaggcttcaaagcttagtgttgaaggccgtgggatggtcaagtacttgtaagctagacacccccgacagccttgcgatgcatatgatggtgtgcgctcagcagcgtgctgctgaagcagtatcaagcactcttccaccatcgccatcggagggcaacaagatcggtggaaacgaaattgcttggctaatatagtacttgttccaaaactgtccaaagcctagcagggtacattgggcgagcttccgaaaacttggtgatttggtttttttatcagatgctcatatataataccgttattgtggacgattacagcatggtgcctttactgtacaaatgtttgtcatgtttgagaagggcacctgactgggctgtaagtttaagttggaatcttttgactggcttttcatacatctctacctgtattcaaagggcatgatgcattccatgatcgaaacatggcgcggacgcgtgg

SEQ ID NO: 35091 - DNA, 1123 bp, Triticum aestivum
  unsure (1)..(1123): unsure at all n locations
  Clone ID: PAT_TA_35091
ccgaagcccaaaccctagctcagatcccccatcgcacccctcctccctcatccccatctcctcgccgccgccgccacctcctccccgtcctctgcaccactcctcgtcgccaacctcgccgccgccacctcttccccgtcccctgcaccactccctgatccctcctccggccccatccccggccatccccggccatccgtcccagtcgctgctctctctcggttcagtgagatgggatccactcccgcagccgccgctccaccctcaccgtcaacgacccatgccgccgccgcacaccaccgcgccctcccctcaccttggccccaagtcgggcagtgcgaggcggcgcttccagaccgcgatggccgcaaccttgcccactccgatctggatccatggtgcactccttcctccctctggatcgatggccgcagcctcgccgatggatccagcgcctgccggagacgagggctgccagatccgcgacctgggacgctcctcctgtaggatacgggagcagcacaccgcaccctgcagtcgtcggtccgggacgagcgcagcagctcgaggaagccggcgacaaacgccggcgctcctctgctccatcgacctggacggctgctactccgccaaagacgccgcctacaggaggtgctctactctcgcgcatgtctggtggcgtctccggcgcagtggcacctcctgcggtggctcccgggacggcggcggtgttcggcggtggccccctgctctccgcgccggcttggggggcgtctccgccggcagccctgcccggttcaccggacgggcccgttccgcggcctgggtatgggcagtgaaccacaagctctttngaagatggtctttgcgggacatgggcgcccggagcttgagcccttgggcantgaaggaagcgantcgcttacgtggcggggtcctttgaacttngctttngggncntcaaacctgggaagaacctttttgccaaangggtttnacccttcaaggtnccccccacttnttgggtggnaaaattaggggngggggaataatttggtntaatggaaccaatcntttcttggttgaaacangnanaanngatctttacttanagcnccctang

SEQ ID NO: 35092 - DNA, 1952 bp, Triticum aestivum
  Clone ID: PAT_TA_35092
cgtccgttttgggatggagggagtatgattttgtcactatgtttaagcactatgtaatcttctgtgcttgatgacttgtgtggaacaaggtttatgtttacttcctggaatactagcttataggacctggtatcattggttgccctagttggggcctggcagtattttcagtcagatgtataaattttattgcattcattatgctttatagtttatatatcaagagttcccgcccaggaatattcttctgcaagccatcccaccaatcatagccgacaatgctggtctggatagtgccgaactgagccctgacctcccttagtagcacaattctctccccagccatggagtattctacgtcatcagcggcggacggggacccatgcctaaggggtggatctgccaggcgttcaatccaaattctgccatcgtcctgtcggcctccgaggctgcggattttggattaagggttgacgagatcataaccgacgccccacgctggagggaggagaattgaaaacgctaatattctggtgttttacactgctatggacacagtataaagttaagatttatggggggcgggtccgggtggggtcgatggctgcttttaaggatattgaagctttggagaaacagaaaatgagagagacaactgagaaaatcattggcggagtaattaactgctttgtcaacaggcagctaatctacaacttccctgaagaactttttgctgatgctggcattctctgcagttgagcatgctgaccttcaggccttccagccgctggcgcttgtctctggacgtgcttgcgctgctgcttttgacaacccagagtctgttaagcttgggcactgcaagctcatcgaagagattatgattggggaggacaggctgattcatttctccggggttgcgatggggcaagcatgcaccattgtcctgagaggagcaagtgagcatgtgcttgatgaggctgagaggtccttgcatgatgccctatgtgtgctttctcagacagtaactgacacgcgtgtcatatatggtggtggatggcctgagatggtgatgtccaaggaggtggacgaacttgcaaggaagacccctgggaagaaatctcatgcgattgacgccttttcacgcgccctgcaagccatcccaacaatcattgctgacaatgctggtctggatagtgctgagctgatctcccagctccgagccgagcaccacaaagagaacagcactgctggaattgatgtcatcagcggcgggctgggagacatgcagaagcgcgggatatgcgaggcgttcaaggtgaagcaggccatcgtcctgtcggcgaccgaggccgcggagatgatcctgagggtcgacgagatcataacctgcgccccgcgcaggagggaggacaggatgtgagcgctgtctcgatgcagcgctctcttatgtatgatggtttgccgagttttggctgggttgctgtggtccacgactgctttaaagtttgatcgaccccatttcgattgtcgttgaaccctgacccctaagcgactggaacttgtagctgctagcgttgttctgtagggagtggcttggttttctttcggttgattttccactaagaggatatagtgatgtgtaagtgtaaccttgttttatgtgcatcttttgcatgcggaggacttagttaagaagatgcatgcaatgctacgagttttcagttttccatgtgtttgctgtacttgctggatatctatcagccgttgctagcagtgtgttggacatggcacatgtatggctggaatccggcccagttttgattgtgattgtgccgaaacaagataggacaatctgtgcgcaatctgtgcgcttggagtgtttgattatctgtttgacaagtgttttcttaaaaaaaaaaaaaaaaaaaaaaaaaaaactcgagactagttct

SEQ ID NO: 35093 - DNA, 838 bp, Triticum aestivum
  unsure (1)..(838): unsure at all n locations
  Clone ID: PAT_TA_35093
gggctcgtgggcgagggtactgagcaaaggcagaatttccatgggcttctggttctatttaagtgcatgctttataatatcaggggaaagctggctcctcctaggagggtctgcggggagctgtggggatgtgaaggtggaaggggatttgcccaagcccctgcttgaaggggatacgaaggcggatggggatatgtccaagctcctgctgggagggggggatacgagggcggaagggggtatggaagggctcgtggaagaatggctcgtgggcgagggtactgagcaaaggcagaatttccatgggcttctggttctatttaaatgcatgctttataatatcaggggaaaggtgagttatccaaggattttctgttggaagctgtcgttcgtgtgggtgttagttgtttcccctgagcgcgatgtttggttgtgagcacaatgcttttcccaagtttatcctgcaatcatctttgaatgttgctgttgacgaggtttgcagtttttcccaatggtcgatgaatgctgagcatgcagctctatgttcatgcccgtcgtattatctgatggaactggtacctttgtttattttatatttgtgcagttcaaaccaccaaagaaaaaaaaaaaaaaaaaaaaaaaaaaaaacccaaagagcacaacaaaacccctaaagaaaagacaaaataacaaaaaaacctaaggctctgggggccgttttcggcgttcccgccgactgggatccaattcaagccaagtacccgtcgtcgccgcncgccgcctgatgtgantcaatcgggcaccggcaccctcttccgtcctcagcacnacgnacctc

SEQ ID NO: 35094 - DNA, 764 bp, Triticum aestivum
  Clone ID: PAT_TA_35094
cgggcgcgtgggcggacgcgtgggcctccagctaatcataacagccgctcgagcactcgatccgattcgatcatctctcccgagctccccgttcttcgatctccgtccatggcgccgtccatctccatcgccgccgcggccccggcctcgggctggaagggcggcaggaaggccggggcggcgccggcggagggcgaggcggagacggaggcgctgctgctgcggcgccggaacgccgagctggagcgggaggtggcgctgctgcgggcggagctcgaggccgcgcggctgcgcgccgaggccgcggaggaggccgaggagcggctgtgcgcgcagctcggcgaggccgagtgcgaggccctcgagctcgcgcgcgcgtaccagggccgcgtccaggagctcgcgcgggggctcgccgccgcacgcagctgctagtgttgcgtggcaccggacccgcttggaggaggcggagaggcaggcagagcgcgtggccgagctcgtcggtgattctttgacgatcgacgaagagacgtgtcacgctgtcgacacacgcggtgtcgcggcagtatggattgttagacaaatgtactgtaaaacgaaacgaggttaattagtttcttgtacgagcaagatgtcagtgtttgtaacttgtacgactaaaattgaatagcaggcgcggaagtatatattcggaaatacttgttgaagaaataggtgtatttagacgtgttttacttttatatatatttattttttactagtac

SEQ ID NO: 35095 - DNA, 524 bp, Triticum aestivum
  unsure (1)..(524): unsure at all n locations
  Clone ID: PAT_TA_35095
ccggtgaagcagcggctagggaggtcgaggcgaggcggcggaccggatgagcctggagagcagatcagccggcaagccggaccagcagcgccgccgtctcctccttgctctttctatgagcaggagcaggggtcgcccagccgccgcagccccgacgggaaagggccgccgcggtcctcctctcggctacgcgcttggccgccgcgctcctccagccacctcccagcgccgcccgccgcgccaagtacaccccggccgcctcctccacttgcctactcctggcggcgcgcgccgcgcctaagcacgcgcacgggcggtcccctcctgctgcctcctcctagcgacgcacgccgcggtcgggagggcctgtttccctaggtccccaacgccgacggtcgattacaagtgccatctaggtgttgttgctgcatacttgggtgggagaatgaacatatgtgcctactttcttctatcggcagagntgagcttgccggtcgggcgtcacgcctctgagctcctacgcg

SEQ ID NO: 35096 - DNA, 810 bp, Triticum aestivum
  unsure (1)..(810): unsure at all n locations
  Clone ID: PAT_TA_35096
ggcgttcctcgacatcctcggccgcgtcccgatgggggaggtggagggggcgctgacctcctgcggcgtcggcccgacggcggaggccgcggagcaggtgctcaagtccgaaacctgctactcccgccccaaatcggccgtccgcttcttccgctgggcgaaggcgtccgtgcagctcacccccttggcctggaacctcctcgtcgacatcctcggtaaggccgccatgttcgatcccatgtgggacgccgtcctctccatgagccaggagggcggcctcctctccgtcgccacattcgcctccatgttcgcctcctactgcgcgcgcggcaacttcaaggaagccgccatggccttcgacgtcatggagcgccacggcgtgacgccggacgccgttgccctcaactccctcctcgccgccatgtgccgccgggatggcggcgggcaggccgcgtgggagcttttcgaacgctacaagaccacggtcgcgcccgacgccgacaccttcgcgatactgctcgaggcgtgggagaaggaggggaacgtccagcgcgccaagagcactttcggcgagatggtcgttcgcgtcgggtgggacgccagcaacatgcctgcctacgatgctttcctctccacgctcgtgcgaggggaccagttcaacgaggcactcaagttcctccaggtgatgcggaccaagggctgcctcccggngctcaagttctttgccaacgcgatcgaccttgtcgtccgcaagggagaccatgccaatgctattgctatctggcaaattatggtctcggatgcaggact

SEQ ID NO: 35097 - DNA, 1157 bp, Triticum aestivum
  Clone ID: PAT_TA_35097
gttgccaggtggcaatacaccataaccctcttgcattggcatatcgggtttatgtatgatattctagttaaacctgctgatttttcctagtgttaaatggaaaactagtggcataattattatctatctggttgcttggaaactgtcacaagttttatcacactctggtgtcacatgtttcttgtctaactgaactggctagtgtccggtgtttcttaaagcctcgaatcatttcttccttagatgagggattgtgcggcgatctagggattgcgtattaggaaattgaggatggggatttggtcagtttgcaccagctcccattggttgaccgaggtatggtaataaactgggaattgaactggaagctaaaaatcatctattatttttctttacctaatggactgtaactgattacatcagagcttgggcatagaggtttggaactctggaagtagagcattaaggattgacggtttggacggcacaatggtatttgctcagatttgagtatgcgaggactggctccttcacaggcttcaaattggagggctgttctagcgtatatgccgtaacattgacacaaaacactttcagtactgcatgttttttgacacaactgattgcttttaatttctgtgagcccattttacctgcatttggcgattggaatgctggggaggatggaggttcttggaagcaagctattaaagccccattctggatattgatttctcttgttttctggaactttttgcagatcaccagcaaaatcccaatcccctgtcgctgcgtcccccgtcgtcaatggtgaagcagcaagccccaagagggacccaagcaagagcccatcacgttcccggtctcctgatgccaaatcagagtaaaacggatgcgaggctaggagcggtgagaggcggagccatggtcttcaaattcttcaaattttgtcttcgccaacttctgcatccgctgttatagtactatctctgtgttcggttattctaggttccttgatgtttctgtaaaaacttgtttggatggattcttgagatttatgtactctcttcattgtcagcatttttacttggattattatctatggtcgttggctcggaagatatttgaatacagtaacattgccgtttgtaatgctg

SEQ ID NO: 35098 - DNA, 1297 bp, Triticum aestivum
  Clone ID: PAT_TA_35098
ggcaggtcaagccgcccacccgtccgcctcctgttccccttctcttctcctgttccccttcgcccccggccggcgacgacgccgcgcgcgcagcgaacccagcccctcctccggttgcagtaagcaaggaaggatgagtaggcgctggagccggaccatttacgttgggaacctcccaggggatatcagggagcgggaggtggaggatctcttctacaagtatggacggatagttgaaattgacttgaaggtccccccaaggcctcctggctttgcttttgttgagtttgaagatccccgtgatgctgaagatgcgattcatggccgagatggctacaactttgatgggaatcggcttagggttgaacttgcacatggcgggagggccaactcttcatcccttccgaacagctatggtggtgggggacgccgtggtggtgtctctaggcatacggagtatcgtgttctggttactggactaccttcttctgcatcatggcaagatctaaaggaccatatgagaaaggctggtgatgtttgtttctctgaggtgtaccgtgagggtggtggtactattggaattgttgattatacaaactatgatgatatgaagtatgctataaggaagcttgatgatactgaatttaaaaatgccttctctcgagcgcctataagggtgaaggagtatgctggaaaaagcagccgctcctattcacgcagccgtagcagaagccgaagtggcagctacagcaggagtccaagtccaaagaaaaaaccatcacgccgttcagcgtcaagatctcggtcgagatcagtttcttcccattcaaggtcaccgtcaaaggaacgctctccatcaagatcaccagctaaatcccgatcccctgtcgctgcatctcccgtcgtcaatggtgaagcagtaagccccaagagggatccaagcaagagcccatcacgttcccggtctcctgatgccaaatcagagtaaaactgatgcgaggttaggggcggtgagaggcggagccatggtcttcaaattcttcatattttgtcttcgccgacttctgcatccgctgttatagtactatctctgtgttcggttattctaggttccttgatgtttctgtaaaaacttgtttggatggattcttgagatttatgtactcttttcattgtcagcatttttacttggattattatctatggtcgttgactcggaagatatttgaatacagtaacattgccgtttgtaatgctaaaatacaacctggatttgaggtattggttcaaaaaaaaa

SEQ ID NO: 35099 - DNA, 619 bp, Triticum aestivum
  unsure (1)..(619): unsure at all n locations
  Clone ID: PAT_TA_35099
agcgagtgtgtgctagtgcggtcggaggtctctaccttcctccgatcgggtgcctgtggactgtggtcgccaagccagccatggcctccttcccctccgtctccgtggcgagggcgaggccgagacccttcctcctgctggcggcggcggtggtcgcggtggcggtgctcgcgcgcggcgcccacgcgcagctctccgcggggttctactcggcgagctgccccaccgtgcacggcgccgtgcgccaggtcatgtcgcaggccgtcatcaacgacacgcgcaccggcgccgccatcctccgcctcttcttccacgactgcttcgtcaacggctgcgacgcctcgctgctgctcgacgacacggccacgacgcccggcgagaagagctccggccccaacgccggcggctccaccttcggcttcgacgtcatcgacaacatcaagacgcaagtcgaggccgcctgccccggcaccgtctcctgcgccgacatcctcgccctcgccgcgcgcgacagcgtcaacctgctgggcgggccgagctgggcggtgcccctggggcggcgcgacgcgacnnccccggacccggannnnncgaggacgctgccgggcccggacctgga

SEQ ID NO: 35100 - DNA, 1065 bp, Triticum aestivum
  Clone ID: PAT_TA_35100
cccggcggcgtcgggcgcgtcctgccccgcccccggccaggaggcggaccagagcaacttcgtcgacgaggcgacgtgcggggagctggatgttgttgacagggtgctgctgctggagtggttcgccgagaactaccagcagtacggctgcaagctggagttcgtcaccaacaggtcccaggaagggtcgcagttctgccggggcttcggcggcatcggcgggatcctccgctacccggcggacgtcgccgcctatgacgacgacgacgacgacatgctggatgacgacgtctatgaagacctcgaatagcaatcaactgacgcgtcggcgcgcgcggcccgcggggggcctccgccgcccgcgaccccgccgtgaagtacctcaacggcggccaggaggcggaccagagcaacttcgggatcgacgaggcggcgtgcggggagctggacgtcgtcgacagggtgctgctgctggagtggttcgccgagaactaccagcaatacggctgcaagctggagttcgtcaccaacaggtcccaggaaggatcgcagttctgccggggcttcggcggcatcggcgggatcctccgctacccggcggacgtcgccgcctacaacgacgacgacgacgacgacatgctggatgacgacgtctatgaaggcctcgaatagcaatcaactgaagcttcactgcacacggtctgggaggagcctgcgctggccccgaccgcgccgccgggacgagaccctgctgaaacatccaaacgatcggtgcaagggaaacgaggaggtgggacagaagaaaggatctcagcaattatagttcggaccttgagcaaagcacgatgatggcgttgatggtttggagttgaaggtctcttcctctctggatccatcccttcaaatttggttatgctactaagcagccgtggctgccttctcttgctgcatcagagaatatgcttattagagtcgtattagttgcgagtgtgagagtggtgttccttataatctactcctgagtcgccttatgagcttatatgctactacaacaactgcttgaaa

SEQ ID NO: 35101 - DNA, 650 bp, Triticum aestivum
  Clone ID: PAT_TA_35101
gccgccacaaaccaagttgagcaacacccaaagtgatactactacagattatcttgttctctgactgctgatccactcttgtcagtttgtttgagccagtttagcgctactccttcctacgtgggagatggcatccaaccaggaccaggcgagcttccgcgccggcgaggccaagggccacacccaggagaaggctggacaggtgatgggcgcggccaaggacaaggcgtacgaggccaaggaccgtgcggcgggcctggcggggcacgcgtccgggcaggggcaaggcgccacggaggccaccaagcacaaggccggcgaggccacggacagggcgtcccagacggcgcaggcggccaaggacagggctgccgggacggcgcaggccgccaaggacaagaccaacgagaccgcccaggcggccaaggacaaggcggccgggacgacgcaggcggccaaggaccgcaccgtcgagggcaaggaccagaccggcagcttcctcggcgagaagacggagatggccaagcagaaggcggacgagacggcgcagtacacgcaggacaggacctacgacgcggcgcagtacgccaaggagtccgccgtcgtcggcatggacaagaccggcagcgtgctccaacaggccggcgaga

SEQ ID NO: 35102 - DNA, 657 bp, Triticum aestivum
  Clone ID: PAT_TA_35102
gcggccccggatgtggtgagacgttcgtggtctgcgagcggttgccttgagcagtgtgggctgcgggcagctgggttgtgcggcgttgctgctcgaggggagcggtggtatgtcggggcggcggcctcggaaggcggtgccggttgattgcgctgggcgtgacggagcggtggatgtcggggcggcggccccggaaaaatcactatggcaaccagacttctgtggcaacgatgatggtgggagcgatgtcggcgacgcggcaatggttgcggtagtcggctcttctccggcgtgtccacgatattgcctcggtttgtttgttgctgtggagtcgaagctgcgatggcggggccctgtggtgtacgatgactggctgcaggtggcccgttcggtgatctttcgtggcgccagccgtgcctggttttgttcttctgagttctccgtcagagtcggagctgcgttgtctggctgtaggttgacatgttgtccaataggatgggctttgcccaatgtgtttcaatctaggggtgtgggcttggcccttgttgttccggttttcgcccagttttccgtaattaactgggcaattctcttctgcttaattaatagatgaggcaatctttgccttcgttttaaaaaaacataaaaaaaaaaaaa

SEQ ID NO: 35103 - DNA, 995 bp, Triticum aestivum
  Clone ID: PAT_TA_35103
cacagtttaagagctcgaggaggaggggcatgtggaggtttccgccgccagtggctgcactgctggtcttcgtcgcctgctgctgtcagatccagcatgacctatcctatcggttctccatcgcttcactctgcttcatgtgcatatgtgcggagaatatgacgacccgcccctgttcttcaccagccacactctcccttatgcgcacaataaccatcatcgcagaagcttagctgataggcggtgagctttttggaggaagcggagacgaagatttctattggccaaaaagatggaggcgccatgggaagcactgacgagcaacagtctcagccgatgcatcgacgagctgaggcgggcttccaatagagaaataaggaggataataagactattggaggtcaccattcaaggattttgatatctgaatgttatgacaatagccctccgcgtcctggtggccactgtatgctgcagcgaagggcacacttcaattagtgtgcaggcaaatgcgctgatcccgggtgtgatttgacattgtgatttgcagtttatcaaggtcgtcattagccgagccgttcctatgcttcgatacacatgcctgaatctggatacactccagtgctgatggtaatactttcagtcactcacaaacaataagcttcagcatacaaagcagagcccaatgctattggattggtgtactggtatgcaattccttgtacaatttacttctatataggatttccgattactgggtgcaaactttgtacaaggcagtctgagcctaccacttggtgaagatgcgatccaatatgtttagcgatacccttttttgtgtgtagggaaacactgtcatgatacaactatttcgtaatcctgaatttttgaatattggtccccccatggcgatgttttggggcttcccaaattatccctcatcactcatactcgttccatttcgcgcttatttctgcaaacattcggtctatact

SEQ ID NO: 35104 - DNA, 993 bp, Triticum aestivum
  Clone ID: PAT_TA_35104
tgatatgttgcctgagtttcagtcattggtagatgaactatcatactccccagtcgttgcaaggcccttcgcggccagagtatacccagctgctccgtgtgctcctgttgccgcctgcggtctctgcccccctgttgcccttggcggcgtgcggccccgggttctgccccgcgcggcgggcggtgttttcggtttgccgccgcctggctcccccttctcccttcacattcaacagacttgcagcagcgtgcatatgaggtacaagccttactaggcttggacaaacaggctgttgaaagtgtgatgcccatagatgcaagctgtgaagatattgaggtcgataaaaacctcacatttctgaacagttatgtgcagcaagccttggaaaatggcgcgacaccttacattcctgaaagtgaacgctcaggcgttgtaagtgttggtaactacagagcccaagaccaacatgagacatctgctcatgctcttagatttgaagcctatgagctacctaaaccttcactacctacagcaacctcacaaagtagtgtttccctgccgactactgaccggtttgcgcgggttgatgggcagacgtgtctgcgggttaattttcctgttgcgtttttgttccagttccagaaccaagtcactatagggaagaccatcatcaggcaaggtcccagcaatcaggcaatgcagtttctggtgaatttggtgccaaacttcgtcttgatggggttcaaaagaaatggggaagggaatcatatgcctcctcttctacaccttcaagctcgacctctagccaacaagcagccaatgggggttccaactctgacgggggaaggggtgggtaacttcacaggcaaggggagtcctcgtatggttctaagagtcagcagcagggaaacagaagtttcagcagaaaagcaacggctggctgcttactttttttgggtcctcagctgctaaacctaatcgcaagggacatgc

SEQ ID NO: 35105 - DNA, 1653 bp, Triticum aestivum
  unsure (1)..(1653): unsure at all n locations
  Clone ID: PAT_TA_35105
agcaacaagtggtaaattctcagtcagatcctcagcaatgtgtgcaaggagctacccaaactgttggttttcacaacagtaacaccatccagtatgcaacgcaacaaaaggcccagtctcaccaaccgattgaagattcgcctaggggtaccattcccgttgcaaaatcagatatcgttacctccatgggtgctagctctttgaatgggactggtcgaatgcagtcagtgaggacagataatgttccgtcttcgtcaacatcaccatccactaccactaatcatgttcttttgcagtccatcccaagtagctccaagaaccagagtttaccaactgcagcaaaaacatctcaatcatctgttgtcttgggccctacaattgaacaggaaatgaagtcttaccagagtgtcaagccaacaataatggttcccaagatgattgaacaagggccagctactgaacgagactacataaacaacccccacatggattacttggatacgtcctcctcagctacttcggtttgcctttctcaggctgatggatcattgcaacaaaactttccatcttcatgcttcgatacgcatcagctgttgagggacacagctccagatagtgagtttgagatttcagatccaacaaataacgttctatttggggtgaacattgatggtcaactgggcttaccacttaatgcagatgccttgattgccaatagcattgaaaatgataaattcatggatgagatggctggaaatggcatttctaactacatttcatctaaggattctcaacaagagttatcatcttcaatgatttcacattcacttggagttgctgacatgggattcaattctatagattctgcaatcaatgatccctcattcctaaatagaaattccagggcaccagctcctgcacatcaacgcatgcgaacttacaccaaggtgcacaaaccgtggtgctgtagggagatctatcgacatgaaccgttattcagggtatgatgaactgaaagcatgacattgcgcggatgtttggtatcgaggggcagctttggtgaccaaagtagagttggctggaaactagtatatgaagatcatgagaaggatgttctactagttggtgatgacccatgggaggattttctgaactgcgtacggtgcatcaggattctttctccacaggaagaaatgcaaatgagattggttggtgacttcggagacgcctttctnaccccaaccaggcctgcagccagctcagatgggggtcaaccttggtaactgagatcacatgtatggaatgcccaatgtagtttcctggtgctgcggggaccgacttttttctcctcccggtccagtccttatgaatacggatgcttgaggacggcagttgacggataatttaggctccggaaattcccaaggtcgagcgaacatgaatataaggaacaattcatactttttgtctctgttgtagtcttgtagtcctcatgttctgttggccttgcaatctacatagccaacccatattttctgctgccatgtagtatatgtcattgttgcctgatgtaacagtttgccacatactcagatgtcaactactgtaacttgcggctctttctaagtgatcgaatcgtattctccccttgtt

SEQ ID NO: 35106 - DNA, 752 bp, Triticum aestivum
  unsure (1)..(752): unsure at all n locations
  Clone ID: PAT_TA_35106
cgcttcggcccccactcacaaacctagctctctttcccctcgacccccacagcgcagtgcatctagactccttcctccctcatcagccgccgccgggtcttcttgctggggtggaagagtaggggatccggccgaatcggaggcgtgcgggcctggtggcgggcatctttggcaggggcggcggcgggcctggtggcgggcatctttggcagcggcggcggcgggcatctccggcaaaaggcgatggcggggatgctcgattcgccatggaccggccctccttctccccttcaattccctgtctcctcttctctagagttacctgagtggtcaacaccgagaaagatggggaagacagagccagcgaggaagacggcttgactctgccaccgatgctgaccggccaattccgtcgggcgttgtcatggaaggaggcgaaccatcgaggagcagcacgggaggagataagataagccgccggaatccctgttcacttctggttgcatcttgcccgtgagctccttcttcttacagccagcttggcccttttcttgccatgttttgggtgatgcagggtatcaagcaggcgatggcgaggatcagatgcggtagcagctgaaggagtcatggagagggggcgagagtgagcagcggctgccggccaagaaggaagaggctggggcgaggaccgnaggaggaggtgctcatggtggagcataggaggacggaggcggagtgctgctgcaacggct

SEQ ID NO: 35107 - DNA, 1525 bp, Triticum aestivum
  Clone ID: PAT_TA_35107
gtaccctctttacgtgttttcttattttggtagcttccctatacactgtacagcggaatttctctggcaggttggaattggctttagctgttgtggtttttggactagtcttcacttttggggatttcctcccttctggaagtgttagccctagcaatgaaagcactgtggttaacaaacagctttcagaggaggaaagaacaaactataagagggcacttgaagggtacgaagaaacactgacgaagtcgcctaacgatcctaccgctcttgagggtgcagcagtatcgttggttgaactaggtgaatatcagaaggcctcagatctacttgagaagctagttaaggtaatccccgacaaagcagaagcataccgcttgttaggtgaagtaaagtttgagctcaaggatctatgatgggagttcttcatcatacaggaactctctatcttcatctgacagcattgattttgacgttctccgtgggctgacaaattcattagttgctgctaagaagcccgatcaggcagtcgaagtaattctatcttgccgtcgcaagttgagtgaaaagcgtcaaaccaggcaacctgatttggaggctgcaaatgagaatggtgctcaggagtctcgagatatcgatcctatccaagttgacctgcttctcggaaaggcctattctgattggggccatatcagtgatgctgttactgtttatgataacttaatcactgaacatcctgaagacttccgtggttatttggcgaagggagctatactgaagcaaaatggtaaggcaggtgatgcagaaagaatgtttattcaggccaaattcttcgccccagaggcagcaaaggcacttgttgatatttatgcacagagatagtccacgagaggcaaaggaggaaaagctttcgttttagatgtatggcatatccggtggactgcctcacttcaccaaacttaagctgtcgtggactgttagcacttaggacattacaggcgagggcaacagtccatgttaagcttgtacctgcccgggcggccgcccgagtgaaggaaggaaaaaaccaataggagaagagcaagagttcgaacggaaggaaaagagtttcagaagggaaggaaaagagtttgaaaaggtttgggtcaaagtcttaggacgcatgtatagttcaatccgttaagtccaaagctcagtttgtcgctgctattcccttcatgttctaaaaggacaaaagttacgaaaaagtggttactctgcttgagaatactccctttcatcaagtatgatgttccattgaaacaccaatatgtaaaaaagggttcaacctattgaggtttctgtaattcgccaccgccgaaggtatcctatgtccaagtaaattgggtacctaaagactactctcaccgctgaagccacacaagattaactgattaactgggtttgcattgagaaccgggaacattttatgctacaaggatgtaccggcataacgttttatgctattgtataattcaatcacggg

SEQ ID NO: 35108 - DNA, 472 bp, Triticum aestivum
  Clone ID: PAT_TA_35108
ccggccgctatggtggccccggcggcggcggcgaaggccaagcaggggcacgtgcgggagtggtaccacagcgacagcgacagcgacgtgttcgccgtgccggagatcacgtcgccgccggccaagcgggcgcggccgtcgtcgttctggtgcctgtgaacgagcttgcgcggcggccaaccacccacgccgccgcagcaaccgggcgagctacgtacctgtggctcgatcgatccatcactagtgtaatctttgctcgttgtagcttggtgtgactgaagtggtaccgaactctagtagcgcacctatggtatagtagagtacgctgttttttatgtataagaatgagatgttgctgttgtatcataaataagtagcgaacgaatcgtgatctcaaaaaaaaatatcaaaactgaaaacaaaatgcgaatacggaaaaaaaaaaaaaaatataaaaataaaaaaaataaat

SEQ ID NO: 35109 - DNA, 1610 bp, Triticum aestivum
  unsure (1)..(1610): unsure at all n locations
  Clone ID: PAT_TA_35109
agaggagaggagagaaaccctcggcacgcctccggcgaacgcgacacgatggtggagactcgccggagctccgccgccaagcgcccctcctctacgtccccggccccccggctccccctccgcctccgcccctcccccgaaagcgccccaaggcggaacctccggcgtcgccgacgtcgtctgcgcccggaaagggccgaggaaggatccggaaggcggccgcggccaccaggagcgccggcttggcggacgacgccttgacaccggcgattaaagatcaaggaggggataagcgggcggctgctgctgctgctgagagctcgcgtaggaggaaggaaacgccaccgcagcagcatgcggcgccatgggccaagctgctctcgcagtgctcacagagtcctcatcttcctatcagtgtccctcaattttctgttggccaaagcaaaagatgtaatctattgttgaaagaccaatctgtcagcgaaatactttgcaagctgcggcacgttgagcaaggaggtccgtgcgagttagaggttataggcgacaagggtgtggtcctattaaatggaagggccgtaaatccaggcatgaaagttccccttactggaggggatgaagtcgtattcagttcatgcggcaaacatgcttatatttttcagcatcctttgaatgataaagttgctaaagcggtgacatcatcagccgttggccttctagaacctccagttgccggtgtcaagcatatccatatggagaacagaacagaagtcacttcgactgttgcggggacagagatgttagcatccgtatcgagtcaatcgaaggacctaccagcagtgccacctgcatcagctgaggaggagaatcagagagtagtgcaacctatcatatcatctgcttctgataaatcaaaagggcactgcatcagccctgataaggaatgcgagaatggggaaaacactaatgaggctaattctaatattgaagactctccaatggatgtggctgcaacccccatatctcctgatgctgttgctaatgacacgagtcgacaaaatggctttggatctgatgctcatcttgatgaaatcggtaagattgcaacttataagataaggccagttctgaggatgattgcagggtcaactgtatcagagttcgatttgactggtgatctttttaaagctcttgaaagatcagagggatctcatcagggatcttaacacgtcagccaagcttacctccgagcagatgccaagcctttaaggacgcgatgaaacaaggagttattagtccaagtgatattgaagttacatttgagaattttccctactatcttagcgagaatacgaagaatgtgctcttatcatgtgcattcctacatttggaaaagaaggaattcattaaagcagttctcccgaaatttcatcaataaaaccagcgaattttattatccggtccatcaggttctgagatttatcagggnaacattgntaaaaggnactttgccaaacattttgggggctangactacctgttgttggttcactccctgntgcctgggggngccctttcanangngccaagaaacccanaaaagatgttgg

SEQ ID NO: 35110 - DNA, 1291 bp, Triticum aestivum
  unsure (1)..(1291): unsure at all n locations
  Clone ID: PAT_TA_35110
cagaaaagccgggagcactgggttcctatgcgcccccaggcatgggccgacagcgtccttctggacctgataccatgcttactcagcatatgctccatcctcctgtgccatgtacgcaagcccagaagaatcaaatgaggccacctagtcatagttttccagaaaatgtccggcctacagtgcagcaacaactatatggtgtatatcaatctgaaatggcaccaagggtgtttgcaccaaaccttccgcggcctgcacccaccatacctgatgatggcatgattcgaccacccatggctggacccttgcctggacttcatgacacaactatgcctccttttgctccagaaaatgttggccgaccacatcctgttggaatgagaaatggtgtcggcggagagcaactaggaaattccagggctttccatgaagaagggttcaatacttcacgggaacatttcaggtcgttggggccaccatatcctggcagatacaatgtcaaccctaaagatattgaagagaatatgaagcaatttccagggccaactcatcttgatgatgacagttttcagagaggcccaaggccttttgatggtttcgattcattaccaggaaggcctccattcccaaacaagccaggcccatatcctataggcttccctgaagatttgtcaaggaagccccattcaattgttggtcatcctgactttgtgtcacctggtgcagaatttggccatcacagggttgatggaatgcctagaaacccaggttcatttgttcaagggatgacagctggtcccggaggtcttcgtaaggaccaactaggccctggcaaccttccagggagtagacagcatgattttgacaatctagggttccctcatacacatttccaccccgctgatatttttcttccaagaaatcttcatggttctgaaccccttgggcatggtcaattgcatggaattgaaccttctggccaccggttccaaggacacgtacatccagatgatccaaactttgatgactattctcgacatggttttccacaagaatctggccgcttcagttcgggtggtttcttcagtagtgganatgttggttggtgccgggatatcatgtttaactgtgcggaatgcanaagacttgggcacatgtcatacaangagaacatcacagcangcatggacaatgttcnaaaatnaacatgatttgcaaagcacnaaataatctggaggccaagtcattaccnaaagtngcatnanacaantcaggaatagntanacncctt

SEQ ID NO: 35111 - DNA, 714 bp, Triticum aestivum
  Clone ID: PAT_TA_35111
gggagacccgcgcccgcgtccgcgtcctcgacgccacggacggcgtctccagccggattgtcttgatatccgcaacagaagaaacacaagcagaactggcacctgctatggatgctgcagttaggatcttcaaacatgtaaatgatatagaagggatcaatcctgatgtcacattatctgcttctgcaccagaaatttgttgtgctagattaatggttcctaaagcacaagcggtgcacttaattggcaagcaaggaaccatgatcaagttaattcaagaaactactggtgctaccatgaggattatagatcaaggtacacggttatacattttcatgttaactattatgcgatgcatttccagtttgatccatagaattactggtcatttttattacctatgaattaatgatattggttttgctcttggatgtgtaacttgaaaaggtatatacattttcaactcaattattatgtgatgcatttccagtttgatttgtagaatcgccagtctttttttacctataaattattaacattggttttgatcttggatgtataacttgaatgctgaaacaagggagtatacctgggcattccaaagcaaacgtggtgtccctaacttctatgatccatcatttcttgtacaagagtccaccagtacttgatgtcaagttctttatgccgagaaaaatccagaaaactattcgactg

SEQ ID NO: 35112 - DNA, 894 bp, Triticum aestivum
  Clone ID: PAT_TA_35112
gcggatgttttggttgtggaattttggttttgcacgccgggttcaccaccgtcagtggcggagctttattaccaacaaatattggaagctcgtcagcatcatcatcttggtacagaccgagggtttgttcggtcgctggttccagattccacctccacgggagccgcctcctccgagcagttggtccgttgggcgctgggaaaccttagggggtagggacggacccagcgatgcgaggaaccgagcggtggcggtgcagaatctttgaaagtactccggtgaccaggtggtgatcgacggaaattttggttttgtacgccggggatcaccaccggcaccactgaccagtggcggagctttacaaacaaatattggatgcttgtcagcatcatcatcttcctacagaccgagggtttgatcggttgctggttccagatcccacctccacgggagccgcctcctccgaccagttggtccgttgggtgctgggaacccatagggggtagggacggacctagcgatgcgaggaatggagcagtggcttgtcagaatctttgcaaataccctggagtctggatattggtatatccaaaacatcttatactccctccgttcctaaatataagtctttttagagattacaatacagactacatacggagcaaaatgggtgaatctacattctaaaatgcgtctatatacaccgtatgtagttcttattgaaatctctaaaatcccctcacaatcatcatcatcatcatgatcatctcccttgctgtcacaatcagcttggtcctctttggttcagaggattctacaaaagaaagagaggaatatgtgatagtcctaaagaattcctttgaatcaaagagccccccaacttgttgctgctgc

SEQ ID NO: 35113 - DNA, 873 bp, Triticum aestivum
  unsure (1)..(873): unsure at all n locations
  Clone ID: PAT_TA_35113
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctcctcctctctcgtcgtgctgctgctgccgctgggcttgggcttgggcttgggcttgggcgggccctagatccggcggtcctccgccgccgacgccctgccgccgccggccttatccgttcatcgcgcgcgcggggcatccttatccttatccttagggcagggcagggcagggcaggaccagaccacatgtgccgtcaaccgtcgacacttgagctgtctccagatgagcagcttgctgctgaagaaaccttcaagttgtactgcaagccagttgagctctgcaatgttatccaaaaacgagcccttgataatcccgcttttctgcaaagatgcctccattacatgatacaggcaagccgcaaaaagaggattcaactaactgtatccctttctcgaggcacaaatactgaccacaacatcttccccctttatgttttgttagctacacctactagtgatagcatcccacttgaagggcattctccgatatatcgattcagtcgtgcctgtttgcttacgtcattcactgaatttgctagtaaagaccacaacaaagccacattcacaattccagacgtcaagaatatagcaacctcccgagcttgcaacctcagcattatccttatnccgntgtgtttcagattcagaagggcaggttggagaaaataactgctctggngaccatgtggaagcatctgctctccgaaagcttgaggggaaatgtttctggggtaaaataccaattaatttac

SEQ ID NO: 35114 - DNA, 1034 bp, Triticum aestivum
  Clone ID: PAT_TA_35114
cgctccgcaaccgcctcccccgcatcctccgcgcctctccctgtgccacccatctccgcctcctctcccatctcctccctgctgctgctgaacaacgcaccctcgccatcgacgattcatgcggccgacagcgagtgccagtgagcgaccgggaggccgccacctctcctggcctcctcccagaggttcccgatctggagcggcgaggccaaccccctcttcacacgcagaggggcgacggggtggatcgggtggcggtgatgtcagagctcgaggcagagatggcggagctcgggctggagcgctcacgggatgacggattcaagggctggagcgctcacgggatggaggtgctcaggctagaggcaggggaggacgccctacggagctggaggtggaggcggggatgggaagaggcctggagttgctcagcatcggttctgtcaacctgcaaggtggtttgctcgaccactcaccgtcggttctgtcaatatgcaaggtgatttgctcgatccctcgctgttggttctgacaaactgcaaggttcttcgttcagctggattgtaggttggctccagtccttgaccagttcttctgcaaggagagtttcagtgctcagcatattgcagtcattgcagcagtgagttttatgaaccacctcaatggaggggacatagtcaatgacaatctcctaccatttaattagatggtttgccagcttcttcctgtagatagtatcacaatgatgcgagtccgatgtttataattcttttctaacattacatgttcttgtagtcattcattttgaaaccaccgaggccgtcacattatgctaggtaatttctgttaaggctataatttttctatcaatatgccaagatcgactgttggcctcacctttattttgcaaatgccaaaatgtacaagacataaatttcaagcttttataccttacatatattatgaacttatgaagttatgatatactgtctaaattcagcttagatctttaaatgaaaccctgaattatagat

SEQ ID NO: 35115 - DNA, 767 bp, Triticum aestivum
  unsure (1)..(767): unsure at all n locations
  Clone ID: PAT_TA_35115
agcgtggtcgcggccgaggtgagaactagtcncgagtttttttttttttttttttttttttttttttttttttttaanatttgcctatacctcagtcttacgaaaaagagaaggggttggcatanagagaaccaaatttgtaaagcaaacaaacccacgcttcgggaaggtgaggcgaactaacaattccttccgtcgtgtatcctcgattgatgcgggcttcagatacttcaattgtagatttgagtattgagcgaaaggttacacctacaggatatggtatggtatggattacaggccaatcctactctattagtatccgtagggcagcataggggagaaaagcactacacctagaaataggaatcaacaagagaaaaactttgttagaaattacccctttcctgatcgttatccgggctgggaagacaaagtggtgggacaaacaacgatcgggcatgtactttggatacccctataaccatcaaagatcgttgaagtagctaattcctctaaataggaggcgttgagaacaaagaaattattggagctatcgttttcctctagcattaatagaattcattggtggtaagaaaaacctcttgtgggaaggttggctagagatttcttggaaaaataccagcccctttcggttcataatgagacgggactaattctattttgattctatagattatttcgcttagtacctcggtgtcgaccacgcaggagccgtatgagatgaaaacctcatgtacgggttttgg

SEQ ID NO: 35116 - DNA, 987 bp, Triticum aestivum
  Clone ID: PAT_TA_35116
agaaagtttttcctgaggcagctgctgtggcacacgggcctatgcaaaatgatgtagctgatcttccatcagacgattcagaagatgatgacttcgaccccaatatacctgaagaacatgtggctggtcacgcagaaggatcatcagaagaggatggggatgaaggttcagactctgatgactcaaatttcatgacctcttctgacaattcagaacacgtgaaggagaaagtgaaagttgatgaccttggattaccttctgaggactcggaggatgatgactatgatccagcaggtcctgattcagataaagatatcgaagagaagcaagatgagtcagacttcacatcggactctgatgagttctgtgctgagattacaaagtcttgtagtaaggatgaagtttcgtctggtcctaaggttggaggtcgtactaatgacttggaaggggcccctgttcggccaaacacatcaatgtcacatagcaaggatcttgagatcgacccagatgtgattttaccatctacaaaacggcaggttcaacggttggactacaaaaaactttatgatgatacttatggggaagcaccatctgaatcaagcgatggtgatgagtggtctgggaagagcacactcaaagaagacaacgaagaacgaaatgaagtggattcatttgcacgcaaaagctccaggggaacgcgagcggtgcatcctgacggttttcatggtttagtaaatgatcaacatgcaggggggcttacctctgctggcagcaatagtaaagctaacaaaagggcattttggtccagtaattaatgagaggctaaatcagtatttcacaacagaccaataccctagccgtgctgttaaagaaagcttggcacaagaattagggctgacattccatcaggttaacaaatggtttgaaagtacacgtcacgcaagagcagctgctatgaaaaatggcactcaggctagaaagcagagc

SEQ ID NO: 35117 - DNA, 674 bp, Triticum aestivum
  Clone ID: PAT_TA_35117
ttttgcttcaaaaaggttaacaaagccatctacaggcttgctaacaatcttcagtgtaaatggttatggcttgccaacaatcttcagtgtaaatgataaccatttcctgctcaaatcaagtttaacataactgctgtaaaacagcaggaattgtctcaaccccttacattgggtaacattactaccgctactagtacatcagagcaaaacagattggggaaacacagccacttcctttcttcctagtaacttcacttttgcttcttgggcatcctgtaaccaccaacaacgcaagcatggtcgcgctcgaagggctccagggtcacctgctctgagggcttgaactggtcggccttgagcttctccacttcactggcgaacacggcctcggccgcctgggtggagtcgatacagttggccttgatggaaatgacaaagtgaccgccattcttcaagaagtatgaagcgttaagggctaagattctagcctggtcaggctgtgcaacatctgaaaagataacatcaaccatgccgaccagcatcctgtacttagccgggtgcctagcatcctcaatgatggggatgacattggtcctcttcttggccacgttgacaagatccctaccactccggtgagagaactcaacggcatacaccaacccagcctcgtgccg

SEQ ID NO: 35118 - DNA, 547 bp, Triticum aestivum
  Clone ID: PAT_TA_35118
aggtatcctccgtgcggttccaagctcctactcccacgcccgtctcccccgagatcaggaggagcacgcccgctgcaccggagcgccgagacctcgaggccttcgtctccaccccggaggagagatggggctcacgttcaccaagctgttcagccgcctcttcgccaagaaggagatgaggattctcatggttggtctcgatgccgctggtaagaccaccatcctctacaagctcaagctcgggcgagatcgtcaccaccatcccaaccatcggatttaacgtcgaaactgttgaatacaagaacatcagcttcactgtttgggatgtggggggccaagacaagatcaggcccctgtggaggcactacttccagaatacgcagggcctcatttttgttgtcgacagcaatgatagggaacgtgttgttgaggctagggatgagctccacaggatgctgaatgaggatgagctgcgtgatgctgtgttgcttgtatttgcaaacaaacaagatcttcctaatgccatgaatgctgctgaaatcaccga

SEQ ID NO: 35119 - DNA, 920 bp, Triticum aestivum
  unsure (1)..(920): unsure at all n locations
  Clone ID: PAT_TA_35119
gcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctttgtactctgtactcgccactccgacagacttgatacattgtagtattgacttgtcttggcatagtttgtcagcgtgtcttctgaaaaaaaaaaaaaaaaaaaaaaaaaaaaaaaaaaaaaaaaaaaaaaaaaaaaaaaaancccccccccnnnaaaaaaa

SEQ ID NO: 35120 - DNA, 929 bp, Triticum aestivum
  Clone ID: PAT_TA_35120
ttttttttttgcaaaatcattcagccattcaccaagatataaaccaagtagctacagaaccaactttgtctaagcttatcaccaacacctaagttcctagtactaattaacgacagaccctcataacaaagtattaactatttccttcaagtcgccttgggcttcttaggcatcctgtagccaccgacaacgcaggcatggtcacgctcgaagggctccagggtcacctgctccgaaggcttgaactgctcaagcttcagcttctcaacttcggcggcgaacacggcctcaggggcctgggtggagtcgatacagttggccttgattgaaatgacaaagtgaccaccattcttcaagaagtatgaagcattaagggccaagatcctagcctggtcaggctgtgcaacatcagagaagataacatcaaccatgccgaccaacatccggtacttggcagggtgcctagcatcctcgatgatgggaatcacattggtcctcttcttggccatgttgacaaggatcctgccactgcggtgcgagaactccacagcattacaccaacccagtcgggccaacaatatcagacacgtgagacactgtcgttccagaggcagcaccaagatacagcacacgagcaccaggagcaatccagatgttgtcgacgccaccaagaacagcggcggccagctttgacctgaaggggttccacaccctgtactcaaccttggtgccgtcctcgttctggacggagacgcgcttctcgccgtagacggactccccggcgaccatgttcttggtgcagagcgcgtcctccattggcttgggcgatgaagacgccgtcgtgcttgtgcggcaccacgaccaccttgctgccgcccttcatgccggcccctccccttccaccgccgccacgaccaccacggccctgt

SEQ ID NO: 35121 - DNA, 1233 bp, Triticum aestivum
  Clone ID: PAT_TA_35121
ttggggtacccggcccccccccttttaagagatgttttaacatttttagtgtgttcacttcatttcagatggagtgacattttctgctcaaatcaagtttaacataattgctgtaaaacagcaggaattgtctcacaaaaccccttacacttgggtcacacattactactactgctactagtacatccgagcaagcagatggcagaaacaacacatccacttcttttgcttcctctcaacttcacttttgcttcttgggcatcctgtaaccaccgacaacgcaggcgtggtcgcgctcaaagggctccagggtcacctgctccgagggcttgaactggtcggccttcagcttctccacttcgctcgcaaacaccgcctcggcagcctgggtcgagtcgatacagttggccttgatggaaatgacgaagtggccgccattcttcaagaagtatgatgcattaagggctaagattctagcctggtcaggctgtgcaacatctgaaaagataacatcaaccatgccgaccagcatccggtacttggccgggtgcctagcatcctcgatgatggggatgacattggtcctcttcttggccatgttgacaagatccctaccactccggtgagagaactcaacggcatacaccaacccattcggtccaacgatgtcggacacatgagacacggttgttccagaggcggctccgaggtacagcacgcgtgttccaggagcaatccagatgttgtccacaccaccgagcacggcagcggccagcttggatctgaaggggttccacacccggtactcaaccttggatgcgtcctcgttctggacggagaccctcttctcgccgtagacggactcgccggcgaccatgttcttggtgcagagcgcgtcctccttggccttggcgatgaagacgccgtcgtgcttgtgcggcaccacgaccaccttggccccgcccttcatgccggggccacccctgccgcctccccggccgccgccgcggcccctgccagcgctccggccgccgaagcccctaccgccgctgcggccgccgccgtcgctcctcccgccgaagccgcggccacggcccccgcggccgccgctgtcgccgaagcccctgccgccgccgcggcctcctcctcctctcatgggtgccctcatggtgctggtggtgtggtgccgccgccgccgccgcaggagggagggtttagggtttcctcgtgccg

SEQ ID NO: 35122 - DNA, 872 bp, Triticum aestivum
  Clone ID: PAT_TA_35122
gattcggacgaggcgaagctgttcagccggctcttcgccaagaaggagatgaggatcctcatggtcggtctggatgcagctggtaagaccaccatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaagacgagctccgtgatgctgtgcttttggtgtttgcaaacaaacaagatctgcctaatgccatgaatgctgctgaaatcaccgataagcttggcctgcactcgctgcgccagcggcactggtacatccagagcacatgtgctacctctggtgagggtttgtacgaggggcttgactggctttcgaacaacattgccaacaaggcttgaagcatctaggcagggcttcaatcaatggaaacactctggatacttggggtacgaactgcctctaccattacagcgatgaactatagtcgtgtctgtcggatgtggggatgtttttgggaggataaaaggctctttggtcaaggagctaggtatcagatgttttcgtggtattgttaatttctgttttggtttgtgcaaggtataccatgtccgactgtgtgctgtgtactcgccactgttctataatgtgctgtatactctcgacccctgactgaggcgttgtactatatatctcgatctgtctagctgtctcttggcatagcaaaaaa

SEQ ID NO: 35123 - DNA, 1030 bp, Triticum aestivum
  unsure (1)..(1030): unsure at all n locations
  Clone ID: PAT_TA_35123
gaacagccactgaggacatcaaacgcaagttatagcttaatctaaaatagacattcgccatgaatctacacgtgcactgaacagacacaagaggtttcatggggcttttcatcctaacttcaatctccttgggtaccataaaatctgagagttccctagtttgatcagaaaagaaacacagttcaacatcccacacctccacacattcagtggcgacctgtggcggtgtttaaagccctccggctatctgctgctagggggaaagcttcacctgtcccactccgaagctggatttggccgctcgaacctaggcttgctagctgaggtcgaggtgctttgagggtgagtcgatagggcctggtcccaacccatgatatgcggcaatgcaaaactcaatgccgtgcgcataactgcaaattcagcttttgttacagggactgaaaggcgttcgttggtcttctgcacattattcagaacagttatgttaacaaagtatccattgtcactgccaagaggagtgattgacaaagattttttcacttggccttcatgacttgatttcatggaaggatcatggaaaaattcacatgattcagcaggcccaagacttatcaagctcccaacttcagtaggtgacagagcaaagagctgtttctttgtatagtcgtacttcctttgtccaactgccgggaaaaaggtcaacattactgacccattcctgtccactcgagatcctccagattcaactttggtgaataaaggaaggataggacttatagaaagtgcagcctttcccttgaacacagtgtagctcgcatactttttaacagatgcattctcatcaacatttgcagctgaagttgaaagcgcgtgcttgaatgtcaacgaaccgctccagagaacatcttttaggtcagtgactcccctggaggtggaggggaggaagcgggagaggcggagcattgttgctgctcgtccgtcgttggtcgcgcccgagccccaggggaacctcgtgccgaattncctgcag

SEQ ID NO: 35124 - DNA, 1057 bp, Triticum aestivum
  unsure (1)..(1057): unsure at all n locations
  Clone ID: PAT_TA_35124
tccatttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcggggtttaatgtcgaaactgtagagtacaagaacattagtttcacccgtttgggatgtcgggggtcaggacaagatcaggcccctgtggagggcactactttcagaacacccaggtctcatttttgtcgtgggacagcaatgacagagagcgtgtttgttgagggaaagagatgacttcaccgggatgctgaatgaggatgactgctgatctgtgctgctggtgtttgccaacaagcaagtctcctaatgccatgaacgctgctgaatcactgacaagcttggctgcatctccggcgcagcgacattggtacatcccggagcacatgtgtacctntggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctctgtactctgtacccgccactccgacagacttgatacattgtagtattgacttgtcttggcaaaaaaaaaaaaaaaaaaaaaaaaaaaaaaaaaaaaaaaaaaaaaaaanaaaaaaaaaaaaaaaaaaaaaaaaaaaaaaaaaaaaagggggcg

SEQ ID NO: 35125 - DNA, 1027 bp, Triticum aestivum
  Clone ID: PAT_TA_35125
gccggccgggtcgggctctctctctccatttctctcctcctcctcctgccaccgatcccgaaccagggaggaacccggcgcgaggagggcaaaggaagagaagaggagatcaccgagcccagcgcgcgcacaggacagcaggcgccgcgatctcggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttgggcctgcattctctgcgccagcgacactggtacatccagagcacatgtgctacctctggagaggggttgtacgagggccttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttccgtgggtgttaaattgtccgtggcgctgtttgtttgcccatcatggttttactatgcccgctttgtactctgtactccccaatccgacagacttgatacattgtagtattgacttgtcttggcataaaaaaaaaaaaaaaaaaaaacacaaacccagcccgc

SEQ ID NO: 35126 - DNA, 1130 bp, Triticum aestivum
  Clone ID: PAT_TA_35126
aggtacgtctccacgcccttcttggccttgctgcccttcttcctgccccgggtcttggcctcgccgccggcctccttggacgccgtcttgcccgccggcagccgcttctcggccttgggcttcttgcccgcgggggtcttctccgccgccttctcgaccttgttctcggccgaggtaccataaaatctgatgaaagttccctagtttgatcacaaaagaaacacagttcaacatcccacatctccacacatttcactggcgacctgtggcggtgtttagagccctccggcgatctgctgctagggggaaagcttcacctgtcccactccgaagctggatttggctgctcgaacctaggcttgctagctgaggtcgaggtgctttgagggtgagtcgatagggcctggtcccaacccatgatgtgcggcaatgcaaaactcaatgccgtgcgcataactgcaaattcagcttttgttacagggactgaaaggcgttcgttggtcttctgcacattattcagaacagttatgttaacgaagtatccattgtcactgccaagaggagtaattgacaatgactttttcacttggccttcatgacttgatttcatggaaggatcatggaagaattcgcatgattcagcaggcccaagacttatcaagctcccaacttcagtaggtgacagagcaaagagctgtttctttgtatagtcgtacttcctttgtccaactgccgggaaaaaggtcaacattactgacccattcctgtccactcgagatcctccagattcgactttggtgaataaaggaaggataggacttatagaaagtgcagcctttcccttgaacacagtgtagctcgcatactttttaacagatgcattctcatcaacatttgcagctgaagtcgaaagcgcatgcttgaatgtcaacgaaccgctccagagaacatcttttaggtcagtgactcccctggaggtggaggggaggaagcgggagaggcggagcattgttgctgctcgtccgtcgttggtcgcgcccgagccccaggtggaatggaaagcagtcgcccccgcgtactctgcgttgttaccactgcttcccgcgtactctgcgttgttaccactgctt

SEQ ID NO: 35127 - DNA, 1097 bp, Triticum aestivum
  Clone ID: PAT_TA_35127
ctcgagtttttttttttttttttttttagctgggggaaaacgatgatttattcaacataaactgaatgtgtattcagcaacatgttgcagaaagatggagattacagctttatctgacagaagcacaagatacatgtaccaacaaatctgtggaagtaatagtgtgctagggcatcaggccataaatacttccagcttacaagaatagtacacataataggtgactacagaatggcgcgccgaattgcacttgcggacaatcgtgaggactgtgctcttgtttcacttccagacagcacaagtcgacgggcagatcaaatccaacgttacattcagacaatagttttcttgcttgctacatcagggagaaaatgtccgactgcgcctctgaacatcaaactcggcctcgatgaggccagttataccagctttgatcttctgccctattcggacagggcctacaccctcaggagtaccggttaatatcacatcaccctccatcaatgtcatgattgaactgatatagctgattaggaaaggaaccttgaatatcatatcacttgtaggccctttttgcctgagttcatcatccacctttagccagagctctagatcatcgggattagggacagctgattttggaaccactgcactaattggagtaaaggtatcctgtgctttagccaaagtccaaggaagacctgtagacttagctacagactgaaggtcccttgctgtcatgtccaaagcaagcgcataacctccgacgaagtccatggcggaggcctcgggcacgtcgcgcgcgcgccgtgagatgacgacggcgagctcgacctcgtggtgcagcgactcgagcggctcgggcacctcgacggcggcggtggccacgcccgcgtggaggaacgacgaggtcggcttgaggaacagcaccggctccttggggacggggttgccgagctccttggcgtgggcgacgtagttgcgcccgaccccgacgatcttcgtgctcgccgcgaggagcctctgcgccgccgccgccatggccggaagagctgcgacttgcggacgcggggcggacgcggggcggacgcggggtc

SEQ ID NO: 35128 - DNA, 1887 bp, Triticum aestivum
  unsure (1)..(1887): unsure at all n locations
  Clone ID: PAT_TA_35128
tcgttctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaaagaaatgaacttcaccgggatgctgaatgaggatgagctgcgcgatgctgtgctgctgggtgttttgcaaacaaagcaaagattcttcctaatgccaatgaatggctgctgaaatcactgacaaagctttggcttacattccctgcgccaagcgacactgggtacatccaagagcacatgtgctacctcccggggaggggttgtacgagggccttgactggctgtccaacaacattgccaacaaggcttgaagcatctcggcaggggcttctatggatctgtataagctggatattcggnttttttttttttttttttttttaaatgataaccatttcctgctcaaatcaagtttaacataactggctgtgaaacagcaggaattgtcttacacttcgtaacataactaccgctactagtacatcagagcaaaacagatagcagaaacaacacagccacttcttttcttcctctttaacttcacttttgcttcttgggcatcctgtaaccaccaacgacgcaagcgtggtcgcgctcgaagggctccagggtcacctgctctgagggcttgaactggtcggccttgagcttctccacttcactggcgaacacgggcctcggccggcctgggtggagtcgatacagtttgccttgatggaaatgacaaagtggccgccattcttcaagaagtatgatgcgttaagggctaagattctagcctggtcaggctgtgcaacatctgaaaagataacatcaaccatgccgaccagcatcctgtacttagccgggtgcctagcatcctcaatgatggggatgacattggtcctcttcttggccatgttgacaagatccctaccactccggtgagagaactcaacggcatacaccaacccagtcggtccaacaatgtcagacacatgagacacagttgttccagaggcagctccgaggtacaacacacgtgttccaggagcaatccagatgttgtccacaccaccgagcacagcagcagccagcttggacctgaaggggttccacaccctgtactcaaccttggatccgtcctcgttctggacggagaccctcttctcgccgtagacggactcgccggcgaccatgttcttggtgcagagcgcgtcctccttggccttggcgatgaagacgccgtcgtgcttgtgcggcaccacgaccaccttggccccgcccttcatgccgggaccacccctgccccctcccctgccgccgccgcggcccctgccggcgctccggccgccgaaccccctaccgccgctgcggccgccgccgtcgctcctgccgccgaagccgcgcccgcgcccgccgcggccgccgctgtcgccgaagcccctgccgccgccgcggcctcctcctcctctcatgggtgccctcatggtgctggtcgtgtggtggtgctggtagccgccgccgccgggagggagggtttagggttttgggctggtgccg

SEQ ID NO: 35129 - DNA, 1172 bp, Triticum aestivum
  Clone ID: PAT_TA_35129
tttttttttttttttttttgagtgatgctctactttgtgaatttcacattttgagctctacttttcagaaagttgttttgaaatatacttgaagtgaagatacacttatagcttcaaaaaggttaacaaaaccatctacgggcttgctaaaaatcttcagtgtaaatgataaccatttcctgctcaaatcaagttcaacataactgctgtaaaacagcaggaattgtctcaaccccttacattgggtaacattactaccactactagtacatcagagcaaaacagattggagaaacacagccacttcctttcttcctagaaacttcacttttgcttcttgggcatcctgtaaccaccaacgacgcaagcatggtcgcgctcaaggggctccagggtcacctgctctgagggcttgaactggtcggccttgagcttctccacttcactggcaaacacggcctcggccgcctgggtggaatcgatacagttcgccttgatggaaatgacaaagtggccaccattcttcaggaagtatgatgcgttaagggctaagattctagcctggtcaggctgtgcaacatctgaaaagataacatcaaccatgccgaccagcatccggtatttggcagggtgcctagcatcctcgatgatggggatgacattggtcctcttcttggccatgttgacaagatccctaccactccggtgagagaactcaacggcatacaccaacccagtcggtccaacaatgtcagacacatgagacacggttgttccagaggcagctccgaggtacagcacacgagttccaggagcaatccagatgttgtccacaccaccgagcacagcagcagccagcttggacctgaaggggttccacaccctgtactccactcgttgaatacatcagtgtagcgcgcgtgcggcccagaacatctaagggcatcacagacctgttattgcctcaaacttccgtcgcctaaacggcgatagtccctctaagaagctagctgcggagggatggctccgcatagctagttagcaggctgaggtctcgttcgttaacggaattaaccagacaaatcgctccaccaactaagaacggccatgcaccaccacccatagaatcaagaaagagctctcagtctgtcaatccttgctatgtctggacc

SEQ ID NO: 35130 - DNA, 1025 bp, Triticum aestivum
  Clone ID: PAT_TA_35130
gactagttctagatcaccgcactgcacgacagccatcctccgtgcggttccaagctcctactcccacgcccgtctcccccgagatcaggaggagcacgcccgctgcaccggagcgccgagacctcgaggccttcgtctccaccccggaggagagatggggctcacgttcaccaagctgttcagccgcctcttcgccaagaaggagatgaggattctcatggttggtctcgatgccgctggtaagaccaccatcctctacaagctcaagctcggcgagatcgtcaccaccatcccaaccatcggatttaacgtcgaaactgttgagtacaagaacatcagcttcactgtttgggatgtggggggccaagacaagatcaggcccctgtggaggcactacttccagaacacgcaagggctcatttttgttgttgacagcaatgatagggagcgtgttgttgaggctagagacgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcgacgtctggcgaagggttgtacgagggacttgactggctctccaacaacattgccaacaaggcttgaagcgcctcgacaagtgcttcatcaagaaacaaacgtgctggatgtctcaacaactcactgctaccattttacatattgtgatatatatacactgtacaagagatagtatgtgtgcgtatgtgacaggcagaagctcccttctttaagtgagctagtatcaggtcaggttgtctttttttgtatggatattatcagttgctgttcggtggttttacaaggtttaatgtgtcgacgatgtgtgtctgaacccctatcttttcgagttttgttaagattgaattgtggttgccaatgttggttggttcagttgagtgatgtggatggt

SEQ ID NO: 35131 - DNA, 1004 bp, Triticum aestivum
  Clone ID: PAT_TA_35131
cggacgcgtgggctgcacgacagccatcatcctccgtgcggttccaagctccaactcccacgcccgtctccccctagatcaggaggagcacgccgcaccggagcgccgagacctcgaagccttcgtctccacctcggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggattcaacgtcgaaactgttgaatacaagaacatcagcttcactgtttgggatgtggggggccaagacaagatcaggcccctgtggaggcactacttccagaatacccaagggctcatttttgttgttgacagcaatgatagggaacgtgttgttgaggctagagatgagctccacagaatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgcgcgacgtctggcgaagggttgtacgagggtcttgactggctctccaacaacattgccaacaaggcttgaagcgcctcgacaagcgcttcatcaagaaacaaacgtgctggatgtctcaacaactcactgctaccattttacatattgtgatatatatacactgtacaagagatagtatgtgtgcgtatgtgacaggcagaagctcccttctttaagtgagctagtatcaggtcaggttgtctttttttgcatggatgttatcagttgctgttcggtggttttacaaggtttaatgtgtcgacaatgtgtgtctgaacccctatcgttttgagttttagcaagattgaattgtggttgccaaaaaaaaaaaaaaaaaaaaaaaa

SEQ ID NO: 35132 - DNA, 1214 bp, Triticum aestivum
  Clone ID: PAT_TA_35132
ttttttttttttttttttttgaaagccacttgatttatggggctctctaacttcaatctcctggggtaacataaaatctgataaagacaattccctagtttgatcacaaaagaaacataattcgacatcccacatctccacacatttcactggcgacctgcggtggtgtttaaagccctcaggcgatctgctgcgaggaggaaagcttcacctgtcccactcagaagctgggctcctcctgccaccgatcccgaaccagggaggaacccggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctctgtactctgtacccgccactccgacagacttgatacattgtagtattgacttgtcttggcatagtttgtcagtgtgtcttctgaattgct

SEQ ID NO: 35133 - DNA, 1255 bp, Triticum aestivum
  unsure (1)..(1255): unsure at all n locations
  Clone ID: PAT_TA_35133
gccggccgggtttggaccgcaccgcactgcacgacagccatctcttccgtgcggttccaagctccaactcccacgcccgtctcccccgagatcaggaggagcacgccgcaccggagcgccgagacctcgaagccttcgtctccacctcggagcagagatggggctcacgttcaccaagctgttcagccgcctctttgccaagaaggagatgaggattctcatggttggtcttgatgccgctggtaagaccaccatcctctacaagctcaagctcggagagatcgtcaccaccatcccaaccatcggatttaacgtcgaaactgttgaatacaagaacatcagcttcactgtttgggatgtggggggccaagacaagatcaggcccctgtggaggcactacttccagaatacgcagggcctcatttttgttgtcgacagcaatgatagggaacgtgttgttgaggctagggatgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcaacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtctttttttgtatggatattatcagctgctgttcggtggttttacaaggtttaatgtgtcgacaatgtgtgtctgaacccctatctttttgagttttagtaagattggattatggttgccaatgttggttggttcagttgagtgatgtggatggtacatgttgcgaacatacttatgtgagcgatgttttcaaaaaaaagggggggcccggtaccaattcccctatatgagtctattaccgcgccactggcgtcgttanacgtctgacgggaaaacctgggtaccactaacgccttcagaaacccctttncactggtatacaaaagcccacgttcctccaaatnccacctaagnaangancccgtcnggataccggggttgg

SEQ ID NO: 35134 - DNA, 1057 bp, Triticum aestivum
  Clone ID: PAT_TA_35134
gccggccggtccgggctccctctctctcctccatttctctcctcctcctgccaccgatcccgaaccagggaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgcgatgctgtgctgctggtgtttgcaaacaagcaagatcttcctaatgccatgaatgctgctgaaatcactgacaagcttggcctgcattccctgcgccagcgacactggtacatccagagcacatgtgctacctctggggaggggttgtacgagggccttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggctttactatgtccgctctgtactctgtactcgccactccgacagacttgatacattgtagtattgacttgtcttggcatagtttgtcaccgtgtcttctgaattgctatctcttgtgttgatttcatgtgcaaaggggggg

SEQ ID NO: 35135 - DNA, 1047 bp, Triticum aestivum
  Clone ID: PAT_TA_35135
tcgaggcggccggttccgctccctctctctctccatttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctggagaggggttgtacgagggccttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctttgtactctgtactcgccactccgacagacttgatacattgtagtattgacttgtcttggcatagtttgtcagcgtgtcttctgaattgctaaaaaaaaaaaaaaaaaaa

SEQ ID NO: 35136 - DNA, 909 bp, Triticum aestivum
  unsure (1)..(909): unsure at all n locations
  Clone ID: PAT_TA_35136
ggtccgaggnatgagctggacacgagctgcgtggaggagatcgaccccagcgccgaggacaaggagctgaagcaccagctgctgaggaaatacggcggctacgtcgggagcctccgccaggagttctgcaagcggcggaagaaggggaagctccccaaggaggcccgccagaagctgctgcactggtgggagctgcactccaagtggccctacccctctgagacggagaagatcgcgctggcggagtcgacggggctggaccagaagcagatcaacaactggttcatcaaccagaggaagcggcactggaagccggcgccggaggacatgcccttctccgtgatggacggcggcgtgggcgtgcagcttcctccccgccccgcagggcccggcgctgtacatggacagggcgcccttcatggtggacggcatgtaccgcctcgggtcgtgaggcctctctccctttctccatcggacggggactgccggccggtgccgtcggcgtggtacgtaagctccatgcatggcaacggcatgcggccggtacgtaacgtacttagtctgacgacgaccgctcaatattatggtccttcggtaaatactccatatatatctgccgttcacgttgaacaagtctgccaagtaggaaatatatatatttgatttttctccacaaaaaaaaaaaaaaaaaagaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaagcgggccccccaaaggtttcaaacttaatttcccgttcaaggaaatttaaagcccttcaaaaggggcccccaattttaatttcc

SEQ ID NO: 35137 - DNA, 1169 bp, Triticum aestivum
  unsure (1)..(1169): unsure at all n locations
  Clone ID: PAT_TA_35137
cccacgcgtccgcccacgcgtcctcgacctctcacctagcgcacatccatggcgcgcttcctcgtcgccctcctcgctgccaccctggtcgcggttcaggctggagggcagctgggccacgcggcgccggcgacgggggaggtgttctggcgcgccgtgctgccgcactcgccattgcctgacgccgttctccgcctcctcaaacaacctgcagcagaatccaccagcttcgtgagagaccccgaggacaggccccccttcgactaccgtgattacagccgctcgtcgtccgatgatgaaccgagcaagagcaccgtcgccgcctccggagcggggggcttcgactacgacaactacagcggggccgacgaacgtcgtggtgccaccgatgaatacagttggccgagcaacagaagccaccagcgcggggcgtgacatcgataagggcccccccttcgactaccgtgattacagccgctcgtcgtccgatgatgaaccaagcaagcgcaccggcgccgcctccggagcggggggcttcgactacgacaactacagcggcgccgacgaacgccgtggcgccaccgatgaatacaaggcgccgagcagcagccccgctggaagcggggcgtccatggctaggggcggcaaggcggagacgacgacggtgttctttcacgaggaggcggtgcgcgtcggcaagaggctcccattccacttcccgccggcgactcccgccgctctcggtttcctgccgcgccaggtcgccgactccgtcccgttcacgacggccgcgctacccggcgtcctcgcgacgttcggcatcgcgtccgactccgccacggtggccagcatggaggcgacgctgcgcgcctgcgagtcgccgaccatcgccggcgagtccaagttctgcgcgacctcgctggaggccctggtggagcgcgccatgggagttctggggacccgggacatcaggccggtgacgtcgacgctgccccgcgccggcgctccgctgcagtggtacaccgtccgcgtcgtgcggccggtggaggggggcccggtcttcgtggcatgccacgacgaggcctacccgtacaccgtgtaccggtgccacaccaccggcccgtccanggcgtacatggtggagatggagggcgcgcgcggcggcaacg

SEQ ID NO: 35138 - DNA, 1574 bp, Triticum aestivum
  unsure (1)..(1574): unsure at all n locations
  Clone ID: PAT_TA_35138
gcgacctttcatttaggcccgaggcacatctcgacctctcacctagcgcacatccatggcgcgcttcctcgtcgccctcctcgcggcctctcacctagcgcatcatcctcggcgcggcgcacatccatcgcccgcgtcgtcgtcgccgtcgtcgtcaccacccgggtcgcggttcacgccggagcgcagctgggccccgcggcgccggcgacggccgaggtgttctgccgccccgtgctggaacactcgccattgcccgcccccgttctccgcctgctcaaacaacccgccgtcgtgtgatgaactgctgacaggaagcccccaggcttccttgaggaacggcggggacaggctccgattagaataccgtggaagtacagcgccgtcgcgcccccggaggatggaagccgcagcaaaatacccccgcgtccacccggcggggaccgccggggaggcggcatagcgagcaaactacaggcggggggccgcacaacggctgcgtgcgcggcggccacggggggcgccggcacttcgggagtacgacgcgtacatctgggccgacgagcgcggtgcgcgccgccaatgaattcccatgcccgcatgcccccgcggcgcctgcaaccgcgctcggctttcggcccgcgcccggtcgacgccgccgtcccgttcaggatgcttgcgctgccaggcgtccgcgcgtcgttcagcgtcgcccattcctcctccacccggcgactcccgccgcgctcggtttcctgccgcgccaggtcgccgactccgtcccgttcacgacggccgcgcaccctggcgtcctcccgacgttcggcgtcgcgtccgactccgccacggtgggcagcatggaggcgacgctgcgcgcctgcgagtcgccgaccatcgcaggggacttacccttccgccctgtaccgctgccacaccaccggccgctcgccagggaagtgctgggacatggcggccgcgcgcggggccggcgcggtgaccatcgccgccgtgtcccacaccgacacgacactgtggaacccgggccacgtctggaggggggtcctgtctaccaagcccgccacgacgacggctacccacacaccgtgtaccggtgccacaccactggcccgtccagggcgtacatggtggacatggagggcgcgcgcggcggcgacgcggtgaccatcgccaccgtgtgccacaccgacacgtccctgtggaacccggagcacgtctccttcaagctcctgggcaccaagcctggcggcacgccggtctgccacctcatgccgtacgggcacataatctgggccaagaacgtgaatcgctcgccggcgtgagcggcccgggcagctctgtggtctcgccggaactaagatcgatgtactactactactatctgtttccacctacgtcttctgttgttcagaccaccagatggtcaccagagcagcgcttgtaataaaagaacagcttctgcagagctgtgtttatttacaatacattgctgataaaaaaaaaaaaaaaaaaaaaaaaaaaaaaaaaaaancccnaaaaaaaaaaaanttttaaaa

SEQ ID NO: 35139 - DNA, 689 bp, Triticum aestivum
  unsure (1)..(689): unsure at all n locations
  Clone ID: PAT_TA_35139
ggctccccttctcttcctcgctcttgcgaccgaaatcgccgccgccgccgccgctcaaccccggccgcctccggtggtttctgccgccgtcgcctagcgcgaacgacgcacctagccgccctttatcacctcctcctcttagattttccgggcgcctcctcgtgcggctgtgccctactccgcatgggagctagggtttgcgcccctcgtcggagttgaactccggcggccgtcctggtgctcgggtggtcatggtcgccgccccctcccccgccctaaccgccgcggacgcgaggcaggccgcggcgaggaagaaggaggacgacgacgaggaggtcgtctgcttcatctgcttcgacggtggagacctcgtcgtctgcgattggaggtgcgacgccgcagtgcgcgacttcttcctgattgcagtcagtgccgccgccgtctccaagctgcagagtcccgttcctttccgcccgtgcgtttcctcagcgtgagatcgantcgggatgtccctaatctactgtgtgtacttttaactgaatttccgacagtgcgtttgctcagcgtgagatggatcatcgagttgccacacgtgctgccatctgaaaaagcattntatgctgctgtatcttcccttggcatctacagcaaagatggttacgatggnaaggggctatttagcgccgctt

SEQ ID NO: 35140 - DNA, 701 bp, Triticum aestivum
  Clone ID: PAT_TA_35140
taaaattacactaaaaacctaacaacagctaagctagctaagctcctcctcaaccatcaaagatgggaacaacccatgttcccagctacacatatgatacatcagctaggctctcccaaagggcttgctctttgcgcaacccaatcaatagccctggttcacacctcgaggacacccgtcgtcgggattcagaagttactcttgctcgtcgaaggcctggacctcttgctattgagctgcgccaccgggaactctaccagaacgatgaacgacgagctctccgcttctcggaggtactgtaccgtgccgctcatcgtcttcaccagcttctggcttatgtgcaggccgaggccttctcgggatacccctgggccgtgccggaacatctcctgtatcagtgcctccgggacgcctggtgctgggtggacaagtctgaattctagatgagcaatctgcatgccagaaccaatgtgttccttcttgggaatgacctggagtaccagagcggcttcagctccgtgacattgcataaccgtgcacgcatcaggcaatctaaacacttgctgaagcctgcaagggcaacctcctgtcaccatttggctgaccactataatttttatctgacccggatggctccggacttgcacagtcgccatcccaaaaaatttatgctgtacacgtaaaagaacatttgatgcaaa

SEQ ID NO: 35141 - DNA, 721 bp, Triticum aestivum
  Clone ID: PAT_TA_35141
ccccacttcccacccactccgcttcccggccccccattaaacgcccgtgagctagcacgcgatcccctacccaccaccgggcgacgtgctccgtctccatcactcctcctcgaccgttgctccgtgtccgcggagaggcgctgcgtcctcacctgacggcggccatgataggcatcgacctcaacaccgtggagggggacgaggaggagggcggtccctcggctgagcccccgaggggtacggtgtgcctagagctgtggcacgcgtgcgccggccccgtggggccgctgcctcggaagggcagcgccgtcgtgtacctgtcggagggccacctcgagtacatcggggaagcggcgggcgcggtggctgcggtgccgccccacgtgttctgccgagtcgtcgatgtcaatctccaggcggaccctgcgacggacgaggtttacgcgcaagtttctctcgtggtcgacaacgaggaatccaagaggcggatgcgccaatgggagagcgaggaagcttgcgaaggagacggcgaggacacctatgccgtgaagctgcgagcgcgcatgccctacatgtactgcatgacgcttacagtttgcgacaccagcacgcacggatgatctgcctagccgcgacgcgcctgctaggactggttaccgtctctgtgttacactcatgatgaacaatgcaaccagcttgcggccaacgatttagtctgcac

SEQ ID NO: 35142 - DNA, 799 bp, Triticum aestivum
  Clone ID: PAT_TA_35142
gctccatctccctcaccctccttctccacctccggccgccgccacggccaggccggcgtggtggtgcgcccctcaccatcacaccatcaccatcgcctctagccacgaccatctccaccatgcaccaccagcaccacttcccacgagccgcacctcacaccaccaccagcaccacgccatctccatcttcgccgccgcgccaccgctcgcacaatctcttcttcccctgctgctccttccttctcctcaccacgctgctgcttcccctctcacgcccctggtactgctccttctcacgttcctgctgctgctgctcgtcttgtgcccctggtgctgctcctccttccctcgtccttgctgctgctctctccctctctgttgctcttctctgaatcccctactgctactactccacttcctctgctccccttcttcttctctgaatctcgctgctgctgctcctcctcttaaaactgctgctgctccctctcccactttcctcgctgctgttccctctctcttctcaccaaaattgctgctgtcctcttctccatttgcttgctgctacacccttcctgaagctctctcaactttattttgttctgtattagtactgtttttgtctgtatgccagttagtttgctgtaataattcagattacttgtgatctttgtgttgaatgcgatttcagtgaacttgagatttgtaatattgctcaatattcagtctataatgtatgatactttgtgattcggtggtgtcaatattcaatatatataaccgtgataaaaaaaaaaaa

SEQ ID NO: 35143 - DNA, 862 bp, Triticum aestivum
  Clone ID: PAT_TA_35143
aaagttgctttcctacatggtattagagcctaggtttaggtctccggacgccgcaactcgtccttgcgatccatttttttttctcgatcgatctgtttttctctggatcgatctcgtcttccatggcaccaccagccccgcgatccgcctggcgccttgactgctcgcccagctgcttcggcgtgggcacctcgtgggccgctacctgcccctggatcgatggcggctgcctcagatcgggaccatcgcctcctgtgcgctcggctggggcgctcggctggaagcacctccaggctccaggaaggctccgctccacgtgcaggcccgcccgtacagctccagcagcctgcgtgttgctctcctgcagctgcaggcttctgtccgcacacgtttgcctgcagctggatctcatcttggccaacgctgctgcttcctgtcgaccgcgtgtgcccctgctggctggctgctgctctgctcccgcacgtccatctgcgtgctgctgttgttccgctgccctttgctgctctactcagctgatgcgttctgctagcctacttgctagttgatgcgttcctgctagcctatttgttagctgccgctgctgatcttttagtcattgcattagtctggcatgtgctttttctatatttttcgctgcgtccaccaaattcgttgatattttgtgttttctcatgtcatgtgagtccaccatacctatgtctgtcagcctttttctggtcattgtcctctctataggatttctgtggcctctctttgcattgttgatctaagcccattcccttgccgccgagcttctttcgccgttggttttcatgggccatgattctttaggcaatgcttt

SEQ ID NO: 35144 - DNA, 809 bp, Triticum aestivum
  unsure (1)..(809): unsure at all n locations
  Clone ID: PAT_TA_35144
cccccgactcctcccttacccgcccgccgccggcgcccgcaacctctcccggacgcagccctgccgaggatctgcgccgccgacgagcccccggcgctgcgataggctcggctcgttggattcgagagtaagcaggccggccggccggccgcccctcgttgccaccaacagcccgcgctataagccaagcctggcgggcagcgcgaagccgcacgcgcatgcgccaccaccatctcctccgctgccgcgcgatgcctatcctgccgtcgccgccgaggacgctgcgggtttcggggagccttgtgcaccaccgcctcatccgatgccgtgggttgcctatcccgccgaggacgccgggggtctcgggcgggcgcctcttctcctccctgccgctcccgccgcctctccagtccccaagagaggtgcatgtttggtatctttgccccgatgagctgaataatcagtcccagctgaatatgtatgaagaactcctgtctccttctgaaagaaagtatgctgactctatgaaagcaacattgttgcggaaagatgctgttttgtcccgtgcattgttgcgcaccaccctctcaagatatacagattgtaaaattgatccgaggtcatttgagtttaagaagaacaaatttggcaaacctgaggtattgtggccacatgatgatagcactgcagagcaacctttgcatttcaacatttcacacacaacttctttggatgcctgtggtattgccattaatgctcgtattggcattgatattgaagagaagaagcgaaatacaacnnngaatann

SEQ ID NO: 35145 - DNA, 1594 bp, Triticum aestivum
  unsure (1)..(1594): unsure at all n locations
  Clone ID: PAT_TA_35145
tgcagaatggcaacactggctatgatgacatccgtgcagctataaaagaagcaaaggaggtcaaagataagccaactcttatcaaggtgactactacaattggttatggatcgccaaacaaggcgagcacacacagtgtgcatgggagcgctttaggttccaaggaagtagaggcaaccagaaaaaatctttcctgggctcatgagcctttccatgtgcctgatgaggtgaaaaggcattgggctcaccatcttgacgagggtgcttctcttgaagctgaatggaatgcaaagtttgcagagtatgaaaagaaataccagcacgaggctgctgagctaaatagcatagtatcagggaagctgcctgatgggtgggacaacgctcttccaaagtatacccctgaaagtcctgctgatgctacaaggaacctatctcagcaatgcctgaatgctcttgctaaagtaatacctggatttcttggaggcagtgctgatcttgcatcatcaaacatgacattgctaaagatgtttggtgatttccagaaggacacccctgaagagcgaaacatccgttttggtgtcagagagcatgcgatgggtgccgtttgcaatggcattgctgtacatagccctggcctgataccttactgttcgacattctttgtgttcactgactacatgagagctcctatacgcctttcggccttatctgaatcaggagtgatctttgtgatgactcatgattctatcggacttggagaagatgggccgacacatcaaccagttgagcagttgttcagcctccgagcaatgccaggcatattaatgctccgaccagctgatggaaccgagacttctgctgcttataggatcgcggttatcaacaggaagaggccctctatccttgcactgtctcggcagaagctcccgcagctggaaggtacatcggttgaaggcgttgctaagggaggatacgtcatttctgacaattcctctggcaacaaacctgacctcatcctcatcagcacaggctctgagctcgagatcgcagaaaaagcagccggtcagttgaggaaggaggggaaatctgtacgggttgtctcgcttgtttgctgggaattgtttgaggagcagcctgaagagtacaaggagagtgtcctaccaagcgaggttacttccaggattagcattgaagccggtgtcacactgggatgggagaagtatatcggccagaagggcaaagcaatcggcattgaccgcttcggttcaagtgcccctgctgggagaatatacaaggagcttggtttgacggtggagaatctcattgcaacagccaaatcactgtaaaaggatcattgcattgctcaacaaatgtatatgaaggttcgctcatatatcctcgtatatgctattttaataatcaataaagggcagtctcaaggttggtttgttacagctcggggagcttattgaggtgtaaataataacaatgtctgcctaataggtctaataattaagccagtttgtttttccaactcagctaagtaatagcatagttnctgggagtgcccgctgcaattcatatagaattactg

SEQ ID NO: 35146 - DNA, 1197 bp, Triticum aestivum
  unsure (1)..(1197): unsure at all n locations
  Clone ID: PAT_TA_35146
ccacgcgtccggccattcggtttgtttgtcggagtaaacaccatttccaaagtatcatattcggaggagttttagttagagatgagacaacagaaacatttgagtgggtgttcactgagtttatccggatgatgggtggcaaacatccgcaaaccatactaacagaccaatgcagggctatggaattagcaattgagaaggtgatgccaaacacaacgcatcgctggtgcaagtggcatatcttgaaaaaggcaaaagaatctattggagcccattacacgaagaggagcaagttccgaatggacttccacaagataatacaccacatgctgacagttgatgaatttgagacagcatggaatcaactgacagaaacacacggtttgcaaaggcacccttacttgactcagatatatgagacgagagaaaagtgggcaaagccatatttcaatggtaaattatgtgcaaagatgtcaagcacacaacgcagtgagagtgcaaaccatatgctcaaaacttatgttccagcaagctgccccatgcacatttttgttaggcaatatatgcgacttctttttgatagggaagcagctgagaactacgaggaaaggcgcactatgataaatgcaccagttatgagggtgaacacaccactcgagcagcatgccagcaatgtgtacacacgagccatgtttgagaaatttggtgaagtactatatgaatcagggcaatataaaatagaagaggtgagccggtggaaaacatatatagcgcgacgacaccacccagagaagcatgaaaaatggtngtagagttttctacaaangttgaagttgtncgatgacggcgcactgatagtgtgcgaatgtggtaatttcgaatacacgggattgctttgttgccatgcattaaaggtcctntgatgtccttggtggtggatcatataccagctaatcacattttgaaacgctggacgaaggacgcacgggacttgctgccagatcatctggcgcaccttcagaaagataagattaatgtcaattctataacattcaggcacttgaatttgtacacacatgccctcggaaagttgtccgtctttggtgatgccaacacatctnacatatgattgtgcaatggaaatactgaaaaaatcaatggatacactgacgccatgggcagcgtccgtgatggcat

SEQ ID NO: 35147 - DNA, 1264 bp, Triticum aestivum
  unsure (1)..(1264): unsure at all n locations
  Clone ID: PAT_TA_35147
gttctctgctcgcctcacctcagcccccaagaagctgagacgagctgcgcagccgccaaacagcaacgtcgcagccgacgagccccacccaccccaccaacccccgctccccgcccgccgtcgaccaggttggtgcctgcccgcccgccacttaacccgcccgccaccgccagccagtgagtagtactacttcaactttgacctggccggggttgaagaagctgtaccaggggaagggacggcgggtgcacccggcgccggcgccggcgccggggcaggacgcgtccgcggtggcgctcgccatgctgccggccaccctgctggcgctcgtggccgcgctcacggccgaggagcaggaggtgctggcctacctgctgtcgggcggggccggcggcgcggcggggggcgctggcgggggccggcgcaggcggctcaacgggccgcaccagccggagatgggctgcggctgcttcggctgctacaagagcttctgggcccgctgggacgcctcccccaaccgccacctcatccaccgcatcatcgacgccgtcgaggagggcaacggcggcggaggcgagggggcagccaaaggagctggaggaccaggcggcgccacgcgccggcggccaccgccgccgccgccgtggccgcggcgggccgtgcgccatcgacccccccgtcgaggagcacggagccgcggaggctcaggccgggtgcgcggatgaccacctgcaaccgcaaggctgctgcgcgtcggacggcggcgaggacggcgactacgagggcgacgaggacgacggcgcggacagcctctacggcggcgaggaggccctgacggacgacagcgactgcgcgggcgccagcaactccgccgagaagagcgccgtgggcaagctggtgcgcttcatcggcgagaaggtgtgggccgcctggacctgacctgaccggcatcctccgccgccgccgctagaacttgtcgtagattagggaggaaggagaccagcaagaaggtcangtgaaaccangtagtagtactaagcagttgggtcgttttgtccaagcaagcaagagccgccgctctatgccccttttgatttcttgcaactctgatgaacgagcaagcccccgaggctccggggtgggggattgtgaaggtccaatccgaccaaaatctccccacatccaggcctctcatgtaccatatttttgctcatttggttcaacaagaaacattccccatttcaccaaaaaaaaaaaaaaaaaa

SEQ ID NO: 35148 - DNA, 1100 bp, Triticum aestivum
  unsure (1)..(1100): unsure at all n locations
  Clone ID: PAT_TA_35148
ggctatgcaaatttgaagtgcttagcatttgaactactgacctgtctgactaatcttgtctgtttcctgtttattgacacaggaatatgggcaccaagcatcacactatcatggtaacatggagccttctgatagagcagctgttcagaggctatggagtatggataagataaacataatctgtgctacagttgcatttgggatgggtatcaataaacccgatgtccgttttgttattcatcattcccttcctaaatcaattgaagggtaccatcaggtaagaagtttgcacaggaaactgcatgatttaagctggttcatgaccgagttttcttttaggagtgtggacgtgctggtagagatggacagcgctcatcttgtgtactgtattataactattctgactatattcgtgtcaaacacatgattacacaaggatctgcagagcaaggaagatcaagctcttcgtcctcacatgggcaagcacttgtaacacacaaggagaatctcttgtgcatggttagttactgcgaaaatgatgtggattgcagacgtttactacaactgatccactttggagagacatttgatccatcacattgttcaaaaacatgtgataattgcaagaaaggattgagatggattgagaaagatgtgaccaatattgctaagcaattggttgagctggtcttgacgacaaggcagtcatgttcgagttctcatattcttgaagtttacaggggttccttaaaccaaaatgtcaagaagaaccgtcatgataatttgcctcttcatggggctgggaagaatctagctaaaggcgaggcagcaagagtactgcggcatctagtaactgagggaatacttaccgaggatgtcaaaaagagtgatacgtatggatcagtatcatctgttttaaaggcgaatcaggttaaagttggtggtcttcgctctggcaatcagatcgtccttaagtttcccactgctgacanagccccgaagatggngaaacttgatgaatcgtcaatctcacaagtcaataagactgttcaacggcagagtgaaatggacgagaatttttcatcgctgctctatgaaac

SEQ ID NO: 35149 - DNA, 806 bp, Triticum aestivum
  Clone ID: PAT_TA_35149
ggcctccccgccaccccgctccccggctgcctgccggtcgccctcgccccccgccccgggcccaccgtcctcggcctcgtctgcccctcccgcgacgcccccgccgtccagggactacatcccacgtggtcgacctcgccggcggccaccatcgcggcgctcgagaagctcttcgccaccccatgacatcggctgtgtggcgcccagcccgggggccggggcagcgggacgacggtgctggagatggtgagcgcgttcgagaaggcatacggcaagaaaatcccggtgaagatgtgccccaggaggccgggcgattcggagcaggtgtacgcgtccaccgccaaggccagaagaggagctcggctgggagggccaagtacgggatcgaggagatgtgcagggaccagtggaactgggccaagaagaacccgtatggctactgcggcgacgctgctgagaacaaagactgattcggtgggcccgtcgcgagccttgtaacgtgaaagaaagatgttgtcaataagcccagggcattaaagtgtgcccagaaaatgtttcctgttgtggtacaactattcgtaagatggaacttgagttgggtgggttagaactgaaaaagggccgggctgttccttggtgaagaattgggtccggtttcgaacatgggccgtcatctgcttccttttttttcaaatgatagagcgagaccgatgaggcaaatcattacaaaccttttactgcttggagcaatagtacttgcagggtgccttcggttacctgcatcgttttttgctcgtgccgaatcg

SEQ ID NO: 35150 - DNA, 962 bp, Triticum aestivum
  unsure (1)..(962): unsure at all n locations
  Clone ID: PAT_TA_35150
tgctttttttggttctaagcttcagaagaagatgcgggactctaatatttttgttgtgggatctggtgctcttggatgtgaattcttgaagaactttgctttaatgggggtttcttgtggccgtaaagggaagctaactataacagatgatgatgtcattgagaaaagcaacttgagccggcaattcctgtttcgtgactggagtattggatatgcgaactctaccggagccgctacagctgctagtgctatcaactccagcctccatattgatgctcttcagaatcgtgcctgtccagagactgaacatgttttcaatgatgcattctgggagggccttgatgctgtcatcaatgcacttgataatgtcaatgctaggatgtacatggacatgcgatgcctgtacttccagaaaccactcttggaatctggaacactgggtccgaaatgtaatacacagatggtgattcctcaccttactgaaaactatggagcttcacgtgatcctcctgagaaacaggcaccaatgtgcacagttcattcttttccacacaatattgaccattgtctaacatgggctcgctcagagtttgagggtctgctagagaaaactccaaatgaagtgaactcatttatgtctaatcctgctgaatatgctgctgctatgagaaaggcaggtgatgctcaagccagggaattgttggagcgtgtacgtgaatgccttgacaaggagcgatgtgataaatttgaagactgcatagcctgggcaagactgaagtttgaagattacttctctaatcgtgtgaagcagctaacgttcacatttcctgaagatgctgccactagcactggtgctcctttctggtcaggccctaagcgattacctcgcccggtgcaattctcagctgttgattcatctcacattcaatntatactggctgcttccatattgagagccgtgt

SEQ ID NO: 35151 - DNA, 2560 bp, Triticum aestivum
  Clone ID: PAT_TA_35151
cttgtctccttcccgagaagaacatattaggtgctcccaggcttggggatacttccttcagtccctgacccaccatctcttccttgtcctcatgtaggcatggcgtggagtccagcgatggtggtgtgtgtggttgctatttttttggttcttttcaccatgaatcaaacaaatcaacccagtaatggaacctattgagggaactaaatgattgaatcttcttttccatcagaacattgtgattgattcaatccccttccactttccccactgcggctcttgtcaagctgttgccaaggtctgcgggggcctctgctgaggtacatcgaggtttgcgtgatggcccgacaggtgcagcgacgaacgaggctttatcactatagtccaatgtgtgcgtgtgtgttggcgggggagggatagtaaggcagaggtaagaccattttggtcttctaggtaagatcaacgctttttgggtaagaagtcaaaattatgctataagaggggcagatccataaaggggagcgtccccctcctgcgccatcgtccccgcggcaccatggccacggcgacaccacagcaatgctgccttccggcccgcgcgcgccctcctcccacctccactcccctgcgcctacgctacctcagcagagcagcctcctccttccacttcccgggccgccgcacggtaacggcaagaaggagaggaagagccgccttagccttctcccccagatgcacgttggagacgggtggcccggcctttgatcctctagggctctacagggaggacccgtccagttctgattatcagtctcccttctcgacacttttcggcgtcctgtctccagtgttcgggagctccagtggatccaggaaagagaagtcatcctatggccgaggagcagcagctgcaatggaggacagtactattgactttggtgacttcttcaagggtcctctacccgggaagtttctgaagctccttgggtttttggcattgtctcgacttggtgtgtatatacctttgggtggagtgaaccaagcagcttttgctggtaatcttgaccagaacagtctgctgggcactttagattctttttctggtggaggtattggccggcttggtatatgctccctcggcattgttccgttcatcaatgcacagattgtgtttcagctccttactcagctttacccaaaattgcaagagcttcagaaaaaagaggggaggcacgtagaaaaaagattcttcagtacacaagatatgcatctgttggttttgcaattgcccaggctatcgggcaagttctttttcttcgtccttatgttaatgacttcagcacagcatgggtgctaacatctgtgactctattgacgcttggatcggtgttcacaactttccttggtgaaacaatatctgagttgaaactcgggaatggaacatctctccttatctttacaagtataatttcgtatttgcctgcatcatttggaaggacagttgcagagggatttcaagcaggcaattatgttggacttctcacaatcagactgtcattctttttcttggttcttgggattgtctatgtccaggaagctgagagaaaaataccactgaactatgcttctcgatacggcagtcgaactggaggaccccaacgttctgcatatctaccttttaaggtcaatagttccggtgtcatgcctatcatattctctacgtcttcgttggctttacctgctactttggcacgttcactggcttagattttctaaaaaggtgccatagcctaactccaggaggttctttttatcttccaactaatgtattgcttatagcctttttcaattactattacactttccttcaattggatcctgatgatcttagtgagcaattgaagcgaacaggtgcgtcaataccgcttgtgcggccaggaaaaaatacagctgcctttattaaaacagttcttagtcgtatctctgtcctaggatctgcctttctcgctgtactagctgctggaccatctgtggttgaacaaatctctcacttgacagcatttcggggattcgctggtacatcagtgcttatccttgttggatgtgcaaccgacacggctcggaaagttcagacagaaataatttctcagaaatataaggacatcgagttctatgatgtcaaaagttctgacaaatgattatcttccgaacatgtacttaaatataatctcgtataaatgattgttgtgtcatttggtagtaatttcattattcttttccttttttctcttctgtgtatatcagttagatctcttctagaggatcagagttcggaaagcatcagtatgtaaaagatactctatagctgtggaagctttacagctcatggatatttctgttgtggagtgatctgatgtgatctctgtacccggagaagggattttaaactttatctatattgcttcttaaaattttagaactaaaaaaaaaaaaaaaccagagggagaggtaccccctgggttttaaccaaagaagcagcaagaaacttggttgcaatatt

SEQ ID NO: 35152 - DNA, 646 bp, Triticum aestivum
  Clone ID: PAT_TA_35152
tgcgtttcagattgacgacggtttatacatggatggggttggcagtttcgagccacttaatttacgggtggcgattgctgtcaccgttgtttaataccaaatatattatccgtctagctagatttttatttgtgtttgtgtcacaggctgctaagaatgttctagctgctgtggcagcgacatcgtctgttcctgctttcagggcaccctactgcaaatacaccttctggatcagagtccacccgtctaggcgccgccatcatcctcgcaccgtcgcgcgctgcgccggagacacggacgaggtcgagcagtatgtgccttcgtcctcttccctcggagtgtgggaccgaggataaggacgaggagaagaaatatgtggcatcttcatcgttgtctcttggcgcgcggtgctggagagacagaaaaggaggtcgagagctggaagtgcggcatattgtagtgttttgtttgatggggaaatatctttgtatgccagcatattttgtagtggtttgtttgatgggaactacctttgtatgcctgcatattttgcttaggtattgatgattccatgctaaatttgtacaagattaaaaaaaaaattgtgagtgcaacaactatttgttagttgcaccaacttccctcc

SEQ ID NO: 35153 - DNA, 1208 bp, Triticum aestivum
  unsure (1)..(1208): unsure at all n locations
  Clone ID: PAT_TA_35153
tggaagccacctcgtccctcacgcgctccctctcccgcgtcccccgcccccgccgctcctcccgcgccgccaagtccccgcacctgcccaccctctccccggcgccccgcgtccgcccgctcccccccgccagctcggccgccgcccgccgcgggtccgtccccgccgcggcgccagcccccgccggctcggtccggccggctccgtcctcctccgctcgccccgcccacgcaccctcggggagagggacgacgcgccgaggcaggactgcttcgacggctcgggcgccggcaagggcaacaacagctccggccggggcgggggcagcggaggtgccggcggcaacggccagagcgccggcatgggggagcactaccgcaggctgctgaggctggagccggacaacccgctgctgctgcgcaactacggcaagtacctgcacgaggtggagcgcgatctggcgggcgccgaggagtactacggccgcgccctgctcgcctgccccggcgacgctgacctgctcagcctctacggccgcgtcctctgggaggccaaccaggacaaggaccgcgccgccggatacttcgagcgcgccgtccaggccgcgcccgacgactgctatgtgctgggatcgtacgcgagcttcctgtgggacgccgaggacgaggacgaggaaggagcgagcacggcggcggccagctctccggcgttggtgccggcctgctgaccctagccgttgatctcgagtggcgcggcggtggcggtctactgtacaatactgcaccgcactgtactgtgcgtagcagagccgggatggcggctggtcggtgacatcctcggccgtgtgaaatggcaggctgatcattccagggatagatagacgctgcatgccattgccggcaacaagttgaggaaggagacgacagatttgaatggatccggccgggtcacctcaggcgtcaatcaataataataactactactgctctactgaagttctttgttctgctctatcgacaatcgcctgctgctactacttaattaacctttcttgtactaatcactactccttcgccccgaaaaagcttatcccaagtttgtcccccaaatgaatgtacctagcacctattaagcgagcttgttacctcctgtacggcttggctgatgctgctgacttaatncatccctnaantggnaaaaaaaaaaaa

SEQ ID NO: 35154 - DNA, 1465 bp, Triticum aestivum
  unsure (1)..(1465): unsure at all n locations
  Clone ID: PAT_TA_35154
cagaggaggaggagcactgaggcttctagaaacttgaggcagggacgtccggcaggaggcggaggcaggaggcatgtgggggcggcactactggggcggccggcggccgagcgacggcgccgcgggtgcggaggccggcggcggcgtggtggtgatgttcgcgtggctgtcgagtcaggagcggcacgtgcgcgcgtacgtggacctgtacgcggcccttgggtgggcgtgcctcgtctgccactccgacttcatcaccctgtttatgccggagaaggctgctgtgcttgctgaccgggtgctcacggagctcgttaaggaactgaatattagaccagtacctgttgtgtttgcatccttttcgggaggaccaaaaggttgcacatacaaggttcttcagctgatcgagagaaggtgcaaagggcagctgaatttggatgactatcaacttgtacgggactgccggacgcgtgggatatatgactcgagtcctgtagattttgtgagtgatttaggcacccgctttctccttcacccaagtgtcctgaagatgcctgaacctccacgtgtcttatcatggatgactagaggcattgcctcgggtctagacactcttttcattggcaagtttgaagcacagcgcaaagaatattgggagacactatactcgtcagtgcatgttggcccaatactcatattctgttcagaggatgatgaacttgctccatgttcagtcgttcaaaattttggacggcgtctgctggagctgggtggtgatgtgaatttagttaaatggcacagttctccacatgtaggacattacaagcatcacactgaggaataccgagctgcagtgactgagctgctcatgaaggcttcagcgctttacacaagcagaaaacgactcaatgactacagtgtcggcacgagtgaggacagtgacacaccttattcgtctcgcaatctacataagactgctgtaagctccagtgataggctagggagggtttcagctgatccagccaatcatttcttcttaccgagttcccatggagtaccatgaaagcagcagtgaagtgctaaaacccgagttgttcaacatgccgagtgttgaaagcgcgaagaaccctgatggcgtgttggggacgatgctctatgatgcatgtgtcccaaagaacgtggaaggctgggacttcaagcttgcatcaatagatgggcagcgtatgcattttactgcccgtcagcatggtacttccaatccaacaaaatgtatacgccgctcaagnattgtaatgattttgactcaacatccaagtgcattccagcagactgctctatactgccagagtatacttgtttcaggagaatgttattgtgttgaccttttctggaaaggcatggcaaaaagaatgctttttaatggaaattttagttgccgcgaagatggcaaattccaaaaaaaaaa

SEQ ID NO: 35155 - DNA, 1325 bp, Triticum aestivum
  Clone ID: PAT_TA_35155
tcgccagccgttaccgagtctcagcttcccctgactcttgccgctcccgttgttcttcttcttctggcggtctctccctccgccacgggggtgccccatctccccggcctccaggaccgcctcccggtccgccgcgagaccgggtaccccagcgggcgcgaggagtcgggagcggagctcttctactacttcgtggagtcagagaggagccccgacacagacccggtgatcctgtggatgacgggtgggccctcccgctctggcctgcttttcctctgggttgctggtgggcccttctgctctggcatggttttcttcgaagttggtcctattaagtttgtgttggccccttataatggcagtttgccacggttgaccttgaagccattttcatggtccatgacagcatgcatcaacgtgttggactcgccagtttgtactggtttctcgtacgctcgtgatgtcaaaggctatcacgatattggggacttttcagttgctttaccggccgtcatcactcccaaccagtggctttccgtcctcccacgctatcaatcctgcccgaaatttgttgcagaaaatccctcagcaggtaacgtgtgaaaacttactgcgcaacacatttcgcaagggctatgtagtcggcaacccttatgatgacaatttcgagtaccatatgctcatggtgttgggattatatccgatcaactatatgaggctgcaattttgaatactagctagcttgctagaagctggccgccgttgctgtcaattactactacatcagagtcagattaagttaaagagtgaagttcagcttttattaatctctaattcgaagctagctgagcaaatcgtctgagtttgaaaatgtttatcaggttgttcgccttttaacggggctgtgaattttacaggatactccctccgcaaagatccctctgtaaagaaatactagtaggagcaattgagcagttgacctgatcaaactctccacaaactggatatgcaaaatgatctactagctgaatttggaaaatatgcgaacatcttggaatgctgaattccatggacttagtgcacaactaattgtacatcaggtagtatctactcatggagctgggctaaaattaaaaagagaagggaggaaaatggtgtaacaattagcgtaagggcccggtatcatttgcaaatctgataatgtggtgtcaaattacaggatgaaaaagcgtattcattatgcagaggccgatttatctcgcctgtccttcttactcttgggctaggccaagctaacaaagcacctagcaagacgcacaaatgcg

SEQ ID NO: 35156 - DNA, 1419 bp, Triticum aestivum
  Clone ID: PAT_TA_35156
cgcgtcgagaagagcgctcaaacattagagacacagttctctgggaatgctgaatctagggcggccggtatggttattaacacggcggggtgggttgaaggccttggaggcgaggataaatgatgtcagggaccttgttaatgcgattgacatcttcaaggctaatgtaaaactggtattggcacaggagaagctctggaagatgttaaaagatgcagtacaaatacatcccaatatcgatgtcgtaaaacttcataaatctgaggaccttgtcctaaggaatctaaaataattgagaaagactaggagctttcgtatcaaggagtacttttatgggattgcaaacgatctggcaccacattcaaatgtagtcaactttcgtgattttacagttttcagaattggtagtggacatcaagctccacggtcagctttaccaattggtgcagagcctgtggcagatcccactcggcttgttgctgtcaacatcagcactgatatggtccacacagtgcttgctgtttcttatgcgaaggaacctgatgaaataatttcgagcaacgacgccggattcattcatgtcacagatgttgacatctaaaggaagaagctgacgtacatcgcgccttgcccaggagacctgccaagcaggctgttaatcgcgagctccctgacatggtacgagcaggcttgacccggttcgaggttggacattgtaggtaggtaaccagatggctgatgacatgttgtaacgccgaaatggatactcttgtgcatttggtaactggaacactgctccgtagtcctcgaaacgctgaatgggttggacgatggctcagcctactcggcttgttgctgtcaacatcagcactgatatggtccacacagtgcttgctgtttcttatgcgaaggaacctgatgaaataatttcgagcaacgttgcaggattcatccatgtcacagatgttgacatccaaaggaagaagctgacgtacatcgcgccttgcccaggagacctgccaagcaggctgttaatcgctagctccctgacatggtacgagcaggcttgaccccgttcaaggttgaacattgtaggtaggtaaccagatggcttatgacatgttgtaacgccgaaatggatactctgtgaacactgtgccggtaaagctgaatgggttcgacgatatctcaggcatcctgctgcgaagctttctgctgacttgcttatgtttttctatgctgctgtggcggcgaagatacaaatagttaggtcaatgaaaggttggtgtgctcttttgtacgctgttgggaactactgtaagatatagaagatgagtcctttggcctcttctcaactgtatccagatataaacatcggagctactacctccgtttcttaaaaaaaaaaaaaaaaaaaaa

SEQ ID NO: 35157 - DNA, 938 bp, Triticum aestivum
  Clone ID: PAT_TA_35157
ccggctggcgctagggcggcgaccacatctctccaccgaaggcccgcgaggctgtgggctctcgcctccatctgccgctccggcggtggttggaggggggagccccggtcctctgccggcttgtagataggtgtaggggtaggtttccttggggcgctgcgatggtggtggaggcagcgtcgcgtcgggctgtgtatgctgcggctcgttccccactccggcgaagctctctatggtggagccggcgggctagcggccgcgtcttctcgttggtcaagtctgaccggcgagatctgagtgcaggggctgggtcggccaggcggcggcggcgacccagtcggtgctttttgtcctccaggtccgcctccgtcttggcggtgtttcctccagcgcagctcgagggcctgggaggttgtacaggagcgaatcggccggctgttgctgcctcttttggcagtgtcgacggcgaccttcagggcgcggtgtgtttggagcagggctcgtggaagagggagggcagatctggcgttcttctccgacttcgtgggatggagccggcggatctgcagtccgttgagcacggggatgctcccccgccgacgtgccccaaggtttcggtcccgtcgttctatggcgggtcacttaatcggctcacaaagctgctccagcgatggtgcttcggcggattcgggtttgttggcagcctgtcttcccatcctccggcagtgctttggcggcgacggcggatggagacgcgtgttgaagatgttgtgtgcaagggcctccaaggactgggttgtacttttgtattttggggggtcttttgtgcaaagttccaaggacacatgtgtttctgggtccttctagtgtgtgctgcgtgtgtgcgctgtaactgttttgagctatgaacacgtggttaccttcaaaaaaaaaaaaaa

SEQ ID NO: 35158 - DNA, 475 bp, Triticum aestivum
  Clone ID: PAT_TA_35158
actgccactgtccatggtgcaagcagcgacccaccaagcagtacggcgttccagcaacttcttgggaagcttctggaactgataagccactaacttctgtagtgttgaatgattaaatcgctacctttaacttgaaaaaaaatatagtcatgtacgccttttgaccttgtcaccctattctctttgtttttcaggatgagatacaacaagaaatcttagaaggtttggtagttgatgtcgtggatgaacaagaggcagatgaagcttgacgacgtaattagatgtgattgctagttgtatgtgttggttgtcgtgtggtgtgagatagtacatttgcacttgtgtatgttgtatgaaaaagcttgaaacatgttgatgttatgtacctgttggaaaaaaaatcatatagtggattttgaatgtgtggaaaatatacaacaaaaagtgtgctggatgttatgctcgtgccgaattc

SEQ ID NO: 35159 - DNA, 1490 bp, Triticum aestivum
  Clone ID: PAT_TA_35159
cgtccgcccacgcgtccggtcgaggaggcccgcgcgcgcgtcgccaggctcatcggcgccgaacccagggagatcttcttcacctcgggcgccaccgagtgcaacaacaggctcgtccggggcgtcatgcacttttaccgcgaccgccgccgccacgtcatcaccacccagaccgagcacaagtgcgtcctcgactcctgcaggtacctccagcaggaggggttcgaggtcacctacctccccgttcgccccgacggcctcattgacgtcgcgcagctcgccgatgccatccgccccgacaccgggctcgtctccgtcatggccgtcaacaacgagatcggcgttgtccagccgctcgaggagattggccgcatctgccgcgagaagggcgtgcccttccacacagacgcggcgcaggctctcgggaagatcccaattgatgtcaaccagatggggattggactcatgtcgctgtctgctcacaagatttatgggcccaagggtgtcggtgcgctctacctgcgccgccgccctcgcattcgcgtggagccacagatgagtgggggtggccaggaacgtggcatccgcagtggcacggtgcccacgccaattgttgttggatttggtgctgcctgcgaaattgcagccaaagagatggactacgacgagaggcgagttagtgctctgcagcagcgtctgcttgatggcatccgttccaaggttgatgatgttgtcatcaatggtagcatggagcaccggtacgcgggcaacctgaacttgtcatttgcatatgtcgagggcgagagcttgctgatggggctgaaggaggtggctgtgtcaagtggcagcgcatgcaccagtgctagtttggagccttcctatgtgctccgggcgcttggtgtggatgaggacatggcacacacctccattcgatttggcattggccgcttcaccaccgaggaagaggtggacagagcaactgagctcactgtccatcaggtgcttaagctccgggagatgagtccactctatgagatggctaaggcaggcatcgacatcaagagcatccagtggtcgcagcactgagactcttatcacaatgctgttcgctggactgctttagatgtgctcggatggacacatacataggcacgtttggtagttgaagatagtgttggcatcctaatcataatgatagatctgcgaagatgatcgatgagtattatgtaaggaggcatgtttggcagcactcaaaacaatctggcgagagttagatttgttctctagctggaatgtatcaaaacacgaaataatgatatttgctgttgtatcttttgaaggacagtttgaactagttacagcgctgtgtatgtattattgctgcagatatggttttggtattctctcagtttgttatgacaagagatatgtactctttggttctgatttattgttattctggtaacatctcaaaaaaaaaaaaaaaaaaa

SEQ ID NO: 35160 - DNA, 713 bp, Triticum aestivum
  unsure (1)..(713): unsure at all n locations
  Clone ID: PAT_TA_35160
ggaaaagcgctcacagaaacaggggtctgtggaagagcaatctgatggagggcaatcagaggaagagacactagagaacggcgatgtctttgagaaccttatgttgctcaaaatgatgaatttcatgggacgcgacaatgagatgcagctagtaagccttgtgttgaagaaggctactagtctcaagcaactgatactatttactcccaagattaatcacccagaagagctccacaaggatcatatgaatacttcccatttgcttgaaagaaaactattttctctcagaagggcctcgccaaatgctcagatagttctcagcgagcctgatgatagtgcagtccagccgctgcatgaggctttagtcaagatttactgatttttgttgttgtggagttatgatcggataatgtgaaatatcagaaactagcaaccattaggtaagacaaagaacaagctaatctgcaaggtaggcaggatgctgtgttctctagtccatgaaggatcatggagtatgttgtctgggccttatatccttagatccttaagactataaaaaataccatgattacccattatctagtccatgaaggatcgtggagtatgtcgtctgtgccttctattttgcggcttaactctttaagactcttataaaaattatcatattacccagtgtctacactaggcctgttgnccctgtngtgtacaagaaa

SEQ ID NO: 35161 - DNA, 763 bp, Triticum aestivum
  Clone ID: PAT_TA_35161
acagtgagaacgaagaaactcaagcttatgaggactctggtgaggaaatggattatgatcaagaacaacagaggtgaattttctgacacgtacacccacacataatacaataaacaggtcagatataacctcatgcctttgtcgactctggcggggaaccccactttgatctagcaccacccaggtatggcgctcagatcaaggggacgctcgatgaagctcatgtgccttttgtgactaaaaggtgtggagaagtcaaacgtccgagcaaacgtgcaaagcacaccaatccctatgacaatacagagatgaaggtcaacaggtctagcagatcggctcagggaagaagggtgggcagtggaggctccaaaggagggaaagggaagaagggcgctgaaaggcggaaaggaggcatgcgacggaaagctaggcagaaggccggcaaagccgaggaactggaaacatgactcctgctgaaatttccagctagccagcatgtcagatagctagctgttgttttttatacattgtactccctctggctctggaaagcccaataaattttctccgaaatcaaacggaggctaaagtttgtaataataatcgtcaacaactacgctactaaatagatctctatctctatgtaacatttacctttacctatttataatgtatatatatgtatagtaaactggtatttgcttctacaattccaattatatctaatgaaccgacccaaccaaactccccacctagacaatgt

SEQ ID NO: 35162 - DNA, 1476 bp, Triticum aestivum
  Clone ID: PAT_TA_35162
cggcaccaggcggcctccccctcctcgatgccgccccctcgtacggcttcttgggcgcgtcctccaccgcgcggcccccccctgcgagcggaaaaagtttgtcgttgctccctcacccgcccccgcgtcgctcccttggggcgactcgggcggcccccaaccctagcccgccgccggcctctcccctcctccctcccgaccttgccgccaccggagacagctgccggcaagcccgcgcggcgccgaggaaggtggcggcgaggcttgccgctcctgcctcgcgcggagggcatggtgtgccggggtggcggccccggtcaaggtgggcagcgttgttccctgcggcggacggcggctgcgggtgctcggctgggctcctcggcttgcttgggcggcgaggccccggtggatggagctcgcggtggccggatttcctccgtcggtcggcctccagatctgaatcggccagctccaaatccaccctcctcaccttctcccgttcgatctcagctccggtgcggccctgctcgccggatccggtggttgccggtgttttggcggtggggctcctgggaccgggggaaacccttggccgccgccggcggccacaaccacgacgatgccgcggcgtcgaactacttcttggaggcttcgttgaggtatcccaccccccacccatctgcccctgcatctaggtgaaaaccttggtcctatttcaggacgacggcgccgctacggcactgttccccttcctgaaggcgccgtccttgtactgcggggtggatgtcgagtttggatgtattggtggctgcagtggcggcattgctcttcatcaacctctcgccgtgtcgatttagttcgcgttcctatcttgcagtgcgcgtctccttcgtggctgtgccatggcaactgaagtttcttgtggagcacaatgtggtctgttgcagcccctcccatgatacatctggttgccatttgtgaattcgggttcttggggaaccacttcgcctgccgacgacgagaaggttgtggcctcctacggcaacgaagacggatttcattatgcccaggttgttcatcatgctggagtggacttgagccttctcctttcacattgttgctttccacaagtttgatgtttgtccggtgctgattgcttcggtggacgaagaccttgactgctcaagcttagttcttcagtttcatcttggtagctgcttgtgtagtctttggtttgtgcactgtcctgttttgcaccttgtatcggccgcctgaggttgttctgcctcagtgtcttccttttctttctttttcatgttgcatgtatgtggttgatcgatgtaatcctgaccggttgatggctttgttaattcaaagtcgggctaggttcgagcctcctcttgggctcggccgatgcctttcctctaaaaaaaatgctgttctgagcagaagtgcctaaaaaaaaaaaaaaaaaaa

SEQ ID NO: 35163 - DNA, 731 bp, Triticum aestivum
  unsure (1)..(731): unsure at all n locations
  Clone ID: PAT_TA_35163
gagtgcacctcctccactaaaagctgaaaggtcaccagcagagctccactagctccaagccaccgagagaaaatggccggcttctcgtacacgagcacgagccatgttgcagttgcactggtttcggtgctgctgctgagcctcgcgcacggctccctgggggctcatggagccaggaggctcatggagctgtacaagccggaccccagcgagctcctcacttaccacaacggcgccgtgctgcagggcgccatcccggtcaccgtgctctggtacggccgcttcacgcccgcgcagaaggccgtcgtctccgacttcctcctctcgctcaccgccgcctccccggcgccgaccccgtccgtctcgcagtggtggggcaccatcgcccagctctacctctccaaggccaagggcgccagcgccaacgccaagcgcgcgacgcaggtggcgctcgccgggcaggcctccgacgagcggtgctcgctcgggaagagcctcgcgctgccccagctcgcggcgctggcggccagggccaggccccggatgggcggcatcgcgctggtgctaccgcggaggacgtggccgtggagggcttctgccggagccggtgcggcctgcacggcttcgacgnccggggcccgcacggcgtacgttgtggggtcgggcaactccgccgcgcagtgccccggggcagtgcgcgtgggccgttccacaagcccggcgtacgggcc

SEQ ID NO: 35164 - DNA, 937 bp, Triticum aestivum
  Clone ID: PAT_TA_35164
ggccggcaccggcgcccggcgcgcccgcgccccccgcggcgcgctccgccgcccggcctggcgggtccccggccccgcgccctgcggcggccgcggcgccgccggggcgggccggccgcccgtcgaccgccggctcctcgggcccgccgcccgcggcgtcggcggccggctcgccctgtccgaccgcgtccggccctcccgccgcctcgccccgcgcgcccgtggttccctaggggttcttcgcagttgggcgccacttcggctgcttcggggcccgggtggcggccgccgctcctggcccgggccccgctgggggtggttggtgcgggcggcggcgatcatcgtcaggtgatgagccaggggtccgcgcaggtcgatgggccggcgtggaggatcccctgcacggcggcttcggcgacaacggcacctgctgggagttcctggagcagttcgacagcatggatcagatgcaggccggcggcgggttctgcgacctgctctccatgaccgagttcttcggcctcaactagagcatcgccaagggataaggaggaattatagagtttcttgaaatttgttagacatttcgtcaggtttaaaggcgcgtttgtaatgctgcagtgtaaattatggccgtaatgtaatgtatgtatagagcaatcaatttgagagcatgtatacaggtgcatgtgcaatgttgtccgctttggttcggagagtagagcaccgacagtaagatggaaagggttcaggaagaatgcacatgttgttgatttgatatacccctgcggggggagggttaatattaggaggacgcccgataagtgccacacttgtgggcgttagggggactgcccacacattttgtgtggtgtataagaggaacaagcccacacacccacgtgtaggcaaaaaattctataacataaaacgctac

SEQ ID NO: 35165 - DNA, 1697 bp, Triticum aestivum
  Clone ID: PAT_TA_35165
accggtccggaatttccgggtcgacccacgcgtccgcaaaaaaccgcagcaaaggaagaacctgaaatcatcgagctcgccgcgacggatccgatgcatgccatggcggagccgggcggcgcgctcgacccccctcctcccccctctccggctgcgccgaccccgccggtccagtggcccaaggacggctcgctcgacccgcctccttccccctctccggtcgcgcagcccccgccggtcgagtggcccgaggacggcgtgctgacgcgggccgcgcgggccagcttcaccgcggcgctggactggtgctcgcggagcatcccgccggaccagctcccctcggtgctctccgcggatttcgtccggcggctcgtcgtcgccgcggccgtcatcctccaccgcgagcccaacatcgtccgcgtcgacccgcggcccgaccagtccgtcgtcgtcgtgggggacgtccacggccagctccacgatgtcatgttcctgctccgggacgccgggttcccctcagaggagcgaatctttgtctttaacggggattacgtggatcgcggcgcttggggcctcgagaccttgctcctcctcctggcttggaaggtattccttccaaattgtgtgtttcttctccgaggaaatcatgaatccaagtactgcacgtcagtatatggttttgaacaggaggtaatggttaaatataaaggtcaaggtgctcaagtttatcggaagtttttaagatgttttgaagatctccctctagcatcaataatagcaggatgtgtgtatactgctcatggagggatttttcgtggggcggttgtactaccgttgaaaaggtcgaaaagggcaaagaaaggtcacaaatataaggcgggtcctactgatgactctactactttgaagcttggatccctggacgaattgttaaaagcaaggagaactgttcttgacaccccgtatgagggttcaaacttgattcctggagatgtgctttggtctgatccttccttagataagggtctttccctgaataatgaaaggggcattggtttgctttggggtccagatatcactcaacagtttctatatacaaataatctgaagttaatcatcagatcacatgaaggcccagatgcaagagataagcggcatgatctattagcaatggacagtggatatacaatcgaccatcatgtcgcatgcggaaagttaataactctcttcagtgccccagactatccacaatttcaggcttcagtggaccgttacaacaattctggagcatatattgtcctcagtccccctgattttgctacccctgatttccatacttttcaagctgtaaagcctccggcctaaggcgcatccctactatgatttcgaagacgtaattgatcctgatgaagagttaaatctaggtgccatggacactggacgtccgagcatttgatcacaacctgtatggtattggtacttaacatgcgaattgtcaccgcgaaccggagaagtggtaacgactagttcttttggattggtactaacatggcagacttcgtaactaatatttggtcacgtccgccaagattaccagtgggtgggttggtttgacctgtcacaatcacacacgtgacctcgtcaccacatccggcatgttgttgtgcccgaatgaggcgtgccgccaaccagcagga

SEQ ID NO: 35166 - DNA, 972 bp, Triticum aestivum
  Clone ID: PAT_TA_35166
tagcgtggtcgcggccgaggtcctctttggggaaagacaccactaccacccatgtgtctcgtgttgcggctgttccttgcggcggcgctcgttctttggcgtcgacgatgaggggatggacggatctggtatggtgttcctgctagacgccgtcggcaggttagtccgcgcagatctatgaaaaagcttttgggatttcctgggcaaagttgcatcacacgcaggagaaccctaatgaactggtggcctttatgccggtgattgccgtggttttttcatattcccgctgagagaggagttcgctgacaaccttgagcagctagatctggttcccctcgttttcctttcagacaacgtactcggtcttgttgttcctgctgattgaaatactgggtttggtgtcactgaaaaggtcaaagaagatcgcacaggtagagcgcgggaaggtgtgcgccgtcgcgatgatgcatctccaatgagtttggctcagtcgatcgatagagtcaatccagaggcccctggctggactaaaagacgcatgtactcatggaattatatcagcgagaggaggtgcatcaaaaaatggtgtaggcggaagttccagtgaaccagaagatgaggaaaggaaagaacgtgtagacagcttagctgcagtagcacttgctgtagtcgaccaagccatagacaatccaaaactcttcaaaggtatattcgagcaagtgaggggtctcctatcaagacttggagtggaaggatacatctgatctggtgcagcacatggaggtcaaggacacgggagcatcaaccccacacgcacgggagatggtgaggatggcatcatttgggatgagctagagaacgaaagccaggaagctgcacaatggaagctgaacagcaaaacggttatgtgtcggttaattggcatattggatacagctatagtagttgatgatgaagatggcaacacggtga

SEQ ID NO: 35167 - DNA, 824 bp, Triticum aestivum
  unsure (1)..(824): unsure at all n locations
  Clone ID: PAT_TA_35167
cccaaatggcaccatcagggaacatcctaaatggaactgttttccgggagcctatcttgtgtaaaaatattccacggatacttactggttggaagaaacccatttgcataggaagacatgcatttggagaccagtatcgagctaccgatatgattattaatggtccaggaaagcttaagatggtttatgaaaatcagtgcctgatggagctgagccggtggagctaaatgtttatgatttcaaagggcctggagtcgcattagcaatgtataatgtggatgagtctattagggcatttgctgactcatcaatggcaatggccctgtccaagaaatggcctctttatctgagcaccaagaacacaatactaaaaaaatacgatggcaggtatctggaatgaccattatttacgatatatttttattgtgccagagtcattaagcacttctttgttgcaaggactaccaaccagtctcttcgatgctcttatatacactgtttcatgctgcactcttaagtcttaactgcgaatgtactagttatccagttgccatgggttttcattgttgtgctctggtgaggtcttattggtaggtgaagtgattattctaaaaaactggaagagtgataggctactctcttaacctgtatctttactactctcgttaaccttataatttccgttgaacgtgcagacttgtttatatatagtacaagtggnttgttttttgtttctctgatggcgtttcgaaggtataatcttgcagttaatcatattgtcatacagcagccccacttgacatgtacaaatttgaaatgtccat

SEQ ID NO: 35168 - DNA, 1792 bp, Triticum aestivum
  unsure (1)..(1792): unsure at all n locations
  Clone ID: PAT_TA_35168
cggtccggtccgatccgggtcgcccagcgtcgcgtctcctgcctaaggccctcgctccaaggcgctgctattcgtcggaagaaacgcattccactccaacaaggtccaactaattcagagagcaacgatgcccgtcggcggcaatgccacctccaatccaccaaagtggcgagcgagaggccaccgaagcagcataagatatctgttgggtttggtcagattgagatgagtgacttgagagttgtcctctatggcaaggatggggttgctgtgaagatgagtgtgcacaagaacatccttgctgaaaatagcaccttcttttctgataagctagcaaggcaatctccagtgtctagcatagaagtgcctgattgtgaagatgtggagatttatgttgagactgttggcttgatgtactgcaatgatgtcaagcagaggttgatcaagaaaagtgttccacgcgttcttcgaatcttgaaggttgcagaattattgggtttccgagcatgtgttctgtcatgcttgaattacttggaagcggtcccttgggccggggaagaagaggagaatgtggtctcatctgttcggcatcttcaaaccgagggggggggggtgaccccaatactgaagagggtatgctctgacctaacgagcccaccaaatgacacgtttgtgcgtatcatagaactagttttgaaaagcagtgatgacagagggaggcgcgagatgaagtccttggtgctcaagcttctcaaggagagcagcagcaggtgtgccagtagctctgctgacctatgtgttgagaccctctacagctattgccagaattgcctggagtctctgctgaccctgtttcaacaagcatctgacagtgatttctctgagcagtctttggagcttaaggaaccggttcttcggcagattactctcgaagcggataatctgttatggttaaccgagattttggctggcaggaatgctgcagaagaatttgcaggcttgtggtctaaccaacgtgagctggctgggcttcattccaagctaccgaccaagtcgcgccaccttgtgagctgcgtcactgccaggctctttgtggcgattgggaaaggcgaaatgctcccgtccaaggacaccaggcagctcctcctggatgtctggctgcagcctctcatggatgactacaactggctgcagcacggttgcaggtcgttcgaccggaccgtcgtcgaggaagggatcgggtcgaccatcctgacgctgccgctggaggatcagcagacgatactgctctcgtggctcgggagcttcctcaaggttgggaacagctgccccaacctgcagaaggcctttgaggtgtggtggaggaggacctttgtgcggccttacgtcgaacagcaggggagccggtcgcagtcgtgtcggagttgagatctccggtggcttgcgcagggaagctatcgcgcgccgtttcgtaagtagaacatcgctgaaaaagggtttagtcgtataagttgatttgtgtgaggcttgagaatatgtttgtgcgctgtgctttgtggtgcttcttcgggtcttcgctgatacgtcaagttctctgaattctggcttaccgaatgtcttgtctgatgtgctgcttatttaccacgagacatcagtttgttgcattgcgttttgttaccacagacattgtgcggtagtggtgacactgtattattgcggctcacctgtagaaactgcatgcttgtgatgcaattgtaaatattttgctgggatgtaggagtacgtacctgnn

SEQ ID NO: 35169 - DNA, 1067 bp, Triticum aestivum
  Clone ID: PAT_TA_35169
caggtcttcggcacaccgcagatgcatcctccgccccaaacgacggcgatagggatgccgacgccctaacccacgtctccttccacctcccccaactcgtcttctcgccggctactttggaggagcctccttttgcacgccaccgtggccgggctgcggcgaccaccagaggtccgccgccgccaggatctccctccttctccactacgaggcaccagcagaggggggcgactcctccttccatccctagtcgcggcctccaacctctaacgccgcttgaaaccctagcccgaatccggcagaggcagttgaaggaagggggcgggccatggacaagctgcaaggtgggggcctgaagccatggatggatgtgtttgggacggtgaggaggcacccaaccgagcggcaggcaaggatgaagtgaagttgagcggatcgtcgtcatatcccttctccgtctgctcgtgctacaagcaagcacagtaccatctcatctctcttgtgagccttgtttggaccagccctctggatgcatgctctgcatcttgcacatgtgctaaaaagggtgatcgacgcggcctacggcagcgtgtctcgttgattcgttcgtgcaacaagggaggggacccgcccttcttcatgtcttgtgcaactagggtgatcgacgcggactaccgctgcccggtgggcgtcgtgctcttcaaccactcggaggtggactttgccgtgaagtccggtgaccgcgtcgcacagatgatcgtccaggtgatcgtgacgccggaggccgccgaggtggaggacctcgatagcatcatttggggggagggaggattcgggtccactagcgtctgaactctgagccttggtaaatacatctagagaagttgtatgtttaggctgctggtggaacactaggaaaggtacctacctttggttgtgtgtgtttactattaaatggaatcacatgatctcttgtggttgagatgttcaatgttgcatccatgaacggtgcaagtgttaagatggtcatgtgaccttaatttattttgcattggacaaaaaaaaaa

SEQ ID NO: 35170 - DNA, 958 bp, Triticum aestivum
  Clone ID: PAT_TA_35170
tcgcctcgagccagaacccaaagaatggcgcagtgtctccggggcaagggcggcgccgccgccgtcggggaggcgctccgcaaggcggccccgtggcggcgggaggcctcggcgtcctaccaccacacgatccaggcggtgccgcgggagacggccggaccccgcgcggcggcgcgcgagcgtcgcaacggcaatgtcccggccgtgctgctcaccctggccggcgccggacccggagaaggggtcgcccaccggaagctcctcaccaccgacaagaagcagctcgcggagatgctgaagcagtcgccgtacttcctctccaccccggtccgcctccaggtccgcgccggcgagcggtccaccgccgtcgtgcactcgggcaccgtactcccaatcaaggtgcagacagatgaatccacagggaatatattgaacttggtgatggtggaagcagatgaaggaacaatgctgaaggtgaatttgcccgtagtgttcaaaggggaggatgtctgccctgggttaaagaaaggtggcttcttgcagaaaatcaggaccagcttggtgtatctctgcccggcggagcacatccctccaaaaatcgaggtggacctgacaaatgttgacattggggatagagtgttaatgcaggacatccctgtccatccatcgctcaagttactgagtaaaaacgagacgatgcccgtctgcaaggtcctgtcctccaagccagccgagtaggaaccccgtgcgaccacctagagctggagacacctgcctaccataggtggtacgtcggcctaagaatttaatccctctatgtgcttgcttttggtatctacttgctaggctccattttgctcatagtagattcaaacaagtttattgtgttcaagatacgcgcgatctggccggtaatctctacccataatctcttggtgttcttagctgatgaaataaa

SEQ ID NO: 35171 - DNA, 424 bp, Triticum aestivum
  Clone ID: PAT_TA_35171
gacttgcccgtcctcccgatcatcctgtttggatgttggttcgatggggtcttcttggtcttcggcgttttccaaagtatcattgtctcctgtgccggtattgctgtcctttccgcgacgcgatttagagcggcgccgattacatcgacgctttggtggtatctcacgaggtttgtcctcgtctggaccattctcatcatcgccgtcgcattctttaagtgtgcccaccatctacacatcgtatgatgaagtggccgtccagcgtccggtaaatggtgggttttgggcctgctcttctctggcatcgtcgtccataccatcgatgtcttcagaggcgtagtgaaacatgtcagttagatcctcgacagtgggtatgaagttggggcgggttggaagtaaaattccctattttcaacccctaatc

SEQ ID NO: 35172 - DNA, 914 bp, Triticum aestivum
  unsure (1)..(914): unsure at all n locations
  Clone ID: PAT_TA_35172
aggcagtcgaccgggcgcttggctcgacgacgagctaccgtgatgggtaccatgctgctctggctccccaacagtggtctacgaacgacttgcacagcgctatacgtatcgtagttagccttcacttttgagctactgttgctatgattcacgcatactacgatggaaacccagcgagtgtttaggatcccacacacgaacagctcttgacagactcctagcgcatctctgagttatctccagacgagtactgagcgcgctgttcatgaggatggcaagatccatgtaactcgtctctttcaacacctccacaattaaccttgggggaccaatcagcgacatttctgtgccagggctttattgcaccgacgatgaggctgccgaggataccgctatgataaaggctatcatatacatagaggacatgacaaacacggttgttagagacttgaaccttgcttcgtccaaacgacatcagctgccatgccgagcacttcctgcagcagttagaggagtcaaggaccaataaaaggatgcttgctagaggttggttcttgccgtcagatacatgcattactttcctgtgcacattagacatgtggttgccatggactactctgggagatcttccctgacacaatgggtagacacaagcancgcttgggcaggacatttnggaaaanagncgctctattaagatgggcctcccctaatnaacagctgtccatgcgtacaaggtccatgtnagcggccttgtaatanncgacaaggaagataatacccactgttagaggctaacgattaggctccnantgntccctatgaatccgcnttggaacaactcngtnatggcgccttggacgtgancactgcgtgacntgatcatgggttattcacnattaagttctccaaag

SEQ ID NO: 35173 - DNA, 1653 bp, Triticum aestivum
  unsure (1)..(1653): unsure at all n locations
  Clone ID: PAT_TA_35173
ccccggcccggcacagagatcacgtccatctgcccgccccgcacccccacctgaactccctcaaataacgagcacccagaccaactccatagccggggcctctccaatcaatgctgccggccagcgcgtagctcccgcccaccctcgccccgtccccgtctcttccgccaaggagcagccgccattgcctgggccttcggaggagaggaggagaggaagcaatgggcgcgacacgcgcggacgccgacgagaaggaacggacttcttttggggaaggcgtgatggcgacggacttcttctggtcgtacacggacgagccgcacgcgtcgcgccgccgggagatcctggccaagtacccgctgatcaatgagctcttgataccggaacttctcgctttcatcaagtggaccgcagttgtttccttccagctatggactgccacgctcctgcgcgacgcaggctggtcgaagatgctggtggttgcttacttcttcggctcctttctgactcacaatctcttcctcgcgatccatgagctcagtcacaacctcgcctttgagaccccatccctgacctgcccactgggcatcttcgcaaacctccccatcggcgtcccaatgtcggtgacattccagaaataccacctggagcaccaccggttccaaggcgtggacgggatcgacatggacatttccagccagacggaggcgcacgtcgttgggtccagcgtcagctcttctactacgcgctcaggccggcccttctgaaaccgacgcccccgggcctgtgggagttcaccaacctgacgatccaggtcgcgctcgacgcgggaatgttctacctgcacggcaggaagtcgctggcctacctcatcctgtctacgttcctcggtggcggcatgcacccgatggccggccacgccacatccgcccactacgtcgtcaggccggctcaggagaccaactgttaatacgggcgcaggaacctgatgcggtggcacgtccgctgccacagcgagcaccgcacctggcgcaggacccccagcaccacgacttccccagtatccccggtcgcaagctgcacaaggtgcaggcggaagcgccacagtactaggagagtctggattcacatgtgtcctggggcccggtgatatggatgtatcacccggaccaagccggacgcgcccaagaaagatgtgtaggaggaacctctccatgtaagattagtagaacgacacatagctgtttaagatgatgtttggaacacataggccactgtctcactgtactactgaagtgtgaactcgcaggtattttgcttgcgtgttcagggaacttgcactagtaccaacttgtggctgctcagggaaccggcccttgtaccaacttgttgcttcatatgaactctgctgtgtactttacgctggagcaaaattttcagattgtagnanggttttcgagagncananatttntaagtaaaaaannntttggaacatntgnnaacccagtgtttggccttttgttttnccggnccggggtttttttcttatacccaaannagggttcananntgtctcggncgggntccngttcncaaaaaaaaaaaaaanncncggggggcgggccaatcncccaantggcctttacccccc

SEQ ID NO: 35174 - DNA, 174 bp, Triticum aestivum
  Clone ID: PAT_TA_35174
tcccaggtccacagtacaagttaccagaaattgtaacaaaaatgttcggtggttgccaaatattacaagggtaattatggtgcagcaaacacaattttacaaaatacctaaatgacctaaactaactaaaacatgaaacggaaaacacaaatataaaggaacaaaaacgaataa

SEQ ID NO: 35175 - DNA, 1580 bp, Triticum aestivum
  unsure (1)..(1580): unsure at all n locations
  Clone ID: PAT_TA_35175
gcaggaattcggcacgagggaaagcccggcccgatcccccatggcctccggcgaaggcaccggagattcgaacgctgcgggggcagggatggaggtgccggaggtggagttgtgcctcgacctcacgagctgccagctgcacgatctgagtgaggtggagatcccgcccaccctggaggagctggaccttacggcgaaccgtctcaccgcagtcgacccccggatcggccacctccctcgcctccgcaaactctcgttccgccagaatctcctcgacgacgacgccgtcgcgcccctcttcacctgggatgccatcgctggcttacaggagatagtccttagagataacaagcttacaaagatccccgatgccagcatcttcaagggtcttctggtgtttgatgtttctttcaatgagttgtcgtccttaaatgggttatccaaggtttccagcacagtgaaagaactctacttttcgaagaatgaggttccaaagatggaagaacttgaacatttccatgcattagaattgcttgaacttggtagcaacagattaagggtgatggaaaatctggaaactttgacaaatctacaggagttatggctcggaagaaaccggatccggactatcaacttatgtgggttgaaatcaatcaaaaaaataagtctgcaaagcaacaggctaacttcaatgaatggcttacaagaatgtgttgcgttagaggaactgtatctcagccataatggaatccaaaagatggaaggcctttctatgttacagaaccttcgtgttttagatgtttcatctaacaaactaaccgctatcgaagatattgagccattaaccaggttagaggacttgtggttgaatgacaaccaaataccatcactgtctgggatagaatctgctttgtctggttcacgagagaaactgaccaccatatatcttgagagaaatccttgtgcaaaaactcccaactattcatccacattgaaggaaatatttccaaatcttgagcaaattgattcagatatgctagcgtgaaacaggttgactcactttctcagattgttgaagttagtcgaagtatgtgttgtgtttctacaggaggaaagcagtcatccagttcagaacagacaacataagctgtcggtcaagtagcgctgcagtttgtactggtgatctgaatggattattgccaactttacttgaaaggcccgtcctgaagttgggtcatttcctgccgagatctataaaaactgaacttatgcgataaagccatcctatggtccatgactccatgctcgtgccacattgcaagggatgatgcatttgttttcccttttcccttgagtgattttcagttattactgggctaaaattacccttttgtgggtgagacccaggccggacgcccattgctgaaaaaaaaggggggccgnaccaatcgcctanatgatntatancccccacggcgtcgttaaactctgncggaaaactgcgtaccactaacnctgagaaancccttccacgntaaacaaaggccncgttncttcaattgcaccnaggaaggaccccg

SEQ ID NO: 35176 - DNA, 746 bp, Triticum aestivum
  Clone ID: PAT_TA_35176
ggcacgaaaacgttatcctccctccctctcacgaaaaaggtgggcgcggcggcggcgacgacgataccgacgccggcggggagagggacagcgcaaccggaggagacggtagcggcgtccctcctccccctattcaacctgcggcacagcatccaaccacagcggcgtgagctcagcggcgacaaggagtggcgaccgcaacgaccccgtcgccggcgtgattctcccccgacgctggactgcgagcttcagctgcattgatcaatgggaatggagtatgcttcgtccacgacggcgtcttccatgttcctgcctttccttgcgatgtttggggccatctacctcctcggctacttcgtggtcttccggcgctggagcccgcagcagcggccggacgcgtcgagctgcctcacctcgctcttccacggcacgccggcgatgctgctggcgctgcgcgccgtgctgtccagcccgggggccggcgacctcgcggcgcccaacgcgcccgctgacgacctcgtccttgacttcagcacggcctacttcgccgttgacctcctccactacctcgtcttcctgccccatgaggtcctcttcgtggcgcaccacctcgccacgctctacgtcttcgccacctgccgcatggccgtgcatcgtggcgcctacgggctgctcgcgctggaggtgctcgccgaggccaccagcctcgcgcagaacctgtggacgctggccgacatgcgacgcgc

SEQ ID NO: 35177 - DNA, 824 bp, Triticum aestivum
  Clone ID: PAT_TA_35177
tgccactcttccccactccactccgagccctattctcccctccctgcgccgcctcctccacctccgccctgccgccgccccgtcgaccgccgctcgcgggggctctcctcttcctcagcctaggagccgtagctggttgcgctctctccacccgccgcgtccccttcctccgggcaataagttctgctggaatggactctacttccacgaccgtgccttccattgttgtctatgtgacagttccgaatcgggaagcagggaaaaagctatcaggcaagcattatcagtgagaaacttgctgcttgtgtgaacatagtgcctggaattgaatctgtttactggtgggagggaaaggtgcaaaccgatgctgaagagctgctcatcatcaagaccagagaatctcttctaaagcgccttgactgaacatgtgaaagctaaccattgagtacgatgttcctgaagtcatcgcgctgcccatcagtggaggtaacctcaagtacttggagtggctcaaggacagcaccaagggagaagtgatctggctagagctttccatggacctcatctgtgagtagagtacctagtggtgtgcattgtggagtgcctgttctggtttgagacgtcgagcttgtgcataaagactttagtagcctctctgcctcgatggcgttgccgtgaaaaatcggtcgcacctttgctgtctcttaggggcacttaaaagtcagaagcatgcatgtcgaagcctgtagcttatctcatcattcttttcatctaatctcttaaaaaaacaaaaaaaaaacatcattcttttcatctaatctctt

SEQ ID NO: 35178 - DNA, 812 bp, Triticum aestivum
  Clone ID: PAT_TA_35178
tcggcacgagggaagcatcatcagcggcagcagcgaaggcaaagcaaattgcacagaggcccaccgcggcggcgggatccaaagctgatgcacatgcgtttgtgtcagtaccattaatgaggtggggtgcttcgagaaggttccgaggagggagagggctgctggtgggggccgcgggcgccggaagcatgttggggagggacgagctgctgcggcggagcctcgtgacgctggcggcggccgtggtggtgaccggggtggccacggcgtccgtgcggaaggcgctggccacctacgtcttcggcatcctggccatcgccggcgtgctgctcccggactgggagttcttcgaccgcgacttctcccagtggctcacccccatgcccgcctcccgccgcacggccgccgccgccgccgccgagcgcgagcacgacatttggagatttaagccgtatccactcaggatggccgtgctcgcgacgatctacgggtttggactttacaagtggtggacgtacgtatctcactaacgagacaggcccaggacctcctcccctgtctcattctcatgatacgaaagatttcgagagtagtaccatcacatcgatcaaattgctttgccttgcttcatgatcagacaattagtacatcgtgggatcatacaagaacgtccggaggggaaatgaacgcccggccgcaagttcatctctgtagcttaatgggtttttgtaatgtgcaaatgtcattcttagatcaaaaggagcactgttacttcgtttttcttcttgttctcgtgccgaattcggcacgag

SEQ ID NO: 35179 - DNA, 1024 bp, Triticum aestivum
  Clone ID: PAT_TA_35179
catttcctaattttcccttctccacaaaaattgggtttgctggatagctctcatcagcttgctctcttgatccgctgtattgaggttgctcctcctcaccacaagccaccactggagctggtgctgccacagggtgaccatcgacggcggctggtttggcccctcgcccggaacctcttggatccagcttcagtatgagggagcttgagacattttcttccccaagcgtgcaaaccaaacgcatcaccgctatttctgcgcgaggcagctcaacacatcattcacatcctctactgcggcaacattcttcaattcgaactgcagaatggagctgtggcattaagacagaaacccactatcgaatttgagttggtacttacttgaggtggtctgattgctcgatggagccagctggtgtccgctggaggaagacaatgccaaagtgccacttgttggaggaagttgactttgaagtgtcgttcacgggaggaagatgatgtacaagatcgctgagtacgcgcttgaacgtggctgcctgtgctatttctgaagcatggtttcgatggtagccatccgcaggaccagatcgccgattactgctcgcactccgcggacaaagaaagaaagaagggaagaagacgaaggcatgtgcgcgtcgacgatctgctggagggcaaggccaaaggttgtggtggcggctagttgaaaggatgggatgggagccttgctgggaaggaaggaaacatcaagcgatgagggaagacctgatcgtgagttcattatttagactatttttttcctttgagtttttttttcaggatgagtattttttctttttgaaacgttttgctttgagtcttcaatatcatgggcctacacataatatatggcaaaggaaaataactaccagtaggatatgtaatggcaaaggtgggtaattaatttcccttagttagatcgaacgatgtaaattgttagtcgatcaaataaatggctagatgttcctaaaaaaaaaaaaaaaaaa

SEQ ID NO: 35180 - DNA, 686 bp, Triticum aestivum
  unsure (1)..(686): unsure at all n locations
  Clone ID: PAT_TA_35180
atacatggttcttaaagttctctgattgtttctataactcttttcttcattcttgatgttacctgtggaagaaaatgcatgttccatacatggtcttcaaagttttcttgttgttattattttcttcctttgttggtggcaaatatcttttcagtgtgtaatggtgatatgcttgagttgaagtttcagtgttttatgctgttgaaaagcaaaatgaggagattatatgatctgaaagtatctggtgttgatacaaccatacatggtcttcaaagttctctgattgtttattgtagcttgtacatacacatgttggtatttgtttcttactttttttgtgactatgtttgatgttgtatgatgattcctgtataaaaatagtgttttatgccattgagaagcaaaatgaggaggtcataaaatctgaagtatctaatgttgatacaaccatacatggtcttcaaagttctctgattgtttctcaagaattgtgctctttgtaataattatttgctgcactagccttttcaagtaaaatgtggtactttgatttgaatttgtagtcaaacaaatattagtgtatctcatggcactcttttacttggttnntttggtgctttgcataactaatggatttgggaagntatcagttattaagttatcacaagttaaaaaagcaaactaac

SEQ ID NO: 35181 - DNA, 590 bp, Triticum aestivum
  Clone ID: PAT_TA_35181
ccggcggctgggcgtgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccaggggagtgcctgcctctgatcctcatcctgaggaacagactggaaatatgctctcacctaccgtgaagtgcaatctatccttatgcagcgtcatattatggttgatggaaaggtccgcactgacaagacctaccctgctgggttcatggacatcatttccatccccaagactggtgaaaactacaggcttctgtttgacaccaagggcccttccgctttcactctgtcggcaagatctattctaagttgaagctctgcaaggtcaggcaaatccgatctgactcaaagggcatcccatacctcaacacctatgatggccgtaccatccgctacccagacccactcatcaacgccaatgacagcatcgagcttgacctggtgaccaac

SEQ ID NO: 35182 - DNA, 992 bp, Triticum aestivum
  Clone ID: PAT_TA_35182
attaagtggtaggaatcaacgagctggattactttctttataatatatataggtctggccctttcgaattcgaataaaacatcaacaatcggaacttaagttccggttgttgtttcttaaattttggttgttgtttcttaagtttcgattggaattgtacttttgcgttaattgaggaatatgtctattttttctgggtctagaacctgtaattattgaaattgactgggcttgaaattgcttttccgttctcatagttacgaaacggtaagaaagataaaatacgagcctgttttataagcaagagtaattaacccttgttgtttcaaaggttaacctatttatccgcctcgataatatttttccctggtcactaataaacctattaattaaactcatgtttctataatcaattcgatctcccgggccaatccgaggacgcctacgaaaaggttgtttagatttacgaaaaggttgcttgaatttacgaaaagtttgcttggatttacgaaagggttgcttggatttattaaaagtttgcttggatttactaaagggttgcttagatttaagaaaaggttgtttagatgtatacatgatttattccttatttaaaatttgaaaatttgaaaattcacttctttattttattaatttaggatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggagctttaatctagccgaaatttagctcaaaagaaaatttaatgtataacttttttttgggggccccaaaaataaaataaagggccggggttttaaaacggggggggggggaaaaccctggggttccccaaattaaatgctttggaaaaaatcccctttttccccgggggggaaaaa

SEQ ID NO: 35183 - DNA, 2148 bp, Triticum aestivum
  Clone ID: PAT_TA_35183
gacgagccagaggcggagctgcccaggcacaggcagcacagcagcagccggtggccaccccacagcagtaaacaaatccgctccgtcgtcgccacgcttcccttcgtcaacacccgcgacctcgccccgtcggtccgaccggacaccggaggctcccatccccaattcctcgccgcctccgccgcccctcctccgcgcgcttccatccaaatcccgcgcccgcgattcggccggccaggccaggcccccttcctgtttagttggctgaggcgcccctctcctgcgttcttgagcaattctttgaccggattcgatacggtctccgctctctcgcctccgccgtctttccgccgagcttcctccgccccggtcaaactttgcggccggccttttccagcgagttccgtcccgacctttcggctttcgtcacaggccccgccgcggtggagcacctcttctcccgcccccccttttgggtcctctccaccgcgtgccggatccgcccccccctccccgccgctccgcctttgcggcttcttgcctcacctctgctactccccgataggctctgcgacgcaccgcttccgcgcctccgatacgggagtcctgcttgttgaatcccttgttgttgggcttgcggggcagctcctcaagaattccaattttggctgcgtgcaaagatggcgtccagcgccggtgatctgcccgaggtgaaattcaagaggaccggtagcctggggagcagcgactacgtgcgagcagacaagatcgacctcaccagcctcgacatccagctagagcagcagctcaacaagaaatggggcaagaccaacatcaagtcccagggacccaaggcggactgggagattgaccttgctaagctggagatccggcatgtcatcgcccagggcacatatggaaccgtctaccgcggcacctatgatggccagcacgtcgcagtgaagctgttggattggggagaagatggttttgccacagaagccgaaactactgctttacgaacatcatttaagcaggaggttgctgtttggcataagctcagccatcctaacgttacaaggtttattggtgcgtctatggggaccaccgacctcaagataccagtcaatgacaacggtgcgcgtgccaacttgccagccagagcatgttgtgttgtggtagagtatctcgctggaggcactttgaagcagtacctgataaagaacagacggcggaagctcgcctacaaagttgtggttcagcttgcattggatctgtccagaggattgagctatctacactcgagaaagatagtacatcgcgacgtgaaaactgaaaatatgctgcttgacacacagcgtaaccttaagattgctgattttggcgttgcacgtgttgaggctcagaatccgaaggatatgactggtgcgacaggcacacttggttatatggccccagaggttcttgatggtaaaccatacaacaggaaatgtgatgtttacagttttggcatttgcttgtgggaaatctattgctgtgacatgccatacccagacctaagttttgccgatgtctcttctgctgtcgttcaccagaatttgcggccagacataccccgttgctgtccaagtgcgtttgcgaacattatgcgtaaatgctgggatggaaatcctgacaagcgccccgacatggacgaggtggtgcagcttatggaggccctcgacacaagcaaaggcggcggtatgataccagatggtcagtcgtccggatgcttatgtttcaccagggcccgtggcccgtagatactttgcacagcactctcctccctttgggctatgtgttgccactcgccgtgaccgggagctccacagctttgcttcccgctgtcgcttgcgcagatgctgcttgcagccccccgtcgccgcccggccgtctcgtgctgcggtgctgcgctccgtgcagccctcgcacgaccgctctggtcacccgctctcttccgtcgtgttcccgtccgttgttgtaatagtacgctgtattctactataactgaggtctccctctcattcttggagctgccgccgcctcctgcgtccatttggcggcggtacgtcttggataccgcgtcatgttttgaaacctttatcgctg

SEQ ID NO: 35184 - DNA, 771 bp, Triticum aestivum
  Clone ID: PAT_TA_35184
tctgctcgccggccaagcgtacagcggattggatccgcgcgctttgccgtcaacgaggcctctgcgtccgcgcgcgcccgacagttcgtccggtggggagggactcgccggccaccgcggctttaggggacggcggggacggccacacacgcgagcggcggcgcgaccctttcgaggtgacggaggcgtgcaagacacgacggccatgcgacgcacacgtccataagcaggaagaaaggggccggatcgattcatcccgcacggtggctcgagggacagcgtcgtcgcagcaccgacgtccgcgcgcggcgtcggccgtgcggaccccggagggtggggacatcgatgcggcgtcatatggcacagtggagctcatgatctccagtggcgaggatgagcagcaacagtggcaccgtgatgatgtagtagtggagaggcagcagctcatccaggagcttcgccggtggcagcgggaagccgccgacacagccttgcggtggccggcgatggaaacggccttcccattgcttcagcacacccctagatcggtagggtttgcgggaattaagggctggatatcatgtacctgaactcactcgtcataggtatccaggccctaccctttatatgtgtgatggcaacaggggaccaaaaccatctgtcggttagaggtgcccccaatcagggcgattctgttggggtcacagccacctacgttggttggtggcccatccccttaacgttactttttacctggtcagagccgagatc

SEQ ID NO: 35185 - DNA, 1499 bp, Triticum aestivum
  unsure (1)..(1499): unsure at all n locations
  Clone ID: PAT_TA_35185
tagaagttcaaggcattctggggataaatatcatagggatggtactgaccagcatgagtcgaagaaatcagaagagggcactcgagctaggaaatacaattcccttgatgatcccttgtcttcagataaaaagaaccttcataaagggaggtctcctggttcagactctgatggcttcaagcatgacactgaagttaggctgcgaaatgcttcattagaaggagctgatctggtcatccaggaagaccagcaatttcctgatgaaactggtacagataaatgctcagcagatgctctattgcctgcatcaaagcagagggccgaggaagatatgtgctctactgtgtccgacattaatgggcaacatggacttgaaggagatggcgctttagggggcaccgaagagtctgccatgtgatattaaccacagtgtttacctgccacatcgttcagttggctgattgcagaggctactcatacaatggatgcattgctgaactggtgtttgttatctcctctctgatttaggagttttatttgcaggatatgaagatcttttggagagcttcagtgccgaccagagtgttcatctgatctataaaaatgtattcctcgttaacttaatgaatcgacagtggcaactgggagtaaacttctaaatgtaacactggagattgtaaggtgatttagcacagtgaggtcaaaaccaaccatatatatttgtcgttgcaggcttgtgaagagtcggagctgattctgcggtgtgaattgaagattcaagggagtgcgcacttatccatactcaagggctcgcttgagaaggcagtgtctgactgatgtgaggcaattgttgataaagtcggaacatttactccagggtgttcccttgatagttccagagataagcagcatgccttcaaatattattattccttgtcttctttttgctcttgcacatgtttgttcgtttcggaagaagcacctgtcctctgcaaagagtaactttgctagttactgctcacctgctatgactggtgctgtggttggaaaaacatgtgcaggtttcttgaaagctggttgccgttggaacttggaacatgtttgggaggggacaggacatgctaactttaaaagctgctttgcgtgtagaagaggtaaggatttatgctgtggacttggttagggtgaacaccagaaatacttatccatgtccagaaaccaatcttgatagatatcgagatatgtttttgtgccatatagcctattccattgtccattggactggatttttttataggaactttgtacagtgttcaacaaattaaaatagtatgcaaccatgtcagtttcgtagttataaacttgatgccttttctaaaaaaaaaatttgcttgngttgaataggatggctacagtacaatggacatagcaggcttgntccagggatccggatctttataagtactgtacgtgctagatcatttttctagtctcgccct

SEQ ID NO: 35186 - DNA, 727 bp, Triticum aestivum
  unsure (1)..(727): unsure at all n locations
  Clone ID: PAT_TA_35186
agaaggtgctgnagacttgtgatgatcagcagagagagatgatccttaccaggatcaaagcccacctgaacactctcaagaagtacacctatgggaagcacatagtcgcgcgtgtagagaagctagttgctgctggagagaagcgccaggggcttcaaccagcatgcaccgccgcctgaaggcgggactatgcagttgtacagctaacagtggctaggtttgcgctcgcgtttccccccaacaaccgaaaaccctataagatcgactagtaatggtaccggcatgaataagatacaaatcttggttgcactggagagagtgtacattctgtagctgaggaggcaaagactaatctgagagactaagctgtaaagaggaggaagagggtggagtaagtttgaacatgttactctgctcactgtacaaatttagcactagagaagtgagagaaagctgttagctgtcgtaaaaatgtccgagttgagagccgctgcgactacttttttagttatcctgttgtgtgtctcgtgtcgatagaagcaaacaaaccatgatgatggcttgctgttgttgtaagataaaactcttttccgcagtttaagctgaagttattagtatcagctttgctgaactgttgaacagttagttgtattaatggagtgtgtcgtctgtaatctaatccaggatgatgatatgcatgagttagtttatgttctctgcaagtttt

SEQ ID NO: 35187 - DNA, 1244 bp, Triticum aestivum
  Clone ID: PAT_TA_35187
tggctagtggttcggcgacatcactgttcgcttctgggacctcagcacacagaccccattgtacacatgcaaaggccacaagaattgggttctctgcattgcatggtcacctgatgggaaacatcttgttagtggaagcaagtcaggagagcttatattatgggaccccaaaacaggcaatcaattgggcactcctcttacgggacatagaaagtggattactgctgtatcttgcgagcccgggcctctccgagccccttcccgccgttttgtaagtgcaagtaaagatggcgatgcacgaatctgggacattaccacgaagaagtgtgttatttccctttcaggtcacaccaatgctgtgacctgtgtcaagtggggtggagacggtttgatatatacaggttctgaagattgtttaatcaaagtatgggaaactactcaaggcaagttggtcaaaacactgcagggtcatgggcactgggtaaattcgcttgccttgagcacagaatatgttctccgcactggggcatatgaccataccggcaagacattttcaagtccagaggaaatgaaagaggcagctcttgcaagatatgagaagatgaggggtaatgctcctgagaggctggtctctggttcagatgattttaccatgtttctttgggaaccaacgattagcaaacagccgaaagctcgcatgactggtcatcagaaggtggtgaaccatgtctacttctcccctgacgggcagtggctggcgagtgcctcctttgacaaatcagtcaagctgtggaacggcatcacgggcaagtttgtcgcagctttccgagggcatgtcgcggatgtgtaccagatcagctggtccgccgacagtcggctcctactgagtggaagcaaggattcgaccctaaaggtgtgggatatcccgggcgcgcaagctgaagcaggacctgccagggcacgcggacgaggtgtacgccgtggattggagccccgacggcgagaaggttgtctcttggtggcaaagacagggtcctaaagttgtggatgaattaagcttgtactagtacgtatctgctacttgttgtctgttggggagcagagacttggtgtgttggcccagatgaactaagacaggcttgttgacaaatgtgatgttcaatgtattgagcatgtggatgagatgggggaggataagcacatcatcatgaatgttaattactctaaaaaaaaaaaaaaaaaaa

SEQ ID NO: 35188 - DNA, 595 bp, Triticum aestivum
  unsure (1)..(595): unsure at all n locations
  Clone ID: PAT_TA_35188
ccatggaggtcgtcaatttgatcgatgacggggaagaacccagatgagttcaccagggacgtgctcaacagctgcatcgccaagaaccagatcaccaagggcaagaccgatgctttcaagagtctgaggaagcatcttctagaggagcttgaagaagcttttcctgaagacatcgaagcatacaggcagatacgtgctacttctgccgctgaatcaaagcggttggctcagtcgcaaaatgttttgcctaatggagattccaatgtgaaacctgagcactgacataagggacccaagaagctctgcatctctcctatgcttacagtgtgaggaaggccctgggaacaagcaactgatatgggttataggagggatcagtagtacatctgtacattatctcacaaaataatatattcaacttcctatttgttgtagtcaattgccccgtgatgtaccagctactcagctagatttgccgtgtttttgtctgtctatgtagtcatcatcagccagaaatggtaattcgggtacctctttataaatgggttatgacgctacttgcaagcgaatagtaagttaatctannnnnaaanna

SEQ ID NO: 35189 - DNA, 1055 bp, Triticum aestivum
  Clone ID: PAT_TA_35189
ctccggccgctccccctcggcccgtccgctttcgacagggaccccgccccctcgaagctcttccttccttccgccgccgcaaccgccgccgtcgtagcggctgcggccgcttccggtaacggtgtacaagggggcgaccgtccggaggacccgtcgaagcagaacctggcgcaggtcacggcctcgatccagaggaccctgggcctgctccaccagctcaacctcaacgtctcctccttcagctccgcgtcccagctccccctcctccagcgcctgaacgcgctggtggcggagctcgacacgatgcagaagctcgccgaagggtgcaacatccaggtgcccatggaggtcgtcaatttgatcgatgacgggaagaaccccgatgagttcacccgggacgtgctcaacagctgcatcgccaagaaccagatcaccaagggcaagaccgatgctttcaagagtctgaggaagcatcttctagaggagcttgaagaagcttttcctgaagacattgaagcatacaggcagatacgtgctacttctgccgctgaatcaaagcggttggctcagtcgcaaaatgttttgcctaatggagattccaatgtgaaagctgagcactgacataaggacgcaagccgcaaagagcaagaagccctgtagctctcctatgcttacagtgtgaggaaggccctgggaacaaacaactgatactatatatccttgtacgcactggccttttataggagggatcaatagtacatctgtatattatgtcacaatactatattcaacttcccatttgttgtagtcaatgctactcagctagatttgccgtgtttttgtctatgtagccatcatcagccagagttggtaattagggtaccactttataaatgggttctggtgctacttgcagccacgtagtaagttaatctggtgatgagctcatcatcgtgtgttagtttgatagtaataatcattcctcatcatgggcctactggcaagtgctgtgtaatctattcaaatactaatcctgtgggctgtcgcccctagaa

SEQ ID NO: 35190 - DNA, 1014 bp, Triticum aestivum
  Clone ID: PAT_TA_35190
cccacgcgtccgggaaaataattgccttgcacgtgctctctttgttgaagaatatagactggcattggattggccaacgagacgtaagatttgcctgggaatagcaaggggtctggcatatctgcatgaggagtctgcaataaggattgtgcaccgagatatcaaggctagcaatatactgcttgacaaagatttggatgctaagatctcagattttggtctagcaaagcttaatgaagatggtcacacccacataagcacaaaagtagctggaacaattggatacatggctcctgagtatgcaatgcgtggttatttgacagacaaagctgatgtttacagttttggggttgttgctttggaaatcgtgagtggaaaaagcaacacaaactacaggccaaaggaagattttgtttatcttctcgattgggcttgtgttttacatgagagaggaactctcctggagctggtagatccagacttaggatccaattactcaacagaagaggcactcctcatgctgaatgtggctctcttatgcaccaacgcagcaccgacacttagaccaaagatgtccaacgcggtgagcctgctcgagggccatacccccctgcaacccttcctatcagaactcagccttgctgcaaacagcctgagctcaagtggtctacgcagaaacttctgggaaaatccaagtgagagccagagcataacggcacaagcatcatgtaacaacaccagtgactcgtcatctttagatgttgatggtagcttgagacattttgcgacttaaatgttagatgtatttcagatctgtacccctgcaggaaccactagggctaggccactatgtctattgtggcagtaaaatgtagctactaacataaaaacgcttaattctactaagaatgcaaagtactctctgcttcagaactgttgaaaggataggatttatttaagattctgacaaaacactatctataatctaaaaaaaaaaaaaaaaaaaaacctcgg

SEQ ID NO: 35191 - DNA, 607 bp, Triticum aestivum
  Clone ID: PAT_TA_35191
ccacgccgccgcgcccggcccagtctcccatcccgccaactgcccccgccccccaccccaagacgacaagatgtatcgacggagaaccatctgttttctcatcatcgtcctcctactcccgcccctgctagcttcctatccatgtgtggccgccgcacatggcccaccacatcatgcttcaggtgacgacgctggtgcgtgtggtcaaatgaatgggcttcattgtcaagggggaaaggtgtcagggatgggagttgcgaggcacttgggacagaggataccactgaaggaccctccctcgccaatccctaacgagaactcgggggtggtgattcccctgacgccgccgccaccgccaccgccgtcgatcaattaataggtgttgggagtctgggtacgagcatatgccatggtgacttccgtgcacctctggtctcttactaatgtgttacaagaataatcttgctgatgtgaaataagttgtcatgcttcaaagtcttaaaatttggacttatgaggtaaatggcggaaataatttttttttttggatgttgcgtggatatgcaccccagtccccagcataaggaacggctagctgccgtgtacc

SEQ ID NO: 35192 - DNA, 629 bp, Triticum aestivum
  unsure (1)..(629): unsure at all n locations
  Clone ID: PAT_TA_35192
ngaggntaancagcatttntaccgntnatggantantgctcatccacagggatcntttgtcatttgtaccaccttgggcatacatttacgttgatgtgaccgaatcctaaagatctgtgtcgagtacccttgtgtgttgtgctcagcaagatgtgtgatccagcaaaagttagtcaacagtactggtttcccatgatggagtttggcgcccacgcgtccgccgattttggtttgaagagtgtgacacccagacacatagtagggtttgtacaccgcactggcaaagaccggtgccaccatcggcaaagttgatccttcttgaagactaaaatgaacccggatttgagaacagcaaggttggtgtttcttgatgattccctgtttggagcttgatctttgggggcaatgtctcttgaacacaagattccggctaacgcgaagcatgcaattgttagacataggttccctttgatcactggactgtacgtaggatgttggtctcggttgtgttgtgtaaagtttttggaccgaagccagcatcatatggctgtgcatatgtacatgtgctcttgtattaccacgtgatatctacgaggacaaattctttttttaacagttttgtcaatgct

SEQ ID NO: 35193 - DNA, 566 bp, Triticum aestivum
  unsure (1)..(566): unsure at all n locations
  Clone ID: PAT_TA_35193
cccttcctcataccatttgtttcaggagacatgggtgtcttcatcaaggtgccagtcctatgcctgctgctgctgctcatgccactcctttcgatcatcccagttgcagggtctgatggtctacattgtgcggaacccagcatgacatatactggtccttgtgaggatcggccatgcgttgagcactgccgcaaggagtattacaccttcgggatgtgcatcagttatgcggggacgaaggacgtgaagcggtgcttctgctgtagctgaacaaacacaccttgaccaccaccagcagctgttgctgcagaaagtgatgtagtattctctgtggagggaaacaataataaggtgtttggttttacaaagaaaaagaaaaaaaacaaatgactaaaggccggtctgggctttgtatgaaatatatttcgaacaacaaatctccccagcggggggggggcccccgggtacccaaattccgccccctaataagtggangtcggtattaacgccgcggcctcanctgggccggtcgnttttacnaacnggtccntgaactgggggaaaan

SEQ ID NO: 35194 - DNA, 968 bp, Triticum aestivum
  unsure (1)..(968): unsure at all n locations
  Clone ID: PAT_TA_35194
gtcttgtaattctcccattgaacacaaaatgtgcttcctaccgtatgtttgctctccacatttgatccagagctagtgtcacatattcagtgatgtgtctgtacttgttggcaattataattttctttgtccaggtcaatggtagcgttatgcctgcttcggtcatttctgtttactgtgcatacctgtgttacactagtctgtcgagtgaaccatatgactatgcgtgcaacgggcttcacatgcactctaagcaggtctcaatgagcgcccttgtccttgggatgctcaccaccgtgctctctgtagtctactctgccgttcgcgctggatcttccactactttcctttcgccaccgtcgtctcctagatctggtgcgaggaaccctttgcttggtgactctaatgtggaggaggggaagggcaacagcgagggaagtgagccgcgccctgtgagctattcttacaccttcttccaccttatattcgccctcgcgagcatgtactcggccatgcttctgacgggctggacgagcgccacttcagagaggtcggagctgatggatgtcggatggacgaccgtctgggtgcgcatctgcaccgagtggtccaccgcagcgctgtacatctggacccttgttgctccgctgctttttcctgaccgggacttctcatgagcatgtttgtgtaccattctgagcatgtccgttgcagttcatacagagattggtgtgctttgaacgagctagcagaatagtatctatgtatatatgtccaacatgcttgttgccccggtgccctctaacgtggaggtccttggtggtatccgtgcaaccagtcctgtactagctttgcttggttgtacgttagactttgcagtgggccctggtccctggctcatccgtcatgatgtatgcaatggggatatcatctgaactagaagggttaggcgcgntttgccgcaccat

SEQ ID NO: 35195 - DNA, 1038 bp, Triticum aestivum
  unsure (1)..(1038): unsure at all n locations
  Clone ID: PAT_TA_35195
ctggcactcgccgctccagtcccccatcgtgaacgcggaggtcgaggccgccgtctcccatcatgcacggcgagagtccaagctccaaaaccaaaccagaaccggttgatccgtcagtagccgcggccgccggcgatggagaagggcaagggcctcgcccgccgctgggcagtggagctccacgacgcatcttcctcctcatcctcgcctgccttccccgatccccccggcttcaccagatctgccccggaagcggaggacgccgccagcgcgcggcagcgcaaggagaccgaagccgcctggaaggggcagaaagcctgggaggtggcgcaggcgcccttcaagaacctgatgatgatgggttttatgatgtggatggccgggagcacagtgcacctgttcagcattggcatcgtcttctctgctctctggcagcccttcaacgcactccgatctgtcgggaaagtttttgaaccatttaaggacccaagggtggatacacttgcacctaagttgctcttcactgctctcaacttggccgctatgggtttgggtgtttggaagctcaatacattgggtcttcttccaacaaatgcatcagactgggtatcttcactgtctcctgctcgggaggttgaatatgctggtggagggatccccttgatgtaatgccccttatgatcttcaattggtaaaactctttcgttttaatacttggaggatggtatctgtactaaagcgaaatttatcctgctgaagggagaaattttatgcgggtttgttgtattttttgtttcacatgtaccaaattcggattgatatctatagacaaatcacaggcttagctaaagatagcttgctcgttttttttatctcttctgcttaccatgtctgattaaatagagaagttgtcgctaactctcccattcaatgtagtggacgaactgcttttgttttgttcgataaatagctgtgagatttgttgttcggtttagctggttgaaattgacattngacttatggtttaaaaaaaaaaaa

SEQ ID NO: 35196 - DNA, 669 bp, Triticum aestivum
  Clone ID: PAT_TA_35196
cttggaccgtacagtcaaggtctggagcagcgactctgcaacatgccacgtcacattgggtgggcacccggatggtgtgctgtgtcttcaatacttctcagatgataatcagcagcttttgattgctggctcttcagacggtactgccaagatctgggacctagcgacagaaagttctgccggtatcacagaaggatatggaaaccagcttaatgctctatgtttgcacccggaactgccggtactgattgcaggcttacaggatgggaccatccaaatctggaagtccactagcactactacatataggattgagaacaccactggatttaacctcggtgcagttaaagctcttgtgtacataaagggattaagaaggactagctggatgtccgtgcgttgtcacggaatggcaaataatatacacacaaatagaactcctcagtagccatttgtatcttcttaactaacatccttgcaatcagatacttacatgcaagtggtgtaaatggtaagggataaatgtaggtcgcgcgcctctattttgtcctagcttgtttttttgtcaataaatagggtggaaccatcctagctccaatcacgtgttgtataaatttatgctgaaataaatatttatatccaagcacaaaacaatgcaaattgcagctg

SEQ ID NO: 35197 - DNA, 551 bp, Triticum aestivum
  unsure (1)..(551): unsure at all n locations
  Clone ID: PAT_TA_35197
ccttgggctcatggctccggagtgggtcacaggtttaccgataacagcgaaggttgatgtgtacaagctacggaatcgtgcttcttgaactagtgtcaggaacaagaattctcgactttgttgttaatttggaggaggatgtccatgtggtgctcaagaagttcattaagatgctttcttacaggttggaaggggatgaactgttgtggttaacggagtttgtagatgtcagactggacggcgatttcaactacctgcaagcgaaagagttgatcaggatagccgtttcatgcctggaggaggacagaaagaacaggccaacaatggaatcaatagttgagagcctcctttcagttgaagaagcttcagtttgaacctgaacatagttgtatccttgtgcataggtattccatattatgtagtaattgagtaatgatagtaatacatgtnactagttgttcatgtaatatattcagtcttttttgtttctgaaatcgcttaggccctcttaagtagttataagaacatattgtaaatctgacaatggtnaa

SEQ ID NO: 35198 - DNA, 359 bp, Triticum aestivum
  Clone ID: PAT_TA_35198
ttgtttgactgaggtgaagaaggggaagaaagctgtggacaagattggtggcggtggaactatgaaggcaagtggtggatcttcgagggatgattacgagggtggaggatctgggaggtctcgcattaacttcgaaagacgagggcgttgaggtatttgctgtgcacatttatcttctgcaattttcatgtcctcagtgcattttcaaatatcatcctgaaggatttctttggagaatatgatccttcttacacaaggaagcaaatatcatcctgaagtattactttggagaatatgaacttttttacaaaaggaagaacctgatggtttagttgctgggataaggctgcttggtctat

SEQ ID NO: 35199 - DNA, 850 bp, Triticum aestivum
  unsure (1)..(850): unsure at all n locations
  Clone ID: PAT_TA_35199
caatctttgattggagatgaggaacctactcctcaaacagtcgaagtcgttatgggacgacatttggaggtcccactgggagcaaatggatgtgcatatttccagtttgaagatctttgtgacagacctataggcgcagcagactatttcgggctatttaagaagtttcacacccttgcagttgaaggtgtccctaagtttggatatcataacagaacagcagcatatcggtttgtcacattggttgatgttatgtatgagaacaaggggaggctattatgcacagccgaggccgagccaatagagctattcgagaatgtcgtgacggtcgctgaagcacaaaaaagttcacctagatcttcacgctcgcagaaaagtgacgatcccgatctctgcgtggacaatgagctaggattcgccaaagatcgtacgattagcaggttgacagagctcaacagcagagagtacttggaggactttgaagcaaaatggcaacatcccctgcatgctgtagataatggcggcgatgtcgtacttgcataagtggcagggcttcatgtgcaaggaccgcattatagttttgttatataagtatctattatcccgcctggtttatatggaggaatgggagaaatgttgattttcctgtcagtgatgcatgtaatttcagtgtgtcatgatatgtaagcacttttgcatgtagctctgcaaaaatgtcacacttgtagagaatatgtgtcatgtcttactggaattctatcctatcctttatatgaaactggaaatcttcagataaaaaaaaaaaaaaaaaaggcccctannnnnnnnnnnnnnnnnnnnnnnnnnnnnn

SEQ ID NO: 35200 - DNA, 1494 bp, Triticum aestivum
  Clone ID: PAT_TA_35200
ccgaccgggaatcgacgctgcagaccgtccaggctgctggaacacataaaaagagtaagctctctagagacagggaccgtgacgtcggtgagaaggtggccctgggtatggcacacactggtgcgaagaccggggaggtcatgtatgaccagaggctctttaacctggacaagggaatggactctggttttgctgctgatgatcagtacaacgtgtattcgaagggcctcttcacagcacagtccagtatgtcctcactttacaggcccaagaaggatggtgattctgaagtgtatggtggtgataccgacgaacatttggacaaggttatgaagacagagaggttcaagcctgacaaggcatttaccggtgctccagagagggctggcaagagagacagacccgtggagtttgataagcaagaggaggccgatccatatggtcttgatcagttcttgactgaggtgaagaagggagagaaagctgtggacaagatggatggtgaaggaactatgaagggaagttgtgaatcttcaagggatgattgaaagggtggggcatctgggtgttttcgcattaactttgaatgatggaattgtagagttatcagcgctttatattatactaccgcaatgtatttctttgcagaagagtatcatttataccccggaatgtatgcggaggtatagaagaaaagtcttacttccggatattttctcttttattttcagggagtaatcatatgggggaattgatgtgtttagcttacttgttctgttgcaactggagtgttaagtggtgtacctacttattagaaccaagggtgcttgtatgctgtgtctcttcgtgacgggctccatgagctttgtgcgttgacgtatttgctgtgcacatttatgcttctgcaatttttcatgtcctcagtgcattttcaaatatcatcctaaggatttctttggagaatatgatccttcttacacaaggaagcaaatatcatcctgaagtattactttggagaatatgatctttcttacagaaggaagaacctgatggtttagttgctgtgatagggctgcttgttctatttcaaccattgtgttaaacggtgtacctacttattagatcctatgatgcttgtatgctgtgtagctttgtgacgggatccatgaactttgtcgttacacttgttacataggctcctctttgatatattagtaacaacgcatggttggcttgctcgcctgtcttctcaatcttacagaccttgctcctataacgcgagcataatgaccattttttatttaaccacatcacatatcaacatagatgcttaattaaaacacaaacacatatctagtcattgttttcatagttccaaccattgtgacctcttgcaaatatccatatcaaggatagccaccgccaccatatcctccaccgtaacctgcaccatacccgccaccgccaccgtatacctcggccgcgaccacgcta

SEQ ID NO: 35201 - DNA, 665 bp, Triticum aestivum
  Clone ID: PAT_TA_35201
caaaatagctggtgcttctcggattattggcattgacattgatgccaagaagtttgatgttgctaagaactttggagtcacagagtttgtgaacccaaaagaccatgacaaaccaatccagcaggtcctagttgaccttacagatggtggtgtggattacagttttgagtgcatcggaaatgtttctatcatgagggctgcactcgaatgctgccacaagggctggggtacctctgttgtcgttggtgtagctgcatctggccaggagattgccacacggccattccagcttgtcactggccgtgtctggaagggaacagcttttggtggcttcaagagtcggagccaggttccatggctcgtcgagaagtacatgaacaaggaaatcaaggtggacgagtacatcacccacaacatgaaccttaccgatatcaacaaggcgttcgacctgctgcacgaaggcggctgcctgcggtgcgtgctggccatggagcactgaggatcctgctatgtgtctcgccctgcctcgaagcggagcagtttgtgtcgtgtgaagttgtaatgcagatctatcctccgccctgggactatagaactcgtttggcctagaaactcttgaacacgaaccgctgctataataatatgttgtgttggatggttgcctc

SEQ ID NO: 35202 - DNA, 1472 bp, Triticum aestivum
  Clone ID: PAT_TA_35202
cctccgcaccgcttgccctcccgctccacttccccagcccccccccccatccccacctccctatcacaccccaccccaccccacccctcctcctctgcccatcccagcacagcggaagcgatcggcaatggcgtcctccacccagggccaggtcatcacctgcaaagcggcggtggcgtacgaggcgaacaagccgctggtggtcgaggacgtgcaggtggcgccgccgcaggccggcgaggtccgcatcaagatcctctccaccgcgctctgccacaccgactactacacctggagcggcaaggatcccgagggtctctttccttgcattctcggtcacgaggctgctggaattgttgagagtgtcggcgaaggggtgaccgacgtgcagcctggggaccatgtcatcccttgctaccaagcggaatgcagggactgcaagatgtgcaacagcgggaagaccaacctctgcggcaaagttcgcggcgccactggggtcggggtcatgatgagcgaccgcaagagccgcttctcggttaatgggaagcccatctaccatttcatggggacgtccacgttcagtcagtacactgttgtgcatgacgtcagtgttgccaagatcaacccacaggcgcccctggataaggtctgcctgctcggctgtggtgtttctactggccttggagcagtatggaatactgcaaaggttgaagcaggttccattgttgctgtttttgggcttggcacagtcggacttgcagttgctgagggggcaaaatcagctggtgcttctcggattattggcattgacattgataccaagaagtttgatgttgctaagaactttggagtcacagagtttgtgaacccaaaagaccatgacaaaccaatccagcaggtccttgttgaccttacagatggtggtgtggattacagttttgagtgcatcggaaatgtttctatcatgagggctgcactcgaatgctgccacaagggctggggtacctctgttgtcgttggcgtagctgcgtctggccaggagattgccacacggccattccagctagtcactggccgtgtctggaagggaacagctttcggcggcttcaagagccgaagccaggtcccgtggctcgtcgagaagtacatgaacaaggaaatcaaggtggacgagtacatcacccacaacatgaaccttaccgacatcaacaaggcgttcgacctgctgcacgaaggcggctgcctgcggtgcgtgctggccatggagcactgaggatcctgctatgtgaagccgagcagtttgcgtcgtgtgaaattgtaatgcagatctatcctccgccctgggactatagaactcgtttggccccgtttggcctagaaactcttgaacacgaaccgctgctataataatatgttgtgttggatgtgccgattggccctcccgctaggtgcttgccccggctccatcccat

SEQ ID NO: 35203 - DNA, 1077 bp, Triticum aestivum
  Clone ID: PAT_TA_35203
tcgcgccaatgcgcacgcgcacgcgcagctcgggctcgccgccgccggtcacccgccgccgacctgcgcgcgcgggctcaggtgccgctacgcgcacggcgtcttcgagttgtggctgcacccgtcccggttccgcacgcgcaagtgcgaggcaggcacgcgctgccaacgtcggatctgcttcttcgcgcacttcacccacgagctcaggggcgaggacccggtcgccgccttccctgccaccgcagtgccgccttcgaccttcgccatgctgcggacgccgccccgcatcttccaacgcactccatccactcctgtgacgcgtccgcaggttgtttcaactccacagctgttcgatgacctcaccctacaggccactccaaacaggcttcgcatgctgagcctatactctgccatcaccggggacgatgttttctcctcccccgtcgccaccgcctccgccgtcgccactgctgccaccaccatgccgaccctcagggcgcccttaccggcaaacgaggacgggcatgaggaggacactaaatccgtccactacgcggatgacgaagactccctgctgaacgactacccgcaccgagatctcatcatggactttatgcgctaggtatccgaggtatgacaatgaattaatctctagccggccggccaggtcgatcctggagctagtgtcaccgcacgcgtgacggctgcggcagcgcatgcatgcgtgcctgctgtgtctgcgcgtgcctgctgtatttattttaggttgcatgtcgcgcatgggcgccaagtggcggtggtcagtcctcaaaaacgtgcctatatgtgtatagcattcctggtcataaataagtgtcgtctctatggggagatatatatctgatggagatgtacaatgccattgttaattattatgttgttatgttgatgttttatcagtcgggtaaatgtgtaatgtttccttaagcgcatatatatggttttctgaactccatgtctccttggttcttttttattttgtttgatataagagaggtgtacttttttatctgcagcaagaatagtatgatgttc

SEQ ID NO: 35204 - DNA, 1263 bp, Triticum aestivum
  Clone ID: PAT_TA_35204
gtcgctctgaagctgttcaccgttgcccttggggtcacgattactaccgttgttgcccgcggggcgtttcagcttgcggaggggaacctccgcgtggtgccggcgcttgcgtttttcctcgggggtgttggcctcccggctccggcgccgttcaggccgctcgggccgggcccccccccgatggggttgcggctggtgtgtgtgcggctggcgtgtgtgtcggcaggcgcagggtgctgggacgccgggctgtcttacgaagaagctgtaagggccaagccggactttttcgaaggtttccttgcacttgcgcaccaacagtttgagcaagcaaagctgtcatggtattatgctatcggtaccaatgcggatctggacacatggccttcctctgaagtcttggagctcttcaatagagctgaagataacatggagaagggtacagaaatgtgggaggaagtggaagaacagcgcctgaagaaccgatccaaacctagccaggaaaatgctgtgctagagaagatgggcatggaggagtatatcaaagatgtatccactgatgacgctgctgaacgggcttccaatatgaggtcccagataaatattctgtggggtatgctgctttatgagcgttcagttgtggagtttaaattaggactgccagcgtgggaggattgtctgatggcagcaattgaaagttcaaacttgggggagcttcagctacaaacattgctgtgttggtgaaaaaccactgtgcaaatgaaactgcccaggatggtttgggcttcaacgttgatgaaattgtgcaagcctggaatgagatgtacgacattaaacggtggctgcttggtgttccatccttccgtctcgagccattgtttaggcggagaactccgcaactgcatatggcactggagcatatatagtatgtatgaagttgctccacacatattaaattctggggcactgttaccgacaccaatcttcttttttaggtcaactgctgattgggatacaatacatggatttgttcggttgcattttttatacatcgaaagagtctgcttcccggttgcgaagctattcattgcggaggggtggagcccacccgcgatttgcatacgttagttgttgttctttttgtctgtcttgttctttttcatgcacaggaagctgtgacttgttactgtattagaactgcatttgcccgtaagcttagtaatatatacatactattttgagggccaaaaaaaaaaaaaaaaa

SEQ ID NO: 35205 - DNA, 834 bp, Triticum aestivum
  Clone ID: PAT_TA_35205
gcggacgaggagaaggagggcgagcggtggcaccgcgccgatcgcgccgcggggaggttctggcgccggttccgcatgcccgccggcgccgacgttgaccgcgttaccgcgcgcctcgaggacggcgtgctcatcgtcacagtgcccaagattgccgagcaccaaaggcgagagccgcgcgtcatcaacatcgccggggaggacgccaacagcggcggcaagggcgcggacgcggaggtcaggccgtcgaaggccgagatgtgagctttcgtgtaggaaaccacgacgagagcgatgcgtcacgtttggatgtgttgttgtcggttcatgcttacctttgcgtgtgatgttgggtagtacccttgttgcccttgtcctggttgttgcccttgtcctggttgttgcgcttgtcctgtctgctgcggagaagttgggcagtccccttgttgcccttgtcctaattctccttttttacttctttgaaacccaaaaaaaaaaaaaaaaaaaaaaaaggacaagatcatctgccatgccaggcatcttcattgttctgcccatccatctggcttccgccagcactcgcgccataaggcggtccgggctatcatctactatatcatcctcccgcacctgcagcggcatcaccatcctctacagcagcctcagattatcatactgtctcagcatcaacaaccccaacaactgggccaactgtgtctcccacccacctcagtcgcctgcggcgaacaactccctcttcgccctctgcagcaacaatggacacatccgacctttttgcccccacccccaattgctcaccttgaggggctgact

SEQ ID NO: 35206 - DNA, 1418 bp, Triticum aestivum
  Clone ID: PAT_TA_35206
cgatagctcaccgctggaggtccaaattaggacccagcgaatgcatgagtatgcagagtatggactggctgcgcattggttgtacaaggagagcagtgttaacacgggaagtggcatgggtaacaagataaaacaaagtacgtcgtatgcatcaagttcttcagaagatgaaataacagacggggtgccctcaaagtatatttctatgaaagtggggcatccggtcctcagaattgatggtaatcacttactggcagctgtcattgtcagcatagagaaagggggtaaagaattgcttgttgctgtacgttttacccttgaagcttctgaagatgtagctgagcggcgatcttcctttcagttgaagcgttgggaggcttatgctaggcttcataagaaggtaactgagaaatggtggtgtgcaccaggacatggtgactggtcaacaaatctggagaagtacacactatgccgggatggtatataccataagcaagaccaatttgggagacttttgccaacatttattcaaataattgatttgacggaagaggaagaggaggagtactggatggttgtatctgcagtatttgaaggcaaagaaacctccaccctgacatctgaatcgagcaacggtgatagatcaacttccgaccttccaatctctactcccttgagtgatcccatcaacaacaaggttcatttgctcaggacaatgcttcaatgggaggagcaagtacggcgtcgagcatcggtagcggagagaagtctcggctcgctgaccgatccaattcttcgtgaggtagccatcatctgctggccgtatgggaagataatgaggatgagtactggcagcacagccgctgatgctggtagaagaatgggcgtggatgggaagctgctttgggtgaatggccaacttgtgctgcctcaaaccgagctcaaggatggagatatagtggaagtgaggacgtagtagttctcagggtaattgatcagattggctcattgatgcatacaggggatgatgcaaaatgcaaaagaatgttagacgtagacaaagccaaaacctcggaagtgtacagtccatgtgtggaaatggaaaataatcgaaggaagcaggcagggagtaacaaggtgttgtattctgtacatatgcgaccaggtaccaactgtacgtgtccttgttcatagtagtggtgtactaatttcagcatgtaaaaaaaactgcacctttcttatggatcacctgtgctccactggtgacccacgctctcctgcccgtctcgctatggcatgctcatttcagttctcgtagtcgtcgctaggtagtctatgaatatgaatgtaatttttattatttttgatgtttgttgtactgccatgattggagataaatatatcggaagcccccccct

SEQ ID NO: 35207 - DNA, 1071 bp, Triticum aestivum
  Clone ID: PAT_TA_35207
gctttccaaagaggacaggtatgtttggcatacactatattggcgtaatggcacaaggaagaactcgaaagaagctttggatgtaatgatgaactataaccccactcgggaagtagttaaagctttactggacaagcacaatgaggaccatcttttggaggatcttgcatatgaaatcaagaaagttgtgagttacaaagctcacttcccaagaaaaggttctcagcatgaatgcaggtccttctcacatttaaatgtgcttgtagaaagaggacctaatgccatcgaagatcgcatgaggattgaaatgacctgcacaacagatggtgaatttgaggaatacacgcttagttgcatttgtgtggtttcatccgaagatgatggtgagtgctgtgaatgcggtgatgatgtgaagcatcccactggtgcggagtacaaaaagtgtgaagccaagccccatgttcggtgcaggaagcctatatcagaagaagaatttaatgagtttattgttgtgcgcgatgaagattggctggagacggaagaggctgcggtgaggtggcaattcaggatgcgcaacgcagcagatggccatggagcgaggggcaaatacatcgtaccggccaaacgtgtgcaggcatagatgtagagtcgatggggcctagtgcttgctttgctgtatgccattcttgtgctgcgttcgtttttggtacctgtgatgctgagtcagtactatgtgtcttgagtgtttggcttgctgatgtagaagcctcgtctgggtcgaggataagctggtgtgaagatcctgtgcagaacccgtgtttatggtgtaggtgaacccaagttttgcgggagtaagctggcaaaacgaaagtgaccatgtgctttgttggtgattttgtttggtaaagcaatgtgctcttgcagtggatggtacctacttacaggtagcttttcatgcctgagtctcaagacctgttttgttgtcacagtgaagtaatcacggaaatgattgagaaatgagagtacatccgtgacgagagaacttttgtcaaaaaaaaaaaaaaaaaaaaa

SEQ ID NO: 35208 - DNA, 1178 bp, Triticum aestivum
  unsure (1)..(1178): unsure at all n locations
  Clone ID: PAT_TA_35208
tggataagatatttccaattctggcaatccacttggaaagcctaggaatgatgtactaagcggtgtggcaaaagtacaggcacatagatatgtcttgttcaattgctctgatgtgaattcataccttagggctcatgctgatgagatcactaatggacgcaatttaaaccctgatgttgtcgagaggattcaaaatgataagttccacgaatggttccaagctcatataaagaaattggagaaggaaaatggcatccacaacattgaaaaggatattagattgctcgcccggggcccagttaatgcagccaaaacatattgcgctttcaactcccgaggctaccattttaggcctaaacgcttggataaagagacacaaaatagtggagtcatggtaactgcaaaaacttctagttatgcttcagcacatgatgccaatcctgttttacgtgatgtgacgtactacgggagggtaattgatattgtcgagctaaactactctggacagttttcaagtggtgttgtttaaatgtgaatgggnttaatgtgttctcagaaacaggaatgaaaaaggacaggtatggttacacacttgtcaacttctcacatctaatacacaaaggagaaaagattgagcatgagccttttattttccctaaccaggcgaatcaagtgttctatgtggaagatgaattgaatccaggttggtctgtggtaatgaagttgccaaagcctagagatttatatgacttaggcaacttggaatgggaagcgcagacagaaaatgagccattccatgtttcacagcttggagagagtttgaaaataaagaacaatgaagaacattcgggcggcccccccggcggggggacaatagtggatgctaataatgcttcgagcaacgaagaatagctgaggttcagactgcaatgctacatggaggcatggagggggtggtcagctgtgtgctttgtgttagtcctaaatagcctactcccttccgcttgctggctttctgctgactacttgaccaacttgcttggtgatatactgttgtgtgagaccatgtgttggtcaaaacatagtatactcttatattcatgcttggtaattcggtcagctgcgacaccacatgcttgtttggaacatcattttgtacctcggccgcgaccacgcta

SEQ ID NO: 35209 - DNA, 1897 bp, Triticum aestivum
  Clone ID: PAT_TA_35209
gtcccatgtgactccagtatcttctgtggattgccccagcggcctgctatttgttgcagagaactgtttacatttggttgaaatggttcatggcaaaagattaaatgcacaaaagttttcagttggagggactccaaggaaagtgctataccacagcgatagtagaacactgttggttatgagaactggtttaactggtgcatcatgttcttcagatattgtccaaatagatcctaataatgggatcttgctttcccgattcaagtgtgaacttggtgaaactgcaaaatgcatccagattgcgaaaataggaagtgagcaagtgttaattgttgggacaagtaaatctactgaccggccaatgatgccaaatggcgaagcagaaagtatcaaaggacgcctaattgttctaagtttggatactcttggaagtcctcatgagtgcagttcatttattccgacttctaatttgagttcctcttctcatacgggctcattccctgaaattgttggatatgcaaatgaagatttctctagcaacagcatgtgcagcagtcctgatgatatttgctacaatcagattcaatttgaacaaatagcaggacacctgagatcactgactcatgttaccttcactggtgcagttcttgctgtatatccatatctagatcgatatgtgttggcagcagctggtaatacgctttctgtatttggttttgtgaatgaaaatcctcatcgtatgaagaagtatgccgtgagtagaacacgatttactattacttgtttgaagacatatgcatcacagattgcagcgggcgattgtcgtgatggtgttctcttctattcttatcacgagaatcttaggaagttggaacttatttatgctgatcctgctcaacgattggtgggtgatgttgtcctcttagactgtgaaactgctgttgtgtcagatcgtcgtggtagcatatctgtattatcctgccctggactggaagtttctgaaagtccagaaaagaacttagctgtacaatgttcattttttatgggcgaaatagctatgagcatccagaaggctgcatttaagtatcggctccctattggtgatgagacagacccagtgttggaatcagcttataactgcgttgtggcgagtactttgctggggagtgtttttgttatgattcctctcaccagtgaggagcatcaactgttgcaagatgtccaagaaagactttcacttcacccgttgactgctccaatcttgggaaatgaccatgcagagtttcgtcgacgtggtatcccgtcgggagtgccttcaattctggatggtgacatgctggtgcaattcttagagctcaccagtgagcaacagcaaactgttcttgatgatgggtcttcagtaaaggcaccacgcaggtctatctccgttttccaggtcatgcgaatgttggagcgggtccactatgcgctgaactgaggttttctgcaaccaacttggttcactcataccgctggacataccgttttccattctgctgacaaatcgacaagtgcgttggtactgcagataataccctgccgtgacctgcagaaaataccgccggaccaaggtagtacacatttggtgctgaggtgatgttaagcgtgtaacagtcaataccctgccgtgacctgcgtctccctatttataatactgtatagacgttgtaaagtaccgaagtcttttggtacataaaatttgacaacagaacatcctcagaattgaagaacgttgagacatcctgaagaaaagccggacgaagcgagtactatatagacgttgtaaagtaccgaagtctttttgtacataaaattggccaaaggacctccctcagaattaaaaaaaaaaaaaaaaaaa

SEQ ID NO: 35210 - DNA, 348 bp, Triticum aestivum
  Clone ID: PAT_TA_35210
actcgcgggctgacgagaccactatcaagaggcctttgagttgtccatcacgatgcggggcaaagtggtttgccccaagaaggtatattcatctgcgattatccgacatgatgcgagacaaagtgatttgccaccttgaaatgctttattagaaaaagcttatctttaatttaataataataaaggtattatccagacttttattaacgtcctgaaaacgcgcgtctagtctatctaaggcaagcaaagaatttaatcccgagaagacttttgaaattttggttcgcgtccttcaatcgcgcccctcttgttcaaaaatttcggccccaaaaaaaaaaaagaagaagc

SEQ ID NO: 35211 - DNA, 684 bp, Triticum aestivum
  Clone ID: PAT_TA_35211
ggagatgccgggagggagcggcggggccggcgcgctggccaggcaggggtcgatctactcgctgacgttcgacgagttccagagcgcgctcggcggcgccggcaaggacttcgggtccatgaacatggacgagctgctccgcaacatctggacggccgaggagtccaacgccatcgcggccaccctgacgccggccaccacggccgccccggcgtccaatgtcgacgccctgccccagccgccgccgcagccgctgcagccgcagcagcaggccatcctgcgccagggctccatgacgctgccccgcacgctcagccagatgacggtcgacgaggtctggcgcgacatcatgggcttctgcgacgaggagccgccggcgccccccgcgccggcgccggcgcaggcgcaggctcaggctcaggcggaggcccaggcgcagcggcagcagaccctggggcggatgacgctggaggagttcctggtgcgcgccggcgtggtgcgggaggacatggggggccagaccgtcgtggtgccggcgcgggcgcaggctctgttcccccagggcaatgtggtcgcgccgaccatgcaggtggcgaacggggtggtgcaccgagtcctcgggcaggggcctggcgtggcgatgaccgtggcggcgccgacgagccgggcgtgctgaacggttcg

SEQ ID NO: 35212 - DNA, 625 bp, Triticum aestivum
  Clone ID: PAT_TA_35212
gcctgcttacggtggaatagggggtactaactgacccaaggtctggattcaaaggaggattggctctacttgacttcagtgaacaggagaggaagagaagggacagggacggaaggaccttgacagcaggagttcactgccttgtctcagcttcctcctagagtggaggtttggtcagaggggtttattcgattgatgcaggaagcaagtatttatggtcgagtgcaggtgacagaaggacagcagaaagcaagtatttatggtcgagtgcaggtaacagaaggacatcagagtgggggcttgaggtagcagaaggaaagcaggggtgagagaaggtaacagaaggaaagcaaatatacctccgtctggaattagttgacaactaattcggaaaggaaggaaactgtgctttattttggttgtggggtctgtgagagaaggtaacagaaggaaagccaatatacctccgtccggaattagttgacaactaattcggaaaagaaggaaactgtgctttattttggttgtgaaaactgtgctttattttgggctgtgggttgactgttggaactgcctttatcctctaattaattagaattattatgggggggagttggctatagcc

SEQ ID NO: 35213 - DNA, 1448 bp, Triticum aestivum
  Clone ID: PAT_TA_35213
cgcccggcgagcgggcggcggtcctccccggcccggcccgcaccccccccctcgtccccccccggttctccagggacctgatgagcaacggcaccgccggcacggccggcggcacggcggcgacctcgcctgagattgacgtccacggcttcgccttcaacagctccgtgctctgggaccccgagcgctggggccgctacccgacctccgagcccgacaagtcccaggactcgatgaggcttgagcagcaagtggtgtcggaggattatagcaaggtgaagggcattcctccagattgcctggagatcatggtgtggggcgtcgacacgccgccgccgccggccccgtcttcctcgcaacaaactccggggaataagaggaggtagatgggagagttgtagaagagatcgtcggatccaagagccgaacaagctgctgcctatactgtacatgcaagggtcgcaccagtaaggtgttgatgctcctactagctgcaaacataagaacttttttggttttcgttataggggacggatcggcaagtatcctcccgggcttgtacatcgtacttaccttttcttttctcttcaacaaactgtgatatatgcatactttcttttcttttcttttcttttcttttccttttttttttgtttcaagaggtttaggtgattacatgacacctcttgaactgtctctgaagaatgaaatgaacagaaggcagacataagcagacggcaccgccggcacgggcggcggcacggcgggcgacgtcgccccgagatcgacgtccacggcttctgccttcaacaagcttccgtgctcttgggaccccgagcgctggggccgctacccgacctccgagcccgacaagtcccaggactcgatgaggtttgtgcagcaagtggtgtcggaggattatagcaaggtgaagggcatccctccagattgtctggagatcatggtatggggcgtcgacacaacgccgccgacccccacttcctcgcaacaaactccggggaataagaggaggtagaagggagagttgttgaggagatcatcggatccaagagccggacaagctgctgcctatactgtacatgcaaggatcgcaccagtaaggtgttgatgctcctagtagctgcaaacataagaacttttttggttttcgttataggggacgggtcggcaagtatcctcccgggcaatatcgtcgtgttgtacatcgtactcaccttttcttttctcttcaacaaattgtgatatatgcatactttcttttctcttcttttctcttcttttcttttcacttattttcttttgtttttgtttcaagaggtttaggtgattacatgacaccccttgaactgtttttaaagaatgaatgaacaaaaggcaggtacaagctgaagatattcttttgctctttccaaaaaaaaaaaaaaaaa

SEQ ID NO: 35214 - DNA, 772 bp, Triticum aestivum
  Clone ID: PAT_TA_35214
cggacgcgtgggcgccggccacgattacgacgacttcgagttcgacgatgccggtggcaacgggttccgaacctccggcggcgcttcccagcaccagctggatactgagatgaatgacacttcagccttggagtacagacaagggaaggacatgcaagagataccctgggagaggttgaactacagcagggatcagtaccgtcagatgaggctaaaacagtacaagaactaccagagcctcgctaggccgcgagatgcactgcaaaaggaatgccaacgagcggagagaagagacgccttctacgattttcacttgaatacaagacatgtcaagccaacaatagtgcacttccaggtaccaatttttatggacatctctttccggcctcggcactcacatgtatatgactactgacacccgcatgaagttgttgcgagattgatttaacctattttatttatattttcaccacaaattatttatgtttgttcgcatggacaaacggacacttgattcagaaaattggcactccgtcattaacaagtaatatggatcagagggagtattagtactccctccgtcccaaaataagtgtctcaagcttaatacaactttgtactagagttagtacaaagttaagacatttattttaggggagagtatttgctaacttaccaccggttaccacactggtcataaattgtgacatcttatcatgcatgggcgcgtttccatgctcgccttttgtgtgttagctattgtacttgctga

SEQ ID NO: 35215 - DNA, 1140 bp, Triticum aestivum
  unsure (1)..(1140): unsure at all n locations
  Clone ID: PAT_TA_35215
cggggctaacatctattgcttttggcaatgtcatgttgaacaaaatagttgttcgtcaatttcttccatagctaaggatcggccgtaagttttgagtcaactgatggaacatatggcttaatatttttattcttgtttttgtttccgtacaaggttacatgcccattatgcattttttgctgttaggcaaactaaatttcagaatatttttctcggtatgatttatgtgacgctatctttgtttatatgttttcctcgtttcgagaattgagttaccgagccatatagtccagatttgatatactgcagcatggcttttcatcttggatgagtgcttctgaagattatattcagttacattgcctgatcttttgagttacacagaaattttcaaacaattcctaaaagtgtactttctggtacaatagttgatttgggcatgtttgaaaagtttacatagcaaaacatatttaactaagataatttatgaatgtacttattcgcctattacaacatcttgaaggacaagacataattcttctttgaaccttctggcctgattgtggggttggctatacccaattgaatgctagagaagaacctgttgagccaagctgcgacgcctcttcaacccccaaatctggtgcttacctataatagcatgtcacagctattgctattcttccagttttggcgtatgccagctacgtggtgctggcatgttgcgctgaagccagccagaggtgtgccatgacatttgcatcaactggcggctattttattggcaccagaagaggtagctgccgagtaatgatgttgtgcaatgctagattggacgctgaatgaggatctttaagttatcagaaacaaactagtttatcgttgacatgctacaccagtatgcgggtaataagcccacgtggagattttcaaggctttcattgatcgttcccnctaagatgtcttagatgatttagtgtgattntcaaactcnactgtaataatatttagagaggatagaagagatgtnttatatgccactttcgggatgttctcncgntgggcaactgcncattggagctcnctgggccccgctctgntctcanctgccaagtagacaaaatgtgtanctttatttcc

SEQ ID NO: 35216 - DNA, 1108 bp, Triticum aestivum
  Clone ID: PAT_TA_35216
gctgcccccctcctccccccttcaatccccctcctccctccctctctcctcgctgtcatgtcgccccgatggaggcccggccgagccccgccgccgcagtgccggcgccctcccccgcttcgtcgtcgcaatcgagggacagtcgccttctcctcggcggcgtcctcccggtcccctggggccaccgccggccgaaagccttccgcaaggacccccactgcagcgcccgtggggggggggcgggggcgggcgaggagccgctgcccaacagcgcccaatccccgccgaatgccgccgccggggcggcgtcgagggggcccaagcacgcccctcggggcgacgagggcggcgcctcccaggaagccgcactcccacccgacgaaccgctgcggcgccggaggcgcggccggggccgcgcatgggacgcgcaggagcacgggaagctctggaacatggtacggcggtggctcctcctccggcggcaggatcagcgccgggttctcggtggagctcaccaagcaggagatcgaggtggacttcctcgcgatgaccggcaagaagccgccgcgccggtacaagaggaggcccaaggtcgtccagcgccaaatcaactccatctcccccggcgagtttctctcggaggtgaaccgcgatcgctacaaggtgaacgagaaagggggattctgaggagtcgcgattcggagcaagagatggatttcctgccgggaattgtgggtcgagcaagagatggttcgtcatcagagttgaggttgaagtcgaagtgcgtcatgtcatgagagtcgatagatagattcagggttgaatagttttagttcgtcaatgctttggcaattgatcgtgtatcatgtaatgtgagtcagtcaaaccctaatacagtgtatgttgggggtgttttattggtttatcatcgggatatggttcaaggatttctcctgtgctggtcctgtatctgttgttgagcgtcgaagccagttgtgctgcagaagaacctcagatcttggttgcaggccggcagaaatggggactattgtagaatcctcatcaactttgcatttcagtgcacagtcggcaatttatattcttttcc

SEQ ID NO: 35217 - DNA, 1245 bp, Triticum aestivum
  Clone ID: PAT_TA_35217
aatggctccaagattgctcgtcgttcttccagtggtgctgcttggtttggccttccaggccattctccggccaccacctacaaaacgttgcggctcggcgggtggacctccggtgacatctcccaggatcaagctcagggatgggaggtacctcgcataccgggaagacggtgtgcagagagacaaggccaagtacaagatcatcacagtgcacgcatttgatagcaccaaggacttcccctcgcctgtttccaaggagctcgtggaagaactggaaatttacctccttgcatttgatagagcagggtacggggaaagtgacccaaaccccggtcggagtgtcaaaagtgaagccttggatgtagaggagctcgccgaccagctggagcttggacagaagttccatgtcttgggtgtctccatgggaggatacacagtttggggttgcctccagtatatacctcacaggctcgcaggagccgcgctagttgtaccagttatcaattactggtggccttctttcccgccagaggtgtccaggcaggctttcaagaagctcattgtaccagagcagaggaccctctggatcgcacacaatgcaccttactttttatacttgtggatgacccagaaatggctcccttcttctgcggcagccatgcatcatcctgaaatatttagcgaccatgatatggaggtgattcagaaaatgatggcaatgccgagaaccattgagaataaatcaaggcagcaaggaatttatgaatcaatccatcgagatttacttgttgcttttgggaattgggagttcgatccaatgaatattacaaatccatttcctacaaatgagggttctgtacacatctggcaaggatatgaagataggttggtgctggttgagctgcagcggtacctttcaaagaagcttccatggatccagtatcatgaagtccaagaaggtggacatatgttcatgctggtgggcggatggactgataaaattatcaaggcactcttggtaggagaagaggcatcacctatgtgactaaagattcatcttcgagctgctgctgggcagtgcagatgctactaactttttccccccaagttttatcccttgggacaccaaatttgtccaattcaacagatgatagatcatacttcacttgctaacttcaagctattgttctccagtacattgaaattacaatatgtgaaaccttgttgcttgttttttaaaaaaaa

SEQ ID NO: 35218 - DNA, 1906 bp, Triticum aestivum
  Clone ID: PAT_TA_35218
tcggcccgccgcaggcttctctgcatttccctgaagcggcagttggatcatcaatgccaaatgtcatccctgattccgtgagtacaatttctcagtacattaaccttatgagggactcgtttaggagggaaggcttcaatggaaatgcacaaacggtgggtaacattgaccctggaactgcaggaagtgctcatgctagtggtacacaaagccaggaaagccagcctggttcaacttctgcacatcatgtacttcctactgcagcattgctagctgaaaccatgcactctactagacaacttcttgttgacctggctggagaattgctatctcaactctccccgctgttgcgacacctggggattgttggtgacgccaccgcgcggcggaaccttcttcagactgctgggagtcttgctgtgcgcctcctcggtcctggggctgttcggcgggtccttgcccgcgccacaatgatgcttcgtatcaatcccgcaccttcagaagcggttgtaaattctggaccggctgtttttatttctccatctgggccaaaccctctaatggttcctcctgttccgttttttccaggaccaagatctgtccaaatgggtcagatgttttctagtcttggttcacaagctctgttctacacccaagagatgctgatgtccatatccgtacaagtgggtctgtgcctgtagccagtactaacccaagtgaatcggttggggcacagcaagcacaagaacatacagatagaactggcaatgcttcacattcaaacgctagaggagcatttgcacgaggtgcaggtggtgctccttttgctgttgggtctggagttagactattgccacttaggacagctggtgctgtgcctgctggcatcagtcgctctccatcgggttcttctagtggaggagttggtgttatcattccaatgatcaccagagttcatcaaagagtaaattctaatggtagcggtgcacgaaatggtcaaacttcaaatgaacctcatagtgacacccatgctaatctgcaaccgaatcctcagccacctcaagcacgtgaagcaggtaatctgggacatcctgtcgaggtcaatgtggggaacagttctcaggcttcccatggtcagcagaatggccagggtcctttttctcagttggtggacagtctccagtggattggatcactgttttctggagaaaatcccccagcaaacgtttcaagtcagcatgcaccagcggcttctgctgagccggtagatgctagaacagtggccagcgacgaggggatacgctttgctaacttggtcaggcaaattatgccacatatctcccaggttgaaaaccagtctcaaagcaccccagcagacaccagcagtactccttcacaggctgccgtgcctgagagcgcaaacggttcaagggatgggccaagtgattccaggaattcacgtcaacatagccgtgacccagttgaaggccctaattctaaaaggcaaaggagaatgagtgagtgattcaggtgggcttgttattgttgggtgggcgctgcttttgcagtctgagctgagaaatttttccagttgctgctacaccagagaattcatgatgatgataccgtgagtcataatcttattgagacaagtggaattgtttcgagtgtatagtcgagccttgggatgttaggcggttcataacctgtgctattccttctttgcacagcagttcctgtaatcctttttacttttttgatgagagcataagatgttttgcaaactggtatccatctccaatatgtggaagtcaattatattttggggtggaaatatccgcgcgatcaataaagcctggcttggtgcttgctgcagtagagcccatttttatgtcaaaaaaaaaaa

SEQ ID NO: 35219 - DNA, 863 bp, Triticum aestivum
  Clone ID: PAT_TA_35219
cttgggacatgcgccgtgggtctagtcacacgaatgtgttaacactgaatttggtcaattaagtacccaagagcagatgactgtagatgctattgtgcaagccagtgcatttcctttgtcgataattctggtcggagttggagatggtccttgggacatgatgaatgaatttgatgacaacattcctgctagatcttttgacaatttccagtttgtcaacttcactggaatcatgtcaaaaaagatcagtcaaagcaacaaggagacagagtttgctctttcagcactcatggaaatacctttgcagtacaaagcaacattacagcttggaatactggggcgtcgacttgcaaagtctccagagcaagttccacttcctcctccttttgcaagttataataccacctcaagagcagcaccatcttgggcaaataacttccgaagtgtgccttctaatcttagggaggaggcgactttagattcaacaatcacaccgtcagttacacccccaccagctgcagatgctagagcatcagaactccaattctgcccagtttgccttgccaaaccccgggacatggcatttggttgtggtcatcagacttgttcagggtgtggaccgcaggtcgcggactgccctatctgtcgaaggccaattgatacaagagtaaaactatactaacagcctcacatgcctgactaggtttgactgaagtacgctggagtgttgaaagtagaatccatggaaaagaaaaagaactctgtttgtactgtagcttgtaccgtaaagaaaatgaataacagttgtgtactgctctgtgttatatgtcatcaattcagtacctagaacaggcactactcaa

SEQ ID NO: 35220 - DNA, 766 bp, Triticum aestivum
  Clone ID: PAT_TA_35220
agtcgatcggtcagaccgctgcgacatcagtggttaccgcgccacaggctgcagaaaataagaaagtagaagccaaagccaaagatagcgatggcgagcaagatggcgacaagaataaaaagggcaacaaggaggagtccaaggcgctgaagatgttcaaactcgcgctcgcagactttgtgaaggacgcgctcaaacctacctggaaagagggccagctgaccagggaggttcacaagaccatcgtgaagaaggtcgtcgacaaagtcacgagcacggtcgaaaacacccctccaacaaaagagaagatcgatgtctacatgtcctactcaaaggaaaaacttagcaaacttgtacaggcatatgtcggcaagtatgtcaaggcgtagcaccaccccgccggccaaaatggcgacatcgggcgtctgtctgtttttgtgccttgtgtgacaggaagaatggaaagcagggtttaggtggcaagggtttctttttgttctgtttcaggcgccttgtgcaaatgttgcctagtgttgtatcatcgtctcctccttttgtacaacaacaccatttgaaacatgaacctcctgtagcggtagatagatataggttatgcaaaagacgtgggtcggtcgtcgtcgtcttcatgaacaccgcaccgggcgtgttcggtgtttgcatgcatgtagaacttgacttagcatgactgccaattcaaactctgtcctctgtctgattggttaaaaaaaaagggggggcccggtac

SEQ ID NO: 35221 - DNA, 555 bp, Triticum aestivum
  unsure (1)..(555): unsure at all n locations
  Clone ID: PAT_TA_35221
tagcgtggtcgcggccgaggtacatacagaacgcatgaagcgacgaggatcaagcctaagttgtctaggaggaggtgaacttggggtcgacgtagttgcccgtggtcaccgcgtgtgtctgtttctctgagattctaccgtgtggtgcgtgtgccccctctcggaagtcccagccgtacgacaagcacagggctccgcggcctcgcaagggactcttcagctgctgtttctgcaagatcaggccggactgcagaacgaaagctgacgctgtgtacaggtctgaaacccaggaggtgttccatgggtagcgagcatgttgtagcttaagttaggagagatgagcaccgttgaaacaaggctgataatgttctatcattttggtacggatgtgggtggccaaattccattggaagttagatcaatttaggcgagtctttgaactgcagcctgctcctgagttctgactctagatgtgcatcgtagatgtcagagtacagtccaataggtcttctaaactctacggtagcgcaanataaatccatcagaaaacaccct

SEQ ID NO: 35222 - DNA, 919 bp, Triticum aestivum
  Clone ID: PAT_TA_35222
gggggaagggggggcgtcggggggaaccgcccgagcggggggaccggcccgatcgaaggacaggcgggtggggggtggctggcggctggcgggcgcgcccgccccaccccccgcctgcccccccctgccggcgcgcgccccccccctcccgcccgcccctggcgggccacccccctcccccctccttcccgcgcgcggctgcccgcccccctccccctccgccgcccactgtcctccccctccccccccctcgctcccgcccccccccctcccccaccgccgcccccccctccgcccccccccccactcgccgggccggccggcgcccgcccgggcgcgccccccgcccggccacggggccccccggtctcccctctgcgcctcctcctgctacagcttcggcccgagggtcctcctctcccactcgtcttcgcctgcagcatctacaacttcgaattgaagatcatcaagtcccataggctctgaatctccctcttctcttgtttctgttaactgaatatatgtactgctgggtctaaaacttagggtctctttgattcaaaggatcttcataggatttttgaaggattagaatccttagaaatttttcctacctttgtcgtttgattcgtaggattgaatcttgtaggatattttcctacggatttatttgtactacatttcacaggaattctaacatccactccaacctcttggaagaaatcctatgcttttcccatgacacaatcaaacaaactcaaatcctatagggatccaatggacatgccatttcaatcctacgtttttcctattgccagtgtttttgcaatcctatgaatcaaagaggcccttactctgttacctgtgcatcttcgctgaatccctatgaatccttgctgaattgctgtgagttgttgca

SEQ ID NO: 35223 - DNA, 689 bp, Triticum aestivum
  Clone ID: PAT_TA_35223
gacaaaccttgagatcgagagacatgcgagcaagttgtacccaagagccatgttactgagcttgagaaaggtcgacagtatctgacaacccacaataatgcttcaaagcgagagagattgagcagggtggtgtacgagttcatgagtaaggacagaggttcccaattcgagtgcgagtgcgggcattttgaacacacaggcatgctatgttgtcatgtgaaagggaggacagtggcgtgtacattgtgcactacggccgcgagttcactgagttgtgcctccggtcaccgctgagcagggtaagatgcaagaacagcagcctggaagcctggaagatgcaagaacagcagccttgaaggtcactgccggtacacctgcaccacaccaggcctcttggagggcctctgttctgaagtgcatttgtgtattgtggcgatttgatttgaggattttctagtgtgttcggtgagctctgctccacgcttgttcctctgtagactgtagttgaattccggtaatgttgtggcattaatttagtttgccatctgttcggactttggaaaaaaattgactgcatgtcaccatgccgtatgcactgataagtgtcatttgttcagacatgattaccacgtgtaagctcgtgtgcctgggcagcagctgccggggagatatttatgaaagtacagtgc

SEQ ID NO: 35224 - DNA, 2096 bp, Triticum aestivum
  Clone ID: PAT_TA_35224
gccccgcctgccgccgcccccgctgcggccgatcccctgcctcctccaggcgctgctctagctcatgcccagccgggggctggggaccccgcgccccctcagccggccgccgccggacgggcccggccgcgcctcacgctcccggtcgctggctaggaggctcctgcccagggggttcaggtcgccggcgccggtgcgcggtgggggcgggcgggcgacgaccggcgggagaggctggtgtccaagcacggccatggcctcggcagcagggtgcgaaatgatggtccctttgaagaaggcggcagggtgaggagcgacgctcgctttgaagaaggcggcaggttcgccgccgctgaatccgccgagtcctctttgctggagaggacgctcgagatccgggacaggtcgtacaggctgaagatcgagcgccgcggcggcgctctgcgccgggcgcggcgcgctccggcggcgccccctgttgcgctcgcgggccgtcgcgccgccggtgtggctgcgcgaccacttacagatgatgatgagggtggtgctgctgctgggggttcagatggtgaagagttcagccgcaacatcaatgaggctgccgagatcttgaggaaggcgagggagtgcatgatggccagggacgacgaagaggccgcggacgcgttgctgtataggtcagcaaggcttctgtccaccgccgtggctttgaggccggcaagcctggtagcggtcggtcagctagggaacacctacctcctccatggggagctcaagctcaagattagccgcgagctgaggacgctgctggccaacagcggggcttatctgaatggaggagagcgtgtctcacggtccaggaagctggacagaagaatccttaacagagagaacatttcgtccgcgctagtgggcgtttgtgaggagtgtgagagcctccttgttgaggcaggcagaagctataggacggctgtgtcaattgattcgggcgacgtcaaggcgctgtacaattggggactggcgcttatctttcgtggacaactgcttgccgacatcggaccggaagcagcagttgatgctgatcgggtgtatttggctgcgatcgataagtttgatgccatgttatccaaaagcaacacttatgctccagaagctctctacagatggggcagcgcgctgcagcaacggtcccagttgcggtctcggaacaacaaggagaagataaggctgctggagcaggcaaagagtctgtttgaagacgttctgtacgtagagggtaacaacaagatggtacgggaagcgctgtcgtcgtgcatatcagagcttaactaccatggacgatggctacagtgaattggccattagtcgtgtgctgtattaggattgaagacagagatgagtgaaataagatgaagcaagctgtatgtatgaaggatacagatatcctttactacgacgagaaagtcgctcctgtacacaattttccttaaaaggcttagcatttcaacaggaaggaaggaagaaccttcacagacgagctttgcatatgaataacaaggatcccagacttagtttaagaaattgcacacaagttccagtctatgatcatcaatttcatcttcagaatttagaagctatgtcagctcatgttgccttctttctgttggtggcctctgctctgcatggggggaattgatgagaagattgtgttcttatcagctcaactacttctgtctgcagtgccaacgtcaagttgggaaatgagtgctgcaacctgattagcatttgctgcaagagaaggctccgtgtagttgtagtcttcgcggacatctttgaagccatcatgcccgtcaggaccagcaaccattactccgaggatgatattagggtttgctttcttactctgcttccattctgtacctcctttgcacccgtacttaacaccgtcataagggatcgatgcccctctgtgatgaacattttggggtacttgtttccaaaaccgacaatgtacgtagcattgggttcttttcctaagatgtaatcaaagctgcaaatcgagttaaaaaaaaaaaaaaaaaaaaaaaaggccccta

SEQ ID NO: 35225 - DNA, 1476 bp, Triticum aestivum
  unsure (1)..(1476): unsure at all n locations
  Clone ID: PAT_TA_35225
gccgcatcgcatcgcgatccagcgccgtctcgagccttccatccagagccctcccaaactcctctgccgaccccccgcccgccgccgccgcgccggagatggggtacatcggcgcgcacggcgtggagacgctgaagcgctacaggtacagcggccaggaccactcggtggtggccaagtacgtgctccagcccttctggagccgctgcgtcaccctcttcccgctctggatgccaccaaacatgatcacactcatggggtttatgtttctacttacatcttcgctgcttagctatatttattcaccccaccttgacacggctccccctcggtgggtccatcttgcccatggaatacttctcttcttgtaccagacttttgatgccgttgatggtaaacaagcaaggcgcaccagctcatcaagtcctctaagagaactttttgatcatggatgtgacgcccttgcctgcgcttttgaagccttggcccttggaagcaccttgatgtgtggaaggttgacattctgttattgggtggttgctgctgtcccattttatctggcaacatgggaacactacttcacaaatactcttattcttcctgtaataaatggaccaacggaaggcctgatgctgatctatgtctcccacctttttaccttttttactggtgctgaatggtgggcgcaagattttcgaaaatccctccctcttattagtttggttccacttccatttgttccagaaatccccttatatgttatcgtgctgattctgatgatcatgtttgctgtaatcccaacagttggatccaatattggtaatgtccaaaaagtagttgatgcacggaaagggagcatggaattagcattagcaatgctccttccatttattgcgctgttagctggagttgctgtctggtgttatctctctccttcagatatcatgaagaaccagccacatctgcttgtgattggaactggttctgcttttggatatttggttggaaggatgatacttgctcatttgtgtgacgagcccaaaggtctaaaaacaggaatgtgcatggctctggtcgtgctcccggccgctatcgcaaatgctctcaccgcaaagattaacgacgggactcctttggttgatgagcttttggttattcttctgtattgtgcaacctcagtgggtctttacatgcatctcgccatttcggtttgtcatgaaatcaaggatgctcttggaatctattgcttcaggatagccagaaaagaggcttgaatttgcctgaatccttccataggaagcattctgccttccagacattgtctgtctgcattcacaagtctaacgttacaacaacgcatagccatggatgctcaacgaatcatgtctttgtaactccatggccaccgattattcatcatgttaaatgcagatttgtgtcaagtagcctatgtacctgcccgggcggncgctcgaa

SEQ ID NO: 35226 - DNA, 704 bp, Triticum aestivum
  Clone ID: PAT_TA_35226
gccaggcctgcgtacacaatggctgcgcctgctaacctcgtatacggctaaacctaccatgaaaaaaacatcgggcacatgcgcacaaagcggagcatcctgtatatgggcaacgcgatatccactatcaccgggtcggaactgtaaatatttttttttttcacaatcaagatgagcaatctcctcttcagcttacgctcaaagacatttggcttgaaattccaggggcaaacatgctaatgggggatattatgaatgaccgcatcaagtactgcctgaggcacgttgcaggcgacagccgatagagtgtgcagtatgcgctgggactggaaagtgccacctctactcctgatgatgatgacatgtgagctgctcgaaagtctaatcaggacaccttgtttttctctcattggcagcgcagattgatggctgaggccaatatttccatcttgttaacccatgctccttgttatctgccatgtgatcagaaaacattgtaacaatgatctcggcggttttgttcagcttggagatctagagtgttttcagtagtctgaacaagataccatgacaagagagtgtaaatttgtcatgtaaatcaaacactgcctggtatgcaccacaacaaatttgttatgcccctgcaagaaaaaaaaatgttacggaaatgtctggaaaaaaaaaaaaaaaaaaaaaaaaaaaaa

SEQ ID NO: 35227 - DNA, 2428 bp, Triticum aestivum
  Clone ID: PAT_TA_35227
gccgggaagatgacggtggctgaatagatgatggagctccttccgatgctggtagctgggagacagttgatgacaatgaaatggacttgcctgatgatcctgcaaatgatgatctgcaaaatgcagtacataatagaattgaaatggaaaatgggtcattcaattcccaagatgaaacttctgttggaagtggtccactctctgttgcttttggttttgttccgcgactgggaagtgagatcttagcccgagagactggtgatgacagtagtaagaacgaggataagaaccgcatggcattatcggagagcctcacactgacaacatgtgtctctaaagctgagaaagaagaagacagaggggtggctgacgagcctgcagattctgattgcttgaaacactttgatgttctgcagtgccctccggaccatcactaccttgaaaacatagcacatggtaccggtggaagaaagtgggtcaaaaaagttcagcaagaatggggcatacttgagaagaatctaccagattatatttatgtcagggtatttgaggatcgtatggatctcatgagagctgtgattattggagcaagtggcacaccataccaagatggtctgttcttctttgacttctaccttccacctgagtttccacaagctcctccgtcggcatactatcattctggcggcttgcgtgtaaatccaaacctttatgtggatgggaaggtttgtttaagcctcttaaatacttggactggcagagggaatgaagtatgggatccatcatgatctcgtattctgatggtactagtctctcttcagggactagttctcaatgaaaagccctatttcaatgaagctggatatgagaagcaagtcggtactgttgaaggggagaagaatgcactgccatacaacgaaaacacatatctgctaagcgtgaaatccatgttgtatatcttgaggcggcctcctatgaatttcgaggattttgtgaaaagtcacttctgcaagcgcggcgactacattctcaaagcttgtgaggcctacttgcaaggagctgtggtcggcacgctgaatgacgatgcctgccccactgatactaacaaggagtactcttgctccatgggcttcaaacttgcattgggcaaaatcttgcgaaggttgatcacagccttaaaggacataggagcagactgcagccagtatgagcacctcgggaagaccgagaccgctcaagaaagctgaacaccgagctgaggattgtattcaaatcttttcttggcttgagaaaacatgataaaacttcacctcccgctgtttccgtataaatgtacatccaacaattgttgttttattatctaaacatgtacaccagattatatttatgtcagggtatttgaagatcgtatggatctcatgagagctgtgattattggagcaagtggcacaccataccaagatggtctgttcttctttgatttctaccttccacctgagtttccacgagctcctccgtcggcatactatcattctggcggcctgcgtgtaaatccaaacctttatgtggatgggaaggtttgtttaagcctcttaaatacttggactggcagagggaatgaagtatgggatccatcctcatctagcattctccaagtactagtttcactccaggggctggttctcaatgaaaagccctatttcaatgaagctggatatgagaagcaagtcggtactgttgaaggggagaagaatgcactgccatacaacgaaaacacatatctgctaagcgtgaaatccatgttgtatatcttgaggcggcctcctatgaatttcgaggattttgtgaaaagtcacttctgcaagcgcggccactacattctcaaagcttgtgaggcctacttgcaaggagctgtggtcggcacgctgaacgatgatgcctgccccaccgatactaacaaggagtactcttgctccatgggcttcaaacttgcattgggcaaaatcttgccaaggttgatcacagccctgaaggacataggagcagactgcagccagtacgagcacctcgggaaaaccgaaaccgctcaagaaagctgaaaatcgagccgagggttgtattcaaatcttcccctggcttgagaaaacatgataaaacttgacccccctgctgtttccgtataaatgtacattcaacatttgttgttttattatctgaacatttgggaaacgtggttccaaatgaatccatcatctcttccaaactgggaattgaggtgtgtcctgcacagtttatgtttttgttaagctttgtgggtttgttgttaaggtacccttattttaaaggctagaccagcattgcaagattaagcctagaaattccaacggtacagatgcagctggctaaaataatagtggcatttttctcc

SEQ ID NO: 35228 - DNA, 943 bp, Triticum aestivum
  Clone ID: PAT_TA_35228
cgggacggtcgtgcccctgacgatgtcggtgccggaggcggggcaatcggcggggagggacgagcaggagatggacgattacgagcagcaccagaccagagtgctcatggcgctgatgcagggcttgtgcgccgcgaggtaccgcaaggccgacaacaccccctgcctcgtcgaccagggcctctacctgggttctgttggagcagcactgaataacgaggctctgaagagcttgaacatcacccacatcttggttgttgccagatcattgaatcccgcttttccagcagaatttacgtacaagaagatcgaggtacttgacagcccagacactgatttgggaaagcatttcggtgaatgctttactttcatagatgagggtatctgcactggtggcaatgtgctggttcactgctttgcaggtcggtcgcggagtgtcacagttattcttgcatatcttatgaagaagcatcagatgagcctgcaaagtgccatgtcactagttagaagcaaacgacctcaaatagcacccaatgcgggctttatatcccagctggtgaactttgagaagtctctgcaagtggagcagggacaaagaacgttgcaatctaactaactacaggtgtaaatatcaagaacccgctatcaatagcttccttactgcatgttatcacctccagaaatcaaacagggccgttgcaaccgatgatacctttgccctcttcatttagggcctgtttgaatcacggggaattttcctgttgactgtggtaaaagatctgttccattttgatgctcaatgatcttcagcagcagcagcagcagccgccttctgaaatgaaagatgtatatgtatcatcttccaataaaaatgggggcctgcttgtgccaccgggtgtttcctgttgactgtggtaaaaaaaaaaaaaaaaaaaaaaaaaaa

SEQ ID NO: 35229 - DNA, 950 bp, Triticum aestivum
  unsure (1)..(950): unsure at all n locations
  Clone ID: PAT_TA_35229
tcggcacgaggctacgggcttgactagctacgtaaacctacagacaaatctacttccttaataaaaggggctcgggggctcgcccgcggctcgacccttctcgtgtctacagtacagaggagccgaatcagcggcgactccggcgtgctcgttcttccgccggccctcctgagcgtttccctcgcccccagcggcccccagggcggctggaggttaggggaaccttggatctgggcgcggcatgtatataggtgcggggcgtcgtccccaggttcggttttcggcgccgatgtattgacggagcaatcgtcggtgcgccatcgaaataatgtcccccagctctggctccggctcgtcggcgttgtggcagatgctggcgaggggcttgtggggtcctgccttttggcgcgatggtggtctggctcgtcggccttctccagcggtgccggctcttcgcgcaaggacaagggcggcttagtctgtcaaggctggtggcttgtgggagggggatccggtcatctctttcgagctgatttggcatcgtccccggatccggtgcaggagcagcttggggagcgtccccggcatggggatcgcctccggccgatgtctgatttggttttagatccgatttgctggaatcggtggatgatgcggttcatcaacgcctatgtggcaaggagcttctcctgcttcaggtttgctcaagatttggcgtctgctccagtgattcatcgtcaacagggatttggggcgcggagcatgcaattccgaggaaggtctccatggactattttccctatgtatggggctttgttttctggctgcgacaacaccgcctgtatcctttgtgtctttctgtatctgtattcgtacgtgtattcgcatggctgtactgttttcctactcgtatgaatacaagtaacgtatgccttcgngtggacggtntc

SEQ ID NO: 35230 - DNA, 1590 bp, Triticum aestivum
  Clone ID: PAT_TA_35230
ctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaacccggtctcgccccttctggtgttctcccctcccgcctcatccggccttctcccctccccccgtcgcggtttgccccgccggcggcgacgcggacctgctggcgctggatcggcttcttctctttgcgggatttatgtgccaagctgcgtactgttctgttttattcctcggaccaaacttgttgagctgattccagcaaggaggaatctgcaaagcagcttggtgttaagcttgcatcttccctaaacagctctagattaaatgggagaagcaagctcggatgatctttgccattgtcaagggtgtcttggcaagtacaccctactcagagatgaagagaacccacagctcgcaaagtttgagagacgccttccttgctttggttgtggaataggatggtcctcatttcttttaggtttcttgtgtccattgctttggtactatgcaacgactctttactgctgcaagtactacaatagggatccccgagagcgcccgggtcttgctgcctctgctattgcggcggccatcttcactaccgcggcaactattaccctctccatcattctgataatctgggcacaaaagtgatttctgaggcagggagaacagggctggatgattggttgtttatcggcagatgagggattcagaaggcaacttctaatgttgatgatagcagatcgttttagttcatcatgtaatcatagtgcatatgcaagtgtttatcgaagggcttcatctattgattgtcgtctctcccgagtcagttattcaatctttctaagagggtgggaacagttgactgtttcttctgaaaagcttccaatccagaggctacagatcgaattacataaattagaggaaaaatccatacaggtagcccattcagcaggtaattgctgggattgaaactgtagtcattaccagcaactcaccatgggagatacactgatacacctggaagtcattatccagtatagcaccgtcgtctgagcttgtcgaattcttaagaggttgaatttctgatacacctattttagttgaaaaaaaaaaaaaaaaaaagcccctaa

SEQ ID NO: 35231 - DNA, 1355 bp, Triticum aestivum
  unsure (1)..(1355): unsure at all n locations
  Clone ID: PAT_TA_35231
ggagttcagcttgtagaattctcacccctgtggctgattgtgaagtactagaaaacctccagccacatcaaaacttgaaggaacttagcattttaaggtatcttggtgtgacatctcccagttggttacagatggcgttgctgagggagctgcaatccttgcatcttgttaactgcaggagcttgggagttctgcctgcactgggcctcctgccatccctcgaacaattacatatgaaggagctgtgcacggtcgagcgaattgggcatgagttttatggtactggtggcatggcatttccttccctaaaggttcttgtgcttgaagattttcccagcttggtcgagtggtctgaagtgagggaaaacccgcttccttgtctccagaggctaaagattgtagactgccccaagttgattcaagttcctgcatttccgccatccgtctctgagcttacagtggagcgtacattattgatatctaatatgaagcttgctccttattcttcatcacaatcagagatactcaccctggacatttctacgaccagtgtactttccaggggactgttccatcaaagccatctagcatctatcatagttttaaaacataaacgctggctgcaagcatcttgttgccgcagagggactccacacctttacttctctccaaaagcttcagctgtgccactctgacatatcagatcagaatttgggaagtcttcttcaggtgctgccctctttgtactcggttgagatgatagatctgcccaacatgacatctcttctggtgccagcaaataatagtctgtgtactaccgtcacggagttgcaaatatccaactgtccactgctctcttctgtagtctccttgggtacttttgtttcactgaaacgtttggtgattgagaaatgccccaaactgacggcagcatccttcccagtaagtttttggagactcacagccctcaaggttctgagtatatcatactgcacagagttccagtccttgcctagttgtggtctgccaaactcaatagaagcacttcatctcgttgggtgtcacccaaagctgcatgaaagttcaagcaacaggactgtcaattcctgagagaagatttctactctacacaaaacattgatggcaaaattcatgttttatgtttgcacctgtttctttcgttcttactacttccagtgggtatttttcagtttattttgtaattgtgccgccatgtgttagctgtaaataccgatctgtgattttgattctgatgatttgttacctgtacttctatcatggttcagattagaacccacccttattgttttgtcgagnatgnggaatcaaagtat

SEQ ID NO: 35232 - DNA, 1096 bp, Triticum aestivum
  Clone ID: PAT_TA_35232
gaattcgccgcctcgtcgctcgacactcgtctccctccacagaaaggctaatggcgaccgccatgcggagcgcccgcctcctacggctcggcttctgtcacgtcccttctcttctcttccgagggcccctgttcccctccccgagcccgggcctgggcctgggcctgagcgttgccagggtcgggttggtccatctccgatgctcggcggccgaggccggcgacggcaggggtaagaaggtgtcagcgcgactagcactggcacagcaggtgatgcgcgacgccgaggagcgcgcggcctcagccggctctgatcccgcccccaagatcaccatggatcatgttactgttagctttgcaagaagtgggggcgcgggtggtcagaatgttaacaaagttaatacaaaggttgacatgcggttcaatgttgagaaagctcattggctcggagagaggattaaggaacggatattgcaaacggaaaagaacaggataaataaggatggtgaacttgtgatgtcttctacgaaaactaggacacagaagggcaatattgaagatgctttgcagaaaatacaggcgatcattgatgctgcatcatatgttcccccaccgccttcagaagagcaaaagaagaaaattgaaaaaattgctgcagccgctgagaggaacagaatgcaaaacaagaaggtactctcacagaagaaagaattgaggaggagcaaacccagctgggactgattgcaggataacaaaagcgccttctctgttacctgttgtactgatgtgatcaagccttcttcatgcgtgtttcttggacgtaccttcagcggagtcttgcgccagtagcatggtgaaggcatcttggtgaagatactaggtcgttgttacagccagttcttgttttcatagtaaatgtaaaaaagaacaagggccaaaaagtgtgatggcatcttggtggggatagcttcacagccagtttttgtttcatccattggaaaccagcgcctgacgagaaacattgcttctgtcccaacacgcactgtacctcggccgcgacctggctacctgacatatcagatgcatcacatgttcac

SEQ ID NO: 35233 - DNA, 1248 bp, Triticum aestivum
  Clone ID: PAT_TA_35233
cttgctggacaacacagctgtgcctgcccgcctcctctatctccaggagcattatgaatttgctatttataaggttcaagtggacaagccagttcagttggctacttttaccgagtgtgtgcgttctggtcaagatgttttcagactcgggagagatgaaagtctgaatcttagtataactcatggtatggtggcttataagattccatcctggtatgagagatgtcactatatgtatttgtcttgtgatccatctagtccctcactgcttcgtgatgatggaggacccatcattgatttagaagggaagttgtgggtctagttaacaaccatattaaggagacattcataccttcgttcttattgcacaagtgcttggatttttggagaagattcaattgtatgcctcgcctccatcttggaatgacgtttacttcaataaaacatttagatcctagctgtattgagagaatgactcgtaatcataacatcgagtccggtcttattgttgagcaggtgtctaaaggatcacatgctgagaaaattggaattcgtgagggtgatgttattgaaagctttaatggaaaagtacatttctactacaatcgagttggagcaaatgctgatagacatatgctgggaatattttgatcaagggaaaagatttatatgctgaaaaggatgtttcggtgaaaatatttgatgccatcaaacatcgccggagaactagaaacttgactgtgattgtatcggatcttggagaagacattgtgaaaggcacttaccctatcatgggaaaagaagccatgccagtctcgtaagtttcttgagctgggcctgagagaggaacttgcccgctgctggccttcatggacaagtcattggaaaaaacccttgcatgccaattgcaaattcaagttcggcataatctttttgtgtgtgtgtgtgtgtgtgtgtgtgtgtgtgtgtgtgtgtgttcccagacaaaaactttaaattatggggcctttggaccatagaagcagcttagcctagagcataacctgtatgttactgcctactagagtacttattttgagtcttgtgaaactcacatcctgtccggtgcaagtctagcagccgtggatgatgaattgagcccggtaattatgctagtgtaatgttgagactgcataagcagaatagcttgggattattggctagtagcaattaattttagttcagtggactcaaaaaaaaaaaaaaaaa

SEQ ID NO: 35234 - DNA, 778 bp, Triticum aestivum
  Clone ID: PAT_TA_35234
gccagtccggcggcgcgatggagctgtccgggagccccggcacgtggagcggcctctcgctgcggctgggccagttcctctttgccgccgcgtccgtctgcgtcatgtcctccgcgatcggcttcgccaactacaccgccttctgctacttgattgcatcaatgggactacaagcactctggagcttgggacttgcgtgtcttgatggctatgctttgagaatgaagaaggaactcaacagtgctgttctcgtgagcttatttgttgttggagattgggtaacgtcgatcctgtcattcgccgcttcatgctcagcaggaggcgtcgttgttctcttcgacaaggatgcgtacttctgcagcagggacccgcatctcccgtgtgggacatttgagctcgcgaccgcgtttgcattcctttcctgggcgcttagtgccacatctgcccttgtgatgttttggctcctcgcttcatcttgactagatttgtaggagctctgtctgtacctagcgttgtttggtcctgtctggttatataccgactgatgtttcaagcagactacatagaaatagactgctaattccagagaatagatgggcaatggtggcaagttccatgaatcttaaatatcagagtcatgctccagtgtttccgggccaatgataacttggttcctggtagggagtcttgctgttgattaactcattttgcccagttaatatggcacaccggacactcgtcaaaaaaaaaaaaaaaaaaaaaaaaaactcgagactag

SEQ ID NO: 35235 - DNA, 758 bp, Triticum aestivum
  Clone ID: PAT_TA_35235
ggcatggttaaacatggtggtgcgtgtggtatcctgcagttttgctttagccaagaacattttaagattcgagacgatgggtagtgtgctgggtaatgctactgtgtttgcagtaagtatgctcacattcttgcagcttcatcaattggcctctggtaaacaaatgccagcggtccagtataggagaaccgacaatgtttctctctctggagggtcaagaaaagacactaaaggaaagcatctggaagtgttattagctagaggttgagcaatcatcagatacaggaagctttgttctcctttgagttttggtcggttttgttaggtcactaggcactagccattgcattcttttggatgggctggtctacagtctaccttcatcgttagaagctgtaccacacaggatgtaaatggtttgagattagcaatagatgcactggaagaatctgcaagtcggttccctttccttcaactaaccacaacaattgtatggtactagggcaacatatctcgttctggggctgtgacatttgaatctgtttgtttggttattactctactacatctatggtgatgaacttggagaagatccgcaagcaatgttccctcaacagtaaccagcagctggggatgcaaatctgcctgcacattgcgatgcgctgctgccaatgtatgccttggccaaagtcttctgtgtcaattaccctgatttaaacgattgattgaccaaaattaacgggattctctatataact

SEQ ID NO: 35236 - DNA, 845 bp, Triticum aestivum
  unsure (1)..(845): unsure at all n locations
  Clone ID: PAT_TA_35236
tcactaagtaatgatgtgagtgtgatctcgaatctcttgggagctttgatgattggttagacaataaagaagcaattgagttttctggcaacaaagaaaaagcaattgaggtcgcaagaacccaactataaatcactatgtaatctaagtgctatcatcagaacgtcagattagttactcttctctttagtgtttacatgctatgagtaaaacatgtttctttagactgctcccacccgtactacgctactactcatctatgctcatgataaacatcaagcatgttctaagttctaactgcatcatgtattggctctgcattgggatgatcggcacaggtcttgggagaaactcttattgaactaacccatgttatcttttatgaaggcgatggacctgagattcagtcagctcttgctgaatggactgggcagaggactgttcccaatgtcctcatccaatgggaaaacacatcggtggctgttgacggtgagctgattgctccctacaaccatgttaaactgttgattgtagtatggtccaatgaacaagcagcaaattccattgtgcgagctttgcttcttgcaattgggttacttccggatattactccatgtcaagtctccgtggnaaatacatgcactgacaaggaaggaagcggtgctcgccganaaggcggacgtnncggtctctcgaaacacgcacgctancttgttgcantgtgtgtcanagtangtgtaatgattgatgtcctgtntaanacaattgtgtttggaattagnntttcgcacatccagacgnaaaccanntaaccntaaaacaattttgntncaccaaaaaaaaag

SEQ ID NO: 35237 - DNA, 889 bp, Triticum aestivum
  Clone ID: PAT_TA_35237
ggcgtgccggcgtcacaagtgcttgtccaccaagcgttgacggagtccaacaagtgccatgaagaggtgtccaactcgaccatgtgaaatatctcatagtacaaggcccacagccttagagtagagcggcgcttgaagaatcgacccttgagctgcgggaatcctgccggcggcagaagcgagggccggttggcaccgggcgcccaaccagtgcgcttcttgacatgctgcactgatggctccggcagaagcgagctgtgcttggtaacggcacgcaaaccgctgcttatttcagaaccatgcaagtagagctccaaaactggccccctgtccaccgcatctgcaacagcatgaagcaaacagcgggaaccccatcaagtcgtggtttcctgacatgccccgaaatttcgggttttagaactggctttctggtaactccaatcaagccatgggctgcgtggtttctttaactgcaggcccaattttcgggcccctctaagggcttgacgacatcaacacgaagattacagagtgcccttcggagacgccatgaatgttctcaactgcttttatgaagctaacatctgaagcaccttgcgaagggtgccctcaaacgagtctcaagtgcagaggaaattccaataacttccttcacgaggataaagaggttatggacttcaatacttttgatcctttgtttccgaagaaaccaaagaaggcatgctatgagatggatccaccttgggaacaagacaggaagtctcagccctggtggcaagtagctgacgaggaaggattggcttcgcttgttgcagaaagagcaatgcagcacattgagaacaatgatctgccaaaacccactcagatagtgcgtattcatgtcgacgcg

SEQ ID NO: 35238 - DNA, 1297 bp, Triticum aestivum
  Clone ID: PAT_TA_35238
catggcgtttgtaggtccgcggcgctcaaggccgccgtggacctacgcatctccgacgccatccaccgccgtggaggtgccgccaccttgcccgaggttgccaccgagaccgggatccaaccgacgaagctttcccacctccgtcggctcatgcgcgtcctcgtcaccttcggcatcttctctgtcgatcaaggccgccacgccgatgccaacgacgtgcgttacaagctcacccctgtctcccgcctcctcgtgggggactacaaccagtctcccatcgtgcgtctgtttttggacccgtcgtacgtgaccgctctctgcggcatagcggagtggttcaccgacgagcacgcgtcagctcgcacgctcttcgaggtggtgcacgggtgcacgcgagatgaaatggtagcaaggatggatacgcgcggggagtacaacgtcggcgtggccgccgacagccgcctcgtcatggaggttgccctcaaggagcaccgcggcatcttcgagggcgtgagctccctcgtcgacgccggtggtgcccatggtgccgcagcggaagccatctgcaaagcgttcccccacatcaagtgcatcgtgcttgatctcccacacgcgatcgcaggggcacctgccattgaaaacgtccagtttgcggccggcgatttgtttgagtacgtgccacctgccgacgttgttctactcaagtgggttatgtgcttgtggcaagatgaagatgccgtcaaggtgctacgacggtgcaaagacgccataacaaccggtagaagcgacggagggaaggtgataatcatcgacgtcgtgataggctccggtgtgtcgcgggacgaagttcttcttagggagatgcaggttctatatgatgtcttcatgatgcgcgttgacgggacggatcgagacgagcatcagtggaggaagatcttcttcgaggccggcttcaaggactacaagatcactccgatgcttggatatcggtccatcattgaagtctacccttgaatgtgtgcctgccaaaacagaaataaataagataaataagcagcatgtatggtttggtgggttcatgctgtcgatcgaaaatgtctgcactagcagactatttacacaataatgttttgagtcctccttcatgtttcgtgtttttcttttttttgaagtttcatgttcgtgttttctagaggttagaaaatcatcagtagtgtccctgcctgtaaccgtaagacagtcggagaattttctttctgctaaaagacgtaatctgtagtgtgtgctaaaaaaaaaa

SEQ ID NO: 35239 - DNA, 1044 bp, Triticum aestivum
  Clone ID: PAT_TA_35239
tctcctttttttttttttttggctactttgaacctagacatgtttatttattcatatcattcactgactctgtgacatttatttatttatatcattcagtcactctgtgacatgtttattcgacttgtacaatacccatgcagatatacctgcacaactactacctatttccccccactcttatgaaacagctccagcgcctgggccaccgtcatcccaccgggcacctggacgaacagcaggatccccagggtggcggccgcctgctccgccgtcctcacgcccatcttctcgatcggcgtgaacttcgctggcgcctttcccggcgggggcttcgcgtccgtcttcagcagcgcttcggacaggtcctgccatccgttcacctgggccttcagcgcattgctgatcctcccgctcttctggtccaacacctgggggtccagcacgccggccacgagccccgacacggtctggaaccgcgtggcctcgtgcaccatgaggagcagcgtcgtcaccgcctccctcgcctgctgctgcttcgggccggaggtcttgtcggccttggtgcgcccgtagagcgcggtcaccgcgtcggccatctgctgccggccgagagcgacgttggtcagcttgtcggtgtcgccgaggaggtcgcggtacgtgccgccgaacccaacgtgggtggcgccggggatgagtccgggggtgagctcccaccaggtgccgtcgctgctcttgaagccctcccagtagaggttgtcggcgcgggtggcgagcgtgagcccggtgcttgccggcgatgtcttgagcacgatgtggaaccacctgctcggcgggacgttgggctcgatcggcggcagcacggggcggttgtgggaggagtgccccgggttgcggagcttgttgcggatgccgttgatgaaggtgacatagtcggcagagctggcctggacgttgaacgtcgccgtgaagagcggcttgtccacgttcttcgccatctttgccgccatggatacgaggcttagatgagacggactatcaagc

SEQ ID NO: 35240 - DNA, 758 bp, Triticum aestivum
  unsure (1)..(758): unsure at all n locations
  Clone ID: PAT_TA_35240
gagaagaacggcaaataaatttggtggcattgagctgttgacagaaggatgcaaaaaagctactcagttactagcaagatgaatcaacgagaactgtgaaggttggagtctagaaaggtattccctgttggaaatcgactacgacggcagttaagctatgcatcattcttggcggtggatctcatccctgtcatttttagcaatcactttgggacaagccttgatgaccgtctgggtactgtagagggcttggtctgcttagcagcagcacttcttaacctacatagtatatttcttgtagccacaccctgcaactcctcaggatcactgtagttttctttgtctgctgagccgcaacacttccctacctttgcaccatgattcttgtagccgggccctgcaacatttcaggatcacacggtttaaaattaaataaataatcctaaaaaatcgacaaatgaaagcaagcaatgaagcagcggggagtaacaccattgtccgaagcaacagatgatcgtgttggatccgtgacgcagaaatttccagcaacgccccgatctgcagaactagcatctgactgggcatttgcggcaggtagtgcaattaccgcatgattggctagttgacgaactgacaagctgccaccatgaccattatcttgttccatagccactgctgctgttggtgtgaataccaaagatgccagttaattgagttacccaaatatcaattaccaaatagnatagttttgcagttgc

SEQ ID NO: 35241 - DNA, 908 bp, Triticum aestivum
  unsure (1)..(908): unsure at all n locations
  Clone ID: PAT_TA_35241
aggaattcggcacgaggcaggagcncagtgctctcttctgcgctctcttcctcctctctcccattttatttatttatttattttaccatatttatcctacaggcctacctctctatctagtatctcttcttcctcctctgaatccttgcatttgctcctgctcccccatccaatccagggagattcccactttttcttgggcgtttctcttcttctactagaccttcggctggcgcaagatctgaagaatcctccccaccgacggcgacggcgatgaggccggaggcgcggctcgactcggcggcgttccagctcacccccacccgcaccaggtgtgatttggttgtggtggccaacgggaggaaggagaagatcgcctccggcctgctcaaccccttcgtcgcccacctcaaggtcgcccaggagcagatcgccaagggaggctacaccatcctgctccagccggatccgggtgccgacgcgccatggttcaccaggggcaccatccagaggttcgtccggttcgtgagcacgccggaggtcctggagcgggtcaccaccatcgagtccgagatactgcagctccaggacgccatcgcttcccagaacattccaaatattgttgataaatctgttggggcccatagttttccaataaccccggatttgtgcaagaacatttatgatcctcgggttgtaaaatggtactggtttacaaagcctgacacgaaccaggaaaattcccttttggaaaacactggagcgcataaaaagcattcaaaagttcagcttctcagagtgctggagactcgcaagactgtcttacgtaaagagcaggctatggcctttgcacgtgctgtagctgctgggtttgatataaacaacctgatatatttgatctcgttcgc

SEQ ID NO: 35242 - DNA, 1466 bp, Triticum aestivum
  Clone ID: PAT_TA_35242
aaaaggccaagctcaaggccgggataattcttatcttaagcaactatctgattacatagttccagctcttgtagaggctatgcataaagaacctgacacacaaatttgtgcaagcatactggagtcattgaacgagtcaattcagatgtcaggaacacttctcgatgaaggccaggttagatatatagtggagggaatcaaagaagtaataacagcaagctctaataggaggacagaacgaacagagagggcgaacgctgaagactttgattcagaagaagacgagctactgagggaagaaaacgaacaggaggatgaaatatttgatcaagttggcgattgtttgggcactctggtcaaaacttttaagacttacttccttccattctttgatgaactctctgtctacttgacacctatgttgggcaaggataagacatcagaagaaagaagagtcaccatttgcatttttgatgatgttgcagaacactgtcgagaagcagcagttaggtattatgacacatatcttccttctctgttagaagcctgcgcaagtgaaaacccagatgttagacaggctgcagtttatggtattggcatctgtgctgagtttggtggttctgcatttaggcctcatactggggaggcactgtccagattatacaatgtaatcaaacatcctaatgcattggatttggataatgcgatggcatatgacaattctgtttccgctcttggaaagatatgtcaatttcatcgtgatagcattgatgcatctcaggtcattcctgcttggttaagttgtttgccattgaaaaatgacctagttgaggccaagattgtccatgaacagatgtgtgcaatgcttgagaagtccgacagtgagcttttaggccataataatcaacatcttccaaagatcgtatctacttttgcagagatcttgtgtgccggcaaggatctggcaacagaacaaactgctagcaagatagttaatctgctaaggcagctccaaaccactctgcctccttcagtacttgcctcgacatggtctactcttcagccacagcaacagctcgcgttacaatctgtattgacatcatagctaacccgaatgacctccgtcgtgttacatatggaattcaaagcttacctttttttcctttcttcttgtgttccattcgcacattttttgtgcttgggttgctggggtttgtgcagcatacaaatgccctgggcttttgtaccaagggcaaggtttgcatcaggtgtgtatattttattgtggagtgatgtgtgcgaggctgggatgtctccacatccccgtggcaaggttgtaaagtgacatatttggctagtgatgttagttgggtcgaatgagttgtaaattaacagcaattttgatcgttgatggttgatgtcgtattcattctgtcaacatttgttcaaaaaaaaaaaaaaaaaaa

SEQ ID NO: 35243 - DNA, 682 bp, Triticum aestivum
  unsure (1)..(682): unsure at all n locations
  Clone ID: PAT_TA_35243
cggacgcgtgggccgttccacatcccaggcggcaccaccgtgcgcgtgccatccatgacattgggccggccgtcacacaccgctctctacccgggcttcagggccctcaaactgccctacaggaccgacggcgatcggcaagctgctgcattctacatgcttatccttctcccggacaacgccactctcagcctcacggatctctacggcatggcggtgtcgatgccagagttcataaggaagcacacgccggaagaaggaagttccagtggggcagttcatggtgcccaagttcaagttcacctctgagtatgaggcgtcgtcagacatgcagaagcttggtgtcaccacggctttcaaagggggcgacttctcaggcatggtgagcggtggggatgggcggctctccatcggcggggtgctccataaggccaccatcgaggtggacgagcaaggcaccatggccgctgctgccacggccatagccatgtatggtagcgcgcttcgcagggaaccaccgcatctggtggattttgtggcggatcggccgttcttatttgccgtggttgaggagaggacgggcacaacgttgttccttggtcatngtggttaatcctcttgctaactgagtaaaatgtggaatctttgggctgntgaatagtatatttgaacattggtcatc

SEQ ID NO: 35244 - DNA, 2148 bp, Triticum aestivum
  Clone ID: PAT_TA_35244
aggaacaacgtcttcctccacaagacatttattcccttacaatcgatccgtgtgaagccaataaccgagaggttgcgtacccttggaggatctgcacagttgatctttgatgtgatacaatttgatcgagctttggagaaagcagttctgtatgctgttgggaatacacttgtctgtgacaaacttgatgaagctaaaactcttagttggagtggtgaaaggtacaaggtcgttactgtcgatgggatacttttgactaaatctggcacaatgactggtggagtaagcggtggaatggaagctagatcaaataaatgggacgacagcagaatagaatctctgaagaagaagaaaagtaagctagaggctgaaatgtccgaacttggttcccccagggagttgcagagaaaggagcttgctgtatctgagaaaataactggactcgagaaaaagttacattactcgaatgtcgaacagaataatctcaaagagaagctacacaaattggcatctgagaaacgtaatattgagaaagaaattgatcatctggagccaggaaaggaggagttggaaagccgtcttgctaaaaacgaacgggaagtaagaaagcgggagaaaaaaataaatgagatagtcgacaggatctacaaggattttagcatgtcagttggtgtgaagaacattcgtgaatatgaagaaaagcaactgaaagatgctcaagcactgcaggagaggaagctaagtctgagcaatcaattatcgaaactgaaataccagctggaatatgaacaaaagagagatatgcatgctccgattgcaaagttaaacaacacacatgagaccctagagaaggagctgaagggcttgcaggagagagaaactcgtgctaaggctgatgctgaacatatttcaaatcagatggaagagctgaaggctgaggctgaagactggaagttgaagtcagatgaatgtgagacagcaattgaggaactaaagaaacagaatgatagtgttgctgctgcattggcaaagctggatcgccaagtgaagttaaaggagggacagatagttcaacttagatcacgccaacgtgagattcatgagaagtgcgaactggagcagttaaagcttcctacagttaatgatccaatggacactggatcatcctcacaggaacttgtccttgattacagccagcttagtgaaatctaccttaaagaagtgcagctgtctgaccgtgacaaacttgaggcagagtttaaacaaaaaataggtatactaatggctgagattgaacgcactgctccaaacttaaaagcactggaccaatatgaagcacttcaaacgaaggaaaaagaggtgagcgagaagtttgaagcagctaggaaagaagagcgagaggtagctgacaagtataactctgtcaagcaaagaaggtatgagctgttcatggaagcctttgatcatatatctaaaggcatagacaaaatctataagcagttaacaaaaagtcacacgcatccactcggaggaacagcatatttaaatctagaaaatgaagatgagccatttcttcatggaatcaagtacacagctatgccacctacgaagcgctttagggatatggaacagttatccggtggggagaagactgttgctgcactggcattgctttttgccattcacagtttcaggccatcaccattcttcatactggatgaagtcgatgcagctctagataatttaaatgttgccaaggttgctgggtttattcgatcaaagtcatgcgaacgtgctggcgaagagcaagatggtgatggaggttgtgggtttcagagtattgtcatatcgctgaaggatagcttctacgacaaagctgaagcactggttggtgtttatcgggattcagaaagaagctgctccagaaccctcaccttcgaccttacgaagtataaagaagcatgaaatccactcctgttggagtcttcctacgtgttaatctgtgatggtgacaattatcgtcaactgattctgtatttcaacttgtgtatatgattagtggcatgtagttaatgtagaaacggcacaaaactacagtaccattagaagttaatgtgtttttgggggctaaaaaaaaaaaaaaaaaaa

SEQ ID NO: 35245 - DNA, 811 bp, Triticum aestivum
  unsure (1)..(811): unsure at all n locations
  Clone ID: PAT_TA_35245
tgcaggnaattcggcacgagggttttcgatttgatagagagagagctagacgtagagcggtggagaagaggaggcgattccgtcccctttccccctgctggagcttaattttctctttgattcacggttgccatggttccagggtgttgttgtggaaagctcttgtagacgcagctatttgttcagcttcgcgggggacttcttggtgataatggaggctttgacaacgctctattcaagttatatatgaatcatgtgtgttctttttcttgaagtagttgattgtgttttttatgatctttgtttggattgacccttgtctttttttgtttttgcataaagtgaatcattgaagaggaaattatcatgtgcttgaagaaggaatgttgtcagcccccattgttatactaaactctctgatggctttagtctgttcctctctttactgttgcactgcagtttcccagtgtcgtagttctgtatttaggccataattaatcttttttgcttatgtatcttattgtttgtttgcacatctcatggaatttcagtgcttttcctctgcaaattaaatgtaattatcagagtatttcctcccctgttttttttgtattatatatgtgctcatgaagtcatagagctgggtttgctgtaatgtatgtactgtattgtagttttgatttcttcacgctttgcttttgctagttccatcatgtagataactaggtcttttgcgttgtatataatgtcagattgtaggggagcagtaaatnaaaatgtatgtactgtattgtaggggagcagtaaatag

SEQ ID NO: 35246 - DNA, 634 bp, Triticum aestivum
  unsure (1)..(634): unsure at all n locations
  Clone ID: PAT_TA_35246
ngtgcantncnttcattccaattcatgggctgtactgtctgggcgccagctgttttcctgggcaaggagtgattgctgtggcattttctggggtcatgtgtgctcatcgtgttgcagcagacatagatcttgaacaaaggtctcctattctagacacgggccttctcggtgtcctcagatggttaagaacactcgcataaaaatgatgtcggatggagacctagagcgggtcttattgttcacacagaagaagcggtggcagccgcgcagatgtcgaggtttccacatggccggttgggtgttgacccatccatacaatgacccagcagcaggcagtatgtagccattcttgttgctgccaggtgtatacgcaaagttggatttcaaggatgtttacctgaaacccccaaatgatagagaatatactgatggtgacctgtaacttgatggaaccggggatctggtattctgatagttcatctgcttggctctcagatacgagtactactcagcacagagttgtatatgttgttgtaagaaactaaggccgatatgtgccacgctgtaattttcggaagatgaagcagctcatatattatggcattttttgtttttgtgaagaaaaacgaaaaaa

SEQ ID NO: 35247 - DNA, 1795 bp, Triticum aestivum
  Clone ID: PAT_TA_35247
gagccacgccccacgcgacccatcactggacgcatgggcagctactccccaatctccgtctcctacgctctggtcggcgtcgcggcggcggcggcggctcagactgctgcgcaaatgttgccgcggcagtgctttaaacacgtcttcccagccgaaggctcctcctccagcattctccacggtcctgggtccagaggtgcaggcagcaggggccgcaccaccctcaacttccaccggtgttgcgtcagggctagcctatggaggaccgatcacctgcacataagcaccgctcgatcgtccgagattaaggtacacacattgctgcaagtaccagatgttttcaataccatcaagagctggagcaagctgcaactggtcacggtgacagggctggcggcatgtgtagttctgctagtcccttctgccggtgccactgatgctctcaagacatgcacttgcctgctcaaggaatgcaggatcgagctggcaaaatgcatagccaacccatcatgtgcagcaaatgtggcatgcttaaatacgtgtaacaatcgacccgacgaaaccgagtgccagatcaaatgtggggatctgttcgagaacagcgtggtcgatgaattcaacgagtgcgccgtttcacgcaaaaaatgtgtccccaaaaagtctgatgttggggagttccctgtccccgatccatctgccctggtcaagaacttcaacatggcagattttagaggcaagtggtacatttcaagtggcctaaatcctacttttgacacgttcgattgccagcttcacgagtttcgtctcgagggagacaggcttgttgcaaatttggcatggagaattcccaccccggacaccggcttcttcaccaggggggccgtgcagcggttcgtacaggattcctcacaaccagcaatattgtataaccatgacaacgagtacctgcactatcaggatgactggtacattctctcatcgaaaatagagaacaaggacgatgactacatatttgtatactaccgtggaagaaatgatgcatgggatggatatggtggcgctgttgtgtacacaagaagcaaggaattacctgagacaatagtccccgagctagaaagggctacgaaaagcgtagggcgggacttctccacatttatcaggacagacaacacctgtggtgctgagcctcctcttgccgatagaatcgagaggactgttgaaaaaggggagaagctcatcgttgatgaggtaaaggagatcgaaggggagatcgagggagaggtcaaagagctggagagggaggaggagacactggttaagaggttggcagatggcatcatggaggtcaaacaggatgtgatgaacttctttcagggtttgagcaaagaggagatggaaattttggatcagctgaacttggaggcgaccgaggtcgaggagctcttcagccgctccctgccgataaggaagctaagatagctacccccagcagccactcctgcctatgcaaggaggattgcagaacagggtgccatccagtggtgagcaaagtagattctaattgtcgaggcaatacctacagtaacagattctccaacagaaatcaaaattttgaatctgataatgttttacccactggcgcaacatgttcccagattagcttatgtgtaaagcatcagtaagtatgtaaattttgtccaaaggaggtatataaatgtatacaactgttcctattatactctgggttaattaaatactacctgtttctggggataaaaaaaaaaaaaaaaaaaaa

SEQ ID NO: 35248 - DNA, 938 bp, Triticum aestivum
  unsure (1)..(938): unsure at all n locations
  Clone ID: PAT_TA_35248
ggcatgggattgtgcggttcttcgctaggtcctcggtgtccccggcgttggcggcctccccgggcctgcggtcccccatcactcatgtggatgtgacgtacgatgggaagtggatactgggaaccactgatacctatctggtactcatatgcaccattttcattgacaaggatgggaaggagaagacaggatttggtggaagaatggggaaccgaattgctgcaccaagactgctcaagctcagcccactccactctcatcttgcaggggacaacagcaagtttcgtgagggcaggttttcatgggtcacggataacggcaagcaggagaggcatctcgtgacgaccgtggggaggtacagcgtggtgtggaacttcctccaggtgaaagaacagccaccaagagtgctacaagaagcaggaggggctcaagagttgctactgctacaaagtgatccccaaggacgagtccatcgtggccagtcgcttcatgcacgagaagtacgacgtgagcgactgccccgaggcacctctggtcgtcgcgaccccgatgcaggtcgcctccttcagcggctccagctagcgcttgctccccactgccgcctccatgggggtccgtctcttcatgcatgggagttgcggcccgtgcggccgccctacgtcgcctctggccgacccggcccccctggtgggcacctccctctccgtcgctggcctgccctggctccggatttatgattatgtggattgctagcaaaactatcttacgcagtgctcccttctgccggctggcttcatgccgtgcggctctggacgtccgagtgtgatgatgactatctatctagtcatggcttgttacaggatttatgagttatgtggattgatagccaaaactatcttacggattgatgatttgtacggctagatnattcnaacttc

SEQ ID NO: 35249 - DNA, 676 bp, Triticum aestivum
  unsure (1)..(676): unsure at all n locations
  Clone ID: PAT_TA_35249
tgaagaggacctcatagaaggctgctgcagtggcagtagctctgggaggaatgatggcttggatgtgccactactgcttgccttccacagtgggaagtcttacggagaagctgatagagatcgcaagtctgctgtcaaggctgatgcccacgataaaccgagagcagatcctggcacatataacaggcaggtttgaatttgatggcctttacaaacggccagcggtgccgttaattttgccaggcatattcacacctgcattggcgaggggtgagcgcttctctgtgtgtgtgggtacagaccatcactctgctctcagccaggcttgtgtttccccactccatgggttattgttgcttctactgaacacttatcacataccgtattgcgaaaggaagacgatgttcaactggctgggaagctgtctcccaagatgcctgcttcgatcaataacagggtcactccacgtatagaagatcaccccctttgtatttatcgtctanggataacgttttctttggattttggtattgccatatatgtttgtgcatcgaaaaagatttgtcttggnaagcaatcctgttattagaggatttttcctttttgcccaccacccttggaaacaaaagtttaaaatggatctcatgaatctggatcacggataggcacacaatca

SEQ ID NO: 35250 - DNA, 1264 bp, Triticum aestivum
  Clone ID: PAT_TA_35250
gcacgaggcctcgtgccgaattcggcacgagggagctctagaatttcatgttaatttgagctgttgactgggccgtttctgttgttgaattactagattaggttctggtgtcttggtctgcaggcgtgcgtgagctctggcatggagagcttcataagtgtctttgagtgcactggatgggagagttatgttactcgctcacccatggagttctccaaaattgtctgttgcttcctactctccgggatcatctttaactgatttaatttgtcccaagttgtggtaattcaggagagagacaacgtcgtcatgttggtcgctgagcaagcagatcaaagcacaaacacgggagttatccgacaacaacgacgaccacgacatcgttccacttagacttagaggcaagagcaatgattccaccggcagcagagatcaacaagttcttctccatcggagagtaaatgcttcaccgccaactaagtgacaacttaactaaaagaagtacaaattggacatcatgtgaggcgtgacgctcaaatccggcaaggaagattgcggccgtgcacgtagaatggaaaaggtgcccacacaatgaaaacaagtctggaaaaggaggttagctgattaatcacagacataacgcaagagttatggtacagagaaagaacttcttcattcaggattacacgtgtcatgtgtcatagaccagcattggaggcaagggatcacttgtacttcgtatgcccttttgcaaaactctgttggcaatatgtttgtccttcatggaaccctccctactgggacagatattcaagacgaagttgcccatcgcaaacagttgctaaatctgccttttgccatggacattattatactgatctcatgggcaatttggaccacaaggaacgacttcatcttccagcacattcctccaaatctctataattgccggcgtcgatttaaggaggaagtaaaatggttcacctacacgacaaagagaaaggagctcactgggcctcatggattgggttcaggttttcagatacagctcttgatagctttgttgtatctgttgtattttctgcctttgtttgttttgctttttgtactttccttttgattgtatagattatttttgttttgaacctcaccatctactccctttgtccgaaaaagcttgtcccaagcttgtccatcaaatgaatgtatctagcagtaatttggtgctagatacatccattcgagggacaagcttttcggacga

SEQ ID NO: 35251 - DNA, 1059 bp, Triticum aestivum
  Clone ID: PAT_TA_35251
caggagctagtcatcaccagggcaaaagtaactgaagagggagagcaccaagcgaaccagcacttgcggcggcggcgagatggcctcgggcaatcgcgcactcccgatcgagaacggcgaggtcctccctgccgccggaggcaatggcgagggcgggaacggcggcagcggcgacggattcaaccgcaaccgctcctccgtggaccagcagatcgatgatatgcggaggaggctgcgggagttggaggagaccgagcgcgagatgctagccgccgccgccgccgctacgcatgaagatccagctgcagcggtaaccgcactcgaaaaggcagaggtggatgctcgctccatctatgttggaaatgttgactatgggtgtttgccagaggaagttcaggagcattttcaggattgtggaactatcaacagggttacaattctgacagacttttatggcaaccccaaaggatatgcttacgtggagtttcatgaagctgaggcagtccaaaatgctctccagctgaatgatacagaactgcatggccgtccattgaaggtgtgtccaaaaagaactaatgttccaggaatgagccaccataggggaaggcacccgtttcaaccttactatcccccctatccagcatttgggaggtcacccaggttcaggaggtcacccaggttctatccctattactgattctgccgggttgctgtgacttcagttttttgctagcgaatttccatgatacatacagaagatacaggcaaagacactgaaaggctgcgacttctgaaagttacatagtctccttgttgtcatacctcccatcagaccatgatgacatcacttttaccttaggaatgaacctatgttccgaattatcccgtgatcagccggcctggtgggttttataccgttgactttagctttgaagttttatcgaattttgagtcagaattgttggcaaagttgtgtactctgcttgctctgatgagttctaagcagttggacctgaattatctgcaaccattggcgatatacattatgcctgttagttc

SEQ ID NO: 35252 - DNA, 1124 bp, Triticum aestivum
  unsure (1)..(1124): unsure at all n locations
  Clone ID: PAT_TA_35252
cgtccggggctgggcggaggtgggcacggaggtgaggacgtacgagcagaagcacatgtgcgacgcgccggcgaacgacagcgtagggtggagggatccgggcttcgtcttcgatggcctcatgaatgggttggagcccggaaggaggtacttttacaaggtcggtagtgacccgggaggatggagcaagacatacagctttatttcacgtgacagtgacgccaatgaaaccattgcttttctcttcggtgatatgggcacttatgtaccatataacacctacatccgcacacaagatgagagcttgtcaacggtgaagtggatcctccgtgatattgaagcccttggagataagcctgcatttatttcgcacattggggacatcagttatgccagaggctatgcttgggtgtgggaccatttcttcagccagattgagcctattgcagccaatactccataccatgtctgcataggaaatcatgagtatgactggccttcacaaccttggaaaccttcgtggtctacatatggaaaggatggtggaggtgaatgtggaataccatacagtgtcaagttcaggatgcctgggaattctgttctacctactggcaatggagctccagacacacggaatctctattactcttttgattcaggtgtcgtgcattttgtgtacatgtcgactgaaactaatttcgttcagggcagcgaccaacacaatttcctaaaagctgacctggagaaggtgaaccgaagtagaaccccatttgttgtgtttcagggccaccggcccatgtatacctcgagcaacgaagccagggattctgccatgagacagcagatgatccagcatcttgaaccgcttttggtgatgtacaatgtgacccttgccctgtggggacatgtccataggtatgagaggttctgccccatgaagaattcacagtgtctgaacacatcatcaagcttcgtataccctggtgcccctgttcatgttgtgatcgggatggccggacaagattggcaaccgatctggcaaccaaggcgtgatcatccagatgttcccatctttccacagcctgngatctccatgtaccgtggtggtgagttcgggtacacaa

SEQ ID NO: 35253 - DNA, 432 bp, Triticum aestivum
  Clone ID: PAT_TA_35253
cccacgcgtccggcagcacacggccgcgggaactgggaccggcggagattacgggcagcaagggcacccaggaatggccggtgctggcgccggcgagaagaagggactcatggacaagatcaaggagaagctgcccggacagcactgagctgccggccccgactggctgtccgctgccgactagccctcttgagttaagcttgagctgagtaaataagatgcctgcgaatatttaagggtgtgttttgttgcagtttgcaatagtagttgcattgcatgtccaaaaaaaaaaaaaaaaaaaaaaaaaaaaaaaaaaaaaaaaaaaaagatgcaaaaaataggttgcctgcctgcatcgcatagagggcatttacccttcgtgtttggtttccgtttttgtgcttagaatgtgagcagatgcgaaaaaaaaaa

SEQ ID NO: 35254 - DNA, 1433 bp, Triticum aestivum
  Clone ID: PAT_TA_35254
ttttttttttgatgcttgacaacggctattccatcagattacctttctaatgcctgttcccctctcaacactatttccagacagcaacatgaacgagagcgagggcggggatcacgtcgccgaactcaagcgtaagaaagggaagaaacccaagcccctgaagtggagatcaaccaacagcgacatgaacaatcatcgcaacggcgaggccgaagaaggttccgacggaggccgcgacgacgacgatacggtcctctcctcactgaccagatccgccactcctagcagcactggcaaagaaattactacagcctgggcaattgcaaataatgacaagctttcccttcctgaaaatggtggctctgcaaagacatggaagagaagtgttacccatgcctatgtgagtcatctcatccaaaaccatttggacaaagataaggcgtcacaaaatcaagtaatcacccaggagagatcacacagccgcatttcaagctctccaagcgtctccaccttgaataagaatggcatgcatttcgacggggggaacccagttcagccttctatcggggtttgcgacatggctcctggtcggcaagcaatggtcagcactgattacctgaacttgcccacctcggcggcattctcggggccacagtatgttcagtatatgcatccccagatgatcgccactcaccacggtccggcgccgtatcagtcgtattcgcatctcccttgtagcagagggaatgtggcacccgtgatgtcgatccagcagcagatgcagcagtacatgtgcggtccggggtacgcgccgcaccccggcgtgccggcgagccaggccgccatgaagctccagcagttcgcgccgactccgcagcagcagcagcagatgtggcagtaccatttctcccagtaccagccgaggcaggcagcggagggcgcggccgcggcgtggcagagcggccggctccgggacatgccgtcgtccggctccctgcggccgatgcaggcgctccatgctcccccggcgatggcgccgccgcagatggagctcctctgcgcgccgtaccagggcggcggcggcggcgccgcccggccgccgcagctcaggctgatctagtagtggtgagtgagagagtgatgtgtagatcttaaaagaaagaaaggagatcgtcggtccccggcgctgcgtttactttgacctgacaacagaggatggttctgagaaaattatagcagtcgtgtgatgtgacttatgacttgtgagtggctgaggccgggagggggagggggccaaattttaaactgtgattagcataattttctgttcgtcgaccagttttaaagttttaataatgtggaaatgggatactgtagttttcctctgtgttccatgtggaatttaaggccgatataaaaaaaaaaaaaaaaaa

SEQ ID NO: 35255 - DNA, 528 bp, Triticum aestivum
  Clone ID: PAT_TA_35255
ggggaccggtggaaccgcacctggggcgagggcccaacggctccggctgggtgacaagtacgggaggagcagtagtggcgagcactgggacactcacgagccgcaggagacgtggtacgagcgctacccgcatttcggcttccaccactgcttcgagaactcggtgcaactattgtccgttcccaggcagcctccaaagaatttcaagcctgggaaatgagtagatgctccttaactaggaacatctcatctgcagtcacaatctgcatttccaaagaaaagctattcataatctccgagacaaatgcattcatccgtggtcactggactcgtccccaatattcacgccggtcattggacacatgaatacctagattatggtcatggaactcgcattagttttcattttcaaagaggggaataccctcggggtttttgcatcgagtgatgcacacaacaatatattattaattattcgcagtgccgtccgtgccgccctaaaaaaaaaaaaaaaaaaaaaaaaaaaaa

SEQ ID NO: 35256 - DNA, 1534 bp, Triticum aestivum
  Clone ID: PAT_TA_35256
ccccccggccgcggataccgagcgcggccggcggttcgcccccttcccaaatcccggcgacggcggtcggtcggacggagaggagatgcggccccgcacggcggaccacctcgaggcgctctccctcgagatcgagcgcaagctgcacaaggctctgaattccaactcgcagcgcctcaagctgctgcagcagctgtttgccgacatcgcgctcaaggtcgacgaccgcgctcgagataagattttaagcaccaataatgaggggatcgctccagtagacgaccgcgaagacggccatttgtgcttcctatgcagattcttgacacatcactatgcgaaaggttccccatgagtggctggcgtatcactttgtgttggtcccgcaacgcgggagccgttcccttgcggccatcgtgctaccctggcgccttccctgtgcggccttcatatttgcgcttctttttcacagatggttgtttgaagtctctcttgcgggggacgaggtatcactaagatacagctctgctcttgtccaagcagctactaacgtttttttggattgacatccaaatcaacacaaggtacttcctcccgttgtagctctatctccttgaagaagtcgctttagttccagatcaactcattaagatatcaccacaggctggtagaaatttattctgcctcctctccagattcatgctgttctatgatcaggatcacttgcttacaagttttcttgggcatttccctgcttttccaaattctttcttggttggtggagctgcagattactttgtgattgaactcaccgatcagctccagaagctaaaagtggagccagtactgctgcactacctttcccgcatgaccatccttcaaggctgggagttgaggatgagtacaagcaccaggctaaagtcatgcctgtatagcttcacatctcctggaggccctgcctatccaacaagagccgtccggcatgcagcctggaatacgttggatttactttttcctgtgggtcgctatccgaggcacgtgataagtctgttctttcggctgctctatccatggtattggccttcctcttgctggaacttcgtcatgacctgcgtgagcaccatctactactacatcttgaatctcctcgtctcgatctgggagaacatgaggaggcgcgaccatcaaaggatgcacagagaatgaagaaatcgcgaccaggcctaaaccgaggctacaatgttgtgttgttgttccttctgttttacctttaggatggttagcttcatgtgtgtgcgcatgaaatttgttgtataaatccaagtgtctgttgtgtttgttatacatggacagaggatgtgatgtggggcagagttgtgcagtgagagagggaaggaaggggcagtttttatgctcaccagtctgaagctgtaatttgtatacaacattcagcagcttctccaaatcgccatcaaaggtttatatgctcttagaggagttggcgcttttgcggaatacgttttgcccataccagctc

SEQ ID NO: 35257 - DNA, 967 bp, Triticum aestivum
  Clone ID: PAT_TA_35257
gcgacacggtggtgctggcggcggtgtacgggccccggccggggacgcgcaagggggagaaccccgagaaggcctccgtcgaggtcgtctggaagcccaagaccggccagatcgggaggcaggagaaggagtacgagatgacgctcaagcggacgctgcagagcatctgcctgctcactgttcatcccaacaccaccacctctgtcattcttcaggttatgggtgacgatggttctcttcttccatgtgcaattaatgcttcctgtgctgcccttgtttttgctggcgtccccatgaaacatcttgctgttgcaattggctgcggagtgttggccgatggtgctgtgattttggacacaagcaaggcagaagagcagcaattgaaatcgtttgctcacctggtgttccccaattcaagcaagtctgttgatgtgaaagaatcacaacagaaagatgggcagccagaacggggcctgataacttccatcacccatggagtgatgtccgaggacgattacttcaactgtatagagaggggtcttgccgcatccgcgcggatctcggatttcatgaggaccaccttgcagaagcacacacctgactacctttgagaaaagcgtcgaaacttggcgtgatttattggacaggtcgtgttgcaaacatagcgccttggtgactttggggcgtggttgtgttggcatggaaagcatgcacgaggaacaattttgcaggaaaatgcagcactagcttcattttggaatgttgaaccactagaatactatatagctgttcttgccctgtagaaccttaattatctgttgtcatccatgttgtgctgattgaatagaaagggttatttgggctatgtatgtactttttgtgcatatatagccatcgactccacaagaatatagcagcagatcgattcagcaggtggttttcacgtactaaaccgttgtggcgcatg

SEQ ID NO: 35258 - DNA, 624 bp, Triticum aestivum
  Clone ID: PAT_TA_35258
aatgggccctccgctggccgtttctcgtttgcacacacatttacaacaggcatcccctttggagtaaatgatctgtatctgacccaatgggatgaattgatggaccccaactgtatttttgtcattaaaggccatttgcacattagaatgcgcatttctgctctccagccatagggttcaggtaaggaggtctccagcatcagtcttcaggccaagtagctcgtccatgttttagcgtgtccttcagacctgacctgtggtaatctgtctgtgattctgatgactgttaagtctggaagccaaggagctttgcatatcatgttgtttagcctgcccttcagacctgacctgtggtaatctgtctgtgattctgatgagttaagtttggaagttttagcctgtccttcagacctgacctgtggtaatctgtcttgcaaggagctggtcttgcatatcatgttgtttagcctgtccttcagacctgacctgtggtaatctgtctgtgattctgatgagttaagtttggaagttttagaactttctatgctaagtatggtcagtagtatgatgaacagagcactagatgccctaatctactcctatgctaagtgtcttcaaaaaaaa

SEQ ID NO: 35259 - DNA, 1524 bp, Triticum aestivum
  Clone ID: PAT_TA_35259
cccacctgcaggctgcagcatctgttccgcgtctccggcccctcccccccgatctctcggccgcgaccggcgccgagaccccgccgagttcggacgccgccgccccgcccgggcgccccccgccggctcccggccgtgtcggtcggggcggccacctcggcgtccgcaggctccgccccgcgcgggggccgcccggcgagatagggacttttttttgaattctgccagtatttttgtcccgcttggaaacctgtgttgacacccggaaaagagattgccagattcttgacacttgtgatatttttcgtgtctgtcgggctcatacagctgcaagctgcaggcatatttcaaagactcctccatcgctatgatatggattgagaaagtgaaggtacaataccacatgaaagctccaatttatgtgtattatgaactccacaacttctaccagaatcagcgtaggtatatcaaaagtagaagccacaagcatctacgctatgggctgaaatacactgatagctcatgcagtccaatagaaaagagcgacggccttccaattgttccctgtggattgattgcctggagcttgttcaatgatacttatgattttacccgtggatccatgggaatagtggttgatcggaaaaatatttcatggagaagtgatcgggagcataagtatggcaaggatgtctatcctttcaactttcagaatggatctttgattggaggaggaaaacttgaccctgatataccactaagcaatcaggaagatcttatcgtgtggatgcgcgcagctgctcttccccagtttcgaaagctgtatggtgtcatcgaagaggatatacaagctgatgaaatcattaccatgcacataacaaacaattacaatacctacagctttggtggaaagaaaagcctggttcttacaacatcaacctggctaggtggcaagaatgactttcttggatatgcatatcttatcactggttcctcgagcattttcttgtcgattctctttgctctgatccatgtgaaaatcccaaggccacatggtgatgctgcttacctatcttggagcaggaaaaacggcaataactaagcttctgtgcatagttttttctttgtgtaagctagcagtacagcaccctggccagaggtttccccgcggcgttccgtctgcgcaccctgtctcgagggaaatggcatagtagcagcttcaggtttcatacactcgacacttggacggagcatgaaatgcgtagcagcttcaggtttcatacacatacttgggagcatgaaacgcttgatgactgctgagggtatacggtggggccggcgttcgccgccccggtcgtccgggtccgcccagcgcgcgccccgcgccccccaggtaaactagagccgtgtaaaaactgatatatgtgtatgtaaagcgccataccatggattccatgatgttgtatgaatgaatacatataatgtttcagtttcgtgccgatgtcgaaaaaaaaaaaaaaaaaa

SEQ ID NO: 35260 - DNA, 1000 bp, Triticum aestivum
  Clone ID: PAT_TA_35260
gccgccgcgccccgccccccgccgcccccccctccgccccgcccccgtgcttcctccaccccgtcggtgcgcgccgccgcccccccgcccccgccccggctccccccgcccatctgagcccctccgtcggcctgccccccctcccgcggccccccccatcgaaatcggtgcttgccggcgcccctaccctctctcctccctcccccccccacgatcccgcgacgccccacagcccctccgtcctccagcaaatgcccccgcggcggccgcctgcacccccgcggcttctgcactccccgaccgtcactacgtcgtcgcgccaccaccatgcctccgcgctgatctacatctgacggccgggggccggcggcctcttccccgtcggcgggcgctgtgcctgctccgcacgtccctggatcctagggctgcgcccttctgtcatggggggatccagatgcaaatgttacagtaggtgctcgccccttctttcaggagcacgttggcatcacactggaagatattctgggtaacatgtagttgtactagtgaactaggatgtctacatggtgattcatctgttcatagtgacaacacaatcaggtggggtgaggctatcaatctgtgatctttcaagcattgcaagtttggtgctcttctgctggcgacatggggccctctttgaataatgcagtttcacatgatgatggcgagtctggttttcagaacatctcatgaaaatggcaatgtcatttggcaaacggctgtgctgaaatatacacaagtgtgaacatgccattgtttcctagacatagttgtagccatatgtcaagctcaaaccgttagtgtagcttagtttgaagacatgacatcttattgtcgcatgtaaattatgtttaccgatgtggttagttgctactgaacacatctatggatgtagaaatcttgaatttttagtttgaattgtttcaggtctaaaaaaaaaaaaaaaaaaaaaaaaaaa

SEQ ID NO: 35261 - DNA, 1070 bp, Triticum aestivum
  unsure (1)..(1070): unsure at all n locations
  Clone ID: PAT_TA_35261
aatgcgcgagtaccagcattctgctgacaaggcgaaggtgactgcagttgaggaaagcgctaatgaagtgctccccgagaatcccactgtacataatcctctggcagtcactactaatctcacaccatgcagtgagattatcgaagaggagagtgaacagaacacatcttttaagctggataatcttgcagccggcttttctaaccaaccagccgggcaagtgcagcaagttgaaaataagtctttcactagtcctgacagaacagtcaagcaagcacagcaagtcgaaaataaaccgatgattagtcctgaggtgcagaaggctttgggcatactggacactgccattgcagttcttcaaggcaacagatctgcaaacatcaagtgctctcagaaagctcctcagttatgatgcggcgtcggaagaaggcagtgccatcacgtacaagaaattcacataccctccgacgttctcgatacagacaatctcccaaatggagagcctcggcccactcctcctctgcattcaagagagatccgccaaacttatttcttgcccgataaggagatgcgcgacagggaggaaggtgctagcgaaagtgattctcctaaaaccatgaccgcttctaccacaacgacgacaaaatccatgacattgaggagcacaataaaggtgcatgaagaagagaccctgaatagcgatggcctctatcagaacagtttccacaatggaaaagagcccaagagaccaaagaagaccaaaaggtggctttgctgcttaacgcctagcaccgtaggatgacgagaacccatcgtaggggctctcatggttaactcttgatttttttggttggacatcagaaaatagacgagctacacaagatggaacatggggatcaaatgacaattccggaggcagcttgtgagatagttacaaagattagatcatgtctttggtaaatgtatagaagttatgttgttgtaacaccatgtaaaacattattagagcatctccaacaaataatgtaaaacttggtgctcaaaaaacgtttttagggcatnananagna

SEQ ID NO: 35262 - DNA, 1114 bp, Triticum aestivum
  Clone ID: PAT_TA_35262
tccagcggccgccccgccagggcttcgatgtggtccgcttgcgccggcttctggggtcctgggttcctggacaggcacactcgattgcgattttctcgcaacttcaacgtgtaaaatcactaaggctgggatcggaggccctcttgttactcttgatggggatgttattggcatgaatttctatgataagagaataggaacccctttcctgttattggtggacatttacaaaattctagcatcgtttgagataaaaagtgaacttggtgaagttggcaatgataggcacccccctggagcgcctttttggaaaatggatgaagatgacaaaactaagttaaacaggtggcctgtgcccgggcaggcacgcttgattgcaatttcctttcatgttccacatgtaaattcagtaaggctgggattggaggccctcttgtcagtcttgatggggatgttattggcatgaacttctatgataagagaataggaaccccgttcctgtttttggaggagattttcaaaattctagcattgtttgagacaaaaagtaaacttggtgaagctggcaatgatagtgatccctctggcacgcctttcttgaaaatggatgaagatgacaacaataagttgaacaggtggcctgtgcccatgccgtgctggcgcaatcctgactacgtggatgaggataagtctgatgatgatgatgtctttgatcccaaatctggccgcacactgagatacggttacttcaagggaaagaaagtcatgctcttttagatgcagtcacacccttgtttggtcacacaatctccatatcattgcgtgtttgagatggtagaacacgtgtcttgcttaagtcttattatgttctgcgtctgtatattggaatcattcagtgttatgttgtgtaatactccctcgtatccaaataagtttctcagttttgaactaaggttagttcaaccttggttcaaaactgcgacacttattatggatcggaggtactccctccgtatttaaatatagcttttgtagagatttcactatggaccacatgcagatgtatatagatgcatttatatttaggaacggagggagtccttcagaccgacga

SEQ ID NO: 35263 - DNA, 599 bp, Triticum aestivum
  Clone ID: PAT_TA_35263
ggtgcaggaagccagacatgtccgccacggcgctgagagccccgagggtggcggccatcctcctggccgtggtcctggcggcggtgctcgccacggccgtgaacggcgaccagaagtgcggcgaccaggcccgcggtgcaaagtgccccaactgcctctgctgcggtaaatacggcttctgcggcagtggcgacgcctactgcggcgaaggcagctgccagagccagtgccgcggctgccgcgacgacgtcgtgggggcaggcgctgcctgccgaaccgggttctacaagagctactgcggcgtcctcggcgtcggccacgggattaaacttgactgctacaaccggaggcccttgaacagtggcctcacggctgggctcgcatcgcagtgaagacgggcggtgactacatagagcgtgggccctggacgaataatctcgagaagtattagtatgtgaaaaaaataatggatgaatgatttcccattggtcttgtctttggcatcagcatctttttgtcttcaataagaaatgggacagagaacttgggggtggtaaaaaaaaaaaaaaaaaaaaaaaaaaaaaaaaaaaaaaaaaaaa

SEQ ID NO: 35264 - DNA, 426 bp, Triticum aestivum
  Clone ID: PAT_TA_35264
ggtccaagatacccgggtccacagttgtccacttacacaagcacacccaccaacctccaaaggctgctactgagctcaatgtccattgccaatttgccatgttgtcagatagctttggaaaggtgtttgtcaaatcttaagtatctcagaggtttgcacaagcattgctgctgcttggtccataccattagctcacattcttcactgctgttaaccaatatcttgtcctgggtctgccaagacgattgcttgcctcctagcggaggaggtttctacgggcaaaatgaagaaggtgaagaaggctatcaggagcataggcaagaagactgacgtcattatgaaggcgtccgcggctgcttaatggaagatgctcagtctttttgtcatccatcttcgattgacacgcctctgtggatttggtggcgt

SEQ ID NO: 35265 - DNA, 1161 bp, Triticum aestivum
  Clone ID: PAT_TA_35265
ggggctgctggcccctcctcccctcgtgtcgggggctgttcgccctcgtcccctaccgcccgtcccccgcggtctgcctcgctgggccaggcccctcccacgcgtctgccaccggcactgccgctcgcgcccgagcttggggagctgccagcgcgtggctcagcccccagcacgacgtcctccagcgagagccagtacttagcgacgcccccggagatgcaggtggtttctgtcgttgccgaagctcgcgggtaggtatctctcgtgtcccgaaggacgttgtcggtttcgcaggtggttggcatgccgttgccattatggagtcatcacggcggtgagctcgtcacgccggtgctgcggattatgtctgagcttcagaagctttgtggggagcccactttgcctatttcgatggtgcttcccgaggagatagggtctcttggaggggacttggcgatgccgactgcgacctcatcgttttcattggagccgagtcagccgcttgcctttgtggaccttggaggtttggcggctgctgctgctctctcacctgaggttgttggcccggtggcgtctgttggtgctgagtttgatgaggtaggtgctttgacacctgtgtctaaggcgccgaagcccgtccagtctctcatctttgaccgcgacgctatgttggcacgtattgatgaggtggtcttcgcgaaaaagcttggccgcttgctcaccagcttggatgcagcttgtcctgggtctgccaagacgattgcttgcctcctagcggaggaggtttctacgggcaaaataaagaaggtgaagaaggctatcaggaacataggcaagaagactgacgttattaggaaggcgtccgcgactgcttaatggaggatgctcagtctttttgtcatccatcttcgattgactcgcctctgtggatttggtggcgttcggtggtttcgttgagggtttcgttgcgatgtcattttgcgagggcttatggttgttgcatgttatgtatgtttgttgggttgaccatggtgtcatggagtttctttcttagagagtagtccgcatgtggtctatatgtatcggttttcgcccggttttcctttaattaactgggcaattctcttcttcttaattaatcgatgaggcaaatcttttgcc

SEQ ID NO: 35266 - DNA, 523 bp, Triticum aestivum
  Clone ID: PAT_TA_35266
tgcgggccggccggcggccggccggagccatcaccaaactaccaaaaccaatcccctcccaatccaacctccaacaccgccaatatgcctgccgcgtggagagccgctggtcttacctacaaccgctacctggccatcgccgcccgcgttgtccgccgcagcctgaaggacgacaagagaatcgttgccgagcgccgaggcgagatggatctccgattttccaagtgggagaacggcaagcagggcgagatgcagaaccttgccaaggccaacgctgccatcgccgccgagaacgccgcttaaggaatttgactcggatggatgattgcgtacgggatattggaagcatggcgcctgaagggggattgctcggatgggatgagatggaacttattcaccaagagccgccgatcgcatgaacctggtgccactgtatcataatgattgctacaatacatcaatcaattcaaaaactacgagaaaaaaaaaaaaaaaaaaggcccctaaaaaaaaaaggccccta

SEQ ID NO: 35267 - DNA, 613 bp, Triticum aestivum
  Clone ID: PAT_TA_35267
ctgtgcgccggccgggccggccggttcgggaccaccaacaatcaactccatcttccaacaacatcctccaacactttcaacacttttccactctcccaaaaccaacttcatcatacaaaatgcagttctctactctcaccactgtcttcgccctcgtcgccgctgccgtcgctgctccccacagcagcggaggcaacaaccccgtctgctctgctcagaacaaccaggtctgctgtgacggtatcctcaactgtcctatccaggttctcggcagcaactgcaatggcaactcttactgctgcaagactgacgcccctgttggctctttcatcaacgttgctctcctcaactgtgtcaagttcctctagaggaccagttgcattagcagctcgcagctctctctctgagtgctaggatgtgcaggatgggttgattggttggataatgggaacatggtgtggaggatactgacggggaaggcctctgctagctactccgtgtcaatagggtcttcacttctactataacttggctcgacttatatactattatttccgaaaaaaaaaaaaaaaaaaggcccctaaaagaaaaaaaaaaaaaaaaaaggccccta

SEQ ID NO: 35268 - DNA, 589 bp, Triticum aestivum
  unsure (1)..(589): unsure at all n locations
  Clone ID: PAT_TA_35268
gcggcnncgctcgagggcgggccttcccgcggaaacaagtcaatagagacatttaattacatccacgaagaataccgattaatcatgactcttactcacactgtcctcttccaattcaagtcggatgttgatttatctgaaatcaaagagatttgcgattcttttcttgctctaaaagaccaatgtatccatcccacaagcaacagtccgtacatcgtttcacttgtaggcggcaaagacaattctccagagggaatgcagaacgggttaacccatgggttcgttgccattttcaactctgcagaggatcgagactactatgtcaaatcggacccagctcatcaagtttttattgctaaagtgggaagcgtccttgaaaaggccactgtgattgactttacggacggagtcttttaaggctgacttaggggtttgacttggggatctctgtcaagtcattgtgcttgggctcgccattgggagagagtagcgtttgagtagaccgtgaacctgctgtagggaatagacaatgccttgtaaaaccagcagaggcaatacataaaaaaaaaaaaaaaaaaaaaggccccta

SEQ ID NO: 35269 - DNA, 615 bp, Triticum aestivum
  unsure (1)..(615): unsure at all n locations
  Clone ID: PAT_TA_35269
gggtcgacacagccgtagccgtcttggcaaaccttgccacaataccagaagggaggaccgcaatcgggcaggcccgtggtatcccagccctcgtcgaagtcgttgagctgggttcggcacgggggaaagaaaatgctgccgcggcgttgcttcagctatgcacaaacagcaataggttctgcagcatagttctccaagagggcgccgtgcctcctctagtcgcgctgtcacagtcgggaacacctcgggcaagagaaaaggcgcaagctcttctcagctatttccgcagccaaagacatggcaactcggcgaggagatgatgatatgatgttagcatcataattttgtagtgtacatgaagcatttcccgcgaatggcggttaaatttgttgactggctggtgctgtgcactgtttgtttatagtcagattgagagagattgtgctcatcatccgtcccatgctacttaccgtcgggtgtgggaatgagtgcgggcgttgggttgtcgtcattgttgttgtgggggtggtgtatttggtgggtttgtacaatttgtcnttccgccgnatctaattnancnaaagatgacttggtggtttttgtaaaaaaaaaaaa

SEQ ID NO: 35270 - DNA, 660 bp, Triticum aestivum
  Clone ID: PAT_TA_35270
ctgtgccggggccggccgggcgggcatcaacattcactcacaggtcatcaatcacaacagcaacaatgggtctcagccactttgcactcccctgcggcgaacactacgtcgagatgcgagatttctacaaggccgtcctcgcaccactgggctacgagttcaagtttgaagctcaaggacctacaggcgcatactactgtgcgtttggcgaaaagaacaagggtcctgacttttggcttggcggcgggggcagttctcttaagaaatacgatggcaatatggagaacagaacgtgtcctgttcatttcgccttcgatgctgagaatccgaagcatgtcgatgagtggcatgaggctgctatgaaagctggtgctgttgataatggaaagcctgggccgaggaattacaggcccgggtactatgctgcgtttgttctcgatcctgttggaaacaatgtcgaggttcttcacttgggttaagggatttgaggttggtgaagcgtcgggaggactacaaggaacttgaacgcgtataggcacaacagtgctattaccataccaactgcatcctagtagacagctttatttgttacaagataacaagattgaacatctcaaaaaaaaaaaaaaaaaaggcccctaaaaaaaaaaaaggccccta

SEQ ID NO: 35271 - DNA, 458 bp, Triticum aestivum
  Clone ID: PAT_TA_35271
gccggcgggctcggggttgtcctcagtccatcacccaattcgtcaacccaggtctcgtcttataatacacaatggctggtatcgcttactacaccattgccggcaagcaggtcgccggccactacctggccatggcctggttgggaaccctcttcgccggtgtccagtacgccacctctggaagctcagctaagcctaccgctaccgctactcctcccatcaacgcctccagctccgacgaggccagcttcatccaggacttccttaaccagcaggacaagaagaactagacggttgcatcaatgacaatggtcatgcggttatttggatgcggtgtacgtttataagccatggaagcataagcggtccatcgagccggacagtcaaattcagataccaacaaaagcctgtttcgccaatcgtggcatgatgaaaaaaaaaaaaaaaaaaggccccta

SEQ ID NO: 35272 - DNA, 589 bp, Triticum aestivum
  unsure (1)..(589): unsure at all n locations
  Clone ID: PAT_TA_35272
aatatccnacccttgtgtgcagcgctcgagccggccggtccgggggcaaaggatctcatccgcgacactttgaacatctacccgttgtcctcagtccatcacccaattcgtcaacccaggtctcgtcttataatacacaatggctggtatcgcttactacaccattgccggcaagcaggtcgccggccactacctggccatggcctggttgggaaccctcttcgccggtgtccagtacgccacctctggaagctcagctaagcctaccgctaccgctactcctcccatcaacgcctccagctccgacgaggccagcttcatccaggacttccttaaccagcaggacaagaagaactagacggttgcatcaatgacaatggtcatgcggttatttggatgcggtgtacgtttataagccatggaagcataagcggtccatcgagccggacagtcaaattcagataccaacaaaagcctgtttcgccaatcgtggcatgacgatactgaaaaaaaaaaaaaaaaaaaaaaaaaaaaaaaaaaaaaaaaaaaaaaaaaaaaaaaggcccctaaaaaaaaaaaagggccccta

SEQ ID NO: 35273 - DNA, 826 bp, Triticum aestivum
  unsure (1)..(826): unsure at all n locations
  Clone ID: PAT_TA_35273
nnntgcattagctcggtcgcgggcgagggccggccgggccgggatcacacacccacacttcagccttccacccccacaacaacaaccatcatcaacaacttcatccacatcttcacaagaatcatcaacaatggctcgcactaagcagaccgcccgaaagtccactggtggcaaggcccctcgcaagcagctcgcttccaaggctgcccgcaagtccgccccctctaccggaggtgtcaagaagcctcaccgctacaagcccggtaccgtcgctctccgtgagatccgtcgctaccagaagtccactgagcttctcatccgaaagctccccttccagcgtctcgtccgtgagattgctcaggacttcaagtctgatctccgattccagtcctccgccatcggtgctctccaggagtctgtcgagtcttacctcgtctccctcttcgaggacaccaacctgtgcgccatccacgccaagcgtgttaccatccagtccaaggatatccagctcgcccgccgccttcgtggtgagcgcaactaagcgaatggctttgggaggataacgaattttttgctttgacacgagggatatcatggttaggggataatcaaggcgttcatgaggaacaatgttttatacactcaggcttgtacattaagtggcaagcaagttagctgcctttagcaatcgaccaacggtctttgatcatcatcaaaaaaaaaaaaaaaaaacacaaaaaaaatgattctttctttcttccttaattaatgccagttaatcgccattgtgcacgcanaaaaaaaaaaaaaaagcccctagggccgc

SEQ ID NO: 35274 - DNA, 1072 bp, Triticum aestivum
  unsure (1)..(1072): unsure at all n locations
  Clone ID: PAT_TA_35274
gccgctcgaggccnnggccgggccgccggccggccggcgggacgcgggccaaatttcaacaacaatctctcactcaacataaccaaacaaccttcatcatgcagctgaccaacctcttctgcctcgccagtgtcctgacctccgtgtcagcaatcaccgtatcctacgacccaggctatggcgaagctggccgcgccatgacagccgtttcctgctccgatggcacaaacggcctcatcacgcgctacggctggaagactcaaggccagatccccaagtttccctacattggcggcgcgcaggccgtcgctggctggaactccccgagctgcggcacgtgctggaagcttacctacaagggcaagagcatcaacgtcttggccatcgaccacactgctgcgggcttcaacatttctcccgcggcgatgaacgctcttaccaacaaccaggctgttcagcttggtcgggttgatgcgactgctactcaggtcgctgttagcaactgtggattgaagaaataggtgtgaggctttgggtgatgagatgggacgggatacgtttatgatcgtaatgtttagtagtacattaattgatattactttaatctcaaaaaaaaaaaaaaaaaaggcccctaaaaaaaatcggcacaagagaacagctagtctaaagagacgaacaaacgtggaggttttagagaggtttcggttccatgggagacggtaagaaatccggctccggtttctggtcggtggtggcgtcttggtttgcttgctttcgcccacctaagatcaaggcggcgagcaccggcggccggaccaccacgtatgaatatgatccagccggcgggatggtggcggcggccagacatttctccagtgctcacaaaataaactttggatgattcatgtcatgtctgtgttgggaatagctttgtggtctacccatatccctcagcgcttatcttggtatcgctcataattcgcaaatcagaggatagggttagggactttcttatgttgtctttccaaagagttcacctcttatacaaataagatttctaatcttttcaacc

SEQ ID NO: 35275 - DNA, 1035 bp, Triticum aestivum
  Clone ID: PAT_TA_35275
gccggccgggccggccgggcactcactcaccatcgctttaatccagtcactctttaatctaatacaccaactcaccaagtcactcttttaacttgcttaattttcaaaacaccttcaccatgaagttcagcctcttctccgtcattgctctggcctctgccgccatggctgctcccgccgtccaggtccaggccaaggccgctggtgccgctgccgatgtccacgcccgacaggttcccgccgttcctgctgctgtccctgccgttccccaggttgtcagcaccaccgtcagcaagaccgttatcaagaagatcacctccaccaaggtcaccaacaccggaggcgttgtcaaggttctgaccgttgccgtcgacgaggtcaccgtccaggttggcaccatcaaggagaccatcaccaaggtcaagtccggcgctcttggcaaggccgctgccatcacccacatccaccagaacgtcgccatcatcaaccagctcctcaccgttgtcgttgaccagctcaaggatgttgtcaaggtcgacatctctctccctgacgtcaagatcattgttggccttgtcatcaagcttgtcaacgagctcgttgctgtcgccaaggacatcctgagcactctcggcctcgacaacatcctcggcgctgtccttaacctcgtcttccgtcttctcggtactctgatcaacctcgttgccaacctcatcggcgacatcgttcccggtgttcttgacgtccttaccgccgtcctcgacaccctttccggcactgccctcggccccgttgtccagcccgtcaccgttgttgtcggtggtctcagcagctacctcactcagggtacccagggtaccgttggtgcttaagcgattcgattgaaacgacctagatataccccttcaggacctgacatagcgctcagacatagagaagtttagtgataattatttaattcgatggtgctttattaggtgctatcaattgcaaaccacattgtgttcctaaaaaaaaaaaaaaaaaaggccccta

SEQ ID NO: 35276 - DNA, 433 bp, Triticum aestivum
  Clone ID: PAT_TA_35276
cgggtccacccgcttttttttattattttttttttttttttttgaacaatatggcatgctttctgcttcttatacattatgatctgaaacagatcaaccaactctccttgtgccaaacgcccaaacataacaaaatttccatgcgctgccatggatgctcattcgacaggcgagccagacctttggttacagtacaagaattgttgcctctaaacaagcatctgctggtagggcaggggaaaaactgaagagtcagccaggcttacgtgcaaggcgacatcaatcaaaataaatagctagaggagaaaaaaaaatgcagcagaggtcatcagtgatactctgccaaaaaaaaatgggttggtttagcattgccgaaccaactgtgcatctcaggagatgcctgcatgccatgaacacatcatggtcaatgtgg

SEQ ID NO: 35277 - DNA, 848 bp, Triticum aestivum
  Clone ID: PAT_TA_35277
ggcacgcaggcctgtcggattcccacgggaaccgggactctccacggggtacggggggaacaatatggcatgctttctgcttcttatacattatgatctgaaacagatcaaccaactctccttgtgcccaaacgccccacctgctttctgtttcttatacattacgatctgaaacagatcaaccaactctccttgtgccaaacataacaaaatttccatgcgctcgccatggatgctcattcgacaggcgagccagacctttggttacagtacaagaattgttgcctctaaacaagcatctgctggtagggcaggggtaaaactgagagtcagccaggcattacgtgcaaggcgacatcaatcaaataaatagctagaggagaaaaaaaatgcagcagaggtcatcagtgattctctgccaaaaaaatgggttggtttagcattgccgaaccaaccgtgcatctcaggagatgcctgccatgccatgaaccacatcatggtcaatgtggtcgtagattgtatctgttattttcgacggtggccagtatcgaagcacagatctcccaagaatgttcttcacgggtagcggtccccagttatgggaatcgaagctgttgtttctgttgtcacctagcacaaacacgtagccttcaggcacactcactgggtccatttcataatcaggtggctcgagcacaaagtcctcatcctggacgactccgttaactaataattgaccatcagtcacttcaacgatgtccccgcccttggccacaaccctcttgatgaacccgtcgcgtgggccgtcccccgatgcccggaccgccagaggtgcacggaagatcaca

SEQ ID NO: 35278 - DNA, 659 bp, Triticum aestivum
  Clone ID: PAT_TA_35278
gccggccggttcgcaattaggtgacctgtgcggggctcgccggggcgggagtccagacattcatcgccaactttgaacaatacaccagcgcccaattccttccaatctttcacaatgcctctctccggacactgcctctgcaaagccgtcacctacaaggttgacgatgagcctctcgttgttggctacgaccactgtgacgactgccagcgtcagagcggttccacctactctctcgttgctgttgtcaagaaggacaagctcaccatcaacggccccgtcaagacctactccggcaccaagggctcttctggcaacattgtccaccgtctcttctgctccgagtgcggttctcccatcgcccacgaccccgatgctgcccctgagatcatcgccctgaaggctggtactcttgataccgagatcaagaagaacctcaagcctgacaccgagatctggaccgtcggaaagctgcctttctgccaggaacacctcgccaagcctttcaagcacatgcccgagtaaggaattgcatgtcaaaatatgattatgatgatgtaacgagccgttaaaatgaggccgagcgcccgaaaataatatagtggaagaatacaattaccccacaaaaaaaaaaaaaaaaaaggcccctacctacccta

SEQ ID NO: 35279 - DNA, 601 bp, Triticum aestivum
  Clone ID: PAT_TA_35279
gtgcggcgctcaggcggcgggtcgccggccgacttgggctaattgccattgaatcatcacctctggacctctcttctttagaccctccccactcattcatctcaaagatgcgttctaccgctgttctccgaatgttcaggcagacgcctcgcatgctgcgacccgtccccaaggaggaccaggctggccacaccatctctcagcgactccgaaagctcaagcagatccctcctgagctgtaccccctcgctgtcgttgttggcttcgctctcggcgctgccggctactccatctcccgcaagttcatcgtcgataagaacctccgtctcgctcgacagggccctgctgcgcgtgcggcaaacagcggtcacggtgagagcgaggagcactaaatttgtgcgaagaatagagtgactctcggggaatgaaattggttgaatatcctgggaagggcagtactgtacatttcaggacagcacggtagcagggaactccgtcaggcataaaatatgaatttcggtgattgatatttatctcacccttgcacaaaaaaaaaaaaaaaaaaaggcccctaaaaaaaaaagggcccctaagggcctcc

SEQ ID NO: 35280 - DNA, 1013 bp, Triticum aestivum
  Clone ID: PAT_TA_35280
gccggccccgacctttctcgacctgccgaccccagttctttctcggaactctcccagctctacaaatacccgacctttctcttcttttcgaatcaactcttcacatccttcaaaatgggcttcaccgacctcctttccgaaactggagctcacgtgctcaacagctggttgagcacccgctcttacattgttggccaatctgcctctcaggctgatgttgctgccttcaaggctctctccggccccccctccggcgagagctacccccacgccgctcgatggtacaagcacatcgccagctacgagagccagttcgccacccttcccggtgatgcttctgctccctacagcacctacggtcccggctccgctgaggtgaccctcaaccccgccaaggcccctgagaaggctgaggaggccgccgctgaggaggacgacgatgtcgacctgttcggtagcgacgatgaggaggaggatgctgaggccgctcgcgtccgcgaggagcgccttgctgagtaccgcaagaagaaggagaacaagcccaagaccatcgccaagtccgtcgtcactcttgacgttaagccttgggatgacgagactgacatggctgctctcgaggctgccgtccgttctattgagaaggacggtctgacttggggtgcttccaagctcgtccccgttggttttggtgtcaagaagctccagatcaacctcgttgttgaggatgagaagatctccgtcgccgaccttgaggaggagatccaggagttcgaggactacgtccagtccactgacgttgctgccatgcagaagctgtaaaaagcctgcgttagcaatgtcaacttatgatgaggcacgacggcgaggattgatgaccaatgggatcttatgattttcaaatgagctacgtaaaaggcggaaaaaatcatgaatcctgcaccttcgcaccaaacatagatgaaaataaaaacaaaaaatgatagatcgaaaaaaaaaaaaaaaaaaggccccta

SEQ ID NO: 35281 - DNA, 1030 bp, Triticum aestivum
  Clone ID: PAT_TA_35281
gccggccgggcttccgaaaaaaaaaaaaaaaaaaaccgggcctcgaggccgctttctctatccatcactactcatcactcacccatctttaccacatctacttccactaccgcaaccatggttcaacaaatccccaaggccaaccacatcctcgacctcctcagcctcaagggcaaggtcgtcgtcgtcaccggcgcttccggcccccgaggcatgggtatcgaggccgcccgcggtgccgctgagatgggcgccgacgtcgccatcacctacgcttcccgcaaggagggcgccgacaagaacgtcgaggagctcgtcaaggagtacggcgtcaaggccaaggcttacaagctcaacgctgccgactacaacgatgttgagcgatttgttggcgaggttgtcaaggactttggcaagattgacggatttgtcgccaacgccggtgctactgccaacgctggtgtcattgacggctccgctgccgactgggaccacgttatccagatcgacctcaacggcaccgcctactgcgccaaggccgtcggcgctctcttccgcaagcaaggccacggctccttcgttattacctcctccatgtccggccacatcgccaactaccctcaagagcagacctcttacaacgtcgccaaggcgggctgcatccacatggcacgctctctcgccaacgagtggcgcgactttgcccgcgtcaactccatctctcccggctacatcgacaccggcctgtctgactttatcgacgccgagacccaggagctgtggaggagcatgatccccatgggccgaaacggagatgccaaggagctcaaggctgcttatgtttacttcttgtctgatgctagtacttatactactggtagcgatctcgtcattgatggtggatacacttgccgatagatgggggatggttttaatgaccttgatgataccaaaattaaataaataaataaataatatatagtaatgacaattacatgatccaagaaaaaaaaaaaaaaaaaggccccta

SEQ ID NO: 35282 - DNA, 748 bp, Triticum aestivum
  Clone ID: PAT_TA_35282
gccggccgggccgggataccacttcttgaactcttccatccaaataaacaatcactcaatcaatcactacatcactctcatccaaaatgtctgccatccccacctccacctcggtcatcgagtctgccgtcattgaggcctccttcagcgacgtctggcacctcatcaagctccaggacttctccaagttctactctgccctcgagtcctccgaatgggtcaagggctcttctcccgacaccgacatcgtcaagtggaccttcaaggacggcaccgtcctcgaggttaagcaggaggagcactccagcatcgaccactacatcacctacagcgtcatctcatcccagcccgccctgagctacacctccgtcgtcagcaccatccgcgcctaccccatcacctctggccagaacgagggtcagacctttgtcacctggagcggaaacttctccagcgacgccgacgctggtgttatcgctgacgccaagttcaagcgccgtgaggccctcgctgacctcgccaaggctgcttccaagaagtaaaaaaaaaaatggtgttgatggaaacgttcgagacaggttttttgaaggaaatgaaatgatattaccacaacgcaatgcgatgcgatgcgatggatgatggatgggcagattacggttatcacttgtatatgtaacttatcgcccaacctctgatgaattcacagtcaatgtctgattgcaaaaaaaaaaaaaaaaaggcccctaaa

SEQ ID NO: 35283 - DNA, 793 bp, Triticum aestivum
  Clone ID: PAT_TA_35283
tttgcctcttggtctcggtttggaggaggcttcccctgatatccttcgccgaccccctcgcagcttgcgcagtggtgtcttcacctttgacctcgttcgcgatcagctcgtttatggattctgctcaggctctctttgtctggccgctttcatgattgtcaactacgcttcgtctggtcagggttactacaacatggtccctcactgcaacgagagcggaaccgagggctgtgacctcgtctaccgtgcccgtgctacaaccttttccaccggccccattttgttgttggtcacagcttgggaggtgaagcatttccaccgcagcttgttcaatatggatgagcatgcttcgggtcccttttccgtgttcaagaccatctaccacaacaagttcctcttttggtccgttgttgctggtttcgtcatgattttccccattgtctacatcccctacctcaacactgaggtgttcaagcacaagggtctcacatgggagtggggagttgtggccggctgtgtcatcgtctacgttgctcttatcgagacttggaaggcgatgaagagacggttcaactggggcattgacacccaccccatcacccagggccaggttgacgtttaagtggcataaagtggtgaatgaaaatcggtgctgtaggtgcagatagtcgaagctggaggacaggttttgggatatgcacacggtcttgaaattgtttggtattatacttattgttattatcctctagtcaatatatttcctgtcgaaaaaaaaaaaaaaaaaaggccccta

SEQ ID NO: 35284 - DNA, 461 bp, Triticum aestivum
  Clone ID: PAT_TA_35284
gccggccgggtgcgcggccaaaccggccatcaatccaacacacaaacatccatatcattccatcccatcagtaaacatgcagttcaccacctccttcatcgtcgccgctttcctcggcactgcctttgccatgccacaggccgcaccagttgactgccccgagacgtcagccattcccacctgcggtgccccttgtatcacctctgcagctgcagctgctggatgcaccgacattgcttgccagtgtgctagctctgaagtgattcaggcttcagctcttggctgtgttgtcggtaactgtggaattcccgtggctctatcagtgcaagctgccgccgctgccgtctgcactgcctgtgcttagatgtggtatatttattgggacatataagtgacattatatacctgaatacaagctatattagttgcgtgaataaaaaaaaaaaaaaaaaaggccccta

SEQ ID NO: 35285 - DNA, 529 bp, Triticum aestivum
  Clone ID: PAT_TA_35285
gccggccgttccgggatcttgactttttattgtcgaggtcggccggccggccggggcggacaaacagctcatcaatccaacacacaaacatccatatcattccatcccatcagtaaacatgcagttcaccacctccttcatcgtcgccgctttcctcggcactgcctttgccatgccacaggccgcaccagttgactgccccgagacgtcagccattcccacctgcggtgccccttgtatcacctctgcagctgcagctgctggatgcaccgacattgcttgccagtgtgctagctctgaagtgattcaggcttcagctcttggctgtgttgtcggtaactgtggaattcccgtggctctatcagtgcaagctgccgccgctgccgtctgcactgcctgtgcttagatgtggtatatttattgggacatataagtgacattatatacctgaatacaagctatattagttgcgtgaaaaaaaaaaaaaaaaaaggcccctaaagaaaaaaaaaaaaaaaaaaggccccta

SEQ ID NO: 35286 - DNA, 549 bp, Triticum aestivum
  Clone ID: PAT_TA_35286
gcgaggggggccggccgggccggggaaaacagctcatcaatccaacacacaaacatccatatcattccatcccatcagtaaacatgcagttcaccacctccttcatcgtcgccgctttcctcggcactgcctttgccatgccacaggccgcaccagttgactgccccgagacgtcagccattcccacctgcggtgccccttgtatcacctctgcagctgcagctgctggatgcaccgacattgcttgccagtgtgctagctctgaagtgattcaggcttcagctcttggctgtgttgtcggtaactgtggaattcccgtggctctatcagtgcaagctgccgccgctgccgtctgcactgcctgtgcttagatgtggtatatttattgggacatataagtgacattatatacctgaatacaagctatattagttgcgtgaataccttgaaagcatgtgccttaaaaaaaaaaaaaaaaaaaaaaaaaaaaaaaaaaaaaaaaaaaaaaaaagcgctatagcacagccgcgaatatattgaattgaattg

SEQ ID NO: 35287 - DNA, 464 bp, Triticum aestivum
  Clone ID: PAT_TA_35287
ctgtgcggcgctgccggccgggtccgaaagcttaaactttgatacttctatccttgtaccacatacatctctcgatatcaactttcaagatggagcctatcgtcaactacaaccacaacacctgccccaagtgcagcgctaccattgagggcgccggcaagacctgcggtagctgcggcgctcactgccccgtctaaacttccaacggagaaattcacgaagacatgatcgagacgagttgagatatcgggtgttagggatgcatacaacggagtgcgggttggcgatttgggcggatgttgtgacgaggccgctgtttgatagcgtcactctttttttgtttgggaggctgttgatggttgtttaacctcttggctttgggcggtactctgtagcggagattaagctcgctcttttattcgaccttattgaaacaagaaaaaaaaaaaaaaaaaaggccccta

SEQ ID NO: 35288 - DNA, 497 bp, Triticum aestivum
  Clone ID: PAT_TA_35288
gccgccggccgcgcacgagacagcttaaactttgacacttctacaccttgtaccacatacatctctcgatatcaactttcaagatggagcctatcgtcaactacaaccacaacacctgccccaagtgcagcgctaccattgagggcgccggcaagacctgcggtagctgcggcgctcactgccccgtctaaacttccaacggagaaattcacgaagacatgatcgagacgagttgagatatcgggtgttagggatgcatacaacggagtgcgggttggcgatttgggcggatgttgtgacgaggccgctgtttgatagcgtcactctttttttgtttgggaggctgttgatggttgtttaacctcttggctttgggcggtactctgtagcggagattaagctcgctcttttattcgaccttattgaaacaagactgatactcatctcaaaaaaaaaaaaaaaaaaagaacctaaaataaaaaaaaaaaaggccccta

SEQ ID NO: 35289 - DNA, 872 bp, Triticum aestivum
  unsure (1)..(872): unsure at all n locations
  Clone ID: PAT_TA_35289
gtggcggccgcttcgannggccggccgggcctgggatcaaacaccacacactctcatctcatctcaagtctacaaagatacaaacaattcaactctcaactccaccatccttaccacaaacacaaacaaaaccgccaaaatgcacgcctctcccattactcttctcgccctttctgccagcctcgtctcagctgctaagcacgtggtcaaggttggagatggaggtctgaaattcgatcccgctgagaccacagcaaagactggtgacactgtcgaattccacttctacaagggaacccacaacgtcgcccagagtggcttcgccaagccttgcgagcccatcaacagcaccgccttcttcagcggcacctgggatgtcacgcagggtatgagtgacaaggtcttcaccatcaacgtcacctccgaggaccccatttggtactactgtgctgttcaaggtcactgccaaaatggtatggttggtgctatcaacgctcctactagcggacagcgaagcttctccaacttcgccaaggctgccgaggactccgaagacagcgttgctccccgatctaccggtggtggtgagatcgctactgctaccggcacaatggccgcctccggtacttccgagcccactggcaccagcactgagaccggcgcttcttcaacagagtccgcaggcgcaaacgctggtcttgaggctagaggagagatccgctggggtcttatgactgccggtatggctatggctggtctcttcggtggcttgatgatgtagatcatctctgcatcagtcaattgtgttttatgatttatgccctgggtggcattttattgagtcaaagctagctagactagccattggactt

SEQ ID NO: 35290 - DNA, 906 bp, Triticum aestivum
  Clone ID: PAT_TA_35290
cctccgcgctggcggcggcgctcgacgccggcacggccttcatgggggtgctcatcttcttcgcgctccagaacgcgcaccacgacctcaagtggtggggcaccgaggtcgaccactgcccgctcgccacctgccccaccgcgcccggcatcgtcgtcaagggctgcccggtcttctgagcactgagctcgccggagcatcatcggacactgcccgccatgtatgtagctagcagcgaccatcgtctggattggcagaggaagccatgaattcaacctctctgcatcaattacccgatgcagccacccccccgtcctgagtcacattgtaaacatttgtgtgttttgtttttctcccaaggaaatcaaatgcctcgcttatataaaaaaaaagcgggagcgtcaccggcaccgtcttcaagttcttcgtcttcaggtaccgcaaggggtggtggcagaagtacaactacgtgctatcggcggcgctcgacgccggcaccgccttcatgggggtgctcatcttcttcgcgctccagaacgcgcaccacgacctcaagtggtggggcaccgaggtcgaccactgcccgctcgccacctgccccaccgcgcccggcatcgtcgtcaagggctgcccggtcttctgagcactgagctcgccggagcatcatcggacactgcccgccatgtatgtagctagcagcgatcatcgtctgggttggcagaggaagccatgaattcaacctctgcattaattacccgatgcagccgcccgtcctgagtcacattgtgaacattgtgtgttttgtttttctccaaggaaatcaaatgcctgcttatataaaaaaaaaaaaaaaaaaaaaaaaaaaaaaaaaaaaaaaaagaaaaaaaaaaaaaaaaaaggccccta

SEQ ID NO: 35291 - DNA, 758 bp, Triticum aestivum
  Clone ID: PAT_TA_35291
gcctgtcgggatcaatcgtggtcgtcaattccccccatatcgccgccatggttgtcaagatccgtctcgcccgtttcgggcgtcgaaatcagcccttttacaacatcgttgttgcccacgctcgcacggctcgtaactcccgcccgctcgaagttattggcacatacgacccgattcccaagaccgatccttacgacgactctggaaagcttcacaaggacatccagctcgatagagcacgcgctaggtactggatcggtgttggtgcacagcctacggacacagcatggcggttactctccatgctcaacattctaccaaagaaggaattcggccccaagaaggacgagataaagggtgttgtgcagaaggatcagatccagattcgctgaaacaacaatggtctggaaggatgtatgataatgtatgaaaagacatttcggggcgttggtttggggatcgatatcacccgatttgaatgagccagcaaaaattcgagagcaggcagtgccaacacaagagattatcggggatctttggcaggcattggaggcacatagtacttccagaggagactgtactatatatttatgttggaaacggcttgaatcaccacaaccaagtcatttgtcgctattactatttgtattgaagcgctacccaataccatgtctaaagcacgcttaaagctatctatggaagatgagtcgctaaatgagaaaacccaacacgaaaaaaaaaaaaaaaaaaggccccta

SEQ ID NO: 35292 - DNA, 864 bp, Triticum aestivum
  unsure (1)..(864): unsure at all n locations
  Clone ID: PAT_TA_35292
gccggcggccgggccgacttttctcgtcttttcggggaaccttcattcgccttcacatccggcacgcaaaccacgagcctctgccgacttcaacgaccaatacagacaagatgcctcccaagttcgaccccaatgaggttaaggtgatccacctccgcgccactggtggtgaggtcggtgcctcctctgctcttgctcccaagattggtcctctgggtctctctcccaagaaggtcggagaagacattgccaaggctactggcgactggaaaggcctgcgcgtaactgtcaagcttaccatccagaaccgtcaggctgccgtctctgttgttcccactgcttcttctctcatcatcaaggccctcaaggagcccccacgcgaccgcaagaaggagaagaacatcaagcacaacaagtctgtcgccctcgacgagatcattgagatcgcccgcaccatgcgatacaagtctttcgccaaggacctctctggtaccgtcaaggagattctcggaaccgcctacagtgttggctgccaggttgatggcaagcctccccagtctgtcattgaggccattgacagcggcgacatcgacatccccgaggagtaaatttgatctcacgaattcaaataccacaaaacaacaacaatagatccattgtctgatggtctcctcatcaaccaaaaaaaaaaaaaaaaaaacccccctataatactgtgtgaatgcgtgacagacccttgactcactctgaaatctaccatgacgctctgtggtttatttctatttttgntcagggagaggaatggaagcccaatactcaccgcggcatactagctatcaagctcttgtggatgcagcggtccat

SEQ ID NO: 35293 - DNA, 713 bp, Triticum aestivum
  Clone ID: PAT_TA_35293
gtggcggccgcttcgaaaggccggccgggcttaccggaaaaaaaaaagaaaaaaaaacactcatcaaactaatatttactaaacgatttcttcatcttcactcacaacttgaagctgtaactgtaacccacatctcatctacttcatcaccatgagcgaaacatacaccaccgccgaggtccaaaagcacaaggacgaggccaacggcttctggcttattgtcgagaatgacgtttacgacgttacaaactttatcgatgagcaccccggtggcgccaagatcctcaagcgttggtctggaaagaatgccaccaaggctttctggaagtatcacaacgagggcgtcctgaagaagtatggcaaagacctcaagattggtgctgttggcgagagcgccaagctataaaggccatctcaaccggcctctgcttatgacccggctgtgatgctttgtttattttggctatatttattctgatttatttgtacggcatggcgtataccatatattggatgaggaacttgatggatggatctggaacaggtcgtaggagcatcttgacctggaacttgtgatgggtgacttgatacactttctatagaccgattctcgacaaagaaatattggatttgcaaattacaaacatatacaaaaaaaaaaaaaaaatctaaacttttcgacgattgaaaaaaaaaaaaaaaaaaggccccta

SEQ ID NO: 35294 - DNA, 807 bp, Triticum aestivum
  Clone ID: PAT_TA_35294
aggccaatgccttgtggtgatttctgtggtgtgagcatcaattggcacgtctcatcagacttcaacaagggctggagtgctcgggtgacattgttcaattggggtgatgtcgacatggccaactggtttgctgccatggtcatggacaaggcgtatgacggttttgagaaggcatactctttcaatgcaacagcagagggcaataacaccatctttatgcagggccttgaggggctcaattaccttgtgaagcagaccaacatgagcgggtcggattacctcgtgccgggaaagcagcaatcagtgctctcattcaccaagaagctgactcctgatatcgatgttgtcgctggagatgggttcccaacaaaggtcttcttcaatggcgacgaatgtgctatgccgcagaggttaccaatcaagagtggtggattcaggacccatctaagcagtgcctttgctttggtattgctcatggctgcctcggccttgctgttgcttcagcaataatcttgttgctgttgctccgattctttgattccttcaggtggttccatcagcgccatttgtaagaaacctttttgtttccggtgatctaccactagaagatcttgtgtagctgctatgtagcagaatcaagcagcaaccatgagatgaaccgcaagagatgcagggagctatagctcttgttgcaggctcgcaacatcgacataggttccctctgagatgatgatatttagctatgtactgcatgcttccccctgtggggctgcgattgttgccaatttctcgtgtttagcttgtgcc

SEQ ID NO: 35295 - DNA, 416 bp, Triticum aestivum
  Clone ID: PAT_TA_35295
gccggccggtccggggattctccgtcaggaattcaatcaccccacacgaacaaccatcggagcctcccagaactcgcattaccgacttcaagatgtctctcgtcgacgccaagaaccccgttcctaactaccagcgcttctaccagaacgcttacaagaaccatacccgtctttggaagattggccctcgcagccgcatgctgatgaccccctacctcatcctcctctggggtagcctcggcgcttctttctacggcgctggccgcaaggtcctcggctacaactcttacttcggaaactagatacgcgggctgcctagcttattataaagctcgacaaagatggaaggctagtgtgatcagtattgagtgaatagaaggagatgcatccaaaaaaaaaaaaaaaaaaggccccta

SEQ ID NO: 35296 - DNA, 561 bp, Triticum aestivum
  Clone ID: PAT_TA_35296
aaaattccaaaaaaaaaaaaaaaaaaaaaaaaaaaattaaaaaaaaaaaaaaaaaaaaaaaaaaaaacccatttcatcaccccacacgaacaccatcggagcctcccagaactcgcattaccgacttcaagatgtctctcgtcgacgccaagaaccccgttcctaactaccagcgcttctaccagaacgcttacaagaaccatacccgtctttggaagattggccctcgcagccgcatgctgatgaccccctacctcatcctcctctggggtagcctcggcgcttctttctacggcgctggccgcaaggtcctcggctacaactcttacttcggaaactagatacgcgggctgcctagcttattataaagctcgacaaagatggaaggctagtgtgatcagtattgagtgaatagaaggagatgcatccaatctgatatcctcgcggaattgtcctttgatttgtatacacagaaacgagacaaactcccagtcgaaccgtgccttctattcacacgtcattgccgttaaaaaagaaaaaaaaaaaaaaaaaaggccccta

SEQ ID NO: 35297 - DNA, 747 bp, Triticum aestivum
  Clone ID: PAT_TA_35297
gccggccggtctccggaattctattgtgtgccggggagtttctggatccttctctctacatcttctctctaccaccacctcttcattcaatcaccagacttccagcacactctctcgacaatcaacatgtcgtcatcttccgccgagcagagaagcgatctcgaagaggagcaggtcgatcaggagaagcctcagcgcaagacaaagaccaagaagtccaagggcgagcgacgcaagcgacgtgcccgattcgacgactacgatgacgagcaggacaaccaaatgtcccagagcaactacaacgcccagcaacagcagatgcagcagcaacaacaacagcagcagatgcaacagcagggtggtggtggcggtggaaagagtgatgcccttagtctgcatctcgagttgaacctcgagattgagattcagctcaaggcaagaatccatggtgatcttaccctatgcctactcaactaaacaccatcgctcggtgtactttattataatattcataaatactgcctatgaatgacaaacgactgttggaattaaacacggcgttggggtttatgactggattgcatttcctaggatatatacatttacacacacatgtgctggtactcaaacaattctctagcatgtcccgtcagagacatagcatgaatattttatatacttattttaccaatcatacgattcatttatcaacaacaaaaaaaaaaaaaaagacccctaaggccccta

SEQ ID NO: 35298 - DNA, 333 bp, Triticum aestivum
  Clone ID: PAT_TA_35298
gccggccggtccggggaagtcccgtggtctcaacaagggtcacagatacaacaagaccaaggctggccgcagaaagacctggaagcgccacaacaccctgtccctctggcgataccgataagcgtctcgccccctggctgggacgtttgttgttttcgcaccacggctgtctggttgtacatgcgatttcgatttgggagggtctggttttggcactgcatgcttggactctggggagtcgggaaccttgtttggtagcacaaaaaatggaatcaaaagtaattccaatttcatgattaagactaaaaaaaaaaaaaaaaaaaaaggccccta

SEQ ID NO: 35299 - DNA, 991 bp, Triticum aestivum
  unsure (1)..(991): unsure at all n locations
  Clone ID: PAT_TA_35299
nnnnnnnnnnnnnnnnnnnnnnnnnnnnnnngctggnnnnnnnccggccgctcgccggcttttcctcggggaaatcttcgacatcctactaaccaccaggacctcgaccaagccgccaagatgggtgccctcaagtacgtcgaagagcttcagaagaagaagcagtcggatgtcgttgccttcctcctccgagttcgctgctgggaactccgtcaattgaacgtcatccaccgtgcctctcgtccttcccgtctggacaaggctcgccgtctcggatacaaggccaagcagggctatgtcatctaccgtgtccgcgtccgccgtggtggtcgcaagcgccctgcccccaagggtgccacttacggcaagcccaccaaccagggtatcaaccagctgaagtaccagcgatccctcaaagctaccgccgaggagcgtgtcggccgccgatgcgctaacctccgagtcctcaactcttactggatcaaccaggactctacctacaagtactacgaggtcatcctcgtcgacccccagcacaaggccatccgcatcgacccccgcatcaactggatcgtcaaccccgtccacaagcaccgcgaggctcgtggtcttaccgccaccggcaagaagtcccgtggtctcaacaagggtcacagatacaacaagaccaaggctggccgcagaaagacctggaagcgccacaacaccctgtccctctggcgataccgataagcgtctcgccccctggctgggacgtttgttgttttcgcaccacggctgtctggttgtacatgcgatttcgatttgggagggtctggttttggcactgcatgcttggactctggggagtcgggaaccttgtttggtagcacaaaaaatggaatcaaaagtaattccaatttcatgattaagattaagaatacctacggtttcccggctgaaaaatnannaaaaaaaaaaaaaggaaaaaaaaaaaaaaaggcccctaggg

SEQ ID NO: 35300 - DNA, 1010 bp, Triticum aestivum
  Clone ID: PAT_TA_35300
gccggccggttccggataagagcccattcccggctctgcgcgaggacagattggcagattcccttttcgccttcccctgaacccgatcgagcaagccaatggagaagcaagccgacaaggccgcggcgccggccgacgacggcatccacgaggagtcgccggcctccgcccagaacgggaggcccggatccgagccggcggccgcacccgaggtggaggtgcagctcttccggcggggccgggggccagtggccgtgttccggtcgcccctgggcgggtacacgcaggaccagctggaggtgggggacatcctggagaagcacggcctcaagtgcgtcttcgccttcgacgccgcctcccgcgcgcgcggcgtcgccatccgattcaacccccgcaacggccgctccctcctcccctacgccgccgactccaccatcttccttgacggcgagccaaaggatcctttgctgaagcccatcacgaaggtgatgctcactgtctgcaccatgacagtggtagttgcggtgttactcaaggaggggaagatgcccgagtggcttaagggaactaagctgggcaacctgaaattcccaccgtgggtgctggcttgcatggtcattgtcttcatgaggctccggaagagaaccagggatgtcatgaagaagattggctggtcctcgtgagcaggttactaatggcaagcacacttttggccactccttccagtttgccgtcaatgttggagatgtactgggcagtgacatactacatgtaaatgttcagaacaaatacatcttattatagatcacttatatttgaccttatgtttagcatatacactacgcggtttgccagtgtggcatttttgcttgtagcaagtgtgcatgaataaatatagccgaacaaactggctgtgcgctctgtttctggggaaacaaacaaactcgggcccacgctgtttctgtgaaaaaaaaaaaaaaaaaaaaaaaaaaaaaaaaaaaaaaaaaaaa

SEQ ID NO: 35301 - DNA, 1091 bp, Triticum aestivum
  Clone ID: PAT_TA_35301
gtgcggcgctcggccggccggtcggggatccaccattcgtgtcccggactttgctcttcaatccacgagcacctactaacccgaacgattcaagatgcctcccaacaaatccggcaagaaggtcgctcccgcccctttccctcagggtaaggctggcaagaaggccgctaagaaccctctcctcgagaagcgaccccgcaactacggtatcggccaggacatccagcccaagcgaaatgtctctcgcatggtcaagtggcccgagtatgtccgtcttcagcgccagaagaagatccttcagatgcgcctgaaggttcccccggctctcgctcagttccagcacgtcctcgaccgcaacactgctgcccaggctttcaagctcctcaacaagtaccgacctgagaccaaggccgagaagaaggagcgtctcctccaggaggctaccgccgtcaaggagggcaagaagaaggaggatgtctccaagaagccctacaccgtcaagtacggcctcaaccacgttgtcggcctgattgagaacaagaaggcttctctcgtcctcatccccaacgacgtcgagcccattgagctcgttgtcttccttccttctctctgcaagaagatgggtatcccctacgccattgtcaagggcaaggcccgtctcggaacggtcgtccacaagaagaccgctgctgtcctcgccatcaccgaggtccgctccgaggacaagactgagctctccaagctcatctccgctgtcaaggatggttaccttgagaagcacgaccaggcccgccgacagtggggtggtggtatcatgggtgccaaggctcagatgaagatcatcaagaagcagaaggctctcgaggctgctaccaagatctaagtctaatttgtttataccccctcaaatgcattgcgattatgggatcaacggtgttgcacggttcacggcatggaaaatgaatgatttttctcgggttacttttttttcccatccccactcgcagtgacatgaggggctggtctcccaaccctcttaaaatagatgatgagcttgcttcttggaaaaaaaaaaaaaaaaaaggccccta

SEQ ID NO: 35302 - DNA, 1050 bp, Triticum aestivum
  Clone ID: PAT_TA_35302
ctgtgcggcgctcggcgcggccggagacaacatttcgcccagagtacaacatccacaagctatcaccatgttcaccctccaagctctccaacttgtctccatgtgcactctagtgtatggacacggctacctcagtaagcccatgagccgaaccggccttaacgccgaggccggtccagatacatgccctgagtgtactatcttggagcccgtgactgcctggccagatctcgatgctgccaaagtcggacgaacgggtccttgcggctataacgcccgagtcagcgtcgactacaaccagcctggtgccaactggggcaaagaacccatcgccacttacaagcctggtcaggttgctgacgtgcagtggtgtgtcgacaacaatggtgaccacggaggcatgtacgcctaccgtatctgccaagatcaggatattgtcgacaagttccttgacccaaactacgtccccactgaatccgagaagcaagctgctgaagattgcttcgaagaaggtctccttccctgtaccgaagttgatggtcaggagtgtggttacagtcctgactgctcgactgatcagccttgccatcgcaatgattggttcacctgcaggtctttccaaggagactcggatggcaagggatgtcgtggtgttgataatgcaccaatcaactcgtgctatacatctattgcaggtggttacactgtctctggcaagatcaagatcccagactacatatcgaaccatacccttctgtcgttcaagtggaactcgttccagacgccccaggtttatttgacttgtgctgacatcgcaatctcagcttgagtgcgtttccatatgcaaaccatgctagagtattctagtgactggatgtatacaaagggcttcctaacgcaacttaacaaaagactgatgggatagtaaactcatcactgggtgtgaccctttcatctattgacttttcttttctgtcggaagagaaagccctctagtctagtatataaacactattttcactgtaaaaaaaaaaaaaaaaaaggccccta

SEQ ID NO: 35303 - DNA, 871 bp, Triticum aestivum
  Clone ID: PAT_TA_35303
gccggctcaagtctatagggtccgcagcaccgcaggtatcaactgaaacctacgccagctcaagtctatagggtgagtcagtgaggagagcagtagccaaatcttcgaagtacctagttagctctccatccttcagctagccaaatcccaggcatggacggaaagaagaagcccactgctgcgactgggagctccatcgtcgacgacctcttcggccccaaggacggcgccgcctcctcctccgcgggctacttcagcaccgtcttcccaactccatccggggcgacggggaaagatgcgtcactccgggcagcagcagcagctgggaataaatcatcgtcggcagggcatcagcagcaaggaaagcagcacggggggtcacctgagtcgccttacttcggctcctcttccgtccactatggcggccgggacttctacgccggcgccgaatctcagcggcaatattcggccgccgctgccgcaccggcacccaagcacaaggacgacggcgacacgtcggcagccacccggggtgactggtggcaaggttccctctactactagcactagcaggaaaaagagactggtgtgagatgagcgagatataaataaaatgtacagctagctacctcataatagcatgcttcatcatcgttatttcactgggtggagaagatggtcggtccagcgatcatcagcttaactaattagtattaagctactgttatgttagagcttgtgtgtgtctacctagttgggacatgggtcctctccatgtgtgtactactgtgctcttgtaattgccttcttcacactaatatatggtcgtgcgcttgtaaaaaaaaaaaaaaaaaaaaaaaaaaaaaaaaaa

SEQ ID NO: 35304 - DNA, 1078 bp, Triticum aestivum
  Clone ID: PAT_TA_35304
gccggccgttccggaatctgcgtctacactccataacgtcctatcggcccctctcatcacatcgcctgatctgtgaactcgtcaccgctacccccaactcgatctgctctttactacacaaagtgtataagtagctggacaccgccaactttttatcacatcaaaccacaattgccaatcccatctatcacaatgcctagaatcaccgcttccgtttccaaggtcactcgcactctgaccgagtcgcatcgccatgccggtgtcgctctcatgcccaagtatgctgagctccttggttcctcttcagaacagtctgagtctcgtggtctcaagactacccaccgtcccactcctcagccatccatcgctggtcgcacacggcctttgatgcagtccttcagctcttcggcatcttctcgtgctcccgtcaaccacgttgacaccatggtgctgcccaagatttacgctactcccagccacaacgagcctcttcctcgtatgccacttcttcctgacaactacggctcttaccacaactccatgtctgatgccaccgacttgtccactggccaccgacccatcatcttcgccatcaaccctgatattgtcgttcccggtgcacccctcgcaaacatggatgccaccaacatggacagcattgacgtgaagtttgttcacgaccagcccaagatctctactgctgccgctggcgagcaatacaaccctgagcgaagcacatttatgatcgacatgtatcgcagtatgaaggaagatcttcttagtgttgcacctcagcttaaaagaaactaagagttctgggataaaagcatggaaagaaagagcaggagtttactacagtcttgacaaagagagctgcaaatctattaagcgttgtaatttgttttcgcggaacggggtgcgatcgcatcaactaatggccctattgtaagtggctggcgtggctcgaggccattcatttttatactacgatacacaagatcatatgaaagcccaagtggcagactcgaatgaatacaagtcttttgttctttaaaaaaaaaaaaaaaaaaggccccta

SEQ ID NO: 35305 - DNA, 519 bp, Triticum aestivum
  Clone ID: PAT_TA_35305
tgtgcggcgctcgagccggcggcccgctggccggccgggccttgatcctcacctcaaacatcaactactataacaccctttttaacaacttccttccaaccaccaaacaatcttcacaatggctggcgactgtggctgctctggtgcctcttcttgcaactgcggctctagctgctcttgctctggctgcggcaaataaacaacttgatctttgatcattcggataccacttgttctaggcccaagcttgggtcaagatacatcctttgacgacgaatcacggacggagttatgaagggcggagttgagatcatgatgtgattgggatatgcgcttggatagttagctacagattaagcttaaatactacccttgtgctgagaaaaaaaaaaaaaaaaaagtatccatatctaatgcagctccatattgagcgaaccttgatcaaagaaaaaaaaaaaacttaaaaccaaataccatacaaaaccccccccgaaaaactccatccccacaacccccatt

SEQ ID NO: 35306 - DNA, 651 bp, Triticum aestivum
  unsure (1)..(651): unsure at all n locations
  Clone ID: PAT_TA_35306
aaaggccgttgagatcctgatgggctcagctggtagcaagaagttccagaccaaagttgaatggggaatcgatttagcgtccgagcatgagaggtacttgactgaggtgatatttaaaaagcctgtcatcgtttataactacccgcgagggataaaagcgttttatatgaggctcaacgatgaccagaagactgtggctgccatggatgttctagtacccaaggttggtgaattaattggtggaagtcaaagggaggagcgcttcgatatcctgaaacaacggatactggatgccggtttgccgatggaatcctatgagttctatctggaccttcgacgctatggatccgtgaagcacagcgggtttgggctgggcttggagaggatgctcctcttcgccacgggccttgacaacatcagagatgtcatccccttcccgagataccctggaaaggccgacctctgaagatctgattggcctctgaagcaatagcacaagttgtccatagtctgattactactagctagggtatagtggtagtaggtgtaaagcatagtaagtgtaaactaagttgtccataactgagactaggagtcatacgtgtgcatanaaaaaaaaaaaaagaaaaaaaaaaaaaaaaaaggccccta

SEQ ID NO: 35307 - DNA, 976 bp, Triticum aestivum
  unsure (1)..(976): unsure at all n locations
  Clone ID: PAT_TA_35307
tatccacccctcttcctgcgtctcaccactttcttcattttgcagttggcttcagcactgtagctctacgaaaatgaagttcctcaatccaattgctgttatactctcgcttgcttcgtctatcgcccagggagcggaggctgcaaccactgaaagcagtcatcttaggggagaagaggtcaagtatcaaggattgactctgtacgtatcgaagccacacaagtcgttgggctacaagacgccaggaaccagggttggggtgctgtttttgacagacatctacggtctcaaacttaaagagaacaaagagttggtcgacaaatttgccaaggagggttacatcaccgtcgcaccagatttgttcaaagggtccccagcaccaagcgaagatacacccggcttcaacgtgactgagtttctggccaagtaccctcccagcgtgaccgaccctgtggttgccaaggcaatcaagtacattcgtgaagagctcaaggttagcaaggttgctgcgactggctattgctatggtggacgatatgttttccgtcagcttgataagaagggtggagtagatgttggcttcacggcgcatccaagtttattacagactgaagaaattgaggctgtcacaaagcctgtttctattgctggtgcagccgacgacaacatcttcccccagcctagacaggcggagaccaacgcgatcctcacaaagattggaaagccgttttcttcggctctgtacagtggaacgactcatggatttgcagttcgtgcgaatacgtcggatccccagcaggcctttgccaagaacgaggctttttaccaggctgttcgtttcttcgaagcttgggactagcatgatctacgatagtccgtatggtgcagctacaattttacgtgtatatatacttttcttcgggnattcaataaattaggatatcaatggaaaaaaaaaaaaaaaaaaaggccccag

SEQ ID NO: 35308 - DNA, 584 bp, Triticum aestivum
  Clone ID: PAT_TA_35308
gccggccgttttcgaagctcacgcccgcgaccaccgcctatatccaccaatttccctacagtacggcgatactcccgatccaacgcgcattttcccatccagcttaccatccttcaggtcgcaacaatggacgcctccaagcagcccgtcaagctcgtcaaggtcacccgagtcctcggccgaaccggttctcgtggtggtgtcacccaggtccgcgttgagttcatggacgaccagacccgatccatcatccgaaacgtcaagggcccagtccgtgaggacgacatcctttgcctcctcgagtccgagcgtgaggcccgacgactacgataaatgtgcattctggggagcatggggttcttggaagacggtcaacgacggatggtctatgcatgctgaggcgtgcgcgccttgtgttgggacattgacctggagctgcacattacccttttggcactccagtttcatttgttagaggaggcacacggacgggtctgggataacgaaaaattccagaacagttcttcttctgcatgcagcattggaatccgacgaaaaagtgaaattgattcttgtttctctcc

SEQ ID NO: 35309 - DNA, 587 bp, Triticum aestivum
  Clone ID: PAT_TA_35309
gccggccggttctgggaccaaaaaagttgtcccaaacaagcgtcaatctacagctcacgcccgcgaccaccgcccaatccaccaatttccctacagtcgcaacaatggacgcctccaagcagcccgtcaagctcgtcaaggtcacccgagtcctcggccgaaccggttctcgtggtggtgtcacccaggtccgcgttgagttcatggacgaccagacccgatccatcatccgaaacgtcaagggcccagtccgtgaggacgacatcctttgcctcctcgagtccgagcgtgaggcccgacgactacgataaatgtgcattctggggagcatggggttcttggaagacggtcaacgacggatggtctatgcatgctgaggcgtgcgcgccttgtattgggacattgacctggagctgcacattacccttttggcactccagtttcatttgttagaggaggcacacggacgggtctgggataacgaaaaattccagaacagttcttcttctgcatgcagcattggaatccgacgaaaaagtgaaattcattcttgtttctcgcaaaaaaaaaaaaaaaaaaggccccta

SEQ ID NO: 35310 - DNA, 778 bp, Triticum aestivum
  Clone ID: PAT_TA_35310
gccggcccgcttcgagaggccggccgttctcaccaaaaaagttgtcccaaacaagcgtcaatctacagctcacgcccgcgaccaccgcccaatccaccaatttccctacagtcgcaacaatggacgcctccaagcagcccgtcaagctcgtcaaggtcacccgagtcctcggccgaaccggttctcgtggtggtgtcacccaggtccgcgttgagttcatggacgaccagacccgatccatcatccgaaacgtcaagggcccagtccgtgaggacgacatcctttgcctcctcgagtccgagcgtgaggcccgacgactacgataaatgtgcattctggggagcatggggttcttggaagacggtcaacgacggatggtctatgcatgctgaggcgtgcgcgccttgtattgggacattgacctggagctgcacattacccttttggcactccagtttcatttgttagaggaggcacacggacgggtctgggataacgaaaaattccagaacagttcttcttctgcatgcagcattgaaatccgacgaaaaagtgaaattcattcttgtttctctcgcacacgacttcctctatctccttctcaaacacacgtctcgcgccctctcgaagctcggacaaggaaacgaacttgggggggaggatatgcagtcaacacgtgctacgataattcaatgacctcagtttcggtattgacctagcaacaggagaattcatgcctcttcttatgacagaaaaaaaaaaaaaaaaaaggccccta

SEQ ID NO: 35311 - DNA, 933 bp, Triticum aestivum
  Clone ID: PAT_TA_35311
gccggccgggctcggagatctcacacagtctttgatccaaacaacccaaacaaacaccatcatcatgtctcaagctttcgttcagcgccctgcgcccgagtttactgccactaccctcttccccggaggcgagttcaaggacatcaagctctctgactaccagggacaatgggtcgtcctcctgttctaccccatggacttcacctttgtctgccctaccgagatcatccagtacaacaacgccctcgaccgcttcaaggagatcaacaccaccgtcttcggtgtctccaccgactcccacttcacccatcttgcttgggttgagaagcctcgcaagcagggtggtctcggtcccgacctggagctccccctcatcgccgacaagtccaccaagatctctcgcaactacggcgtcctgatcgaggacgagggcatcgctctccgcggtctcttcatcatcgaccccaagggtgtcctccgccagatcaccgtcaacgaccttcccgtcggccgcgacgtcgaggagaccatccgtctcgtcaaggccttccagttcaccgacgagtacggcgaggtgtgccctgctggctggcaggagggcggaaagaccatgaaggccgaccccaagggcagcctcgagtacttttccgcccagggagagaatggagctaaggcatagatgttagatacctccaatgaaacccgaattcccatcaacacccgctctcagtagaaagggcaatgtgtacatacacacccacatacgatagagcatcgacgaccaacacgcgattgacgaacatgtacgaacgggagacgaatacgaaaaaaaaaataccacaatacattacgcttgtatagagtacagtggtcgctttgactggcacgcgaaggaaatagacctagactatagaatatagacatttgttgacg

SEQ ID NO: 35312 - DNA, 780 bp, Triticum aestivum
  Clone ID: PAT_TA_35312
cgggaatacaaacccgccggtaaaaaaccttcgattaattacaaatctctcccacaacatcacacacactcaaaatgactccctcactacaagacgcaaagatcaccttcctcggcggcggtaacatggccgccgccatcattggtggtctcctcgccaagaacaccaacaagcaaaacatttacgtctctgaaccctgggacgtcaaccgcaacaagatggccgacctcggcgtccgcaccaccgccgacaacaaggaggccgctgctgatgctgatgttgtcatcctcgctgtcaagcctcaggttgccaagggcgtttgcgaagagctcagctcagcttgggctggacgcgatagccttcctgttgtcatctccatcgctgctggcatcacccttgctagcattgcacagtggttcaagggcgatagtggaaaggcccctcatattgtgcgcgtcatgcccaacacgcctgcgctggttggtgagggtgcttcaggcctgtatgctgctgaggatgtcactgctgctgagaaggagttgacttctgctctcctgggcagtgtaagcaaggccaccgagtgggttgacaaggaggagcttctcgatgttgtcaccggtatttctggttctggccctgcttacttctttgctttcgtcgagcacctcatctccagcggcgtcagcctgggactatccgagagcaagctacccgccttgccacgcagacctgcctcggtgctggaaagatgctcgtcgagtcatccgatgagccttctca

SEQ ID NO: 35313 - DNA, 772 bp, Triticum aestivum
  Clone ID: PAT_TA_35313
gccggccgggtcgggctcccgccggcgaggaccggacctcccgccgacactaccactcaaaaaccacccaaaaccacccccccaaacagccaaaatggagaacgaccgcggcgagattgtggacctttacgtcccccgcaagtgcagcgccaccaaccgcatcatcaaggccaaggatcacggctctgtccagatctccatcgccaaggttgacgagaacggccgtgccatccagggcgagaaccacgtctacgccctctgcggtttcgtccgagccatgggcgagagcgacgactccctcaaccgactggcccagcgtgacggcctcctcaagagcgtctggagcggacagcgataaatcaacaaagtgtgggaaaaagttactcgacatctggttctgagaatcctcgaaaaggaattctgatacgaatggaccacagggttttgggttcgggcacgaaggcaatgggtgaaagaaactagggttggctgcatctagcaaatccacttcgaggcgttcggctcgattttgagacaacattacgatatcccgaaaacgtgtttaaagatgtgatgaactggttacaatcccccgatacggctggcaaagtctcctaggacagaccttacaagtcaacctactccgaggattctggggctactctgatagtctccgtgccgcagattgattaggctctgaaaaagccgtagcgctcaagtcgtttgctatggtacagatacgggtctaacatgaattttcagttatgtgatt

SEQ ID NO: 35314 - DNA, 688 bp, Triticum aestivum
  unsure (1)..(688): unsure at all n locations
  Clone ID: PAT_TA_35314
gccgctcggccggccgggccgggcgacgacctcacctcccgccgacactaccactcaaaaaccacccaaaaccacccccccaaacagccaaaatggagaacgaccgcggcgagattgtggacctttacgtcccccgcaagtgcagcgccaccaaccgcatcatcaaggccaaggatcacggctctgtccagatctccatcgccaaggttgacgagaacggccgtgccatccagggcgagaaccacgtctacgccctctgcggtttcgtccgagccatgggcgagagcgacgactccctcaaccgactggcccagcgtgacggcctcctcaagagcgtctggagcggacagcgataaatcaacaaagtgtgggaaaaagttactcgacatctggttctgagaatcctcgaaaaggaattctgatacgaatggaccacagggttttgggttcgggcacgaaggcaatgggtgaaagaaactagggttggctgcatctagcaaatccacttcgaggcgttcggctcgattttgagacaacaaaaaaaaaaaaaaaaaaggcccctagaaaaaaaaggcccctaaaaggacctttatccccccaggcgtctttttttcgggcggaaaccgggtaccattatcctgagaaacccttcaanggttaacaaggcccnnttcctcaaanttcacan

SEQ ID NO: 35315 - DNA, 702 bp, Triticum aestivum
  Clone ID: PAT_TA_35315
gccggccgctcctctacctctacttcttaatgcgactctttgccgggcggggtcgggatctcaagtcataccagacaagaatatcgccaaaatgtcctcctccgagcagaccttcatcgccatcaagcccgacggtgtccagcgtggactcgttggccccatcatctctcgtttcgagaaccgaggtttcaagcttgctgccatcaagcttatgacccccggcaaggagcacctcgagaagcactacgctgatctcgctggcaagcctttcttcgctggtctgattgagtacatgaactctggccccatctgcgccatggtctgggagggccgtgacgccgtcaagactggccgctccatcctcggtgccaccaacccccttgcctcttcccccggtaccatccgtggtgactacgccatcgacgtcggccgcaacgtctgccacggttccgactccgtcgagaacgcccagaaggagattgctctctggttcaaggagggcgaggttgtctcctggaagtccgcccagttcaactgggtctacgagaaggcttaaatttgtcattgatacgacaccctaagcgacggaatggaaaagcacatagaagtgggatgacttcatctctgtcggtatatcaaaatcaagacaaaatcttctcaaaaaaaaaaaaaaaaaaggcccctaaaacgaccctagccata

SEQ ID NO: 35316 - DNA, 557 bp, Triticum aestivum
  Clone ID: PAT_TA_35316
gtgcggcgctgcgccggcccggggccggttctcgagcaaacccttcgactaacccatccagcaaaaatggccgctgatacccccgcgaagtccggtctggccgttggcctcaacaagggccacaaaactaccccccgtgttgtcaagccccgtgtttcccgaaccaagggtcacctgagcaagcgcaccgctttcgttcgcgaggttgtcaaggaggttgctggcctcgccccctacgagcgccgagtcatcgagttgctccgcaactccaaggacaagcgtgcccgtaagctcgctaagaagagactcggtaccttcggccgtgccaaggccaaggtcgacgagctccagcgtgtcatcgctgagtctcgccgtgctggtcactaaatcgcttaatctgatttctgggaatctggaaccgaatggggttcgcatggattggcgtggtcacggtatgatctaaaaaattaacggctttgatgctccgtggcaaagaagctgcggctcaccggaataccaacactttcaagcaaaaaaaaaaaaaaaaaaggccccta

SEQ ID NO: 35317 - DNA, 627 bp, Triticum aestivum
  Clone ID: PAT_TA_35317
gccggcggcggccggcgccggccggtgccggattctcgatcaacccttcgactaacccatccagcaaaaatggccgctgatacccccgcgaagtccggtctggccgttggcctcaacaagggccacaaaactaccccccgtgttgtcaagccccgtgtttcccgaaccaagggtcacctgagcaagcgcaccgctttcgttcgcgaggttgtcaaggaggttgctggcctcgccccctacgagcgccgagtcatcgagttgctccgcaactccaaggacaagcgtgcccgtaagctcgctaagaagagactcggtaccttcggccgtgccaaggccaaggtcgacgagctccagcgtgtcatcgctgagtctcgccgtgctggtcactaaatcgcttaatctgatttctgggaatctggaaccgaatggggttcgcatggattggcgtggtcacggtatgatctaaaaaattaacggctttgatgctccgtggcaaagaagctgcggctcaccggaataccaacactttcaagcaatttatggcataatgatcaaaaaaaaaaaaaaaaaaagcccctaaaaaaaaaaaaaaaaaaaaaaaaaaaaaaaaaaaaaggcccctagggc

SEQ ID NO: 35318 - DNA, 1323 bp, Triticum aestivum
  Clone ID: PAT_TA_35318
ttctggtccagcgctgaagaagcggaaaaccccaggcgcccaacgaccttccttccggcgaaaccatcctccgactcctccctcatctccctgctcgccgaggctcagctcaggataaaccatgggtggcgttttgggtttagtgcaggttgatcagtcaactgttgctatcaaagaaacttttgggaagtttaatgaggtcctggagcctggttgccacttcttgccttggtgcatagggcaacggattgttggttacctctcactgcgtgtgaaacagctagacgtccgatgtgaaaccaaaacaaaggataatgtctttgtgactgttgttgcttctgtccaataccgtgcccttgttgataaggcatctgatgccttctacaaactgagcaacacaaagcaacaaatccagtcgtacgtctttgatgttattagagccactgtcccaaagctggagctggacgatgcatttgtgcagaaagatgacattgcaaaagctgttgaagaggagcttgaaaaggcaatgtctatgtatgggtatgagattgtgcaaactctgatagttgacattgagcctgatgtgcatgtcaagagggcaatgaatgagatcaatgcagcttctaggatgaggtcggcagccaatgacaaagcagaggctgaaaagattctccagattaaacgagcagaaggagaagccgagtcaaagtacttggctggtgtgggcattgcaaggcagcgtcaggctatcgtggatggtctgagagacagcgtcctcgccttctctgagaacgtccctggcaccactgcaaaggacatcatggacatggttctggttacccagtacttcgacaccatgaaagagattggggcctcatccaagtcttcttcggtgttcatcccccatggtcctggggccgtcaaggatgtggcatcgcagatcagagatgggctccttcaggccaacactctctaagaggaggaccatggaaagggatagcttctgttttgcaagagttgtgaagttcttcatcattcaccattaccctaaaaacatattttacgcgatagatatttggcaaggtcgtgagtaatttatctacctgtgtgagctactacgttaagttgtgaattttagtgtgaactactacctagataatcagacttgcatggagtgggtttctgtaagaaaagtttagccagattcctgaatgctacttgttgctacttgcaagtgagcctggatgcttaccagtcttatcttaattattatttggtgacaataacaaaaaaaaaaaaaaaaaaggcccctaaaaaaaaaaa

SEQ ID NO: 35319 - DNA, 783 bp, Triticum aestivum
  Clone ID: PAT_TA_35319
gccggccgttccgggtttggtatctactacaaccacggccagtgctgctgtgctggtacccgtatctttgtccaggagtccatctacgacaagttcctcgctgccttcaagaagcgagctgaggagaacaaggtcggtgaccccttcaacgaggagaccttccagggtccccaggtctctcagctccagtacgaccgtatcatgggctacatcaaggccggtaaggacgagggtgccaccgtcgagatcggtggtgagcgtctcggtgacaagggttacttcatcaagcccaccatcttctccaacgtccgccccgacatgaagatcatgcaggaggagattttcggccccgtctgcgctatttctaagttcaaggacgaggctgaggtcattgaccttgcccacgacaccgcttacggtctcgctgccgctgtccacaccaagaacctcaacactgccctccgcgtttccaacgctctcaaggccggaactgtctgggtgaactgctataacatgctacatcaccagctcccattcggaggctacaaggagagtggaattggacgagaactcggcgaggcagccctcgccaactacacacagaacaagtcggttgccatcaagctgtactaagcatagcaaagcgaattggggactttccaaggaaatatgggcggcgttgtaactgcatgatcaatttttatatgattccactttagttttacgcattcaatgaagaaatgttaaagaaaaaaaaaaaaaaaaaagaacaaaaggccccta

SEQ ID NO: 35320 - DNA, 837 bp, Triticum aestivum
  unsure (1)..(837): unsure at all n locations
  Clone ID: PAT_TA_35320
ggcgctcgaggcggtcggttcggggaactcccatcagctcgtaactatattgcgccgatttgtctatttctcctccagatcaactttgacatatcgagcttagacaattaattgttgcccaacatgccggcatacaactccgtcttcaactcggaccctaatgtcccccgtataatcggcaacttccctcttcttcctctccgaaccaagacccgcggacctgcctacaccctgcccgccccctcgccgcctctgccggccaacgagtcacccgatcccgacagtgacagctacgatatccttgacgaggtcctcgccctcttccgtgccaacacattcttccgaaactttgagattcaaggccccgccgatcgtctgctcgtctatggaatctggtttgtcagcgattgtctgaccaagatccgccctcatgcttctctacgtgatgcccagaaggatgtcatgaacctggcgcttgaccttaactttgctattcccggcgacccaggatggcctcttaaccagatgtacgaggcccccaaggacagacaagaggcggagcagctcaagcaatacatgtcgcaggttcgacaggagcttgctgctcgattactcgctagggtatacgacgaggatgagaccaagcctagcaagtggtggttgagctttaccaagagaaagtttatgggcaagtcgctgtagagtattggcaaggattgctgtgaggtgaacgtatttagaagactaccatgatacaaacgttgaggagctagcaccatacaaaatatattttccagtacttgcgccttaaaaaaaaaaaaaaaaggnccctanngg

SEQ ID NO: 35321 - DNA, 966 bp, Triticum aestivum
  unsure (1)..(966): unsure at all n locations
  Clone ID: PAT_TA_35321
gccnggccgggttctgggaaaaaaaaaaggcgattcctccacggcgctcgaagcgcgtcgtggtatttcgcgtattgtaatttcaacacgagcggggtcaaatcctttgcagacgacttagctgtgcgaaacggtcctgtaagcagtagagtagccttgttgttacgatctgctgaggccgggccgccggccggttgaacaccggaaaagtcgacaatcacccacagccgtcgccatgcctacccgtttgtcgaagacccgcaagcaccgcggccacgtttccgccggtaagggacgtgtcggaaagcaccgcaagcatcccggtggtcgtggtcttgctggtggtcagcaccaccaccgtaccaacatggacaagtaccatcccggttacttcggaaaggttggtatgcgatacttccacaagcagcagaaccacttctggaagcccatcatcaacctcgacaagctctggtctctcgttccccaagagacccgtgacgcctacgtcaagggtgagaagaaggacaccgtccccgtcctcgacctcctccctctcggttactccaaggtcctcggaaagggccgtctccctgagatccctctggtcgtccgcgcccgctgggtcagccgccttgctgaggagaagatcaagcaggccggtggtgtcgttgagctcgtcgcttaagcgaagcatcgcaactgttctgtaaatgcttgaggagtcggttgggcttgtatgggaaattctacaaacggaaaacaaaacctctccaaccccggtgaagaacaaagcctgcgggcactggagaagaagaggtcttcctgcgctcgggaaagatgggccagggacctaggtcggtcggcttcgggcattgcatcagggactcttgcacggagttaacgaaataaaaatcgattttcgcccatgaaaaaaaaaaaaaaaaaaaaataccctaaggccctagg

SEQ ID NO: 35322 - DNA, 515 bp, Triticum aestivum
  Clone ID: PAT_TA_35322
gcgccggccggcccgggatcatcacacatcaatccaatcctcactcacaaacactttcaaacaaaccaacccccaaacaaccaaccactatcacaatggagtccctcaagcaaggtgtcaactacgtcgctgagaccgttcagcaggccgcctctggtgcttccaaggagaccaacaagcaggtcgccaaggacagcaatgcccccatcggcacccgtgcctccgctgccaaggacgccctgtccgacaaggccgacgagaagacccatgagggtaaggccagcgtccacaaggaggccatctaagtttgtcttaatcgaagaacgacatgatacagaaatcaccttctgaagacatggatcgcaacggcgttgaaagggaatagcgttgggactacataggctgtatacacctacacctaatacaaacagtcaaataccaaaaaaaaaaaaaaaaaaggcccctataaaaaaaaaaaaaaaaaaaaagaaaaaaaaaaaaaaaaaaggccccta

SEQ ID NO: 35323 - DNA, 883 bp, Triticum aestivum
  Clone ID: PAT_TA_35323
ggcccgctcgagggccggccgggccgagatacttttacccatcgaacactctcaaaccaaacaacatcataccaactcagttctcaaaatcccacaaacatctgctactacaatgtctgacgaaacggccaccaaatttgaaaccgtctccgatcttccaccgtctctggccgctgccgcctctcagatggtgcagtacgccggaacctgcgtcgaactcgagacagatgaagtaaccaagcaagacaaacgccgattcgactggccatctttcaagaaatgcttcgatgattatggaggcatcgacctcgctatgctggattacaaagaattcaccatctctcgtagcgaaatcgatctcagcatgatggtccagaggatcgtggagtccttcgtcagggagttccatatcatcggatatgaaaatgttaccacgttgctccggactaccattgagaagacatttaccaacctggaagaaaaatcctcgaatgagtgtttgtatttcagcaagtctgctggcgggcaaggttcattttgggaatatggtgttcatatagcggtccctatcccgagttcggccaattccttccacagttttatcactaccatcaaattggaggcagatgtgtctgaccagaatgattggtggggtctgacaggctcctcgagaaagaacttttccgctacgatgaacggaatgaagttcgaggtggaagaaggcttcaagaactaagaactcgacacccctcttgtccagctctcttctagccaagacagaaattgactgtacttgattagcttatatcactctacacgcctctttatcaaaacagtgataaatttgaaaaaaaaagaaaaaaaaaaaaaaaaaaggccccta

SEQ ID NO: 35324 - DNA, 713 bp, Triticum aestivum
  Clone ID: PAT_TA_35324
gccggccggtccggggccggccggccggtgaacacacgatcgactctgagcaactggaccgccaaagttgcccatcatgtcgctcgtctcgggagagaagtcgaacttccagttcattctccgtcttctcaacaccaatgttgacggaaagcagaaggttatgtacgccttgaccaagatcaagggtgtcggtcgccgatactctaacttggtctgcaagaaggccgatgtcgatctgaacaagcgcgctggtgagctcacctccgaagagcttgagcgaatcgtcaccatcctccagaaccccacccagtacaagatccctacatggttcatcaaccgacagcgcgatatcgtcgatggcaaggactctcacatccttgctaacggtgtcgactccaagctccgtgaggatcttgagcgcctcaagaagatccgcgctcaccgtggtctccgacactactggggtctccgtgtccgtggtcagcacaccaagaccaccggtcgccgtggcaggaccgtcggtgtctccaagaagaagggtggttaaactatttatcggtgttggttacgggtggacaggcgtgacggctggtttcatctttctgagcattctgagggttttgctttccggcatacgcagctatggctgtactctagatcagagtcacgaatcaaaagcattcaagcaaaaaaaaaaaaaaaaaaggccccta

SEQ ID NO: 35325 - DNA, 858 bp, Triticum aestivum
  Clone ID: PAT_TA_35325
ctgtgcggcggccggcgccggccgggccggaaccaccgatcattgaacacacgatcgactctgagcaactggaccgccaaagttgcccatcatgtcgctcgtctcgggagagaagtcgaacttccagttcattctccgtcttctcaacaccaatgttgacggaaagcagaaggttatgtacgccttgaccaagatcaagggtgtcggtcgccgatactctaacttggtctgcaagaaggccgatgtcgatctgaacaagcgcgctggtgagctcacctccgaagagcttgagcgaatcgtcaccatcctccagaaccccacccagtacaagatccctacatggttcatcaaccgacagcgcgatatcgtcgatggcaaggactctcacatccttgctaacggtgtcgactccaagctccgtgaggatcttgagcgcctcaagaagatccgcgctcaccgtggtctccgacactactggggtctccgtgtccgtggtcagcacaccaagaccaccggtcgccgtggcaggaccgtcggtgtctccaagaagaagggtggttaaactatttatcggtgttggttacgggtggacaggcgtgacggctggtttcatctttctgagcattctgagggttttgctttccggcatacgcagctatggctgtactctagatcagagtcacgaatcaaaagcattcaagtaaaatcttcattatgggacgggagatgttttatggcaaaaccatgtgaaactatggtcaaacgaagtccacgaaaggtcaaaaatgaaaggtgttcgccaagaaaaaaaaaaaaaaaaaggcccctctaggaaggtatcatgatttcttttttagc

SEQ ID NO: 35326 - DNA, 694 bp, Triticum aestivum
  unsure (1)..(694): unsure at all n locations
  Clone ID: PAT_TA_35326
gtgcggccgcttcgaggcncggccgttcaccggcgggcggtcgagtgaccatccacatcaccaagcaaatcattcaccatgggtaaagttcacggatctctcgcccgtgccggcaaggtcaagtctcagactcccaaggtcgagaagcaagagaagtccaaggtccccaagggccgtgctctcaagcgcctcaagtacacccgtcgattcgtcaacgttaccctcactggtggcaagagaaagatgaaccccaaccccggctcttaaacgattggttaaaaacgacaatatgtgcggaatcgggaatgttggcttgcggaccacaacaatggttgacttcactcagtaatgggatgatggattgggtcgggtcgcatggaataggctgagcccccttgagaattaaaaaaggaaatggcaaagaagcgctacgaccctactcggcgtccggtgtcagttgtcaaatgcaacaacatttgttcgcacattgtgccgcgacgtgaatgtcggtgtttctgtctatggtgatatctggtctgcttggtgttgggctgtcgtagaggatttctgggggcaaattcggcgagtgactcacgccggcggatgacatctacgattctggtgcctcaggatcgcaacaaaccttgttcaatgcaaaaaaaaaaaaaaaaaagaaaaaaaaaaaaggccccta

SEQ ID NO: 35327 - DNA, 620 bp, Triticum aestivum
  unsure (1)..(620): unsure at all n locations
  Clone ID: PAT_TA_35327
gccggccggtttcgaaaattcccccaatcttaccgccggccggccgactcaccatccacatcaccaagcaaatcattcaccatgggtaaagttcacggatctctcgcccgtgccggcaaggtcaagtctcagactcccaaggtcgagaagcaagagaagtccaaggtccccaagggccgtgctctcaagcgcctcaagtacacccgtcgattcgtcaacgttaccctcactggtggcaagagaaagatgaaccccaaccccggctcttaaacgattggttaaaaacgacaatatgtgcggaatcgggaatgttggcttgcggaccacaacaatggttgacttcactcagtaatgggatgatggattgggtcgggtcgcatggaataggctgagcccccttgagaattaaaaaaggaaatggcaaagaagcgctacgaccctactcggcgtccggtgtcagttgtcaaatgcaacaacatttgttcgcaaaaaaaaaaaaaaaaaaagaccctaataaaaaaaaaaaaaaaaaaggcccctagttcccccccccccccccccccccgcggggagaaaaaaaaaaaaaaaagagggggggggnnnnnnnnnnnnnnnnnnnn

SEQ ID NO: 35328 - DNA, 528 bp, Triticum aestivum
  Clone ID: PAT_TA_35328
gcccggcccgggctgtcgatcaaaaaccgcttccttcttcattcacgctcatcaacaacaaaaccaatatctccaaaccaccacaaacccttcatcaccacaaacccttcatcaccacaaacaatccatcatcatgcctcgcaacggagacggttcttctgacaacggcccctttgaggaggccaagcacgacatcgtccacggcgctggcaaggtcgagtctgaccatgtcgaccgtgccgacaagaccgctgaccttcctgagggcaaggacgagaagggcttggctctcgagggcgtcaacgccagcggcggccagagccagggcctcgccaagggcaaggacgtcggacagggcaactagaagtaaagcgaggaactttctatttggcagagagatgagagaacagaggatgaacaatacctaatgctgtctgcacgggaaagtgcatcacgatgacaacgaaatgaatacaaagaaatgaccaacgaaaaaaaaaaaaaaaaaaggcccctaaggcgcgcgcg

SEQ ID NO: 35329 - DNA, 846 bp, Triticum aestivum
  Clone ID: PAT_TA_35329
gccggccggtccgggacaagactatcattacaacaccagaaaaaccatcactatgcctcgtaagaagctccgcatactgtgcttcggcgactctctcacctcgggctattactgccaggggctgatgtcgcacccgtacgctgctaagctagaggatcgactcacaggcacctttccagaggtggactttgacattgttgtaagcggtgttcccggtgacatcgcttcttctgaacgtttctctatcagaacgaaaactgcctggcgcgcaagagcatatgactggactattgtccttggcggcaccaacgatatcgcattcggtattcccccagatgtcattttctcatctctgaagaaaacctacgactttgcccgggacaagggcgccaaagtccttgcccttaccgtcccagaatgcagcgcagataacgagagaaccatggcggcgaggaatgcgctcaacgaacgtattctcaagaacaaaagtcggaattactacgcattcgacctcaggtccaagattccgtttcattccctttcacaacaagatcgccacaggtactgggacgatcatgtgcatctagggaaagagggctgcgactggatgggtaaccacatcgccgacgctttgatagacattctatggcacgaaggcacgttcgagcagccgtcagaaccatcagatgaggtagacgtggaagaagagttcgtctatgacgaggaggatggcaacccacacaatatcaacgagggctatattgttgtccgcaagaaagatttggactaactagagtgttatatactgttgggataacttgacatggaaataatttgcacatgacc

SEQ ID NO: 35330 - DNA, 728 bp, Triticum aestivum
  Clone ID: PAT_TA_35330
gccggcgccggccggcggcggtactaccaacaaacccgaacctcaactaccctcacaaccacttcacaatgcctcgtcaacgatccgtcggccgcgctccttcgcgccctaccgccgctgcttctgctcccaagccccagcagactcgacctgccgccacccatgctgctcccgctgctcaccctcctgcccaggccatgcctcctcaggctgccggttcccagggccctggactttttggtcaaatggccagcactgctgccggtgtcgctatcggttcctcagtaggccatgccatcggtggtatgtttggtggctcctccgagcccgctgctcccgtccaggctcaagccgccccccaagagcagtcctggaaccaaaacaactgcgccggtgtcgctcagaactttacaaagtgcatggatgacaacaacggaaacatgcagatctgcaactggtaccttgagcagctcaaggcttgccaggctgcttctggccagtaagcgttgggaaatacgaataatagaacttgatatcattatgggaaaggaaacaacatcggggataaatcccctggcagcgtgcgtgctaatagagactcggcgagaatactgttgcatctcggcacaaccaattgtataatacaaaacaagatctcactcaacccacaaattgggaactcaactatctttctcctcctccaaaaaaaaaaaaaaaaaaggccccta

SEQ ID NO: 35331 - DNA, 680 bp, Triticum aestivum
  Clone ID: PAT_TA_35331
caatatctgcccctgcaggaggcaatacgaattccccaagaatcaggggaacctattgacttgttgggggctcatgcagaccgcaataaccagactgctagttgtgcccaggatatccgtggatggactgcgagcggtgagactgatacaaacaccaaacacattgattgccccagaacgcggcaacgagactggcttgcagaactttggttacaacggcactggatagtgatcggtctcgtcgtgaagctgccttgatgaaattccgcatgaaaaggaaagatagatgcttcgagaagaaggtcagatatcacagcaggaagaagcttgcggagcaaagaccaagaatcaaagggcagtttgtgagccaaaaactcaagtcagctacaacaacggaagatgcggaaacagactagtgatgtccatgactgtacttttgatactttgcttcccagccgagggaggggcgtttaaagtataactggtaagagtgaaaggctggcaaaagttttccttccagggttagccttttgtacaagtgttccgtgtactccattgtcggttgtttattgacatggtttgcctgtaaagagtgtcgaattgaaaatcctctggggggataggaaatcaatgcagatattcagattttccgtcaaaaaaaaaaaaaaaaaaagccccta

SEQ ID NO: 35332 - DNA, 626 bp, Triticum aestivum
  Clone ID: PAT_TA_35332
gccggccgggtcactcaatcattcatcacccaccattctcccggccgccggttctttggttctcgcctgaaatcttctgtctgcgagctcgcaccgcatcagtctcgcggtatcatctgtagcagtagcagtagcagaggagcaacatgaagcaaaagatggtgatcagggtgcacatgacctgcgacaaatgccggtccaaggcaatgggcttggttgcctccatttacggagtggagcgtgtggagatacagggcgacgacagggaccggctggcggtggtcggagatggggtggacgccgccaacctcacggcctacctgcggaagaaggtggggaacgcggacctcctcacggtggaggcggtcgttcctgagaagaagccggcgccggcaccggagaccaccgaggctccgtggtgtcccggctattactcctggccggcaggggcctactcccactgctatccgtacacgtacagcatgtaatctcttgtatgtctgcggtatttgtcgaattgatccatgtaatctttttgagacggagacaaagttttgcccccatcatattaattaagaagagtttaacaaaaaaaaaaaaagaaaaaaaaaaaaaaaaggccccta

SEQ ID NO: 35333 - DNA, 1459 bp, Triticum aestivum
  Clone ID: PAT_TA_35333
catccttcactgacaagagcgaagccagcacaaatgagaagatccattctcgcgttgcaagggctcaatccaagtctgacgaacctgccagcagagcgagctcgccaaggcctacagggtcatcaagccccaggttagtgcagaggaaggcagagtcggagaggaggtctcgtcccccggtctcaccggagtctccaagcaagaagtcaaatgaagcagcatccccaaggcgcggggcaagatcaaagccttctcaagtgaggagcaaccgtgacaatgaggcctcgcagagtccaggaagaaggatcagcttggcgaagcagattgacgtcagtgtaatggattgtcaaagtcctctggctgccagatcatcgttcattgacccaaacacaccgagccaaaagagcccttcttcaatcctgggttcagatcacaagatccattcactggagaacgccctgagccccgtgtcggtcctcgacacatccttctaccataaaagcatctcagattcattcaaagatggcgagacgcatacttcagacgaatgctggaattcaaacagcctgccggacacgccgcaagtcgaagacgagcagtgaagtcagccagatcaaaccaagaaaacctggaggcgctcattcagaaacttgaacaattgcaatcgatgaacgatgaagctgcaaactccaaagatcaccagtatatctacgagatactcttagcatctggtcttctgcacaaggaacttagcttcgcagcgatgcctgcacaactttcgccatccagttgcccgatcaatccagagctcttcctcattctagagcaaacaaagccgcacttcatttcagcgactcaggctgttaccggagccaagaagagttctgaccctaacatggggaagcttcatcgcagaattgtgttcgatctggtaaatgaaattatagctcagaagatgaacatctatagctctgcaagtggaacggcgaaacttcttcggtcaaggaagttaagtgggtggcgtcttttcaaggaattgtgcacagaggtcgacaggctcttatccgagagctcggcagcgaaatgctccgaagaggatgaggatgaaaacataccattatctgaggatgcattgtatgagatgaaagattggggtagccctgaaggtgagctacaaggcatggttttggacattgaaagatccatcttccgggacctcattgacgaggtcataggttgcgaggctacagagaggatgcaagctggacaatggaaactgcgtaggcagctgtctttcagtagtataaactgaatacgactggcgatagtcgttgtttccattaggaggcttagccactagtataaatgtaaccctttgtatttttctgaaaactgaattatatagaagaaatataattattcctggaaaaaaaaaaaaaaaaaaaaaaaatcaaagcaa

SEQ ID NO: 35334 - DNA, 442 bp, Triticum aestivum
  Clone ID: PAT_TA_35334
ctgtgcggcgccggccgggcggtgtcgagactgacacatatccaagcttccatttcccaatctccactcctcaacgtcaagatgctctcccgcgccgccacccgtaccacgacctctctggtcaccaagcgaggcttccagaccacccgcgctcgcatgtcctcgccttaccactaccctgagggcgcctacagcaacatccccttcaacccccgcagcaagtggttcggcgttggctactggaccttcatggccaccggtttcttcgctcccttcggcattgctgtctggcagacctacaagccccagtaaattcgtcgctcacgaactgggtttgttgtttggttgaaagaacgggagccttgcggcggcggaatgtggtgtacataaccgaaatagacatcagtcattctcgagaaaaaaaaaaaaaaaaaggccccta

SEQ ID NO: 35335 - DNA, 593 bp, Triticum aestivum
  Clone ID: PAT_TA_35335
gtgcggcgctcgcggcggctggtgcggggctcgtatcatcactgacacatatccaagcttccatttcccaatctccactcctcaacgtcaagatgctctcccgcgccgccacccgtaccacgacctctctggtcaccaagcgaggcttccagaccacccgcgctcgcatgtcctcgccttaccactaccctgagggcgcctacagcaacatccccttcaacccccgcagcaagtggttcggcgttggctactggaccttcatggccaccggtttcttcgctcccttcggcattgctgtctggcagacctacaagccccagtaaattcgtcgctcacgaactgggtttgttgtttggttgaaagaacgggagccttgcggcggcggaatgtggtgtacataaccgaaatagacatcagtcattctcgactcttgattcgaaatttcatttgtccgaaaaaaaaaaaaaaaaaaaaacacgaaaaccgagtgctcaaataccagtccaatgcgatgcaaatccctgccaacccaattttttatatacagaatctttgtcccggggtattaaaaaaaaaaaaaaaaaaggccccta

SEQ ID NO: 35336 - DNA, 1080 bp, Triticum aestivum
  Clone ID: PAT_TA_35336
gccggccgggcctccacagcaggccttgcatttgcattttgcaagtaagccgaacatcacagcgaatcgcggcggcggcatccccccttgccatccgtggcctcatctctgacctctcgccggccccggcgtcgccgacgcgatgcctccgctccccaggctcctccaccgccacctctctgccccgttcgcccgccgcctcaccccttgccatctgtggcagcccgcggcggacgtcttcctccgtcgcgggctcgcatcttcctccgccgccgccgccgccgcggcagcgggccgggagaagagctctaggaagaccctgggttaccttgttggcgtggcagtcgccatggtcggcgcctcctacgccgccgtcccgctctaccgccggttctgccaggccaccgggtacggcggcaccgtccagcgccgcgagagtgtagaggagaagatctcccgacatgctcgagtcggaacgacgccatcaagagagatagttatccaatttaatgctgatgttgctgatggaatgccatggaagtttattcctacgcagagagaggttaaggttaagcctggtgaaagtgctcttgcattttatactgctgaaaatcgcagttcagctccaattactggtgtgtccacgtataatgttgctccgatgaaggctgcaatttacttcaataaaatacaatgtttctgctttgaggagcaaacacttcttcccggggagcagattgacatgccggtattcttctacattgatcctgagtttgagacggaccccaaaatggacggggtgaacaatattgttctttcctatacattctttaaggtgaaagagtaggaatatttgtaagtgacctgcaacactaattctattgaaacagttacgaaaatcatgtgcctaagaattccttctcatgtaacaccaagagtaaaaggctaggtttttttatgtagttattattagttcacatggttggtgggaatttttgcaaataatctgtaagagttgctccaatgcaatcaaatttcagaaacagttttgtgccaatctcaagaatcaaggaggggaac

SEQ ID NO: 35337 - DNA, 572 bp, Triticum aestivum
  Clone ID: PAT_TA_35337
gccggccgggtcgggaactaaacacacacggataatttagcaaagagcagagttacctcagagacaaaggaagaagagaggcgaggtagctagcttcagacatggggttctgctgtgggccttcggatgtccaggtgctccccaagaacacgtcctcctcctctccctcctcctcctcgtttgttaaagattccggtgatggcggcaagaagaaacagcagcaagttataaagaaggaacaggggaaggagaagaagatgagcaaccttgaccgggccgccctcacaacaccccgcctccccttccattctcgacccggtctaatgtgacagattagccgagaaccagtgtatttcatagaaatatatgatcttgtgtgttctcctattagcctacgtctgagtctgtaacttaggatgtatagctccattgtcccgttgaagtttcgaggtttgcagtgtggccacgtgttctatttattcattgatgggttggctgtatcagaatatccaaattgcaggtgtgttataataaaaaaaaaaaaaaaaaaaaaccaaaaaaaaaaaaaaaaa

SEQ ID NO: 35338 - DNA, 840 bp, Triticum aestivum
  Clone ID: PAT_TA_35338
gccggccgggcctggacgaccttacttgaacaggatctgttctataggctcgtaccgctgcatcctttaccaataaggaggcaagcacttcagtctggttgatgcattctaacctctgggccagagcgtgattaacggccaggatttccctgatggggcaatccaatggctgtagaggatcgttcctgccttgctcatgcctgtgcagggtggcccagaggttgtctgacagactacaaaatataaaaaaaaaaaaaaaaacacacacggataagttagcaaagagcagcgaagtttttctgtaggctgaagagcagagttagctcagagacaaaggaagaagagaggcgaggtagctagcttcagacatggggttctgctgtgggccttcggatgtccaggtgctccccaagaacacgtcctcctcttcctcctcctcatcgtttgttaaaggttccggtgatggcggcaagaagaaacagcagcaagttgtaaagaaggaacaggggaaggagaagaagatgagcaaccttgaccgggccgccctcacaacgccccgcctccccttccattctcgacccggtctaatgtgacagattagccgagaaccagtgtatttcatagaaatatacgatcttgtgtgttctcctatataaactacgcccgagtctgtaactcaggatgcatagctccattgtcccgttgaagtttcgaggtttgtagtgtggccacgtgttctatttattcattgatgggttggctgtatcagaatatccaaattgcaggtgtgttataatagagattttgtccattgtccatcaggacaatatatttttccct

SEQ ID NO: 35339 - DNA, 676 bp, Triticum aestivum
  unsure (1)..(676): unsure at all n locations
  Clone ID: PAT_TA_35339
ggccgggtnatcttaaaaaaaaaggaaaaacagaaaaaaaatacaacagaaacgcacacggtccagtttgttaaaacagagcagctaagtttttcatttgctgaagaacagagtgagctgcgagagaaagcatagaagagaggcgagcttgctagctgcagccatggggttctgctgtgggccttcggatgtccaggtgctccccaagaacaccgccacttcctcctcctcatcctcctcgtcttctgctaaagattccggtgatggcggcaagaagaaacagcagcaaggtgtaaaggagcaggggaaggagaagaagatgagcaaccttgaccgggccgccctcacaacgccccgcctccccttccattctcgacccggtctcatgtgataaattagccgagaacagcagtgtatttcatagaaatatacgatcttgtgtgttctcttattagtctacggcggagtctggaacttaggatgcatagctccattgtcccgttgaagtttcgaggtttgtagtgtggccatgtgttctatttattcattgacgggttggttgtatcaatatatccaaattacaggtgtgttataccagagttcattgtccatcaggataatatatttttttccctaaaaaaaaaaaaaaaaaaacacctaaaaaaaaggcccctat

SEQ ID NO: 35340 - DNA, 644 bp, Triticum aestivum
  Clone ID: PAT_TA_35340
gagtttcgaaaccttccactggaagtttgcatcgagccactcttttccactaaaaacaggtcgatgggagcatatcgtttgccaacataaacacacacggataagttagcaaagagcagagttacctcagagacaaaggaagaagagaggcgaggtagctagcttcagacatggggttctgctgtgggccttcggatgtccaggtgctccccaagaacacgtcctcctcctctccctcctcctcctcgtttgttaaagattccggtgatggcggcaagaagaaacagcagcaagttataaagaaggaacaggggaaggagaagaagatgagcaaccttgaccgggccgccctcacaacaccccgcctccccttccattctcgacccggtctaatgtgacagattagccgagaaccagtgtatttcatagaaatatatgatcttgtgtgttctcctattagcctacgtctgagtctgtaacttaggatgtatagctccattgtcccgttgaagtttcgaggtttgcagtgtggccacgtgttctatttattcattgatgggttggctgtataagaatatccaaattgcaggtgtgttataatagagattttgtccattgttcatcaggacaatatatttttccct

SEQ ID NO: 35341 - DNA, 668 bp, Triticum aestivum
  Clone ID: PAT_TA_35341
gtgcgctgcgctcgtaccgccggatgcgttaccagcagaaactcacacggtccagtttgttgaaacagagcagcttagtttttcatctgccgaggagcagagtgagctgggagagacaggaagaaaagaggcgagctagcgagctgcagccatggggttctggtgtgggccttccgatgtccaggtgctcccccatacgaccaccacttcctcctcatcctcctcctcgtcctcctcctcctcgactaaagattctggcgatggcggcaagaagaagcagcaagaaggtgtaaagaaggaacaggggaaggagaagaagaggagcaaccttgaccgggccgccctcacaacgccccgcctccccttccattctcgacccggtctaatgtgacagattagccgagaaccagtgtatttcatcgaaatatatgatcttgtgtgttctcctattagcctatggccgagtctggaacttaggatgcatagcttccatagctccgtcgaagtttcgagttttgtaattttgccacatgttctatttattcagtgatgggttggctgtatcaaaatatccaaattgcaggtgtgttataatagagattttttccattgtccatcaggacaatatatttttcccgaaaaaaaaaaaaaaaaaaaaaaggccccta

SEQ ID NO: 35342 - DNA, 810 bp, Triticum aestivum
  Clone ID: PAT_TA_35342
caagaagtttttcagcccctcaagaaccatccctcgtttcaatgaattgcttgagaatatatacacagtgttggatttcttcaacagtagaatggacatgcaacagttagacggggaatggtctgttgacaaggttcttgagctcattaataaaaattgccgttcatggcgtggagaaggaatgaagatgtttacgcagttacggtttacatatgagcaagaaagtcatcctgaggaattcttcattccatatgcatggaggcttatactatcacgaggattctctttcaatcctggtgccataaatttgttccccgtggagatccatgttgatgattcaccatccagcgaacaaaaggtttagggatgatctggagcctttgggttctgacaacacacaaaaatgttggacttgcatcctgacaaagagactgttgtatataggcggcatatgataatcaaagtgtattttcattcattttgtgttaatatttctgttgtcccataatgtaataccagaggtggggggtgtgaggaattgcaggggattgtatctggttcttgaaagtaggtagtgcatagggcaccatacacaattcgtttataagttatatcgttgtattattagagcaagtacaatagcctgcttccgtggtaattttgcatatgtgacagagagacatgcaaaattgaggggaataagctcttatgcaagagtctagctatatgcgtagagttggaaaaagtactatgactataaatgatgactacatatgacatggcgaaaaaaaaaaaaaaaaaaggccccta

SEQ ID NO: 35343 - DNA, 1424 bp, Triticum aestivum
  Clone ID: PAT_TA_35343
gccggccgggtcgggacacaaccatagatttggtgaggcctcgttactgaccatctggtcatctatctcttttctttctttcttttctttgtataccttctttttctattactcgagatagcttcacttctgtttttattgttcatgtcttatacgaaccatcgtcaacatccgatagtggggttggcaacaggcggcatcgagtggatccctcagccgttgatccctggtttctcgggcttccttcctgcttcccctacggctacagctacaggcccagctcggggcgttttcgctagagtacgcacgcactgcagagtcgactcattcgaatgagcatgccacttttccatcaacaacagacaggcgaacgccggaacaatagaattggacgacgattgattccgataaaaaggcgggcgggggcgggatcaacttcaagccacagtcttcaagcgcatcacagtcaaaatggtctccttcacctaccttctcgccgctgtctcggccgtcactggcgccgtcgctgctcccaaccctaccaaggttgatgctcagcctccttccggtcttcttgagaagcgcaccagccctacaactggtgtcaacaatggcttttacttctccttctggaccgatacccccagcgctgtcacctacaccaacggcaacggtggtcagttcagcatgaactggaacggcaaccgtggtaaccacgtcggtggtaagggatggaaccccggtgctgctcgcaccatcaagtactctggtgactaccgccccaacggcaacagctacctcgctgtttacggctggacccgcaaccctctcgttgagtactacatcgtcgagaacttcggcacctacaacccctcttccggtgctcagaagaagggtgagatcaacatcgatggatccatctacgacattgctgtcagcactcgcaactgtgctccttccatcgagggtgactgcaagaccttccagcagtactggtccgtccgccgcaacaaacgatccagcggatccgtcaacaccggtgctcacttcaacgcctgggcccaggctggtctccgcctcggaagccacgactaccagatccttgctgttgagggttaccagagctctggccaggctaccatgactgtctctggataaatgcttcgatagcatgatcagtttccggagtctttggagctgaagaccaatgtcaattggctggttactctcaagatgtgaatatgaattcccggaaggacctttgaccaaggctttatggttattaggctggacttgtagctggacttcacgcaggacctgtctctatttcaatgtacataacttcattttcaatgaatatacaacctcagtcggcttgcccggctttcttgctcttccaaaaaaaaaaaaaaaaaaggccccta

SEQ ID NO: 35344 - DNA, 634 bp, Triticum aestivum
  Clone ID: PAT_TA_35344
gccggcagggccggcatcgaagcccattctttgacgacgacgaaatcgacgagcaattgaacgacgacacaggcttccaccgccctacgattcaagatggtttcctacactcccatccgcatggcggaattcaagagcaactatggtcctaagtaccatgctcagcccaacctcgctggctacactgctcagtctgccttccgaattgcttcccgtctggccatgtacggtgcccctgccgctgttggtgtcatgctcttcgccaacggtatcccccgtgtgcagcgtgatatcctccagaagatccccgtccttggtggcttctttcgaaaggaggtccaccccgccgacaaccccttctaaatcaactggtgtattgcggaagatagacgttgctcagcgccgttaccggttctccttgtaaagatatctcaatagacatgttctgagaaaaaaaaaaaaaaaaaaaaaaacaaaaaaaaaaaaaaaaaaaaaaaaaaaaaaaaaaaaaaaaaaaaaaaaaaaaaatgcgtcaattttcctacaagttttgggctgggattttgctatattatgaactccttccgttactaaatataagtctttcaaaaaaaaaaaaaaaaaaaggccccta

SEQ ID NO: 35345 - DNA, 618 bp, Triticum aestivum
  Clone ID: PAT_TA_35345
tacggacacatctagccaacattccgcaatacgcaagcaggcaacaaccgcagccccaagcaaaccgaagatggggaaggagttcgggagcatggaggagttctgggggttctacctgggccagcactcgaagccggcgacgcggcgctggcacttcgccggcacgctcgcctcgctggtgtgcgcgctgctggcggccgccacaggccgcgccgcgctcctggtggcctgccctgtgctcggctacggcatggcctggtacagccacttcttcgtggagggcaactggccggccaccttcggtcaccccgtctggtccttcctctgcgactaccgcatgttcgccctcatcctcaccggccgcatcgacgccgagctcgcccgcctccgcgtccacccgcgcctcgcctccgactgaccgatccggccgcctcttcgccgtccgtgccgtgccgtgccagcatcaatcaaccaataaagattccgcgcacttgcaggtgtgtcggagcatttgtctactgaggttcctggtgtatgtgtacttgctgcgcatttctctacgcacacaaaaatactactccctcctttccgaaaaaaaaaaaaaaaaaaaggccccta

SEQ ID NO: 35346 - DNA, 540 bp, Triticum aestivum
  Clone ID: PAT_TA_35346
gccggccgggatcgccggccggttcgggactctcttaccaccatcctgtctcattcttaagaaatcaactattaattctccttgaccatactacaatggctgcacaacttcgccttcaagattccaaggagaaattccaagctgcgtataacgcagctgtcacccagaaggaaagttcggagaaagactggaaagacgaaaaggaagcgggtatgcacgatcaggaattcgatcaatggtttcctataaatgcacccgcctacgctgttgcttttcaacaataccgaggcgctagagctgcatacgaggccgcacttcacgcagttgatgagcaagctgctaggtcttggcaggaaaaggtcagacaagcggtgattgacaacaagctcaactacaacatattgatcggacctgatgaatgaggtttagacctagataatctacagcaatcatgccataacatgcactgattcgaaaaaaaaaaaaaaaaaagacccctaaaaaagaaaaaaacaaaaaaaaaaaaaaaaaaggccccta

SEQ ID NO: 35347 - DNA, 762 bp, Triticum aestivum
  Clone ID: PAT_TA_35347
gccggccggggcagcgaacgccacaacgtcaattgaaagccgaagccttgcaatcatggccgccctccgatctcagagtgcggctcgtatgctgcgaagcgccgctgttcctcgagtcgccctctccgccgccccccgacgattccagagcaacatcacctcagctactggtaccatcactggccccgttgccaacgagcccgactacaacatccaggccgacaaggctacctccacctacacccccgtccctcgatcaatccaggatggtagcgaagagatccttcccgcagccattatgtcaggcgctcctatggagctccaggcccgaacagttcgcatctaccaggaagccaagcccgctacacagtccggtgactggcgtggtcgacgctggcgaatggattgggacattctccccaagggacaccgatgggagaaccctctgatgggctggcaatcatcgggtgacttcatgcagggaacccacatcaacttcgaaagcaaggaggacgccattcactttgctgagaagcagggttatgaatactttgttcaggagccaaactctcgcaagtttgcccccaaggcctacgccaacaacttcctgtactccgccaggaagctcaagcacatcaggacgaaatagacggcttagacagcctgctcttatgtaaatatgtttatttgaaaaactcattttcgtgtgttcaagcatgagcctaagataaatattgcagttcgaagtcacaattatgaacc

SEQ ID NO: 35348 - DNA, 712 bp, Triticum aestivum
  Clone ID: PAT_TA_35348
gccggccgggcttctcacttcacaacccacaaaataacacagatcagatcatacacaccgccggcccgtggatcacttcactccatcgctgttccatccactgttgttctctttgaaagctgccagttcgttggtaatggggcgccgcagcagcaacgccagcaaagccgaggccggcggcgagcagcaccgcaaggaggagaagcatcacaagcacatggagcagctcgcccagctcggcgccgtcgcagccggagcgtacgcgctgcacgagaagcacaaggcgaagaaggacccggagaatgcccggtcgcacaggatcaaggaggagatcgcagccacggtcgccgttggtagcgccggtttcgccttccatgagcaccacaagaagaaagacgccaagaatcagggccaccattgatcttggcacacatatatatagcatgtataggcggcagcagtctagctacttatacggttacgaggtttccattgttgttttttttccagggtgtgttgttcttcactatatgtacgtctgttctatagtatatgcactgttttattagctacctaaaagttgctgcccttgttcgcggtacactatatgtacatctgtccttggtctaaaggtttatcatgcatgtatctatcaatgtagtatgaatcgagcatgcctttttttataaaaaaaaaaaaaaaaaagccccta

SEQ ID NO: 35349 - DNA, 856 bp, Triticum aestivum
  Clone ID: PAT_TA_35349
gccggccgggccggctcgtaaagtggtagtttgtaggcacgtttccatgaaatgtggtagtttttggttaaatactcgctgagattggatcagaaaaaaaaaaaaaaaaaaaaaaaacaccgcaatcaactgcgttctcaatcttccactccccctttctccctctctcgatcgcccatctccgctcatatggccactgaggtcctccgcccgcacaacatcctgcagccgcagccgcagaggatccgcgcagcgcaccggaggcccagcaaccccggcaccaccaggaagtctcctcctccatcggcctcgacaaccggccggagaaaccatgggcggccttcctcttcttcttcttcttcttcgtacgggaaggtgacgtctgcggccgctccggcgaggcgccctgccgcggaagtgtacgccggcccggccttctccgccgcgtcccccgagccgagctcgctgccgctgccgcagttcccgctccacaagcccgcggccgccgtcaacgacgccgccacgcgcgacctcaggcgcatgctgcgcctcgagtaggagtagctggcccggtgccggcgagctagtcgcctagtggacacgaactgtatgttagtttagttctagcagcaatcgtcgttgagtggtgcggccgcgcgcagcaaggccaccggctcggttttattgtgtggccggtggcaaggcgcgcgggggccgtgggctccgacgacggtggtctggaatgagcgcagccagcaatgtgaccatcgatcggcgtgatgtaattacaaatagaatccccagtcaagagtgcctacgtatatgtacgacctcctaattgaccgatcccctttgc

SEQ ID NO: 35350 - DNA, 1056 bp, Triticum aestivum
  unsure (1)..(1056): unsure at all n locations
  Clone ID: PAT_TA_35350
catctccgagcaggccgggccgggtccttctccccgcccccaacatatccctcgtatcccactccccattcctccctcccaccgaccgcgttctccactcccgattctccctctctccgatcgtccatctccgctcatatggccaccgaggtcctccgcccgcacagcatcctgcagccgcagacgcagaggatccgcgccgcgcaccggaggcccagcaaccccggcaccgccaggaggtctcctcctccatcggcctcgacgaccggccggagaaaccatgggcggccttcctcttcttcttcttcctacgggaaggtgacgtatgcggccgctccggcgaggcgccccgcggtggaagtgtacgccggcccggccttctccgccgcgtcccccgagccgagctcgctgccgctgcctcagttcccgctccagaagcccgcggccgccgtcgtcaacgacgccgccacgcgcgacctcaggcgcatgctgcgcctcgagtaggagtagcttgcccggtgccggcgagctagtctcctatctggtggacacgagctgtatgttagtttagttctagcagtaatcgtcgttgggtggtggcggccgcgcgcagcaaggcctccggctcggttttattgtgtggccggcggcaaggcgcgcggcggccgtgggctccgacgacgacggtctggaatgagcgcagccagcaatgtgaccaccgatcgaccggcgtgatgtactgtaattacaagtagaatcccaagtcaaagagtacctacgtatactgtacggcctcctagttcatcgatcccctttgcctctagttagcacgcaggtgccaaatggccaaggttaggctaaatttgatttctgttcatgttgattaaaagaagtttatgtgttccaatcataaagaaaaaaaagagtcggtcaagggataaattcaataataatccctaagcggacgcgtgggttttacacggcgccccctcgaacggccgtttgtctgaccccccgtcgtttttgngggggaaaggtnaagntngatttcaanca

SEQ ID NO: 35351 - DNA, 1001 bp, Triticum aestivum
  Clone ID: PAT_TA_35351
ttccaccaacaaattaaacatggcaactctcccttcttttaatccagctaataattgaaaacattatatatctaagaaaccatagcacactgcaagaacaccatccttatggcatcatagtcttcctcttactgccccatgtttagctcttgttcttgtacttgtccttggcccttggtgcaagaccgatggcttcggaccccttcatgatcctcaagcgtttgcatgaagcagcaaacatctcccatgggacgtctccaacaagcatccagtctccatccttgtcttcgtaagtagtaacaacatctgaaccgttcactgcctcaaccatcttcccctcattcccagttgcggtgaaggtgctgaacatcttctgcagagcaatggagaggtccttgtaggtgttgtacatcttgagatccaccttgcgcaggtagggcgcgccgtccatgctcaccttgacaaagttggagccgttggcgccagcagcggcgccagcagcaggctgctgcttctcggtctcctcctccttcttgatcttgactgactggacggtcatggcgttcctgcggtacgaccggactggtggccaacccacagcctgtgccttgggagcaggtggcttctcggggtcggcagccgcggcctctgcgggcctcttggccttgtcggcggccggctccggcttgcctgcggagtcttcctgcatgccgccggtgggaagcgtgagcttcaagtcaatggtgtcctcatagcccctcttcccggccttggccgcctcggcgccgcccccgggcagcccgagcctgagctccgtcccgacgtcgacgtcggcgccagccatcggctccggtggagcagttggtcggctagctagcctgggcttgggtctcccaccttggacacctccacgcgagctactcgagcagctgctgatctctcgtcctctctttctctctccgtgtatgcaagatgacttgtgattaggagatggtggtgcg

SEQ ID NO: 35352 - DNA, 1154 bp, Triticum aestivum
  unsure (1)..(1154): unsure at all n locations
  Clone ID: PAT_TA_35352
tcctcggcctcgttgctgccgcctggcaggccgagccggagcttggtctcctcaaacccgaggcccgccattggtctcctgcgccaatgcaccagacgcccctagctgggtttcttcttcgctccctgtgtgtttgcttgttgttatacatactacacatatataacaacaagataaaacataggaagtaggagtacgcagtatagtatggtacatagttgggcaagcagagccataatcttgaattggtagcaaacggtcagctcctgctcttgcatttctccattgcccttggtgccaggccgatggcttctgatcctttcattatccggaggcgcttgcaggacgcgacgaacatctcccaggggacgtcgccgacgagcatccagtcgccgtccttgtcctcgtaggtgggcacatagtcggagccgttgagcaggtccaccagcttgctctcgttcatgcccgtcatcccctgagcctgcgagcagtcgttgccgatggtgaaggagctgaacatcttctccagggccttggacagctcctggtagctcttgtaggtgcccatgtccaccttgcgcaggtagggcgcgccgtccatgctcaccttgacgaacgccgccgctgccgccggcgacgacttctccgccaggatgttcttccggaacgaccggaccggaggccacccccaccacctgcgccttgggagcgcgcggcttctcggcggggtcgggcagcgcggcggtggtgacgacgctgctctggctcggcgacctcttcatcttccctccgccggcgtcggtcgccgtctcctcctggttctctgccgccgcggcggcgaccacggccacgtcggcccgatcctcctcggccggcgcctcctcgccggccggctnccgcttgagcttcaggtcgatggtctcggcgaagcccctcttgccggaggagctcctcgcctccccctcgccgccgccgggcaggccgagccggagctcggtcgcctcgaagcccaggtccgccgccattgctagctggctcagctcctcgcttcttcttcttcttccgctgctgctgctgcttggtttgcttcgctcctttctgcgtttctcggcgagcttttggggttcggtttggctgttttgagaggctgcaat

SEQ ID NO: 35353 - DNA, 1412 bp, Triticum aestivum
  Clone ID: PAT_TA_35353
gttgccagctccccgggggaggggtgggaggcgtggtggtggtggtgcggctggcagaggcaacaagaaaccggctgccgcgggaagaggaaggccagctccaaaggctagaggaaagagggtcgaggctattgatctgactgaccagcctttcgaggacatccctgaagctatcgttggagaggcagttgcagccaccgcccagcaggaccttggtttgaacaaggtagctgacagggccgccaacttcaaaatggaaggtgcaagtggtgatagacttgcagcggcggaagatgaagccacgacgacgccagtgcctgagagggttcaagttggtggttctccagaatatataactgataggaagttgggtaaaggtggatttggccaggtctatgttggcagaagaataactggtggggcatctcgtacgggcccagatgcatatgaggttgcactcaaacttgaacatcggagaagcaaaggatgtagttatggccccccgtttgagtggcaggtttatcagtctctcaatggttgttatggcataccatcagtccactacaagggtcgccagggagactactacattctcgtaatggatatgcttggtcctagcctctgggatgtttggaattcaatgggacaggcgatgtcttctcatatggttgcttgcattgccgttgagtccatatcaatccttgagaagcttcattccaaaggctttgtccatggagatgtaaagccagaaaactttttgcttggtcaacctggatcacctgatgagaagaagcttttcctaattgatcttggtttagcatccaagtggaaaaaagcatcatccagtcagcatgttgaatatgaccagaggccagacatctttaggggaacaattagatatgctagtgtccatgctcatttaggccgtacaggcagtagaagggatgatttggagtcactagcgtacacccttatttttttaataagaggaagattaccttggcaaggctttcagggagacaacaagagctttcttgtatgtaagaagaagatggctacctctgcggatgttctgagttgtttctgtccacctccattcaaacattttcttgagatggtcactaatatgaaatttgatgaagagccaaattatgcaaaacttatttctctctttgatagtctgattgaagtgcctgcttcaagacccatcagaattgatggtgctctaaaggttgggcagaaacgtggaagaatggttgtaaatcttgaagaagaggaacagcctaagaagaaagttcggttggggagcccagcaactcaatggatttgggcttatggtgcttaatgttccttgtattattgatcctattactttgtagccgcttaaaggatgtaccatcattttttaagaa

SEQ ID NO: 35354 - DNA, 2870 bp, Triticum aestivum
  Clone ID: PAT_TA_35354
cgtccgcccacgcgtccgtcccccacaattcctggcccccggtcgcgcgccccatcctccctcccctccccctccccccccctccgtacgacgacgcctgtgcctgagagggttcaagttggtggctctccagaatatataactgataggaagttgggcaaaggtggatttggccagggctatgttggcagatgaataactggtggggcatctcgtacggttccagatgcatacgaggttgcactcatactcgaacatcggagaagctaaaggatgtagttatgtgtcccacaaaaatagtgtgcttataattaacaaacaggttaacttacaagataccataataataatagtctcattgatgccctttacttaacaatcacacatacttaattgacaacagtagaataaaatcaccaagtagattctgggacacatggtagggaacatcacataacaccaatccagctacacacagatagattattgcttctggtccaccaacaaattaaacatggcaactctcccttcttttaatccagctaataattgaaaacattatatatctaagaaaccatagcacactgcaagaacaccatccttatggcatcataagtcttcctcttactgccccatgtttagctcttgttcttgtacttgtccttggcccttggtgcaagaccgatggcttcggaccccttcatgatcctcaagcgtttgcatgaagcagcaaacatctcccatgggacgtctccaacaagcatccagtctccatccttgtcttcgtaagtagtaacaacatctgaaccgttcactgcctcaaccatcttcccctcattcccagttgctttttttttttttttttttttttttttttttttttttttttttttttttttttttctctaatgtatatacccccctcccaatcccgtgtgacatgccctggtcacttctttctgcataatacaatacaattaacatttaacaccttgcaataaatatatgttctgttgacagtcacaccatgctgataataaaacaacttttgatggacaaaccgcaagaggaaaaatagggtgcctttgcattttgtgccaagaagagacataagaagagaaaaaaaaaaggaagaacaagcagagcaaaaaagagaagacacaattatgtggcagacaggtacagatacatctcacatgttcttggcttcttctttcttatgtatataacaagatgagacttgggactgactgactggaaaagagaagatcacaaaccaaaatgacttcactgatcaggagatacagacttagacttaggacagagaatatgatacagggatgagcaagcaaggttataggtattttgattcttgcataacatttagtgcaccctctcctcagctcctgttcttgcatttctccatcgcccttggtgcaaggccaatagcttctgatcccttcattatccgaaggcgcttgcacgactcgacgaacatctcccacgggacgtcgccaacgagcatccagtcgccgtccttgtcctcgtacgtcggaacatactcggatccattgagcagatccatcagcttgctttcgttcatgccgttcatccctggagttccacagtttccgatggtgaaggagctgaacatcttctcgagggccttggagaggtcctggtaggtcttgtacatgttgaggtccaccttgcgcaggtagggcgcgccgtccatgctcaccttgacgaacgccgctgccgccgccggcgacgacttctccgccaggatgttctctccggaacgaccggaccggaggcccaccctcacccacctgcgccttgggcgcgcgaggcttctcggcggggtcgggcagcgcggcggaggtgacgacgctgctctggctcggcgactcttcatcttccccccgccggcgtccgtcgccgtttcctctcttgctcccccgtcttcagcgctgcttctacgtcttcgtctgcccgatcgttgtcggcccgcgcctcctcgacggccgcctccacctccagcgtcaggtcgacgctctccgcatatcccatctggccgcagcagctcctcgcctccccctcaccgcccccgggcaggctgatccggagctcgaacgcgtcgaagcccagtccgctgccatttctgttcgctggccctgcacctcgctttttctttttcatcgtctactgctgcggctgcttggattgctttgctcatttcgacgttgcttgcccagctggtgggctccgggatggctctgcttcgcggcgtcttcgcgcttctcgcgctctacagggtgggcagcgaccgggcggtcccggcgttactgctgaacgagcggaccggccgccgaggcaggtgcggcgggggggcgccgcgacgccacggagggccggccgacggggctagggggcgccgggagccgcggtccccggacgccgccggcctttcggggttgcccccgcccggggcccgcggcggtgacgatggctggttcgtcccccgggcccgcgcaggccgccttttcccccccgcggccccccccgggccccccccggggcgcccggcccccggccccccccccgcccccccccccgcccctcccagccgccccccggcggccgcggcgccgcccctggctggccccgccgccggtgcccccctccgcgcccgccgcgcgcgccgcccctgctcttgcctcctctctctccctctccgcgtgtggctgttggtttgtgtctcccacattgcgtgcctgcacgcgggctactcgagcagctgctgatctctcgtcctctctttctctctccgtgtaagcaagatggcttgtgattaggagatggtggtg

SEQ ID NO: 35355 - DNA, 879 bp, Triticum aestivum
  unsure (1)..(879): unsure at all n locations
  Clone ID: PAT_TA_35355
gccggccggttcgggaagctcctgccaacgcgtcgactatctcaacccgccatagctcccctcgacctccacaacgtcaaccatcacctcgatatcctctcatctggaactagacaagttctttttgagcttcgctttctaatttaaaccgatttccaacatcaaccccacgaatccctcacaatgtcggccggcgcatacgatcgacacattaccatctttgctgacaatggtcggctttatcaagttgagtacgccttcaaggcgatcacagccgccaacattatgtctgtcggtgtgaggggcaaggactgtgctgtcgtcttgtctcagaagaaggttcccgacaagctcatggaccctgcttccgtcacccacatcttccaactctctccgtcagtcggttgcgtcattacaggatccatcgcggatgcccgagctttcgcccaaagagctcagggcgaggctgccgagtttcgatacaagtacggttatgagatgccagctgatgctctggccaagcgtcttgccaacatcagccaagtctacactcagcgggcttacatgcgaccttacggcgttgcgaccacactgatctcgctcgattcggaatacggcccccaactgttcaagtgcgaccctgctggatactacattggttacaagggaactgcggctggcccgaagcaacaggaggcgctgaaccaccttgagaagaagctccgcaataaggagcatgcggagggttcttgggaggaggttgttgagcttgccattacgacattgagcacagttctgagcatggatttcangaagggggagatcgagattggtatcgtgggtggccccccgactgaggtcaagaggggaactactcgg

SEQ ID NO: 35356 - DNA, 782 bp, Triticum aestivum
  Clone ID: PAT_TA_35356
gccggccgccggccgccaacctccaaatatacaagtcatccatcaacgtcgcccgcattcccaccaccaaatcgaccgcgaataacacatcgatcgtattctagcgacgtgtatcgacttctctccacaagaaccaacaatcacattcgccaatatgtctcaagcaatgcgcatcgtccctggcaactccaacgtccagtcctacactcacatctcccacacatcctccgccccctccgccccaggcatccacgatactctccgccatggtgtcggcgcatctcccttcgactccaagaccacacctgcttctgcccaccctcttgaagctcgactgaagaactgggaggccacccaggagtctctcaagatggagacccttcgacgaacatacggcatggccgagcccatccgtcgtggtatggagctcaagatcgtccagaacggcgagtggcggcccatggctctcggcggcggtctgcccagcgtccatgaggaaattcttaggggccgcgatactactattacctgggaggatgttttcaagggcgatgagacaagggccgtggctggattccatgacgagatggagaagaagctcaagatccagtaaacagcagtttatttacaatggagagaaggaagaggcttcagctgtcgctctgtacacccatggtttcctacatttagacaagaccaagaacgtgaaagaccgccaacaggcaccctcatgaaaagaatcattaattgtgatccggaaaaaaaaaaaaaaaaggccccta

SEQ ID NO: 35357 - DNA, 313 bp, Triticum aestivum
  unsure (1)..(313): unsure at all n locations
  Clone ID: PAT_TA_35357
actgtgcggcgctcgagccggccgggaatcggtacttctatttctcttcttctaatatatcgaagcgcaaagcttttgcatgtttgcaaaaaaacaatggcattttctccgccgccattgaggagctaggaggagttgtacaggaggtcgccggtggtgatgctgccgtgcggtacaaaacgaagtttttggagcagggaaagaggtgcgaggccggcggatctggtgtctttcctcgacgctgtcaacggagatcggtggatctgggtcctgggcagnacgaggtggntccccagccgacgcgccacatcga

SEQ ID NO: 35358 - DNA, 632 bp, Triticum aestivum
  Clone ID: PAT_TA_35358
gccggccgggcgggttaagcctaaaccatcccgcaacccttcgagctttcggccttcaaccccccaacaacgacaccatgtctcacgaaagcgtctggaactcccgcccccgaaactacggcaagggctctcgcagctgccgtgtctgcaagcacaaggccggtctcatccgaaagtacgacctcaacctgtgccgtcagtgcttccgtgagaaggccaaggacatcggtttcaacaagtaccgataaacgatccaccatcatgacacccggttttctcgtttaagggatggggggaactgctagagagcagagtattatgtggaagggggtgaactctcagcagaaagtcaaaggcctcgcgttaaaaaagcactcggagggcggccgcttggaacaggagttttatggcttgcttgggtccctcaggaagatcgtgcgtctgacgaacatcctccgaggatagacgaataccattgcattggacctcgaaatgtctatgtgtcttgtcttatcctcgcaccatcccgcatgaccaacctgtggccatggagtgtatcgggtcaatgtgaaattatgacaatcaaaaactccatgtgaaccatcgaaaaaaaaaaaaaaaaaaggccccta

SEQ ID NO: 35359 - DNA, 602 bp, Triticum aestivum
  Clone ID: PAT_TA_35359
gccggccggcttgccgaccgccaatttcacgcagcaatctatctcgaaatctaaaccatcccgcaacccttcgagctttcggccttcaaccccccaacaacgacaccatgtctcacgaaagcgtctggaactcccgcccccgaaactacggcaagggctctcgcagctgccgtgtctgcaagcacaaggccggtctcatccgaaagtacgacctcaacctgtgccgtcagtgcttccgtgagaaggccaaggacatcggtttcaacaagtaccgataaacgatccaccatcatgacacccggttttctcgtttaagggatggggggaactgctagagagcagagtattatgtggaagggggtgaactctcagcagaaagtcaaaggcctcgcgttaaaaaagcactcggagggcggccgcttggaacaggagttttatggcttgcttgggtccctcaggaagatcgtgcgtctgacgaacatcctccgaggatagacgaataccattgcattggacctcgaaaaaaaaaaaaaaaaaaggcccctagcctaccaaggggcgcccttcctggaacatcaccccaatcaaggttttttggggcc

SEQ ID NO: 35360 - DNA, 877 bp, Triticum aestivum
  Clone ID: PAT_TA_35360
cggcgtccgcccccccggggcctcgcccgcacgacgccgtcgccgccgccgccccgcggcagcgcgcgccccccccccggcccggcgccgccctgcatccgccagcgccgccgcccccccccggcgcgtcgctgaatcggtcaattccgcgtcgccctcccacctacccatcccccaaccggtggaaggggggccatgaagaagtcgttctgcttccgcggctccgctgcgaagagggcaggacggacgccgatggcggactggtgcgtcttctgcgacatcgcccgccgcgcccccgcttccaccgccgttctcctctactccgatgacaaggtcgtcgcgttccaggacatcaatccgtccgcgttcaggcactatcttgtcatacccatcgagcatataccaactgtaaaaaatctccaaagaaccaacgaagatcaccagttagttagtcacatggtgaaggtgggaaaagatttactcagtcgagatgctcccaaatctgaggaacatagatttggttttcatcagccaccatttaatagtattgatcacctccatcttcactgcctggcactgccatttatacccagttggaggcaagtaaaatatacaccattgggtcccttagggggctttattgatgctgagaaggtattggaaaaaataaaaccagaaacagaagtgtacagttaataaaagtatttaagactggtactggctattcctgattattaacgttcttctacttttttgcttgtaatatcatttgtatgtggtttgtatccctattactattcttggatcgctataaattcgaaagactttgtctgaaatcctatacttcatatcttcatggtgaaacccatgcaggtac

SEQ ID NO: 35361 - DNA, 1347 bp, Triticum aestivum
  Clone ID: PAT_TA_35361
tgccggcaccacctcgccgcgaccgggcgccgccgctcgcccggggggctcgaggcgccccccgccgcgcggctgctcggcgcggcccggcagcgggactacccgcccgagttccgccgctggtacgtcgtgctggccgagaacaccaccggcgcgggcgtcaccggcggcggcgagatcaacggccagggcggcgccttcgtggtcacgcccagcgcccagaagaacgtcatggtcagctggaacgccacgggggactgcctgggcgacgagtgccgcccgcggctcctcggcttcatcgactccaaggacgtcgcggtccatgacatcaccctcaaccagccggccctgtggtgcctgcatcttgtcaggtgtgacaactcggtgatccgcaatgtctctatatacggggatttcgacactcctaacaatgacgggattgacatcgaggattcaaacaacacggtcatcaccgattgccacatagacaccggagatgatgcagatctgcccaaagtctagcacagggcctgtttacaacttgacagcaacaaattgctggatccgtactaaatcgtgcgctatcaaatttggaagtgcaagctttttcaactttgagaagctgctctttgacaacattactatagttgattcacatcgaggacttggaatgcagatccgtgatggagggaacgttagtgatgtgacattttcaaacatcaaaatgcgcactaggtactaccatccttcatggtgggggagagctgaaccgatctacatcactacctgtccaaggcaccctgattccaaagaaggcaccatttcagatgttcgtttcatcaacatctcatcagtatcagaaaacggtgttttcctggctggatcgaagcacggattgcttcgcaacttgaagttcaagaatgtcgacctgacctacaagaggtggacaaactacactgggggcctgtatgactacagacctggatgtcagaagatggtgaagcacaagactggcggtatgatgctggagcacatctcaggcctggaggttgacaatgtcagcatgagatggtggagaggaagcctgaaagggtgggatgttaacccgctcctcttccggccatccactattgacgggctgtcgttccacgattggcagtcgctggatgttcaatagcggaccagctgaatctcacccttatgtcgatatgtatcatgtatccacgatgaataagccacgattctttgtgtggtatctttgaataaaagatcccaattcaaaacagaacactttgttgatttctgctgtctgcaaaaaaaaaaaaaaaaaactcaagactagttctc

SEQ ID NO: 35362 - DNA, 922 bp, Triticum aestivum
  Clone ID: PAT_TA_35362
tagtgttctatcccgtcttacatctatcttcttgggttttgctcctccgtttctgctgctttctattggctatgaagcggttttctatagtgcttttgcgctggtactcatgggatggatatttcttgaatctgccaacttgttttgctctgaaggaagcaattcttcatgccacagtagccttgcggatggatcagtttatggctatgacgaaagatgcttacaactatctgatttacgaatccctcgccggccgatgatcttattcaatgttgctttctttggaactggtaattttgcaagtattgcaagctttgagatctcatctgtgtacagattcatcacaatatttagtccatttcttatgacggcactccttattttcaaattgttcattccatatatgcttgtcatatgtacatttagtgccataaccaagattgtacgggttccacgtattggttgttattttcttgtaatactgttttcagatgtgatgacaattcatttcttttttctggtccaaaacacagggagctggatggagattggcaacagcattagtcatttcggaattgtgagtgcgcaagtagtcttcgtgttgctgctttttgcactcacaaatatatacacaaaagatatcgaagtctcgtcttggcaattaacctcgcgaaaatatatgtgaattgatctgactttatatagattttgcagaatgtgtccatttttgtagaactaacttatgggctgtgtttttatatgtggcccaagttttaggattaagctcttgtagtttatatatgttcattgtattgggtggattaacttgtttacccttgtcgtttcttagagacagaagtgcctgcttaaagacataatctggccacgacatcatgaatttgttaatgcaaatggtcgcatt

SEQ ID NO: 35363 - DNA, 1099 bp, Triticum aestivum
  Clone ID: PAT_TA_35363
gtcgaccgcctcgcatcgattcgttcccctcgccgagtctccgcgccgccactatccctccccgcgcggagggcccacggagaggcatgccgcgcgtggtgtctcgttcgccgccatcccaccgtcggcggcgctccccgtcgccgcggtacggcagcaggcggcgctccccgtcgccgcggtacggcagcaggcggatccgacgagatcgcagccgctccccttactcctcccggagaaaaagccggtctccttctcctagatgggacaggagccagtccccaattcctaggaggcgtaaaagccctccatcaccgaggagacatagaagacggcgaagtcggagcagctcaagttctcttgtaaataactccagcccaagtcatggatccgaacagaacagtttaattgaaaaacaaaggaaggaagaagaaaagaaaagttttcaccgcagacgccaaaaggaagctgaacttaagttgttggaagaggagcttgctaggagagttgaagaagctgttaggaaaaatgttgaggagtgtctgaactctgaggaagtaaaagatgaaataaaacgccgagttgaggaaggtatcaaaaagttatttgatgaggttgatgctcagctacaaaaaaaaaaaaaaaaaagtctcctaggagccaggcgctaagcagagcaggtatggagggtgagggaggagctcgggtggcgggtcggggtggtccggggggctctcgtgcaatcgcaagcgtgagctgctcaggggccgcctctggctgcggtgctgcggcctgtggcgctgctgcggtccccaatgcagagaggggaggccgttcgcccccctttcagtggagaggccgaacaacctgctgggcagttcggattttagtagtaaagaataggcactggtttcgtgtttgtgttgtaatgtgttgctctcttacaaatgggagcatttaacttctcaggggcgcctctagcttctgtgcctgtttgcgcatgataacttttttctgaagttcgcacaatattattagaggggagatatgttgacgtctcctttttctgaaagatatttctgcagcaactcttgaggcg

SEQ ID NO: 35364 - DNA, 675 bp, Triticum aestivum
  Clone ID: PAT_TA_35364
gcgcgggaagcacggagatcctcgccgcaccgatcctaaccagaccttctccactcctattctaaccaccccctcgccgccgccgccgccccagagcccaccaccgaccgaccgaagcgatggccgcctccaccgtcgcgtccagggccgtggccgtcctcgccgtcctgtcggtcgccgccctctccgtcgtctccgcgcaggaggccccggcgccgagccccgtgtcggccgccggcgcagcggcgccggccctccgcccccgcggccgtcgcctccggcgccgccgtccgcctcgccgccgtccgcctctgactgcggccgcctccgtcccctccgaccctccttccgttcattcgatgggctcctcctctacatctacttaagtagccgccgtgctgtatcccgtttacgcgaccgcatgtcttgtttgtaccttgcgagctttgttcggttgttcgtgttagccttgggatctgatctgcctgctactgtccgtcgctcggtgacgatgatgatgatgattattacatccttggtagagattgtacccgtgtgcttgtagatacgtacttctcaccactgctatttatccggtttgatctgctgataaaatagaagaatttaaaattgatgataaaaatctgcaggaaaaaaaaaaaaaaaaggccccta

SEQ ID NO: 35365 - DNA, 980 bp, Triticum aestivum
  unsure (1)..(980): unsure at all n locations
  Clone ID: PAT_TA_35365
aaagtgggccggattattctctagacgggttaacagtcatcatgaagtttactgtttctttcgcggctcttgctgctggagcattccaggctgtggctggtcaaacagtttactttgccggcgactctactatggccagaagtggcgccaacgacggtgctactgatggctggggaaactacattggcaaatacctcaaggtcaacgccgtcaacaaggccatcggcggtcgatctgctcgctcatacaccaacgaaggtcgtttccaggagattgtcaacctcgtcaagccaggcgatgtagttgtcattgaattcggccacaacgacggtggttcacccaacaagaacgacaacttgcgctctgcttgtcccggtgctggcacagaagtctgcacctctgacaagactggcgaaaaggtgtatacctatgtcttttacatctcgcaagctgccaaggcccttgtcgccaagggtgcccaagtcgttctcagcacgcagactcccaacaaccagtgggagactggcacatttgagcctggtgcccctcgctttgttggttatgtgtctactgcgcacagggctctggctagctccagcgtaacctgggttgaccactttgctgctgttaccaagatgtaccagaagctcggtaaccaaaaggtcaactctttgtatcctcgcgaccacactcacacaagtcccgaggctgcagacctcattgccaaggcttttgttcaggctatcaatgaggagatgaatggaaggactagcttgaagtctctcattaagactcctgtcagcaacgtctactagactgtggggatacctcactagtatagcgtattcttgtcgttatctagacaggatatcaacatctatctaagatgattgctatagtttctgtacataaaccttgtcacgagtctcaatactcnaccgctattgtttttcagaaaaaaaaaaaaaaaaagggcccta

SEQ ID NO: 35366 - DNA, 573 bp, Triticum aestivum
  Clone ID: PAT_TA_35366
tacaatgacgtcaggaagcactcgtcggaggcctacgtgatcatgtccaatcggttgtcatccccagacccgacggagctcctcgagtttgccggcgggttatccaagaccgtcatcgacgtgcactactatgtgttgttcaatagcatgtttgatactttcaccgtgcagcagaatatcgatttcatcaagaccaactactcaagcgctcttagcactgtcacgaagcagaacggtcctctcacctttgtaggtgaatgggtggctgagtggcaggtgcccaatgcaacgaaggaagagctccaaatgttagcaaatgcacaaatggatgtgtatgggaaggcaacatttggatgggcttattggactctcaagaatgtaaacaaccactggagtatggagtggatgatcaagaatgggtacatctccttgaaaaactagggtgtgctttctacgtgtaatgacgcatgaaataactttgtagaacaatcgatgcatctctagaaaaaattattgaaggtgaataaatgaatttgtagtatttggcaaaaaaaaaaaaaaaaaaggccccta

SEQ ID NO: 35367 - DNA, 1733 bp, Triticum aestivum
  Clone ID: PAT_TA_35367
gccggccgtgccgggacacaccgagaccgagagagctgtggcctcccgagcaaccgatcccagtcgttctgaagaagcattagctgcgaaatgaggagccgcctcttccgctctgcctcgtgacgcgtgctgtgccccctctcccggcgctcggcgcccagtgctgctcctcgcctccccgtccgagcggtcaacctcgtcgggtggctggtgatggagggctggatcctgccgtccctcttcgacggcatccccaacaacggtcccctggacggcacgcagctgcagtcccagtcggtgacgcagagcgccgcagtggggcggcggagtggcggcggcgcggggctggtggcggacgggccgcaggcgtctggctgggagaccttcaagctgtggcggatcaaccagtgtacagttgatcttaaagggttcggaagccagttcgcgcgcggttcggtaggcggctcgctggtagccacggcgacggcgcccggggcgaccggagacgttccgattggtacgcagccccggcaaggatatcgggatgcggatcatggcgcccaacgggctcttcttgcaggcaaacaaagtggactctgggaagagcacaaacggcgaccacaccggccggggcgacgacgacccgtcggggttcgtggggactagagtgacggggctacaaggcgagtaccagatctgcaacggctatgggacgacaaaggctacacctattctcaggaaccattggagcacatatatagtggaagccatatccagaaagcgggctgaccgcggtgaggataccgggaggatggtgggatcgctaggcgaacccagtcctccaccaccttacgtccggaggctcgccttcaaaccttggaccaaggaattcagaactgggcattcgaagtacaatctaggcgtcatcattgacctaccacgcagctcctgggtcgcaaaaccccttccagcaaagcccctccaaggatggtcctccagacggggggatcaacaggactggggcaccaccgacactaacatcgcacaaactgtgcaagtggtagatttcctcgccatccaaggtaccccaaaagcccaagcctcctcgcacttgagctaatgaacgagccgttggcgcccggcgtatccctgcggacagcctaggaacgatgccgccagggaagcactcttccggaggcatacactgatcgggtccatacgtcagcctttcccaccgcccgacggcgcccctccaagttcgcctggccgggttccctggcccgtcactcgacgtgcgctactatgtgtcgttccaacggcatgtttgacactttcatccgtgcagcagaatatcgatttaatcaagaccaactactcaagcgctctcaacactgtcacgaagcagaacggtcctctcacctttgtcggcgaatgggtggctgagtggcaggtgcccaatgcaacgaaggaagagctccaaatgttagcaaatgcacagatggatgtgtatgggaaggcaacgtttggatgggcttattggactctcaagaatgtaaacaaccactggagtatggagtggatgatcaagaatgggtacgtcacctctcattacaatactaggctatcttctatgtgtcattactcatgactcttcaaataactttgtaatgacaaatgcaaaaaatgattgaaggtgaataaatgaatttgtagtaaaaaaaaaaaaaaaaaac

SEQ ID NO: 35368 - DNA, 614 bp, Triticum aestivum
  Clone ID: PAT_TA_35368
gccggccggtttgggaaaacaaaaagcagaccctcttcctttcttctcaagaaagatctctccttgctcaggcctcagctcactgcaagttccctacatcgatcctctccccgtcgtcgctcgcgaaacaactaatggcttcttcttcttccagcgcccgaggcagccgcgtggccacatgcctcgtgctgcttctcctgctcgtcagcctgcgagaagcctccgccgcgcgcccgctacggccggccggcgacgtgtccagcgaggtgaagtacccggcggtcgtcgacaagtacgcgccccttctgctcgccatgctgccgagggccccgactccgccgtccgccccgagcggtggcacgaacgaggccaggaactgatcgatctatagcacagaaatcgttaggcatacctacgtatactcagtggttgatggtttgttctgttttgcagtacaaaaacttgtacaggattgttagagtgggaaacggacgtatagtgtaggatattaccccaaaaattataccttcattctttcgtttgtcccttgaagtactacttgttgattgaaagagttctgtcgtgatccaaaaaaaaaaaaaaaaaggccccta

SEQ ID NO: 35369 - DNA, 648 bp, Triticum aestivum
  Clone ID: PAT_TA_35369
ggcccgctcgaggccggcccgggcccgggaaagcacaaaaaaaaaacagataaacacaaaaagcagaccatctccctccctttcttccaaagaccctctctcgttgttcagcagctcaggcgtcagctcactgcaagttccctccatcgatcgtctcccgccgacgctggcgaaacaattaatggcttcttcttcttcttccagcgcccgaagcagccgcgtggccacatgcctcgtgcttgttctcctgcttgtcagcatgcgaggagcctccgccgcgcgtccgctcccgccggccggcgacgtgtccagcgaggtgaaggaccaggcggtcgtcggcaagtacgcgccgcttctgctcgccatgctgccgagggccccgactccgccgtcagccccgagcggtggcacgaacgaggccaggaactgatgaagcaaccgcagggttttccactaggatggatggatggatcgatctatagcacagaaatcgttaggcatacgtatgctcagtagttgatggtttggttacataattgttagagtgggaaatggatatattgcgtaggatactaggatataccccaaaactataccttcattcttccgttcatcccttgacctatttgttgattgagcattgttcat

SEQ ID NO: 35370 - DNA, 599 bp, Triticum aestivum
  Clone ID: PAT_TA_35370
gccggcctggttcctgaggctagctctctccttcgtcctcgcaagcatcgcaccagatccaccggtaggagcgagcaagggagatccacctaacccaccaatggcggccgctgcttcctccagcgcgtggaaggcgaggtggctccgccccgaggcgtacccgatcttcgcggcgacgggcgtagccgtggggatctgcgtcatgcagctggtgcgcaacatcaccaccaaccccgaggtccgggtgaccaaggagaaccgggcggccggggtgctggacaaccacgacgagggccgccgctacgcgcgccaccccttcaggaggttcatcgacggcaagtccgccgagatcatgcccggcatcaacagcttcttcaccgacccaccaaagaactagacctggtcgccgtcgccggagacctcttgtccaagccaagaggaaggaaggaattcctccgcgagatttttttttcccttctgaaggaatacaggaatactgttgttgtttttcctcgaattcaagtatattattcgccatgactaattgtctggctgtacaccaaaaaaaaaaagaaaaaaaaaaaaaaaaaaggccccta

SEQ ID NO: 35371 - DNA, 661 bp, Triticum aestivum
  Clone ID: PAT_TA_35371
ctgtggccggcggccggggcgggaggctagctctcgcaagcatcgcaccagatccaccggtgggagcaaggaagcgagcgagatccacctaacccaccaatggcggccgctgcttcctccagcgcgtggaaggccaggtggctccgccccgaggcgtacccgatcttcgcggcgacgggcgtggccgtggggatctgcgtgatgcagctggtgcgcaacatcaccaccaaccccgaggtgcgggtgaccaaggagaaccgggcggccggggtgctggacaaccacgacgagggccgccgctacgcgcgccaccccttcaggaggttcatcgacggcaagtccgccgagatcatgcccggcatcaacagcttcttcaccgacccaccaaagaactagacgacgtcgtcgtcgtcggagagctcttgtccaaggaaggaaggaattcctccgcgagattttttttcccttctgaaggaatacagaaatactgttgttatttttcctcgaattcaagtatattattcgccatgactaattgtctggctgtacaccattgattcttgtgatcatacacacaaaactcggcctgaattaataatccctatatgtcttgaggaaccaaaaaaaaaaaaaaaaaaggcccctacagggaactgtatag

SEQ ID NO: 35372 - DNA, 796 bp, Triticum aestivum
  Clone ID: PAT_TA_35372
ctccttcgtcctcgcaagcatcccaccacgcccaccgcacgacaaagccaccgaggcttccttcacccaccaatagcccacgctgcttctgccggcggctgcttcgcgaggtggctgggaggctaggtctctccttcgtcctcgcaagcatcgcaccagatccaccggtaggagcgagcaagggagatccacctaacccaccaatggcggccgctgcttcctccagcgcgtggaaggcgaggtggctccgccccgaggcgtacccgatcttcgcggcgacgggcgtagccgtggggatctgcgtcatgcagctggtgcgcaacatcaccaccaaccccgaggtccgggtgaccaaggagaaccgggcggccggggtgctggacaaccacgacgagggccgccgctacgcgcgccaccccttcaggaggttcatcgacggcaagtccgccgagatcatgcccggcatcaacagcttcttcaccgacccaccaaagaactagacctggtcgccgtcgccggagacctcttgtccaagccaagaggaaggaaggaattcctccgcgagatttttttttcccttctgaaggaatacaggaatactgttgttgtttttcctcgaattcaagtatattattcgccatgactaattgtctggctgtacaccattgattgttgtgatcatacacacaaaactcggcctgaataatccctatatgtcttgaggaacaaaaaaaaaaagtgcccttatctatcaagaaaaaaaaaaaaaaaaaaggcaactacaaaaaaggcccct

SEQ ID NO: 35373 - DNA, 861 bp, Triticum aestivum
  Clone ID: PAT_TA_35373
ctgtgcggcggtcggccgggccgggactccaccaacaatctcccctcagtcctttgtcgtctgaataaccatccttcaaaatggctgcctctaccggatccaccaaggtcgacgccgtcgtccagaacatcaaggctgagacccccgagaagaagtctggcctcgctctctactcccgattcgcccttgccggtgctgtctgctgttccgtcacccacggtggtctcacccccgtcgatgtcgtcaagacccgtatccagctcgaccccgctacctacaaccgcggtctcatcggtggtttccgccaggtcgtcaagaatgagggtgctggtgctctcctcactggtgtcggccctacctttgccggttacttcctccagggtgctctgaagttcggtggttacgagttcttcaagcagcagtggattgacgctctcggctacgagaccgcctccaagaaccgaactgctgtctatctggcctcttccgccaccgctgagttcttcgccgatatcgccctctgccctcttgaggccactcgtatccgtctcgtctctgagcccacctacgccagcggtctcgtctctggcttcggcaagattgtcaagaacgagggtttcggtgctctctacgccggtttcggtcccattctcttcaagcagatcccttacaccatggccaagttcgtcgtcttcgagaaggtctctgaggctgtcttccgcactttccccaagaaggacctctccgacggtatgcagactgttgccaaccttggctctggtctgattgccggtttcgccgccgccattgtctctcagcccgccgacccatgctctccagatcacaagaccagggtctccc

SEQ ID NO: 35374 - DNA, 853 bp, Triticum aestivum
  unsure (1)..(853): unsure at all n locations
  Clone ID: PAT_TA_35374
gccggccggtccgggataccgtgtatagctcacgagacaattaagcacaatgtcttccgttaaagaatactctctcttctgtctggagaaccctctcctcgacatccaggctcagggtgaccaggctcttctggacaagtacggcctcaagcctaacgatgctatcctcgctgaggagaagcacatccctctctacgaggatctcctcaacaactacgatgccaagctcattgctggcggtgctgctcagaacagtgctcgaggcgcccagtacatccttcctcccaaccgcgttgtctacgttggtggtgctggtgacgacaagtactctgccatccttcacgacgccgtcaaggctgctggcctccgcgtcgagtaccgtgtcgatcccaaggagaagactggccgttgcggtgccatcattaccggtcacaaccgaagcttgtgcactgacctcggtgctgccaaccactacgaccttgaccacctgaagaagcccgagatctggaagctcgttgagaacgccgaggtctactacgtcggtggtttccacttcactgtctgccctcctgccatcatggagctcgccaagcaggctgctaaggacaacaagccattcgtcctctcgctctctgctcccttcattccccaattcttcaaggaggttgtcgatgccagcgcccccttctgggattacatcattggtaatgagactgaggctgccgcctacgccgagtcccacgacctccccagcaaggagcccaagggatgtcgcaagcaccttgccaaccttcccaaggagaacagnncagagaaagcgagttgccatcatcactcagggtaccgaccctac

SEQ ID NO: 35375 - DNA, 820 bp, Triticum aestivum
  Clone ID: PAT_TA_35375
gccggccggtccgggaacaagccatacttgatccaccgtctagacattcatttgctggacaatatctcatcaaaatgacctcctctcctctccgcatcggcttcgtgccagaacacttctcaactccccttcacttcgctcagaagcactttggtctcgatgcaactctcatcccctttccttctggcacaggccacatggtcactgccatccgatccggagagattgatgtagctgttggtctgactgagggttggatcgcaggtctgggcaaggagggcgttgaaggagatggtggatatcgtcttgtaggaacttatgttgagactcccctgtgttgggccatctctacaggctcagggcgccctgaaatcacctctgtcgactctctcaagggcggaaagattggtgtttcacgaattggctctggcagctacgtgatgggcttcgtcctggccgaccaacaaggctggctgacccctggcgccgcagagaaacccttcaaagataccgtagtcctcaacaactttgagaacctgcgcaacgccgtcaacagcggcgaggccgacttcttcatgtgggagcatttcacatccaagaagttctacgactcgggtgagatccgccgcgtcggtgaaatctacacaccctggagcagctggaagattgtcgcctcgacaaactgacacaggatggtttggatggtcgcgtagaggatctgtttggcaagttggaccagggcattaagcacttcaacgagaatcaggaggagtctgtggcgtacatctcgagcagtcttggctacacgagcctgatgcgc

SEQ ID NO: 35376 - DNA, 463 bp, Triticum aestivum
  Clone ID: PAT_TA_35376
cggccgcccggcgcggccgggctgtctctaacaaatttcacattctttccataaatctctcaaacaacacccacaactcaaaatgaagctgaacttcctccttaccgcggctctcgttgctgctcctgtcatggccgcctcaagcactacaacatcgactgagaccgccaaggcgaccaagaccagtgccgcctccaagacctccaaagccgctgctgctcctactatgggtgtcgatatgttgggtgttgcaggtgtcgctggtgtcattgctgctatggctctttaattgactgcctgacgcgtgtgctatgagcttagcgagaatatttttctgcgactcctgcatagttactttcttgactttattacaatcaatttacaaacgcactattaattccttaacaaaaaaaaaaaaaaaaaacctaccaaaaatgaaaaaaaaaaaaaaaaaaggccccta

SEQ ID NO: 35377 - DNA, 884 bp, Triticum aestivum
  Clone ID: PAT_TA_35377
cctgtgcgccgctcgagcgtgcgagatccccatcacaaaacgaggacgtgagagaataggccagcaaacagacgtatctgggaccagaaaaacaatcgccaaaatgtcgaacccccgcgttgaagaacttcccgatgaggagcccaagaagaccaccgtccaggagcacgaggatgactccagcgacgactccgaggttgaggaggtcggcgagggccagctccccgctggctctactgtgatccacaaccgcaacgagaagaaggctcgcaaggcccttgagaagctgcacctcacccgcatccctggcatcacccgtgtcactctccgccgtcccaagaacatcctcttcgttatcaacacccccgaggtttacaagtcccccaacagcaacacctacattgtcttcggtgaggctaagattgaggacgtcaacgccgctgctcaacaagctgctgctgcccagctcgcttctcagaacgctgaggaccactctggtcacaaccacggcgagcccagcaaggctgttgaggccgacgagaagaaggaggataaggaagacgacgaggacgaggaagaggaggaggaggaggaggtcgacgcctctggactcgaggataaggacatcgagcttgtcatgacccaagccaatgtcagccgaaacaaggctgtcaaggcattgaaggagaacgacaacgatattgtcaattccatcatggctctaagtatctaggcatgagtttttgaccggacgatcttccacaaaagcatgtgcatggtacgaacactgggctctgtattagttctgggcgaactgtactctgcggaatggagttgatgtccaacaccggaaaagaatcaaagggaaaacacccacatccgcc

SEQ ID NO: 35378 - DNA, 967 bp, Triticum aestivum
  unsure (1)..(967): unsure at all n locations
  Clone ID: PAT_TA_35378
gccggccgggtttggggtaccattctcccctactctggtaccttcctgaacttcgtttcttacgctgccggatccgtccgcttgtctgctctttctcgcgtccgcaccatctgggtcgccactcacgactcaattggtctcggagaggatggtcctactcaccagcctattgagactcttgctcacttccgcgctctccccaacaccatggtctggcgacctgctgacggtaacgagaccagtggtgcttactacgtctgcttgacttccaagcacacccctagcatcattgctctgtctcgtcagaaccttccccagctcgagggctctaccatcgagaaggccgccaagggtggttacgtcctgcacgaggttgagggtgctgacatcaccctggtttctaccggttctgaggtttccattgccgtcgacgccgccaagtacctcgaggagaagaagaacatcaaggctcgcattgtctccatgccctgcttcgaggccttcgacctccaggacaaggagtaccgcctgtctgtccttcccgacggtgtcccctctctgtccattgaggtcatgagcaccatgggctgggagcgctacactcacgagcagttcggtatcaaccgattcggtgcttctggtgcctacaaggatgtctacaagaagttcgagttcacccccgagggtatcgccaagcgtgccgttgccaccatcgacttctggaaggatgttcccaacgtccgatctcccatcaaccgcgccttccagcagatcatctagatctattaatataacgagtaaaaagaaacgaaagaaaagagtaaaaataccggtacaaaataagaccggacagaatgattatgatgatggactttggagcaagggcttgtggatttcgagcaacttagacgtactacgagatngaattaaatcttctagaacaaaaaaaaaaaaaaaaaggccccta

SEQ ID NO: 35379 - DNA, 1003 bp, Triticum aestivum
  unsure (1)..(1003): unsure at all n locations
  Clone ID: PAT_TA_35379
ggccgctttcgaggccggccggtttccggaaaanaaaaaaaaaaaaaaaaaaagcggggggccgggatacttaaaaaaaaaaaaatcccactattaagcaccactttcagctttttttttcttctcctcaacctcactcctttctcctcaagaccctcgatttcttgtcaataccgccaaaatgtccgcccccaacgacaacgagcatgagatgaccttcgactccgccgatgccggcgcgtctctcacctaccctatgcagtgctctgctctgcgtaagaacggtttcgtcgtcatcaagaaccgcccttgcaagatcgtcgacatgtccacctccaagactggaaagcacggtcacgccaaggtccatcttgtcgctaccgacattttcactggcaagaagtacgaggatctctctccctctactcacaacatggacgtccccaacgtcagccgccgagagtaccagcttctcgacatctccgacgatggtttcctctccctcatgaccgacgacggtgacaccaaggacgatgttccccttcccgacaacgaggttggccagaagatcaccaagctcttcaaggaagaggagaaggacaccaacgtcattgtcctcacctctatgggcgaggagtgcgctatggaggccaaggaggctcctaaccagggctaaatcatttaacccttgatacacgccctaccttaatggcacttggcccctggggatctacatcaaaagatgatctggatcaggggatcttttttgttttgatggacatttggcgcatcaatattcatgggccatgggtaggcgtcgtgcagaaggaccctacctggacagggttgcctgttgttatgatatacggcaacccttcgcaaccgagcctcaggctcgaaaatgttttcctttgttcctggctcacaagctgcgaataccatcatgtcacgatacgtagcagcaattaaatgacgaaaaatgggagagctttggagttgatcg

SEQ ID NO: 35380 - DNA, 807 bp, Triticum aestivum
  Clone ID: PAT_TA_35380
ctgtgcggcgctcgagccggccggttcttcatggacatctttcattcaactctttcgttctttacttttcacttaaaacacgttatcatgcactttgctctcctatcgagcaatttggccggacaagagaagaacagatcttgttgatccccaacgatccaaggattaaatgccttgatcaggggaagaaaaagcaatcagccgaagaaacagattcggcagaagaagaaaatagagcattgaagaagtttattagcacatggaaagacacggaagcagattcaaagtcttcatctaattgccacgcaatcaggtgctattatctaattttcttttcactgattcctgcacacaatcgattctactgggagtagttggcttggagcatggcagctttgtcctcgccgtacacaggagaatcaccacggcgcggctcatagcccggcggcacgagcgcggacgctagcggccggaatcgccctacagcgcactaatcctcctcacgcggctgtagcctccggctgactgctgccaacgggcgtacgtggaggcgcggtctcagactccgacagcggcggcgccatctggcgaagcagcccacggcgcagcaatggccttcggcctcggcgcggcgcggaaacgacacggccgcgatgcccttcagtggcgcgatgtccatggccttcggcccggcggcagttcgcaccacccggcatccagcacgccatgacatccttctcaaagcgacgctacggcgacggcgacgccctaaacgtaaacgcacgggagaagaaattggggaatctc

SEQ ID NO: 35381 - DNA, 952 bp, Triticum aestivum
  Clone ID: PAT_TA_35381
ctgtgcggcgctcaggcggccggccggttctggaatttacacggccctcgcaacagcacgccgctccgtcgtcgtcaatccacgtagtcgaaccagccgtcaaaatgagcgcccaggcccttaacaagatcgctcccaacagcccctcgaggcagaacccttccgagctcgagacgagcatcgctcaggctctcttcgacctcgagtccaacacctccgatctcaaggtcgccctccgacctctccagatcgtctctgctcgtgagatcgaggttggccacggcaagaaggctattgtcatctttgtccccgtcccttccctgcagggcttccaccgcgtccagcagcgcctcacccgtgagctcgagaagaagttctctgaccgccacgtcctgatcctcgcttctcgccgcatcttgccccgccccaagcgatctgcccgctctcgcaacaaccagaagcagaagcgaccccgttcgcgaactctcaccgccgtccacgacgccatcctcgaggaccttaccttccccgtcgagatcgtcggcaagcgcgtccgcaccaaggaggacggctccaagctcctcaaggtcatccttgacgagaaggagcgtggtggtgttgactaccgcctcgacacctactctgaggtctaccgtcgcttgacaggccgcaacgtcaacttcgagttcccccagagcggtcccgctgactactaagtcggtgcgtctacttcagagatgaactagtagtacgaggaaaaaaatacatgtcttcacatcaatccaagggctgggagtgctattctttaaacatggttggtttggtcacaaaaggggcttggcgtctttaaagaaagtagcttgataaatggtacaagctgcgtatgatttgacaagacaacctaaacacttcttcggtccatgaataaaaaaaaaaaaaaaaaaggccccta

SEQ ID NO: 35382 - DNA, 621 bp, Triticum aestivum
  Clone ID: PAT_TA_35382
gccggccgggtcgcgatcttctacagtaggccaagtcacgtcccttcgactataaaagagccgtcaatctcggccggcgccgccggctgaatcctcatcctacaactttatctatacgagacactaccaaacaaactttacttctacacaatcaaaatgggcagactttcaaacggcgactggctccttgtcggcaacagcatcttcagcgacgacaacggaacagaattccgcatgcaagacgacggcaaggtcgctgtctaccatggcgaagagtgcgcctggcagaacaccgccgaacagaactggcaagttcacggcatcaagatgcaagaagatggcaacctagtcatctacgacaactctggtactggacatgccatttggcacacagacactgctggtggcaagggcaaccagtcaacaacccttgtggtccaggatgatggaaatgttgttttgtacaatgagggtggtgaccccatctggcacactgccagcaacaagtaatcttatcacgcggaatgaagcggtttctgggatgctttcaacgttggtatagctacagaacccatgaataaataataactttcacaaaaaaaaaaaaaaaaaaggccccta

SEQ ID NO: 35383 - DNA, 697 bp, Triticum aestivum
  Clone ID: PAT_TA_35383
gccggccggttcgggactaaccttcgcagcggaattgacaacgtccaatgggccgtcttcaggaatacgaggtcatcgggcgccacttgcccaccgaggctgaccctacacccgccctctaccgcatgaccatcttcgcccctaacgagacggtcgctaagtcccgatactggtacttcttgcgcggtctcaagaaggtcaagaaggccactggtgagatcgtcagcgtcaaggtgctccacgagaagcaccccctcaaggtcaagaacttcggtgtctggatccgatacgactctcgttccggtacacacaacatgtacaaggagtaccgtgagctgtcacgaacagatgccgtcgagtccctctacaccgacatggccgcccgccaccgtgcccgcttcaggtccatccacgtcctccgcgtcgtcgagatcgagaagactgaggacatcaagcgaccttacatccgccagctcacccagaagaacctgagcttccccctcccccaccgtatcaccaaggagaacacccagaagttgttcagcgccaagcgaccttccactttcgcttaaatgatttcggtttagaggatggttaggctctgcgggtgttacacgggatcatggaaatatcaactgactttgctcaataaaatgggcaacgaatgaacgaaaaaaaaaaaaaaaaaaggccccta

SEQ ID NO: 35384 - DNA, 842 bp, Triticum aestivum
  Clone ID: PAT_TA_35384
ggcccgctcgagggccggcggcgggccgccggccgggccgggaacttcggtcatcttcactaaccttcgcagccggaattgaccaacgtcacaatgggccgtcttcaggaatacgaggtcatcgggcgccacttgcccaccgaggctgaccctacacccgccctctaccgcatgaccatcttcgcccctaacgagacggtcgctaagtcccgatactggtacttcttgcgcggtctcaagaaggtcaagaaggccactggtgagatcgtcagcgtcaaggtgctccacgagaagcaccccctcaaggtcaagaacttcggtgtctggatccgatacgactctcgttccggtacacacaacatgtacaaggagtaccgtgagctgtcccgaacagatgccgtcgagtccctctactccgacatggccgcccgccaccgtgcccgcttcaggtccatccacgtcctccgcgtcgtcgagatcgagaagactgaggacatcaagcgaccttacatccgccagctcacccagaagaacctgagcttccccctcccccaccgtatcaccaaggagaacacccagaagttgttcagcgccaagcgaccttccactttcgcttaaatgatttcggtttagaggatggttaggctctgcgggtgttacacgggatcatggaaatatcaactgactttgctcaataaaatgggcaacgaatgaaccaaaaaattctgagcatacaagatgctggccggtgtgatgcacaattgattgggtttataaaaaaaactagcaatgactaccgattgtgaactggtaaaaaaaaaaaaaaaaaacccctcccgcag

SEQ ID NO: 35385 - DNA, 859 bp, Triticum aestivum
  unsure (1)..(859): unsure at all n locations
  Clone ID: PAT_TA_35385
agcttcagcgggtcgccgcgtgccggccgggggacggacgccgggaagagggcggccggccggtcgacgcatccacctccatacccagcatcgccaaatttcacagcgacaaccgccgccatgggtatcgatctcgaccgccaccacgttaagggcactcaccgcactgcccccaagagcgacaatgtctacctcaagctcttggtgaagctctaccgcttcctggctcgccgaaccgatgcctctttcaacaaggttgttcttcgacgtctgtttacgtccaagatcaaccgacctcccgtctccttgtcccgcattgtcgccaacatcaacaaggagggtgagaagcgaaccgtcgttgttgtcggtaccatcaccgacgacaaccgtctgctcgagtgccccaaggtgaccgtcgctgctctgcgattcaccgccaccgcccgtgcccgcatcctcgctgctggtggtgaggctatcaccctggaccagcttgctctccgtgcccccactggaagcaacaccctgatcctccgtggccccaagaacgcccgtgaggctgtcaagcacttcggcttcggtccccatagccacaagaagcctcatgtcgagtcaaagggtcgcaagttcgagcgtgcccgtggccgaagacgttctcgtggtttcaaggtctaagcggtttcaaggtgaaaattattggccttgggtggagttggggccagtttatggggcaaatgatgccgaacatcggcttgcaaatgggtcttgcatggaattggcgtgcctaggtatcacaaaattctacaatgaacttctcgcgcattgctgccgaaaaaaggcccctaaaaaaggcctaann

SEQ ID NO: 35386 - DNA, 843 bp, Triticum aestivum
  Clone ID: PAT_TA_35386
cttcctcactttccctctcgatacggagtctcatcgaattggccgtccagaaaggcctcggtcgacacatcgaatgggttctcaccgtcgtctctgaaaatgccgtcccaatcggtctcctcggccaagtgtcgcagcctctggtcattatgtcgtgcgctttcggcaaggtctcattctccatcagtctcatgcgtctagctgtacaaccgttcatacacagattcttgtggttcattgtcgttactatgctcacgctgcatattctcatatcaatcatcatctttgtgaggtgcaaagacccaaggacaacttggaaccctgctatagtcagccagtgctgggctcctcatgtctacttgggagtaatgtactttatcggagcctattctgctgctacagactttatccttgctctcttaccttgggctatgctgtggaacctcaacatgaagagtagagaaaagtttggtgtggccattgctatgagccttggtgtatttgccggatccatcgcaatcatcaaatgcaccaaactcaaagccaacgcaacaagtctcgacccaaccttcgacgtcggagagcttctcctcacagccggagccgaaaacgccctcatcatcattgccgcctgtcttccaacccttcgacccattctacgcaaggtgtttccatcgaccgcaaagtcgagcgcgaactcgcaccctttaaagaatctccccaataacatcatttttgtaccaaagcacaaggctggtcaatggagtgctcttgtcgagacagaggctcaccgagaaagacactctgataatcagagtgacaggagtattctcacatgacatc

SEQ ID NO: 35387 - DNA, 827 bp, Triticum aestivum
  Clone ID: PAT_TA_35387
gccggccgggttcgcggtgagcttcagccctccccaagcaacgaccaacggcaacgaaacattacgactcacgacgcttgaccgatcgatcgcttgtcttcttacaacattaaacaaatcatctaaaaatcgccataatggagtttggtaacgctggagtgttgaacgaggatggtatccatgtagatatggatcgcctcaagaagggagaggtcaacctgggaacatcgattatggcagttactttcaaggacggtgtcattctgggtgcggattcacgaacaacgaccggtgcctacatcgcaaaccgagtgacagacaagttgacgagagtacacgacaccatttggtgttgccgatctggctcggccgccgacactcaggccgttgctgatattgttcaataccagcttggactcttcgccatgaccaacggaaagcctcctatgacacagaccgctgcgtcaatcttccaagagatttgctacgccaacaaggaccgcctatctgccggtctgattattgctggctgggatgagcgattcggtggtcaggtttactccattccctctgggaggttctcttcacaagcagtcgtacgccatttggtggttctggatcgacttatatctacggttactgtgatgccaactggcgagagggcatggagaaggacgatgctgtcaacttcgtcaagggagccttgagagagctatcaagtgggaggcaggctccggtgggcattttccgatggttgttctcactaaagagggagcggaccgacacctgtatctccctgaaaccgactacgctgtgcggcatgagta

SEQ ID NO: 35388 - DNA, 1011 bp, Triticum aestivum
  Clone ID: PAT_TA_35388
gagggccgtgcggccgacgtacccgggtgtcgctctccgctccaactctactacagtcccgccgcgggttgtccccctccgccgaagtatccctgacaccccgtcggcgcagatttattttctctcgactccctccattctctcttccttctttcatcctcaatctcccctcaatcctttcttcttgttcaagggaaagcccatcacagccgcaatcatgtcttccgctgaaccccagaaggtcttgggcatgccccccttcgttgctgacttcctcatgggtggtgtctccgccgctgtctccaagactgctgctgcccccatcgagcgtgtcaagctcctcatccagaaccaggatgagatgctcaagaccggtcgtctcgaccgcaagtacaacggcattggtgactgcttcaagcgcaccatggctgatgagggtgtcatgtccctctggcgaggaaacaccgccaacgtcatccgatacttccctacccaggctctgaacttcgctttccgtgacaagttcaagaagatgttcggttacaagaaggacaaggatggctacgccatgtggatggccggtaaccttgcctccggtggtgctgctggtgccacttctcttctattcgtctactctctggactacgcccgtactcgtcttgccaacgatgccaagaacgccaagtccggtggtgaccgtcagttcaacggtctcgtcgacgtctacaagaagaccctcgcctctgacggtattgccggtctctaccgtggtttcatgccctccgttgctggtatcgtcgtctaccgtggtctctacttcggaatgtacgactctatcaagcccgtcgtcctcaccggtaacctccagggcaacttccttgcctctttcgctcttggttggatcgtcaccactggtgccggtatcgcctcttaccctcttgacactatccgccgacgtatgatgatgacctcccggtgagggcgtcaagtacaagaacaccatggacgctg

SEQ ID NO: 35389 - DNA, 1045 bp, Triticum aestivum
  unsure (1)..(1045): unsure at all n locations
  Clone ID: PAT_TA_35389
gccggccggtcctgggagcggtggtgacgctcgaggcggactaaaatcaattgaccacccgcagccggtctttccaccctgaggagctccgaatccgaatctacgaggcatctcgtactctcttcacagtcttaaccgccgcaatgtcttccctcgctcgtcccatgctccgctcgccggctctacgtgtcgccgcccgacgcttcgagagcaccactgctcagaaggctgccgagaacgctaagcaggctgccaccagagcccaagaaggtctatcgcgtgtcacatctactgctggtcctgccattgctggttacgcaaagggtgttgctagcactttgggcaaggttggcggacgaacgggcaagatcatcggctttgttgagcgacaagtccccttcgtcgtctactactccaaggtcggcctcgagctcggcaagtttgttttccacaaccagaagatgagccctcctaacatggccactttccaaactacctaccaaaacctcatcaagtccatccagaaccgtaccatcatccagtcttcccagaaccttgtccagcaggtgcggaatatcggccctgcccagcttgctgctggcggcgtcgttgcggctgaggtcctcggattcttcaccgttggtgagatgattggccgtttcaagcttgtcggctaccgcggcgaggtctcttctcaccactaaacgggtctcttgtattggagcaggagttgtaaggatcaatccgtgctggaccgtgatgagcaaataaggacgaatggactatagacatggaccttcctggctgaggacgtctgggagggtctggttggagactgattgtttcggggggagttgaaaactgggagatttgggaataccggtctcaccggacctcgatgtttgtcctgagcatctttcttttgtagaactgtacatcaatcaagctgcggcgngtgatccccgccgtggagggctttcgacaatgatatctaataacgaaacgacccttattgatgaaaaaaaaaaaaaaaaaaaggccccta

SEQ ID NO: 35390 - DNA, 538 bp, Triticum aestivum
  Clone ID: PAT_TA_35390
atgtccccaaaccaaaccagacactcaacacttatcacacatgtcgcgtgttggagaaatctgcgtccagggtggagaagatcggaacggagaggcagaagatggccacggcgagcgtgcacggggccgccggcgccgtggcgcagccgggcggcatcgatgcggccgcggcagagtatatcaggatggtgcatgagcggctggcggcggaggaagctgcggcggcaaggcgctactatatgcgtgcgtagaatggaattacttttttttatgttcttttggttctctgcaagattggtcaagtctggtcagttaactcactagaaatactatgtaaatatagcttttaggactaaataatactactacaatgtcaagtcgttatttcatcttcagctatttgtattccccgatcattgagtccaaggcagcatatgatcgtctgtgcaaaccgagactagcggtaatgtgcgagatgataatcataagccagttatttacagagatgtttcacatctttctggcttttctattgatc

SEQ ID NO: 35391 - DNA, 490 bp, Triticum aestivum
  Clone ID: PAT_TA_35391
gccggcgggatcttcattcattcagtccaaaccaaatccaaacactcaacacactagtatatatcatccgacatgtcgcgtgttggagaagtctgcgtccagagggtggagaagatcggaacggagaggcagaagatggccacggcgagcgtgcacggggccgccggcgccgttgcgcagcggggcggcatcgacgcggccgcggcggcgtatatcaggatagtgcatgagcggctggcggcggaggaagccgcggcggcttgcggcaaggcggcaaggcgctagtaggagtactagctagctaggtgcggctaggtgcgcctagtgtagcatatgcgtgtgtaaaatggaattgctatttttttttgttcttttggttctctacaagattgatcaagtcgttattccaaaaatggtcggtttactcactggaaatactatgtaaatgtagcttttatgggagtaaaatgtgaagtcgttatttcagcat

SEQ ID NO: 35392 - DNA, 627 bp, Triticum aestivum
  Clone ID: PAT_TA_35392
gccgggctccatcattcattcagtccaaaccaaacagaacactctaacaccagtatcacacatgtcgcgtcttggagaaatctgcgtccagagggtggagaagatcggcgcggagaagaagacggtggccacggcgagcgtgcacggggccgccggcgtcgtggtacagcgggccggcatcgacgccgccgcggcggagtatatcaggatggtgcttgagcggctggcggcggaggaagccgtggcggctgctaccgctgcggcaaggcgctactagctagctacaggtgcaactaggtgcccctagtctagcatatgcgtgtgtaaaatggaattgctatttattttgtgttcttttggttctctgcaagattggtcaagtcgttattccaatggccggtttactcactggaaatactatgtaaatatagcttttataggagtaaaatgtcaagtcgttagttcatctttagtaaaatgtgcaaggcagcatatgatcgtctgtgcaaaccgagactagcggtaatgtgcaatgatgatcataagccaattatttgcagagatgtttcgcatctttctgggttttcctattcctcactaacaataagccccttgcttttagtcccc

SEQ ID NO: 35393 - DNA, 469 bp, Triticum aestivum
  Clone ID: PAT_TA_35393
cgggtccacgctgaaccaaaccgcggcggcgatggcgagggcggatgtgtggaagaaggaccaggctcgccgaaacaggcacccggactacgagttcttcctgtcccggcagcaacggtagatgactcgaggcttttgcgcacaccatgtttgagaacgctgacggatgcttgttcccctgtaaccagaaccaaccatgccggctgagcggcgccgtctgcctgtgttaccaccctgtatatatttgagatagaggtacatgtggaggtgctgctcaattgaaagtgaaaccagaccagagaatgtttactcactgcttacttactagttggggttgatatcataggtgcaacccctttttaaatctaattagcttgctcacccatgtgatgtgtgtacatatatgcctgtaactcaactcagcactgtatctatctgactccatattatcatatagatctgattaaca

SEQ ID NO: 35394 - DNA, 738 bp, Triticum aestivum
  unsure (1)..(738): unsure at all n locations
  Clone ID: PAT_TA_35394
tcctggtcctctccccccttgctcgtcatcccgcctcgggggtcggcgctgcgccgtaccccggcggccgtggcccgggcgggtgtgtgcaggctgctccccgctcgccccatccgcctccccgccggcgtcgtcgtcctggcccggcagccccggctggccactcgcggcctgttttgccagtcatgggtttgcaatcttacaatgacaagggggagtggtggtttcagacgagcagatccggttcggaagacgcagagtcctcgtcaagtcagccgtctcaggttcttgaagaaaggttgtcgacgctgaaccaagccgcggcggccatggccagggcggacgtgtggaagaaggaccaggcccacaggaacaggcacccggactatgagttcttcctgtcccgacagcaacggtagacgaccccaagctttttgcacacaccatgtttcagaacactgacgggggccacttcccctgtaaccagaaccatccggactgagcgggccgtccgcctgtgttaccctgtatatatttgagatanaggtacatgtggaggtgctgctcaatnaaagtgaancagaccagaaatgttaactcactgctactacnanttggggttgttcaaaggtgnacccttttaaancaatnactgcnaccaagtgngtgnttaaaaacccgtaacaancggantgttcaaccaaaccgtnnngctaaaanattggtaccacaaaaaaa

SEQ ID NO: 35395 - DNA, 1146 bp, Triticum aestivum
  Clone ID: PAT_TA_35395
gccggcccgggctgtgtatttaacatcattatcaagaaccaaagatgaacgcccctgatcgtttcgagctcttcctcctcggagagggtgagaagaagatcgaggagaaggtcttctctggaatgtccaatacctcggactttgttctcatgaaggaagaccacacccttggaaacctcctttccgagcatctcaagatgcaccccaatgttcatatggccggatacaagattgcccaccccaacgttccggagctttttatccgagtgcagacggacgggaccatcacccctcgagacgtttttacctcagtctgtgaaaagctcattaaccaactcgagatgttgcaccaggagttcacgcgagagtgggaattgaggcgaatcacaactgccggagagcaaggcaacatgcagaacggtcactaaatcgtctttcttgaagtcgatcgtatcacgatcatttaaaaacaaacaggcacctttttttttcggcgtttgggggctgtagattactgctttttatttttaccagatgtaaactggaatgaactcaagacttaggactcttctgagccgcacactgcaaaaaaaattcctatttgatgccaatgtcacaacaccaatattaagataggcagcgcgaagtttcgactccgtgatggggatgatgctcgtcatgagtcttgattgaataggcttgcggtgtttctttgacttatccgtctcaatctcgagcagccccttctgggccctcaccaccggggatcaacatgcaaatgttgttaccgttgagtagaatcttgggtagcttggtgtggtttcccgagtaatcaaactcagtcacatcctcaaggaccatgttgacgtagtcatcgaatccaacgagtgttccactgaattccttatcacccttcatgatgacccaaattctagagccgacacacttgtcgataagctcgaggggtagcagttgggaggccattgtgaggatttatatgacaaagatttggcggtaaagaatttcggtctgacaatgctctcactgagagactgctattataattcaacggatagtctctggtagaggtgaccaataactgagctcgtctcttcgagttaggctgaagtccccggaccggccggc

SEQ ID NO: 35396 - DNA, 511 bp, Triticum aestivum
  Clone ID: PAT_TA_35396
gccggccgggtccggatcctatatctattcatccaatcgtccctcaaacatctttcacttcttaattggccggtccaattgtatctagtactcttaatttcttccaattccataccacaatcaaaatgcttgctaaagtcgtcttcgctattgcattcgcaactcttggtatggccatgccccaacgtggtggcaacaacaacaacaataacgggaacgcgcaacaggcgcgtgttgaggacctacgcaacaaaggactcacgtgtaacgaccgaggtgacggcatctttgtttgcgatgacggcctcggtggtaactgtatcgtgaacagcgctggaagaggtacttgtctcatctagagttttagcttcaaactgaaacaaactctgggtgtcaacgatggaggcatatctcgttcttgtatcgagtatctacaaattcatgttggacagataaaaacaacagatgcatatccatcacgaaaaaaaaaaaaaaaaaaggcccctaagga

SEQ ID NO: 35397 - DNA, 598 bp, Triticum aestivum
  unsure (1)..(598): unsure at all n locations
  Clone ID: PAT_TA_35397
gccggccgggctccgatctccctcctagggttcccagcacctcgcctccgccgccgccgccgccgccgtatcttcatcccgtacctctcgccctcgccccctctcttcccctccgcgattttcttcgttctttttcataaattcgatcctgcttatttgcgttttcccctctcgattcctgacaagttggcggcccccatgccgccatcttcgcgaggaggggatagatcgacgcgtcaagaaatcgtttcaattgccatggcttcccgtaggcaatgtgattgttgcttgcgtacacttttttctctctctcccttcgttttgctcgttcttctcttgccgatgagtaattttcttgtcttgcacgatgctaaccccgggcttgtcggacggatctcggtccgctgtgatgaaggaaagccccaatgctgtgctagatccacaccgccgttcagtgttgcaggccgcgacactacgcgtggatgagcagcctgtgtcagagtaatggatacattcgcatcacatcgtttttccctcttttgtttcggatcttggatttttttttggtggntgggattagaatcttacccgcgcttct

SEQ ID NO: 35398 - DNA, 744 bp, Triticum aestivum
  Clone ID: PAT_TA_35398
gccggccggcgacggccgagcttttcttcgaacactccgacgacaaccagcaccaccgacaactttgtgcccacgacaaccgacacaatggccgccaaggataccaagggaaagaaaggaggcaacaaggccgctcaggctgccaaggccgctctcaagggcaccaactcccacaagaaggtcaaggctcgctacagcacctccttccaccgccccaagaccctgatcactagccgtgctcccaagtaccctcgtcgatctatcccccaccagcctcgcctcgatgagcacaaggttgtcatccaccctctcaacactgagagcgccatgaagaagatggaggagaacaacaccctcgtcttcatcgtcgacgtcaaggccaacaaggctcaaatcaagcttgccctcaagaagctttacgacattgactgcctcaagatcaacaccctgatccgacctgacggtagcaagaaggcctacgcccgccttactcccgatgttgacgctctcgacatcgctgccaacaagctctctctcgtttaaagacattacttggcttgtggatttctggcgtgtcattgggctggtttattgtctgctgaaaatgcaagacacggacatgggaaaaggcgtaaaaagtgcttctcgtttagagtgcaaatgatcatgaatttaaaaccgcccagcacactgtcgtgcctattcgtcgagaaaaaaaaaaaaaaaaaaagaaccctaccccta

SEQ ID NO: 35399 - DNA, 993 bp, Triticum aestivum
  Clone ID: PAT_TA_35399
gccggccgggcctgcggagctcaagaagtacctcgacaagagactgttcgttcaattgaacggcagccgaaaggtcatcggcgtcctccgcggttacgatgtctttctgaacatcgttctcgacgaggcggtggaggaaaaggacaatggcgagaaggtcagaatcggcatggttgtcatccgcggcaactcagtggtgatgctcgaagcgttggaacgaatcggcggagacgaccgacgaggagaccgataaacccccctggcggcagtggtttctcttgatgtttcgatggatattatatgatctttattggcgttaaggtcgaaaattgagacacgttcttgcggaaactttgcttgggaacacgtctaatagacaaacaagagagaataaccctcgactgttatactgtgcccatcctcactctttcttctcccaggccttttcgtcgtaaaagtccatcaactggccatcgtatgccttttgccaacccttgattcctccggtcagaatttcagccttgatgtcagtttcaccaacctcgtcgaggtagtcctgcatccacctggcgcatcgtggaccacggccattggagctcccgcaataaaagataattctcttgatacctgcctgtttaacaagctgataaacctggggacgggtctggtagaacgtgtgagctgggaggttgattgacgtggaaatagtgccgccctcccagtcagtccttcgaacgtcgaccaagaggaaatctcttttggcgtttttcccaagagctgcattcacctcgatgagcttggagataatagctgggtcggttcgagtgcactcggcctttggctcaggaaaggcttcccaccaatcctgctgcggggtgtcttgcggggcgtcgtctcccatgatatgatgcaagtcttttaggtgtattgctaaagtgagccgcttagtagggtattatcaagtgcgaatcccgcccgccgcctgagcggccg

SEQ ID NO: 35400 - DNA, 943 bp, Triticum aestivum
  Clone ID: PAT_TA_35400
cggccgctcaaggccggcgggccgggccggccgggttgcgaactgtgctcctcttacgtattggacgctaagtcagctatttcacaccaacccctccaacgtctttttttacaactctaccttcctaccatcactcaacttttcgacattaccacttattgatacatcattaccaacaatgtccgctcaagacaaggcccagcaataccttggtcagctcgaccgtgagctttccaagtaccccgccctcaacaaccttgagaagcaggctggtgttcccaaggcctacgccgtcatcggtgtcggagctctctacttcttcctcatcatcttcaacctcggcggtcagcttcttaccaacttagctggtttcgtcattcccacctactactcgcttggtgctctcttcacccacaacaaggaggatgatactcagtggttgacttattgggtcgtttttgctctctttaccgtcattgagagcttcgtccaggttgtctactggttccccttttactttgtcttcaagttcattttcctcctctggctctctctccctgccttccggggtgctgatctcgttttccgatctttcctggcccctaccctcggccgatacttccagcagtccggctctaccgcctcaggcctccgtgccaaggctgatggcctcgacaagaccgagtaaacggtcaccgctgtgaagcttggtcgctaatccaaatctcgcgtgttccgcgtgacccggaccaagtactttcggttatacatgaatggaaaattgttgccttttaggaatcgagtagcttcaaagtaatgctgcacggtttgaaggtggatgagaaggatcaacatcagggttgggaagtatacaggctagagagagacgctgcactgggcagctgcttgagcgcgaaggggtgactcttgtcatggccctgtt

SEQ ID NO: 35401 - DNA, 646 bp, Triticum aestivum
  Clone ID: PAT_TA_35401
cgggcccgggccggccgggcatcactctctattcttcacatctatcacctactacaatctccccacacatcctatcatcatgtctgccaaggtgtatgtcggcaatctgggctggaacacaacagatgactccctccgaaacgctttccaagactatggccaaattctcgactcgattgtaatgcgcgatcgagatactggtcgctcaagaggctttggtttcgttacatttggtagttctcaggaagccgagactgcaatcatcagtttgaatgaacaggaacttgatggccgtcgtatcaaagtaaatctagccaatgctcgtcctggtggaggtggtggaggtggtggttacagtggaggcggtggctacagcggaggcggtggctacagtggaggcggtggctatatgggaggtggtggttataatggaggtagtggcttcaattaaggtaccggacataaatctagttaaagtatggatcatgtggtttaagatcacgacgataaggcccggtcaaatatcactttcactgttattgagaaaaaaaaaaaaaaaaaaaaaaaaaaaaaccctcggcgccctgcatcaagagtcatcgaaagtagggcataagcgtaaaaaaaaaaaaaaaaaaggccccta

SEQ ID NO: 35402 - DNA, 995 bp, Triticum aestivum
  unsure (1)..(995): unsure at all n locations
  Clone ID: PAT_TA_35402
nnnnnnnnnnnnnnnnnnnnnnnncggtcgcgccggccgctgtggcgggcccgctgattcgaagccgacggcgacaaacagctaattaaccaagcctaactactgtttcgatcgagtcccccgatcccccgcaatcgaatttcgcccatcatgtccgacgtccaagaacgcctcaagaagctcggcctcggagcccgaactggtggaaagggtaccccccgacgaaaggtcaagcgcgcacctgcccgctccggtgccgacgacaagaagcttcagctcgccctcaagaagctgaacacccagcccatccaggccattgaggaggtcaacatgttcaagcaggacggaaacgtcatccactttgctgctcccaaggtccacgccgccgtcccctccaacaccttcgccatctatggaaacggcgaggacaaggagctcactgagcttgtccctggcatccttaaccagctcggccctgactcccttgcttctctccgcaagctcgctgagagctaccagaacctccagaaggagaagggtgaggacgacgacgagatccccgaccttgtcgagggtgagaactttgagggcgagcccaaggtcgagtaaatttcctccacaaaaaactcgagggcgatgggcagtgagatcgtaggcatgtccggccaagaggctggctagtttctcctgcgaggcgggttttatgttttcccccttatgggtggatagtcgtgacaatcactccccggctctctatttcgagtagctgaggagtaggtacgggtatgcaaaaggtcacagcttgggaacggtcgcggtggaatggcgatttatgctggctgaggttgattgatctgtacaaacaaacaaaaaatacgacttacatcgggagaaataccaatctctaatgatgtcaatgattgctacgcttttctagttggaaatctgaccctccgtcattcctgatccaaaaaaaaaaaaaaaaaaggccccta

SEQ ID NO: 35403 - DNA, 784 bp, Triticum aestivum
  unsure (1)..(784): unsure at all n locations
  Clone ID: PAT_TA_35403
gccggccggngatcaaaacagggagcggcgcagcaagccatgnccccaaagccaacgatcatcgcctcgtcgtcgtcggcaatggaggatcacttcggccggaggatatccagggaggaggaggaggcggtggtgaagccgacgaggagcttccggtacgaggactacagcaccaggcgggtgttcctgcgcagctaccctctacagtgggactcgccggcgcccggcggcggcgtcgacgagaagcagggcggggcggaggacgacgacgaggaccggtacggcgacggcggcggccgcgacaggcggtggaagcggcaggtggcggcggtggtgtaagcatttgagtggggggaggacaagctgctgctgctcaggcgggtcaagaagcggctggcgctctacctcatcggctgccactacagccgccccgcgctgccgtacaagtccggcggctcatgcaccaccgccatgctcaagtccatgtgatcgccgccgtggcgagccggttcagctgctcgtgtgtctgtccatgatacgcagcagacagttgttagtctgctcgtgccgtctgccttccatgctgctctgttttgtgcgcctgaaatactctgtatctatgtgtgtccctacgtagaggtaataataagagtttgtacgagtgatgaaacgctcatgtatatattttcttgtgaaatctttgtcatatgatagatggacaaataatgtccaaagaaccttcaaaaaaaaaaaaaaaaaaaaaaaaaaaaaaaaaaaaaaaaaa

SEQ ID NO: 35404 - DNA, 763 bp, Triticum aestivum
  unsure (1)..(763): unsure at all n locations
  Clone ID: PAT_TA_35404
cccaagcgacgccagcggcccagaaccagccacccgcgccgaccccgaaacccgcgcgcacccgccnccgccaccgccagggcgcgcgcgactgccctgtgcatgttcctcgtcgccgcacggagcatctcggtccacggcgctcagtacgccccgccgcctgccgttgcgttcgccacatcggccgccgcacgggctttctccacccacgccgccgcctacggcccgccggcagcctcttcctacggcgagttggcctcccctcgcccctcctccgcccacgccgccgcctacgtcccgccggtgcccgcctccagggctatcgtcggccaggccctgccgccgccggggtcggcccctgggtggacctcgtctcccgcgctgtcccaaggccggcgcgctcgcggcattggtcggcgccgggatctacatggctctcgcgcccgacgatgacgaggaggatttcccgggagcaataacgggttgttggtccaccaaaggcggactcttcggagcgcgacttaagggccatcaagggactgctccagaacattggttgcaatcctgaagaacattgcaaaggggcaacaagagcaagaggccccnaaaccagatgcgagatgctgggaggatatccttgacgatatatccagaaaaatctacctgattcnaaccggagttggaagaattaantccctaaccatctntagggtgancccnccgaaatnttggatcaccaaaattcatgccctcccggtgnatg

SEQ ID NO: 35405 - DNA, 678 bp, Triticum aestivum
  Clone ID: PAT_TA_35405
aatcctgaacacggaggacgtgtacgaggcatggggcacattccgtggaaaatagggttcccccagaacgatgacccgtacggttacagaagccgaaagagaaagatggatcgggaagcagatgttgtggcgcggttggcatcggaaatggatgtgatgaagaaaaccgtgagtgtactagtagccgaacgagatgcagctcgggcgcagcatgaagatcatccagcggatctcagaagccagcagcggagaagcagtgtggcttccacggaggccccaccggctggtgcagatgcaccgacgatcgaaattactgcaccggagcctctggtggtcgaaattactgcaccggagcctctggtggtcgaaattactgcaccggagcctcctcgctaccccgtggacgatataaaggagatgaaagaatgtcatctgtattatcctatcgggaacatgtccatgaaggtagccatcggcagtgctttaccatgtttacctggagcactccaccacaacaaccccattcaagatggctatgctcgtgtcacggtggaggacatagtccaagggtttgaggacctggagattgacattgctacacctgaaggggagaaaagacttggagatgtcaagcgccatttcattctatggcaaaagaagtttatcaagtttccaggc

SEQ ID NO: 35406 - DNA, 664 bp, Triticum aestivum
  Clone ID: PAT_TA_35406
ccaccccgtcacacgtaccttgtggaagtagtctcaagaaagaatggcgctgaatactaggaatgcaatcgttgccgttctcctcctcgtcgtgatggtcgtggcggtctcaacaccagcagtaactgcccaagaggactgctgggacaaatgtttcaaggactgcaaggcaaaaatggcaatggaagtttgcaaccaaaagtgcattgacttttgcatttatcaagctggagccagagaatatgttaagatggctggcgataaactcaaggagaccaaaactgcctctccagaacaggccactaaactcaagaatcaagctaccacctacttagaacgtgccaaagtcctcagcgataaagccgtgaccccgtgagtgtgagtgcgcgctcttttgtctatcagtgtcgctgctgttatggtgtctatggatgttttacttatttactattaaattgtcgcggttgcatcccatattttttggtttctttcatttttgtctctttgttaacagaccgtcttttgtattatgacgacatgcttgttccagtgactccctttctctgtttttattgtcgagattactcatgtgtaatggttttccattgatttggatacataataataaagattcttgcttcctttttaatgccaaaaaaaaaaa

SEQ ID NO: 35407 - DNA, 786 bp, Triticum aestivum
  unsure (1)..(786): unsure at all n locations
  Clone ID: PAT_TA_35407
annnnnaagnagnagttganacccctgctcgaaattaaccctactaaagggaacaaaagctggagctccaccgcggtggcggccgctctagaacgtgcggcgctcgagcggggcaggaattcggcaccagctccccttcctccccctctcgaaccccacctccctctccaagactaactccctttcccaattcctcccaaagaccttgtatccagatccatggtggaatagatcgagaagaggagcgtaacactcggccactctctcttcactcctcagatcccaggcctgaacaatgaaaaactgaggtagctcgtggccttctcaaagcatctccgcccttgccatgctgtcaccatcaatgggtctaatgactaaaggagatgtacatgttgcgccttttcggccacccactgttgtcattcgatcccaggggcgatgccctgatctagatgccactagctccagtgctagtggacgctagaactcttcagagacggttctccagggtccccggcatgaccatcgtgtttctttcagcatcattgctgcttagcgaggaagtctagagggggagatgcttgattggaaagggttggagtattagagtgaaatgtggccccagtgcccacaacacttcatttcgttatatcattatggtattattgctttggtcactgcataagggatattgtgatttattgtatcacattcttaattttatatatatccagtcattattaatggttatntttnaaaaaaaaaaaaaaaaaaaaaaaaaaaaaa

SEQ ID NO: 35408 - DNA, 1080 bp, Triticum aestivum
  Clone ID: PAT_TA_35408
cctggctaggcaacaggagaaggatcatagtgatgaaccgcgaggacatggtgtcggccgacgacagaaatgcatgggcaacttacttttctagtcagggtatcaaagttatttactcaaatggccagctgggcatgggtacgatgaaattaggcagaatggcaaaatcagcagcatctactgtgaacacaaggcgaagagaaaagggattgcttcctcgtccggttcgagctggaattgttggatatccaaatgtcggtaaatcttccttgattaatcgcttgctaaaacgaagaatgtgtccagcagcacctagaccaggtgtcacaagagaactgaagtgggttcgttttgggaaggatctagagctattagactcacctggaattttgccaatgagaattagtgatcagacagctgcacttaagcttgctatctgtgatgatattggagaaaggtcatatgattttgctgatgtggcagcaattcttgtgcagatattgttaagacatccggctgtgggttctgaggcatttcgaaaacgatacaagatcgatgtagacagtgactgcggtaaattgtttgtcacaaagctctcggtccacttgttcaatggagataccacccaagcagctttccgcatcttatccgacttccggaaaggaagatttggttgggttgccctagagagacctcccacatgaacaatgaatataacactttaccagaggtcatactcacctgtagtacgcacgtcaatcacaatgtcatttgtagcaccatcataggacaatttctctggacctatgtgtggaatgaggaatctattggaggatagggtggctatatccctacatcacaagtctgacggcacatcagaaattgccatgtagttacatggttgtctaggggtctgagctgatctgtatgagcatgtgaaagttgggttaactcttttttgtaatctgttacagaattaggtatggataaatggaactggttccaattttgcacaattaaatgctcgctcgcattttccggactaaaaaaaaaaaaaaaaaaactcgagactagttctct

SEQ ID NO: 35409 - DNA, 1039 bp, Triticum aestivum
  Clone ID: PAT_TA_35409
acctgcaatacctggcttggagcatttttatcagttctcggggttggtattctggagttaagtggttctccaccatgtgttggtgatcttctgaccctccttagtgccttttgttttggaattcacatgctcagaaccgagcatatttccaggaaaatgaagaaagaaaatttcctaccgcttgttggatgtcaggtggttgtcgtagctgttgtgtcggcagtctcgttcattgttaaatgcttcctccagaatgtggtaccctggaatttaaaatcagggacaccaacagagttattcagtatgatgtcatcgtttccttggctagcaatactatacacaggcataatcgcaacaaccttttgtttatgggcagagatcgttgctatgcgtgatgtatcagctacagaaactgcaataatttatggtctggaaccagtatggggtgatactttcgcatgggcaattcatggcgagagatggggcattactggacttattggagctatcttcatcatagctggtagcttgatggttcaggtactggggtcatttcttgatattgatgtatcagaggacagttaccagatgaacagctgatacataaattgcaaaaatacgaggatttcacatgataatgatcagttgatcactactgcgacgtaatacgccaagtagctagcatgacactgcaacaagatctaactacaattatggccagttgcacaaggaagggaaagctcactaggctgacaaaactaggggtggcgtggctcactggtggcctgagcaactgatgaaaacaaactgtggtgcctcgtggcgtggagaacacatctacagaaaatggtgatgtgtatcactccactaaacgcttagggtagcctgatgtagtatcagtaacagtctaaatccttctttctctcaatgtaaatccatccacatgatgtagtatgtaatagattacttcatgcggactcggcaccagcctgtgcccctcgacggcgcccttcagcgccacccctgcccgggcggccgc

SEQ ID NO: 35410 - DNA, 614 bp, Triticum aestivum
  unsure (1)..(614): unsure at all n locations
  Clone ID: PAT_TA_35410
ngtggaatntgaggnacgnnggctttgtntacccgttggaaggggattctgcagngttagttgtacccagttgccggtcagagttttaacgaggcccgtagcgcgcacgggtcgacccaccacactcgtccactcgccgacgtttctctgggccggccggccggggcttccttgcacgcgcgcgacgccatggatgggcaggatggcggccagggcctgaggccgaagcccgacgggaaccggaaccccaagagaggcagcatcatcaagaccatcatcgccgactggaccggcggcggcgggacgccaacgacttccggcggcggcggcgggggaggaggaggaaacgaggacaccggcaacggcggcgactcctagcgagcgagcatggctgcgcgcgtgcgtaccacgagatggttagtttgagcctatgcagctatactatcgctaaataatgcctctcgttgtacgtgtgccagtggtaaaaagaactgtctgattgtgtagcttaattgtcttctggatctgtggatggatagatattagccctctttgttgaacctaaacctaatgtagtaatgatgctattttccgtcaaaaaaaaaaaaaaaaaa

SEQ ID NO: 35411 - DNA, 923 bp, Triticum aestivum
  Clone ID: PAT_TA_35411
gccggccgggtccgggaaaaagtggtctttcagctactcttgtttctttctttatcctctctctacctcaactactcacacaaatcaccaacaatggctaaacaaactaccctcgacgagttcaacgccgtcttccccaagctcgaggaggttctcctcgaccatgctcgctcttacaagctcccccaggagcagcttgactggtacaagaagtctctcgaggccaaccctctcggcggaaaatgcaaccgcggcatgtccgtccccgattccgtctctctcctcctcgagaagccccttactgaggagcaatacttccaggccgctactctcggctggatgacagagctcctccaggctttcttcctcgtttccgacgatatcatggactccagcatcacccgtcgtggccagccctgctggtaccgtcaggagggtgttggcatgatcgccattaacgacgcctttatgctcgagatggccatctacactcttctcaagaagtacttccgcacccaccctgcctacgtcgacctcatcgagctgttccacgagaccaccttccagaccgagctcggccagctgtgtgacttgctcaccgcccctgaggacaatgtcaaccttgacaacttctccctcgagaagtacagcttcatcgtcatctacaagaccgcctactactccttctacctccctgttgcgcttgccctccaccagctcaacctcgccacccccagcaacctcaagcaagctgaggatatcctcatccctctcggagagtacttccagatccaggacgactaccttgacaactttggcaagcccgaacacattggcaagattggtaccgatatcaaggacaaccagtgctcttggctcgagaaacaggctcttgccgttgcccacccccgaagcagcgcaag

SEQ ID NO: 35412 - DNA, 786 bp, Triticum aestivum
  Clone ID: PAT_TA_35412
atacggctacgagaagacgacagaagtgacgggatccgggacgttgctcaaaagaagaaggccatcaagaaatcgagggactctgtcaagaacaggaacaaggaggctcgccgtggagaggcggatcgcgtcatccccaccttgaaaccgaagcatctcttctctggaaaacgaggagttggaaagacccagaggcgataaaccagtcaatgtggacgttgctgcttgcaatcactcgatcaggaactattggatcactgccatttttcgtgctgggcatcgggggaggcttcagtgtcaatctggcagctggagatactactatctattgcaattttatttttatctggcatttgctctgtgttccgctttgtttgttagactacattgttgttgaactatatggttgtaccttcggtttactctgcacttgtgcggagcggagtcgaattttgtttgatggtgttattaatgtgaagaaaaggggggaaaaaaaaaaaaaaaaaaaaaaaaaaaaaaaaaaaaaaaaaaaaagaaaaaaaaacaaaaaaaaaaaaaagaaaaaaaaaaaaaaaaaataaattggataacatccaaaacatttttttagaattaatttaaccttcagagtcttgagaagcgggccccctgctttttcagcattgcgaggttttgtgtttcaacgctcatccctgcatgttcaactccgcttccctaataattttcccgcatttccaaattcacgattgcggaagttccagaccgccacaaccacgacgaaacaaa

SEQ ID NO: 35413 - DNA, 1403 bp, Triticum aestivum
  Clone ID: PAT_TA_35413
gggtgacgctgcgcacgataacagatgggtgggtgacgacgatgaaataagctgcatgtgaggggcgtcttgggctgagggtggagagcaggaaggaaagcaaaagaaggatcaatgactgcttaagcgcgtttcatgttgctatgcccgcgttgcgcgtaatcagggctaggacccgacgttcgcagccagtcgagcgggcggatgcagcggaggtcgctgcgcagggcaggtggaaacttcagagggaccttgagtggcaggcacgaggtgatggagtctagtccgagagtctcataaagcattacttgtcggccgattgtaaatggcggaacggttgtcgccatcagggatggggcgcgaataatgtaggcgatcaagtggtcccgggaatctggcaaaaagtgtaacagagctgcaaagggaggggaggccgtcgtcttgatcaagaagctgaacccgatgcattcctgatttgatggccaagaagttggtaagtcccggacgccgtaaaccagtgggtaagattaggaagaagagggctctgctcatccaaaagcataggatgaagaagatgtactgcagagggccgtcctattgttccaaggaagcatgacaaggataggaatttcactaccaagagactgggcaggcaactcacatccatgggtgttgatcctactgctgctgtgaaccgacttcgcagccagtcaagaggccgtaagcgtgagaggtcactgagcagagctgatggtgatgatgctatggaagttgatggccagcactctgacaagaagctgcgtatgaggtcgaggtctaggtccaaatcacgaccaattgaagaggttgtaccaggtgacgggatccgggatgttgctcaaaagaagaaggccatcaagaaatcgagggactctgtcaagaacaggaacaaggaggctcgccgtggagaggcggatcgcgtcatccccaccttgaaaccgaagcatctcttctctggaaaacgaggagttggaaagacccagaggcgataaaccagtcaatgtggacgttgctgcttgcaatcactcgatcaggaactacaggatcactgccattttccgtgctgggcatcgcgggaggcttcagcaccaacctggcaggaggagatactatttactgcatttttacttgtgtctggcctttgctctctgttacgacgcttggtcctcctttgttagactatatatcgttgctgaactacatggttgtaccttcggtttactctgcacttgtgcggagcggagtcaaattttgtttgatggtgttattaatgtatttgaacgggccgcttgttttccttttaaaaaaatgttttgatactgtgatattgcaaaaaaaaaaaaaaaaaaaaaaaaaaactcgag

SEQ ID NO: 35414 - DNA, 2038 bp, Triticum aestivum
  unsure (1)..(2038): unsure at all n locations
  Clone ID: PAT_TA_35414
gtggcggccggctcgaggcncggccgggtttggagacagacgctaccatttcttctatgactctgctccagtacctccaggaatgcattgatgaatcccttcgcctccacccagtcattatgtgtggcctccaaagaatgacgccacctgaaggaatgcagatcgacgacgtctttattcccggagacaccatcttccacgccccttcctacactatctatcgagatgaacgttgctttgtacgcccccttgagtttatccccgagagatggaccacccagactgaactgatcatcgactcatctgtttatgctccattctctactggacgcggcgcatgtgctggaaaggagatgagtctcatggaaatgcggcacgtcctcacggaaattctgtcaaagtacaacatgtcaggtcgcacccggctacaaacccagaagcctttatcgatggcttgagagactgttttacactggagctcccggagctaaacatgatcttcaccccgggaggcgagaagtctcatcggacggttccatactaaatcatgtattgcgaagcatatttgaggtatggcagtggaggatttcatttggtagtaataaggtccctcagctattgccggccggagcgtacgacacgagccctctcgaatggtccttggatttttcgcccgtcaatcagtatcgcgaccacttgcacccaacaattcgagggacgactaaccccagcagcacaggaaatccaaatcttcgccgaccggtttgaggatttgtttgtctagccgtcgactgagctgcccttctttccttttctttaatccccccagaaaagacggttacgatgtccagcttcgagcaagttgtcgtcatcgatggcaagggccatctccttggccgactcgcctccattgtcgccaagcagctccttagcggtcagaagattgttatcgtccgttgtgaggcccttaacatctccggagagttcttccgcgccaagctcaagtaccacgcccacctccgaaagatcacccgatacaaccccacccgcggtggtcccttccacttccgcgctccttcccgaatcttctacaaggccgtccgtggcatgatcccccacaagactgcccgtggtgccgctgctctcgagcgccttaaggtcttcgagggtgtcccccctccctacgacaagaccaagaaggtcgtcgttccccaggctctccgcgttctccgactccagcccggccgcaagttctgcactgtcggtcgtctgtcccacgaggttggctggaagtaccaggatgtcgttgcccgtttggaggagcgaagaaaggccaagggtgccgcctactacgagcgcaagaagattgccgcccgacaactggccgatgccaagaagaacgccactgtcaaggaggagacctccaaggctcttgccaactacggctactaagctgttcatatccctcgacctagcatcttgccggtctaggcacagcttggcaacgtctatcatttctcatgcgtttcattagatggcgcggtggttcaaagggatttacttgatttgctgagtgatggcaagggtggctcgaggagtagatgtcgattccccccaaaagaaatgttctaaatgaaaagtccccaaccacgattatcgaatgcttttttttgcacttactgcccgcgaccagaagaacctaaagcacagagttccgacaattcaacatgatttgcatgaggataactgagactcttgtgtggatacctcttcaaaccttgggatatgtggtgaggcttttgatgatgtggaggagggatgctttgttgatgaacgtttgacggaggctggcgattgtcattgatcctgtgtttacccaaggacgccagagttcggcggacgggttttatgagtgatggcaatgggaggtgatcttgtttcgcttccctgaacgggacagggtctcgcattttgcacaataggagtagaaaaggaaaggctcttgtttgatcaaaaaaaaaaaaaaaaaaggccccta

SEQ ID NO: 35415 - DNA, 470 bp, Triticum aestivum
  Clone ID: PAT_TA_35415
ataccaccgcctcggcgcttcgcattcgccttcgccagggaaagagctgccctgacaccccgaagcgaaatttcgaggagaacccaggacttcgcctcggcctccccaccggcggtgcaggctgcgatctgatcgtgtgacccagctgtatccgggagctgcaatcgaagatgagcgtggttgggtttgatttgggcaacgagagctgcattgtgggggtggcacggcagcgtgggatcgacgtggttctcaatgaggaatccaaacgggagacccctgccatcgtctgctttggtgacaagcagcgcttcatcggcacggcaggcgctgccaactccaccatgaacccgaagaactccatctcacagatcaagcgcttgttgggccgcaagttcgctgatcctgagctgcaacgcgatctgcagtcgttccctttccgtgtctcggagggccctgatgggttcccactc

SEQ ID NO: 35416 - DNA, 857 bp, Triticum aestivum
  Clone ID: PAT_TA_35416
agagatgctactaaatttattcggattctgccctagggggcacagcaacaccatcaaactccaatgaaaaatcgaatcacacttttgaactaggaactaggaagcatcggcgggggagggacaaacacaaaatttacacgcgtagaatagataaaaggaatcttcaaatcttgggggcgaaatcaaggccttccttgccgagcgcctccacgtcggccaccggggggtgggccctggcgaccttggcgatggcctgattctcgtcgggggagccaccctttaagaacacaccgatgaccttgccgtccttgacccagtaggggccgaacttgggcttaggcgccgctgggtcgttgtccccgaacagcaccgtctcgccaacgttgtcgccgtaaaactgccacgcgacgtcgaacgacctcgagtaaaaatagggcaggtagtcttactccgccacggactcgccggactccttggccttgatcgcctttactgcctgctcggctgatttccgagcatggtcgacgtgctccactctcctcggctcgtcgtacagcttcatggggaaagtcgccacatcaccgatggcatatacaccagcgacgcttgtttcgaagaatgtgtcagtcttgagtccacccttctcctcttcaacttggcctttgaagaggcctgtcagcggcctgccaccgactccgacgatgacaatgtccgcatccagtactcttccatccttcagcttcaccacactaacatctccattggcatcagcatcaaaaccactggccacagtacccttcacgatattgattcctttgctagcgtagtaaccctcgtagaaatgagccggacgcgtg

SEQ ID NO: 35417 - DNA, 995 bp, Triticum aestivum
  unsure (1)..(995): unsure at all n locations
  Clone ID: PAT_TA_35417
ggaggcgacgccagttctcctcgttcttcccatattaaccttttggttccacaagtactgcacgcaccggtacaaacccgcgtttgtgaggaacccgctgcaggtaacgtttacacataatctctcttcgccatcggattgatttctccttgtcctcttcggtgctgagagtctgaagatgtgccgtggtttgcgcaggaggcgatgaggaaggacacgctggagcacgcgagggagcccaacttcgacctcaagtcgtacctggcggactcgtacctgcacccggtgttcaagagcgacgacgtcgacaagttctacgtcgccgaggaccccggcgcggaggaggtgatcgtggcgaccaagcggcagtcgaggaggaccacgcccgtgcagagcaagtatgacggctccgacaggctatccgtgccggactccatacccgaaaggtagcacctggctggccagccatgggaggagtgctattggttctttaggctgttagcgtgtacagagagagacagagaggggggaatggaattctgcttgatgatgatgtcacacggctggggatgttggctgcacttgctgcaaacttgcaatgcacacggcacaccagtacacctgtttttccactggtatttgaaccgaatacgatccagagatgcacattgcagtgaggattggtttggcgttggcaagcatatagtattagtgaattggagaagtttgtgaccagtttcatctgtcctattagagttttaaaatactagtaagcgtgcatgtgcaacgcacgtatatgcatttatatgtcggggccacgacctagaaacaataccggttgagtgtgcaaggcgtgttggagcagtggacgtcgaagcgatggccccaatagcttggcatataaaatgcttctccttcaatattaaaatattgaactaccacatattcttagtagttnccaattcaaagagaagaaaagaaaaaggggcgtgccg

SEQ ID NO: 35418 - DNA, 900 bp, Triticum aestivum
  Clone ID: PAT_TA_35418
acccgacctcctctcgtccgtctcctcgtccggaaaaagacgtgctgccaagacaccaccctcagctgcggcggctaccagaagcaaagctccagaagcttctctggcctcggcaacggcctccacgccgcgggtgtagttcgcgatctagatctcagaaccagtagtgatcgggaagataaaaaggacaggtcggagatgagtgtggtggggtttgatctgggcaatgagagctgcattgtgggggtggcgcggcagcgcggaatcgacgtggtcctcaatgaagagtccaagcgggagacccccgctattgtctgctttggcgacaagcagcgtttcatcggcactgcaggcgccgccaactccaccatgaaccccaagaactccatctcccagatcaagcgcttactgggacgcaagtttgctgatcctgagctgcaggatgatattaaggccttcccattccgtgtctcagagggccctgatgggttcccgctcgttcacgtacggtatctgggggaggagcgctcgttcacccccacacaactgcttgccatggtgctgtccaatttgaaggccatcgctgagggtaacctcaactcagctgttattgactgctgcattggtatcccggtctattttactgacctgcagcggagggctgttattgatgctgcaacaattgctggtctccggccattgcgtttgttccatgagactactgcgacagcattggcatatggaatctacaagactgatctccctgagaatgatcagctgaatgtggcatttgttgatgttgggaatgccagcatgcaggtcagcattgttggttacaagaaggggcagctcaagatgctatcacatgcatatgaccgttctcttggcggaagggacttt

SEQ ID NO: 35419 - DNA, 1749 bp, Triticum aestivum
  Clone ID: PAT_TA_35419
cgtgcgggatcaggttctcgtgtccctgctataattaggattatcactgaattctttggaaaggaacctcggagaactatgaatgcaagggaatgtgttgcccggggatgcgctcttcagtgtgctatacttagtcccacgttcaaagtgcgggagttccaggttaatgaaggttttcctttttcaatcgctttatcatggaaaccagattcccagaacaatgagccccaacaaacagtggtatttccaaaggggaaccctatcccgagcgtcaaagctctgaccttctataggtccaatacatttgcagtggatgttctgaatgtcgaaacggaagattcgcaagttacccaatgcctatcatcataccttctattccaattttatatcagagaacaaaaggtcgttaatgagtgctcggacgcagagacctggctaatggagaaaaagcagcagcaagatgctctaccgaagcatgctaatcccgtcctccttgtttctgacataaagaagaaggctgaagcacttgacaggttctgcaaacccatcatgaccaaaccaaggccagcgccaaagccacagaccccgccaccagcagaaaccccatcacccgaggctcatacaccggaacaacaatcaaatggagccgatgagtctgctgagccagctagcgacggtgctcaggatgagcatgcggcggagcaaatggacaccgataaggatgatccttcccaggtttaagaactgtcgatcagggagattttatgtccatgatcggttgggttctcttgtgctttttgcctgctagggcaatagactagcaggaatggttgttttcatacgttgtgaggatatgagtagaacatggagagttctgcagtgtttctagacgtctttgtcccttcaaaagcggtcttttctttgacgacgtttggcagatgcatgcagggtaagggcattcgtcgaggttttggtgacccatggtctccagtgtatttttttaatgacgatggtccataacgttgtaatttttatctacggtggcccatagcgattcagaaatttttggtcactacggaaacaatattattattaagagctcttcaattcctgcaaaaaaacacacaaaattagcacttacacgatcgggcctttccaatccagcaaaggtgagaagggtaagctggaagtgaaagttcgtctcaacatccatgggataggctatcttgaatcaacaacgatgctagaagaggaggaagtggaagttcctgtttcatctacaagtgaggggccaaaggatgctactagaatggagacagatgatgcaccacaggaccctgcttctagtgctggtgaccatattcaggaacctaaaggagctggtgatcctgcgtggggtgctgctgaatatggggcacaagatttccaggaattaactgaaatgtctaacacaaaggtagaggatttgccattcgaacaactataggtaactgaggatcgtattttgcaaatggatctaactcatacacaggatcctccttttctgcatcagaagtttcttcagagtcagatccgccctttttctttgctgtctcggatagaatgttttcctcctcttgtgactcagttttctcgtcaccttcagcaatagactccgaagattgaacaaccaacttccccgttttctctttcggtttaataaacagtttagcaacagaggctggaagatcgacgttgtctaagcggacg

SEQ ID NO: 35420 - DNA, 1722 bp, Triticum aestivum
  Clone ID: PAT_TA_35420
ctagtctcgagtttttttttttttggctcagcctgtttttttttttttgctactaaacaaatttattcgaattctgccatagtggtcacagcaacaccatcaaactccaaaatgaaaaatcgaatcacacttctgagctaggaactacgacgagtaatttggaacggagggagtagcaggaagcatcggcagggagggacaaacacaaaatttacacgcgtcgatagatagaggaatcttcagatcttggtggcgaaatcaaggccttccttgccgagcgcctccacgtcgtccaccggcggctgggccctggcgaccttggcgatggcctgattctcgtcggcggagccgccctctaggaacacaccgatgaccttgccgtccttgacccagtaggtgccgaacttgggcttggccgccgctgggtcgttgtccccgaacagcaccgtctcgccaacgttgtcgccgtagaactgccacgcgacgtcgaacgacctggagtagaagtagggcaggtagtcgtactccgccacagactcgccggactccttggccttgatcgcctttactgcctgctcggctgatttccgagcatggtcgacgtgctccactctcctcggctcgtcgtacagtttcatggggaaagtcgccacatcaccgatggcatatacaccagcaacgcttgtttcgaagaatgtgtcggtcttgagtccacccttctcctcttcaacttggcctttgaagaggcctgtcagcggcctgccaccgactccaacgatgacgatgtcggcatcgagtactcttccatccttcagcttcaccacactaacatctccattggcatcagcatcaaaaccactagccacagtacccttcacgatattgattcctttgctagcgtagtaaccctcgtagaaatgagcaatgccggcagtgaagagacgtggcatgcaccacggctctgggtacaccatagtgacatcgaaattgttgattttcagtgctgcgctgagctcaagtcctatgtagccacctccaacaacgacggccttcccatccttctttgcttgcatagctgcgaccaacttgtcggcgtcatcaatttcccttagatacaatatgttgtttgattctgctccttgaacgccaaagtcagtgagctttatggtcgaggagccagtggcgatgagcaaggtctcataggtgaaggttgctccatctgcactggtcaatgtcttggaggcaagatcagccttgacaatttccatgctcaggatcagctcaatgcctttttccgtgtaccattcgggcaagagcttctccccgccgctcccgacgcaggtgtggaatcctggaagcctggcggcattctggggaaagaggtagcccttgctgagcgcagggcgctcatacggagccacggactccttggagatgatggcgagctccccgggctggacgccctgcttgccgaactccctcgcggcgtatcccgccgcgacgccaccgccgaggatgacgtacttgaagtgcttctcggacgccatctccccgacggatcgatggatggagcgcagcagcgaattgcgaggaagaaacggaagggcggaggagaggaaggtggagagagcggcccgcgcccgttcgctggctttttattccctcgcctcccctggccgcttacgtttccgccccacgcgtccgcccacgcgtccgcggacg

SEQ ID NO: 35421 - DNA, 1945 bp, Triticum aestivum
  Clone ID: PAT_TA_35421
tcgaccggctgccgtggtacttggcatgctgccatcggggcggcgggtacagaatccatgagggcaacaattcctttggctgcggctagggggtcggatagacgggaatgggcgactaaaggtggttaactaggaccaacacacaagatcatagaaggtggggtgctactaaatttatgcggattctgccatagtggtcacagcagcaccatcaaactccaatggaaactcgaatcacactgctgtactcgggaactaggaaaccatcgggaggggaggcactaacacaatatatgcacgagaccgaatccgctgaaggacccatcttccaatctgggtggccaaatgaaggacattcaagtcgagcccatccgtgtgcggcgcccgctggctgtggcgctgagaaggctcgggcggatgagctgattcactgtcacgtggcacgaaccttcccaggtcaaaaaggaatgtttatgaagcaattgtacccgttgggtccatgttgtgtggctcgtggggtctggctggtagggcgaaagactggaaggaagtgtctgaaatggctcttcagtgaagagttatggaacaaacgaaggacaagaaaatttcagttgaggcttatgtttatgccatgcgtaactagattcatgcgaagtacaataattgtgtcatgtgggaggacatagaagggttgatggctaaacttcaggaggttgaggattggctttatgaagatggtgaggatgagaccaagggagtctatgttgcaaaactagaagaactgaaaaagtttggtggtgttatcgaaaagctctacaaagagaggacagaaagaggtccagctcttgagcaattggggtactgcatccgcaatgtaggggaggctgcattgtctgctgaccaaaagtttgatcacatagacatatcagagaaacaaaaggtcgttaatgagtgctcggccgcagagacctggctaatggagaaaaagcagcagcaagatgctctaccgaagcatgctaatcccggtcctacttgtttctgacataaagaagaaggctgaagcgcttgacaggttctgcaaacccatcatgaccaaaccaaggccagcgccaaagccacaggaccccgccgcgagcaagaaaccccatcacccgaggctcatacaccggatcaacaatcaaatggagccgatgagtccgctgagccagctagcgacggtgatcaggatcagcaggcggcggagcaagtggacaccgattacgatgatacgtcccaggcggaagaactgtggatcatgggcgattctatgcccatcatccaaatgacggcacttgtgctttatgcatgctaggccgtttagacttgctgtactgtggatgtcaaatacgttgaacagtgatactgagcaaactcatgtattgcgccaggcggagctattgcggagctcgaaggccccttccgtcgaggagtccagtaccgatgcatttgatgttttcatgccggacacggatgttttgccagtagtaggtgagcttagttcttctgtgctctgttcttttgaacacggtgaaggtgggagggctagattgcaagtgtggccgatcgtgaatatgcatgggatggtctctgttgaatcatcaactttgttgcaagttggagatggtcgaagctcccctgtcctccacttttgccactggtatttgatgctaataggatcgagagatgcactgtgcagtgaggcttggtttggcgtgggcaagcatatagtattgtgcattggagaagtttgggaccagttgcatgtgcccatgtccgctggacccattagtatgttgaaatatctggtcgaaccaccacgacccccaagccaaagccttcaaaaaagaaagttaagaaaacaaatgttccagttgccgaaatggtgtatttttctctgctattgact

SEQ ID NO: 35422 - DNA, 760 bp, Triticum aestivum
  Clone ID: PAT_TA_35422
gccggccgggtccggaattcctctcaccttcttcctttaaacctcggaccttgtcgcaacaaatcacttatatcacagtcaatcaatccgtattttcgctttacatttggactcttactcaaccgccatacgcataaatctctcaaacgttgtcacaatggccgacactaccgagcagcaacccaagctcgttgatgactctcccatctcccctgtcgaacgtcgaaactcgctggaggcccatctcaagcaccgccccgagcgctctgagctcgtcgagaaaaacatccttccggcctcgaacgcagcgccaggcctccaagcgcaccagaaggagcttgagaagcacatgctcgaggacaagctcaacgacaaaatctcgcaccgcccagaccccgaatctctcatcaaggagggcgttctccgcgacgacccgcgcgacgtgactcaggacgaggctgcgaagaagtacgacgaggccatcgaggacgagtatgccaagcgtgaaggtggcgcctgatcatgatgtcatgcgacagggcagggtacatacttagcccagggtcatgagggcctcggtacggaaactgtactcatgatgctaaatgtggagttttctttttttcgaaatgtgtgaaatgaattgaattatgatggctttggtaagaagtacgtgttgttaacggacaacaaacaaataggcactaccgggcctcgtatcaggtctttgtatttatggattgctaaatattgagttctg

SEQ ID NO: 35423 - DNA, 794 bp, Triticum aestivum
  unsure (1)..(794): unsure at all n locations
  Clone ID: PAT_TA_35423
gccggccgggtctggatctcattcaatcagaccatcttcaaatcgcccaaaatgtcaaagacaaagtcaaagaagcgcaaacaaaacgctcaagcccaagcccaatctgataaccctcgaaagatcgcaaagacaacttctccctcgataccgactcctcctcccgatggcagcaccttcgagccaaagaaccttcacactgtcgtctccgaggaagaacttgagattgccatcgacactctcacatcccttgcccaatatcctggcttgatcaagtccaagctctgcaaggatcttcgagttgccgtatacgattttcgacaagcttgtaccacgggtgtcaacaatgctgctggcgcgaacctcacggcccaggtcacggctgctttggccgatcggaaatacactgaggcgagaattcatcttgccgagatgaagattcggggtgaacagcccaagctaggagccctatgtcgatgggtacgagatcttgatgtcatcagtggtctgtcgactgtgccagaccagcagggtcttgtcgtgcgctccgagagggaagagaccctgatcaaggtcatcgatgctgtcctgagagtctgtggccatgaggatcgaaaccccaacgncgtggtacaccatcctcaattgctcttcaagagatttgggacctccgaccagacacacccacgggacaagtctacgctacagtcctcgacggcagtctcgttgcttcagcgcccgactctctcaagaagacctacgncagccccccaatcaccacgatggcatcctat

SEQ ID NO: 35424 - DNA, 774 bp, Triticum aestivum
  Clone ID: PAT_TA_35424
tgcggcgctcgagccggccggatcgggactttttccttcactcaagacgacgacctcgcgatacatataccaacacgtaagacgctgtactcggctccctttaaacaacctaatacccactaccaacccaacaccgacataaacatggctgacaccggtcttcctcctggctgggaggtccgacactccaactccaagaacctcccctactacttcaactcggccgagaagctgtcgcgatgggaacccccctccggcaccgacaccgaaaagctcaagcactacatggccaccaaccacagcgctggttcgcgtcccggtgccgttcccggtgtccccgagggcaagatccgagctgcccatcttctcgtcaagcatcgcgacagccgacgacccagcagctggagagaggcagagatcactcgcaccaaggaagaggctttcgagatcatcaaggagcacgagcaaaagatcaaatcgggaagcgtcagccttggcgagcttgctctcaccgagtccgactgctcatctgctcgcaagcgaggagatttgggatactttggcagaggtgatatgcagaaggagtttgaagatgcctcctttggtctttcgccaggccagatgagcgagattgtcgagacagccagcggtctgcacttgattgagcgtttggaataattggaaaaaagtatataaattatcaaacgttgtaaattgacaaagcagagcgcatcgttaatgaaaaaaaaaaaaaaaaaggcccctacgccccta

SEQ ID NO: 35425 - DNA, 856 bp, Triticum aestivum
  unsure (1)..(856): unsure at all n locations
  Clone ID: PAT_TA_35425
gtctctttctcttctctcttctctcgcccgcagcgcgttgcgtttcttttctagtcactcgtttaacaatatcggtgttgatcacccgctggcccgttacacttctttgaatcactcacaatcgacttgtgtgtttatttctccagaatacgattatcgtcgccattttccttctccaccgaaacacttccgcaaatcaacatcacgacgaaaaaagaaaaagaaagaaaaaaagcaacaaccaccgaaaatgcgtttcgtcaacctcatcaccgtcttcgtcggtctcgctgccgctgcgcctgcgcctgctgttgcacctgttgctacgcccactaaagatgatatgatcgccgtcacgactgtagctcctaccgcctctggtgatcccgtcacctactggtccgccagccctgaatcggtcaaggtctgcgatgaggacacctacgtcggtcgcgagggccccaaggagatgaagcgtgccaactaccgcgactgtgctgcgctgctctccagctttggatcccgcaacggtactttcttcgtcccccgcgcttgtgaagacgacagcgagtatggtctcaaagacggccacgtcgatatcgtcaagtctggttcctgcgcgttttccgtccgcgccgatgcgggattgatggttggcgatgaggacattgtctggatcatgcgaaaggcggttctcaacaactctgatggtatggagatggcagctcgtggttctgtcaagtgtaagcctgaggatggcagggtgatgngtggtctttactgggagatcacgggattgagtcactggctattaacgaggttatcnttctctctaggggggctgatgacatct

SEQ ID NO: 35426 - DNA, 602 bp, Triticum aestivum
  Clone ID: PAT_TA_35426
gtgcggggctcgcggccggggcgggcggaatgaccactgatcatctcaccatcatcttcaacatctcatattaaacaacttcacttcctgccaacatgcagttcaccaagcttactctcctcgctgtcactgcgctgttctccatgggagaggcgtgcaagtgttacggaaccaagggaaacctcaacaacggcgcaactcacaagtgctgcaatgactacaagggcgtctactctggaaacgactgcaaagccggctctatttccgagcacctgagcggattcgaccgctgctgcaagggacagggctcagactgcgactttccccgccttgcctcaactgaggccaagatggtcaaggccgttaagcacgtcgaaatcaagactgcctattctggttaagaaaccacggtttgatgattcgactacactgtcaacttggatgatgataagcaagtagtaggattggggcggatatactaagtacaataaacaacatagatgtatagtactattatagtgacaatgccgactatcgtccttgaccaatctcagttggtacaccaaaaaaaaaaaaaaaaaaaaaaaaaaaaaaggccccta

SEQ ID NO: 35427 - DNA, 377 bp, Triticum aestivum
  Clone ID: PAT_TA_35427
tagcgtggtcgcggccgaggtgacaaatgaactgttaattgccaccaagttggcgaaatcaatggaatacagcaattgaggggagactaatgtcagtgcccaaggtctctgcagtcggaaacagtaaaaattaaactttagtattcatcaagtttggcaaaaccgctggaccagattaatcgaaggagaaacttcgactcaagttgttgatgccgaagatttctgttattgctgcttcaaacatccacttgataggaagccctagatttttagatttagctttcttgcaagtgtagaaagaaagcagtgttgtcccttgtttgcctgtaaagtgttgttgtaatgagataattttacatcaagagtattatttgtct

SEQ ID NO: 35428 - DNA, 768 bp, Triticum aestivum
  Clone ID: PAT_TA_35428
ccgaaccccgcgaggcctgccgcgtctcgcctacgaagaggtcgaagcaggcaagaaaaggggggctcgagggaaggaagaagaaggaggagatcggtggccgttccaccttgctcccgcccccgattcgccaacctcctaccctccaactgcatgctgccttacaaggcgcaacaaccgacagatcaaagaaaggggttgaggggaatgaccagaagaatgaagccgctggacgcaaggccgccgctctccaacggcgatctatctcggcgccccttcccccccttctatccaacgacgcggacctccggctcctctcaaaacacacccaaccgaacgagacaaagttgagaagcgtttccgtcgtcgccttggtggcgctcccccacccgaccactcctcatcgtcgtcgaccccgatgctctcctcttcccccaatatactattgagaaaggaggctgtgcatcatctccagctttctctttaactatcactttaccttagatttgttcgttgtataattcgctgcttctactcttaatctacatcatctactacgatgttggtgactctgactctcttttctcttaggtaattttaatctgttttttctgtgattaaaatgcagcttataatctgaatctcagttaactattgatgtgtccatgagaaaactaggtggttcaacttgtaatattgttctgctgcctgggatgtttgagatagttccatcatctactctatgctactgataatatgttcagttcg

SEQ ID NO: 35429 - DNA, 642 bp, Triticum aestivum
  Clone ID: PAT_TA_35429
gccggcgccggcgcgggaagggatctcgacagaacctccttctccagccctttaattgagcgtcattcagatcctcgacggaccaacgcggcaattgaccaattcccgagtctcgaacccttcgaaataccgacatcatgagcttcgtcacccgccgagcgctctcgacgctcattcctcccaaggtcgcttctcccaaggccattggcgccgctcctgatgctatccgcatgcagcgtgtcgtcagcttctacgagaagcttccccgaggtgccgcccccgaggtcaaggctaagggtctcctcggccgataccaggccaagcacttcggcaagaaccctactgccaagcccatcattcacctgattgtcttcctcgtcggtattggttacgcccagaactactatttccatctccgtcaccacaagaacaacgctcactaagcgagtgactttttgataccttagatggatcgctgtgtgagagggagcgggggtcgtgtacatataaactccggaaacttcgcggtcgaatacgcgacttagcttccctatgtatctctaacaagcaagtgaagtgacactactatcacgttttggttaaaaaaaaaaaaaaaaaaaaaaccaaaaaaaaaggccccta

SEQ ID NO: 35430 - DNA, 505 bp, Triticum aestivum
  Clone ID: PAT_TA_35430
gtgcgccgctcaggccggccgggtccgggactaccaccacatctccttgtgttgcaaacacgtagatcccctgaaagccctcaaccgtgaagcatatcaagagggggaaacagcagacagaacaggaggcatgaggaggaacactctccttgccctggcgtcctggctcatgctgcttctgcttgcgctcttcatcacaaccgccactgcttcactgccgtgccagtgctgctggatcgtgcagcatccgacgaggacctgcggccacgcctgctgcggcaacaactgctgcccgcccgctccaccgccatccgcaggctgaaaaaaatgatgcacaggcttgttcatctgtaatacagaagcaaaaaataaaaataaaaatattccagagggaatggtgttgtacttatacttacctgctcttctgtgagcatgtaatagtctctattagtttccagaaataaacatctcttggctccaaaaaaaaaaaaaaaaaaggccccta

SEQ ID NO: 35431 - DNA, 596 bp, Triticum aestivum
  unsure (1)..(596): unsure at all n locations
  Clone ID: PAT_TA_35431
gccggccgggccgggatatatacttaccaccaccggtccttgcgttgcaaacacgtagatctcccctgaaagctctgaaccgtgaagcatatcaagaggggaacacagcaaacaaaacaggaggcatgaggaggaacactctccttgccctggcgtcctggctcatgctgcttctgcttgcgctcttcatcacaaccaccactgcttcactgccgtgccagtgctgctggatcgtggagcatccgacgaggacctgcggccacgcctgctgcggcgacaactgctgcccgcccgctccaccgccgtcggcacgctgaaaaaggatgcccaggcttgttcatcggaagtaaaaataaaaataaaaataatccagagggaatgatgttgtactcatacttacctgctcttctgtgagcatgtaatggtctctataactttccagcaataaacatcccttggctccttcaaaaaaaaaaaaaaaaaaggcccctaccgggccggggcccccggcgccctatttgcgccctcgtattgacgcncgctctacgggcggtcgtttaaaaacgtcttgactggggaaaaaccctgncggtntc

SEQ ID NO: 35432 - DNA, 456 bp, Triticum aestivum
  unsure (1)..(456): unsure at all n locations
  Clone ID: PAT_TA_35432
gccggccgggttccggngccggccgggtttccgaaaatcaaatcaaccaaaaaaaagcctaacaccaacaaaccctttctcttttccaaaaacaaaccacgaaaataaattaccaaaatgactggcaccgagcaacagaaggatggcgagaagcaattctccatccagcccatcaaggatgaagccaaggacaaggtctctgccttcaacgctcaccccggacccgccatgcccaaggatatgcctcaagaagagggtaccaaggaggagcgcaagggcaagatggaggctctaaacaagaaataagcatgtgacttctgcaacagaagctattttgccgacatgactgtatgactagatatgggaataagctattttacgacttaatacaacacagctagacagctattaaaaaaaaaaaaaaaaaacgaaaaaaaaaaaaaaaaaaggccccta

SEQ ID NO: 35433 - DNA, 445 bp, Triticum aestivum
  unsure (1)..(445): unsure at all n locations
  Clone ID: PAT_TA_35433
ggccgctcgaaggccggccggtgactcnggatgccggccggagattaaatcaaatcaaccaaaaaaaagcctaacaccaacaaaccctttctcttttccaaaaacaaaccacgaaaataaattaccaaaatgactggcaccgagcaacagaaggatggcgagaagcaattctccatccagcccatcaaggatgaagccaaggacaaggtctctgccttcaacgctcaccccggacccgccatgcccaaggatatgcctcaagaagagggtaccaaggaggagcgcaagggcaagatggaggctctaaacaagaaataagcatgtgacttctgcaacagaagctattttgccgacatgactgtatgactagatatgggaataagctattttacgacttaatacaacacagctagacagcgaaaaaaaaaaaaaaaaaaggccccta

SEQ ID NO: 35434 - DNA, 675 bp, Triticum aestivum
  unsure (1)..(675): unsure at all n locations
  Clone ID: PAT_TA_35434
gccgctcgaggccnnggccgggaaaaaaaaaaaaaaaaaaaaaaggcagaaaaacggaaccctcccacacaactacacaagtcccaaaccatctgcaagcatccttcatcctagctaggctcctaacttacttgtgccttacttagccaaggaagcaacggcagcaccaagaatagttgaggagaaggagaggagctgataagagagagatggcgtccatgatgggaggagacttcgtggaggcctacgtgctcaggaacgcctacaagaagaagatgaggcgcatggaccaagcggaagccgcggcggcgctcgacggcgcaaagagcggcaaggacacggaggccgccggcgccgccggagagaagaaggctgctgctgctggtggtgcgagcagcaggaggcgattctttggcctcatgaagaagaaggtgcaccccaaacccaaagcggcggcggctacttcctcttgaatactgcatttgcgatgccacaaaattgtaggccgcagctttcttctagctaggagcgcgcgcgtgtgtgtaagtttgttctttcgatcgattagcttctcttggaggagtgtgtgaagcaaaaccttttgttatttggtaaaaaaaagttgacaaaagttacgcgaagagtaaaaaaaaaaaaaaaaaataaaggtaccta

SEQ ID NO: 35435 - DNA, 461 bp, Triticum aestivum
  Clone ID: PAT_TA_35435
gccggccggggccggccggaccactcgaatcttacttctatcttatctctaaccgtcaaaatggctcaagtcctcgttgtctacccttcgggtccttcgtttgacatggactactacctaaagacacacatgcctcttgtcgcatccaagtggggtcctttgggtctcaagagctacaagatcctgaacttccaggagggtgctccctatcaagttcaggccactctcgagtgggagggcgtcgaggtctttgacaaggctgccgcaaacgaggttgccaaggagatctttggggatatcaagaacttttacaacggagagccaatgcttctcaagggccctgttgttgctcacgaaagcgtttcgtcttcgtaaggatatgcactagttatgtggtggaattaatacgtcgaatctgacctgcgatagtcacgcaaaaaaaaaaaaaaaaaaggccccta

SEQ ID NO: 35436 - DNA, 623 bp, Triticum aestivum
  Clone ID: PAT_TA_35436
gtgcggggctcgaggcggccgggcttgcagtacacactcgaatcttacttctatcttatctctaaccgtcaaaatggctcaagtcctcgttgtctacccttcgggtccttcgtttgacatggactactacctaaagacacacatgcctcttgtcgcatccaagtggggtcctttgggtctcaagagctacaagatcctgaacttccaggagggtgctccctatcaagttcaggccactctcgagtgggagggcgtcgaggtctttgacaaggctgccgcaaacgaggttgccaaggagatctttggggatatcaagaacttttacaacggagagccaatgcttctcaagggccctgttgttgctcacgaaagcgtttcgtcttcgtaaggatatgcactagttatgtggtggaattaatacgtcgaatctgacctgcgatagtcacgcaaaactttgagacttgtctggtgactttggttatctgcatgaatgcggcgggcatctctgtgttggtctgcgtggatacaagagctacctgtctgtttttgtaacgtaaatctgtagtaaaagcaatcgtagatctacttgacaaaaaaaaaaaaaaaaaaaaaaaaggccccta

SEQ ID NO: 35437 - DNA, 875 bp, Triticum aestivum
  Clone ID: PAT_TA_35437
gccgggcttgaatctccccgatccaccttcgtcgtcacttctctcccgcgcgcgcggcgccaaaacacaccagtccgccatgtctcccttgctctcctcctcctggctctagccctcccgctagcgctagccacaccgggcccggcgtcggagacccaggaggacgacgtgcggtgcctacgcggcgtcaagagcgccctcgcggaccccgacggccgcctctcggcgtggaccttcggcaacacctcggcgggcgccgtctgcgacttccccggaatcacctgctggaacccgcaggagtcgcgcgtcctcgggctctcgctcgccggcttcggcctccagggcaccgtcccctccgcgctcaaatactgccggtccaccaacattctcgacctctccaagaacgcgctcgaggggccgatcccgcccgcgctctgcgactggctccccttcctcgtcgtcctcgacctctccggcaaccgcttctccgggccgctcccctccgagctcgccaactgccgctacctcaactccctcaagctcagccacaacaacttctccggccagatccccgcgtctctctcgcggctggagcggctcaagtcgctcgacctctctgagaaccggcttgacggccagatcccgccccagctcagcgcgaccttccccaaggaatccttctccgggaacccgggtctgtgtggacgccctgtatcctcgcactgcggccgcgattagcagctggacaaacgtatttaaacatagctatcgtttgagggacgagcaactgcgcaagcagcttcactctgatatcctaaaaacaataataaatcgcataatttcgtcgccaaaaaaaaaaaaaaaaaggcccctag

SEQ ID NO: 35438 - DNA, 781 bp, Triticum aestivum
  Clone ID: PAT_TA_35438
gccggccgggccggcggagcttcgagcggaccgtcccgacgctgccggaacctcacccaacgactaatctccctccacccacccaaccaccaatcaataccgcaaaaatggccggcggagttaccgttcgcgatgtcgatgcgcagaagttcatcactgcctactctgctttcttgaagcgtcagggcaagcttcccatccctggttgggtcgacaccgtcaagactggtcctgccaaggagctccctccccaggacattgactggttctacgtccgcgctgcctccatcgcccgccacgtctacctccgcaagactgtcggtgttggccgtctccgcaaggtccacggtaccgccaagaaccgcggcagccgtccctccaagcacgtcgatgcttccggctccgtcgaccgaaaggtcatgcagtctcttgagaagatcggtgtccttgagcaggacgaggagaagggtggccgccgcatcacccaggccggtcagcgtgatttggaccgtatcgcccagaccaccgctgaggccgaggaggaggaggatgacgagtaaatttagtcctcaatcaaattaactccaaaaaagtctggcggttctttacccggtcaatggtagcaatggcaatggatttgggcgttgggtcatagattttgtcatgtatgaatgagattcccctgactctgggtcattcggtttggtcaaattgcacccgtccaacttgtcgttcaaaaaaaaaaaaaaaaaaaggcccctagggccgttgacccgtttat

SEQ ID NO: 35439 - DNA, 744 bp, Triticum aestivum
  Clone ID: PAT_TA_35439
gccggccggccggccggccgggccgggataccaatcaaaccatcttaacattccatcgatttgaatccgtacaactcaggttccctgtcttccttccaaccacaaccaataccagatacctgccagatcaaaccaagtcgatccaacgattggctcatcaaacaacagacatctacaacttcccttaataacaacatcaacatgcccgtccgcgttcccagacttcctgctgccaagccctcagagatcttctgcatgggtgcggccggtgttggcgttttgacacctttgtacctcgtcatgcctggcgctgaggaacgcctttccaaccaaaccaacaagtgggctccccgatgggagaggaacgtcagctacttcatccctcctatggagaagggtgtccagagaatcgagcccccagtggccaagatggtccaacgcgttgaggatcgccttcccctcgagaggatggcaaagtccgttgataagggtatccgaagcggcatcgcccgattcaatggcgagaacaaaccttaagaacatatttctcctgtctagtccgtcatgtctgtggccttgccagcaaatcattgtcaggcaggcgtctttcctttgtaaattatcatagcataccctgggtacggatagatgactattgttcgcatcggcccatatacgaatggaatgaatttctatctcttcaaaaaaaaaaaaaaaaaaaggcccctaaggacgcggccccta

SEQ ID NO: 35440 - DNA, 954 bp, Triticum aestivum
  Clone ID: PAT_TA_35440
ttcggcacctcgtccccccgaatcctcctcatcttcccccctttccctcttatcgtcgtcgagatgtaccatcccacgagaggcggcgtccgcggcgggcgagatcaattcaaatgggatgatgtgaaggttgacaagcaccgggagaattaccttggtcatagtgttaaggctcctgttggtagatggcagaaagggaaggacttgttgtggtatacaagggataagcaatctgactcagaagacgctatgaaggaagaaattaggagagtgaaagaggaggaggaacaggccatgcgtgaggcacttggcttagctcccaagcgtagcagtcgaccaaaaggcaatcgtttagataagcatgaatacgctgagctaataaagaggggatctaccgcagaggatttgggagccggccatgctgaagcagcacaagtgcaaggattaggtttatacaaggctcctcacaacgaggaagaaccaagctctcttagtcctgaccctcctggaacggagcctgagcaggttgactttgcacctgcaacgaagcaggaagattctgaagatgataggaaggggaaaaggcggcgcgaagagaggagaggggacagagaaaaagagcggaggcgtgaaaagcactatgagggaaaagagaggaagcgagacaagtatgagagtagacacgactcggaggacagggagaagcgccaccgcaaggataagcagaagaggaggcatgattctgattaacgtagcaggctagcagcgctgcaacagtattgctactgtaccttacttgcatgtttcatgacttggatgctactcttgcttgataatgtagtgtatgattcaattctgctgtctataccgtgcccctatttcgcagaaacacatgtgcaactacggagtagaatcgcatgactttgttgtgcctgttgaagattgaaaagatgg

SEQ ID NO: 35441 - DNA, 1245 bp, Triticum aestivum
  Clone ID: PAT_TA_35441
gccgggcctagccgggagggctttacacaccaaatccttcacaatggtcgaccgtcctaacaagccctcggcacttgcctcaacccccgcagctccccctcaagctgttgccgacattacccacgacaactcccgcgtcaaggccgttcttccctcaggcgagagtgttgaggtcctcctccatggtgctaccgtaatcagctggaaggatgcttcaggagccgagaagctctgggtcagcgagactgctgctctcgatggcagtgctcccgttcgaggaggtattcccatcgtcttccctgtttttggtaccgcccccgaccacgaacccgtagccaagcttccccagcacggatttgctcgcaactcacgatgggagttccttggcaagtccaccagcgagggctccagctccagcgtcaagctcgactttggtctgtcctctgagagcatcagcgacgacttcaaggctctctggccctacaagtttgctctcatctacagtgtctctctcgatagcgagagtctcaacacctcaatcgttatcaccaacgacggcgatgctgcgtttgacttccagactcttcttcacacctacttcaagatcagcgatatcgcctccacagaggtaactggtcttgaggactctgtctacttatccaaggtctctggctcagaagccactcaatccggcgccatcactttctctggcgagaccgactccgtgtacacccccgccaacggtcccaagcaccccgtcgtcatctccgagtccggcagcccccgctaccgcatcgtccgcgacaacctcgaccaggtcgttgtctggaacccctgggtcgacaagtccgccggcattaaggacttttctcccaaggacggctggaagaacatgctgtgcgttgagcccggttccgtcaagggcaggcagaagctggaaaagggcgatgcctttgaggcggcgcaaaccatcacactggcttgatggtgcgatagcgcaaacaagagcggtgggggagcgatcaaattcaagatatgaaagtttttatgtaacggcagcacaataatttcagatggacatgatatcagtttacatctattttttgacaaccggatgaggtacagcagtacctaatgttaagtccatatctatgcttagagctcagagagaagcaagcaatgcattggataaattaaagaatatcaacaaattgtgctcaaaaaaaaaaaaaaaaaaggccccta

SEQ ID NO: 35442 - DNA, 716 bp, Triticum aestivum
  Clone ID: PAT_TA_35442
gattgcttcccccatcaactgcactacagtgaacaaggactttttacaaaagaccccccaggggctcccgcgatcgcgaaggcgatctggcggcggtggcgagagagcgcgtgtggtggcggcgccggcgccggcggcaaggccgggaggaggggccgatccacctggagtgggcctcatcgggggtctcttcagcgcgacagattgggaggagatccgagcaagatcgaggcggatagggccggcggccggagcatcatacactacttcaaccactcgatcatctacaatatacaaacatcttttatctttaacaatggattccatcaagaataccgtcaaccaagctaccgagaaggtccaggagggtctctccggcacaagcaaggaggccaacaaggaggttgccaaggactccaacgccggcattggcactcgcgcttccgccgccaaggacgccgcttccgacaagattgacgagtccacccacggcgccaagagcgaggcctacaagcagaacccataaatactctcaagtattgaatgaggaatgctacgatggaacgatttcgaggaggaaatgtactgtctctctttttagagagttacggtactatcaccattgagcaatcagataccccaatttagtagctctttaatcaatctatgaaacaccaaaaaaaaaaaaaaaaaaggcccctaaaaaaaggccccta

SEQ ID NO: 35443 - DNA, 878 bp, Triticum aestivum
  Clone ID: PAT_TA_35443
acacacaccagcaattattttcagccgtgttgtgagctcgctgcagaaacgagagaagcaaagatgagcgaggcggtgccggtgaggctgctgggctccttcgggagcccgttcacgcaccgcgcggaggcggcgctccggctgaagggggtggcctacgagttcgtccaggaggacctcggcagcaagagcgagctgctgctccggcacaaccccgtccacaagaaggtgcccctgctcctccacggcgaggacgacgacgacgtccgcgccgtcgccgagtcgctcgtcatagtcgagtacgtcgacgaggccttcgagggcccgccgctcctaccggtcgacccgctcgcccgcgccgcctcccgcttctgggcgcagttcgcctccgacaggtgctcgaggacgctgttcaaggcgctgtggacgccggagggcgaggcgcggagggggttcgtggaggaggccaaggagaacctggcgctcatggaggcgcagctggaggggaggcgcttcttcggaggcgactccatagggctgctcgacatcgccgccagcgggctcgcctggctccccgtgctggaggaggtcgccggcgtggaaactagcatgatccgcgaggaggattaccctgagttgtgccggtggcgcggggagtacgcctccgacgaggccgtgaagaagtgcttgccgagcagggacgaaatggtcgcctactacgcggccatgaaggaccgtttcgtgctccatgccaagtcaatgcacaagaaataagaccaaacttgtaccgaacattgttgcgtgtgtagtgagttatgacccaaaactttccacgtaaacaaattattttcgaaaaaaaaaaaaaaaaaaggccccta

SEQ ID NO: 35444 - DNA, 795 bp, Triticum aestivum
  Clone ID: PAT_TA_35444
gccggccggtcatctgcgacaatgccaagttctctgagttctgatagcaattatacgttcacggaggatcttgagtggacccttggtttgcgagtttccatccgtgagaatatgagaaagtctctttctcaatatgagaaaaacccacaatctctccacacacttgaagatgtgatcaaattcacactcacgactccagaagagcagcccgagaaatggggagtagatgagtggttaaaatgcgaacaactaggcacccagtatgggcctgattcatccgagtttagagactcaatcgagttgcgaaaccgtatcggaatgcagatcgctgagcttttagatcgcacggaatgcgacttcatctttgccccttcgattgacacgagtgccaatgttggaggctgtccaaccattggcgttccccttggcttttatcccaaggaccaacctgttacacgtcgcaagtccaataggcttgtgacagttggaccaaacgtcccctttggtggattgtttgttggccgcagatgggatgacttcaaacttatctcagctgcccatgcctttgagcaggcatcattgattcgtgagcaggtgccccctgtcgtctcttctgacatccagctaccagttagaacggaagagaagtttcggggctcgctgtgattcatgtagagctggcagcaagtacaatagagttataagacaacacacgcgttcctgcactgcaaaaaaaaaaaacaaaataaaaataaaaaaaaaaaaaggcccctaaaaaaaaaaaaaagggcccta

SEQ ID NO: 35445 - DNA, 1492 bp, Triticum aestivum
  Clone ID: PAT_TA_35445
agtcttgtctatcccactacactcgttcagtctcaattgtgactattacattcatttccggctttgccattacgatcattccagctctacagcaacttgcgttttctcgcgttcaaacttgaatactttctttagtgaagcgaaactgtgtcttgctcactacttgaactgtggaatcgatttctacagccattacatcgtacctacgttgtcatagacaaaaactgaagctaccgcaaaaatctacatacctacccaaccttcaaaatgaagtccgtcgtcgctagcatcggcatgatcgccgccgtggccaacgcctaccagttccctcagcacgcccactaccgccgagactacaacggaaccgactctcagaccactctgaccgtcaagaccaccgtcgtcgagaccattaccagctgcgcccctaccgtcaccaactgccccagccgtgaccagactgccattgctcagctccccgagtcggacaagaccaccctcactgccactcacactgtcatcctcaccgaggttgtctgccccgtcgctgatgccagctctatctacacctccgtcctccagcatgctgagaccggtggtgttactggcaagaccatcactgctgatgttcccatgaacaccggcggtgcctacccccctccccccgagaagactgttgtctcagactacaccaccgacccagttgtcacccttacccagggcggggagaccattaccaccactatccacaagaccatccagaagactctgaccgtccctgctggccctgaggtcactgatgacggctccaagggcaacggtacccccgaggatgacaccaccaccactaccactaagaccaccactggcaccatcaccaagaccatccagcgtgttgatgagactggccctgccaccggcggtgacaacggctacagcactggcaagagtgaggacgatggctccaagggtaccggaaacggcaacggaaacggctccaacaacggaggctccaacaacggaaacggcaacggcgagtgctcccccgagaccgttaccgttactgcccctgcctccactgtctatgttactgttgtccccgaggctgccaagaccaacggtgctgatgacgctaccgtcactggcaagaccgtcaagggcgatgactccgaggatgatgatgatgatgaggacgagatctgcgacaccaccaccaccctggaggctactgtcaccgttgtcccttaccccgttaacggcaccgctaccggtggctacgccaagcccactggcttctctcgccgtctccgctaaatgtctacggacaactcctatgtatatgaagtttcgtctgtacattaatcaccacttggttacttcttggttaggcatctagtgaaggaagggctcccttggataggcttacactattctcctggatgtatgacaatctattttttgcttgcaaaaaaaaaaaaaaaaaaggccccta

SEQ ID NO: 35446 - DNA, 751 bp, Triticum aestivum
  unsure (1)..(751): unsure at all n locations
  Clone ID: PAT_TA_35446
gnagcaggctcaaccgcctcgtgctctgaatgacgcactgaagcaggaagtggagaggctcaagatggctacgggtgagatgtcaaattccagtgatgcatatagcgtgggattgcaacatgtcctgtacaactcgtccttcttcccacagtcccagcaaaacacagcccagcaccaggggggcgcccggtttccacccccattccacccgcctcatcctaatgtaccaaaccatcagatgctatcccacccaaacacgctgtcagatatcatgcaacaagatcatcttgcgcggctccagggtttggacattcagcaaagggcatccagttgttaagtcagagagcagctcgatctctgccagcgaaagcagcagtacattctaaccaggcctacgcctaccctgatcgagccctcagtttcattaggttcctttgttgatagcctctgacatccttgtgctgtttcttttgtcctgtaaacttaatttttcattccatttgttccattttagttgaaattcgttgtaatctcagttgctgatttttgtagacacgatccctgggttcctcccacccgtttgttccgggttcattttcttcgtgtgtgatatgttgtttgggattatattggggaactgggaggggcttcctcccagtataccgtggtgctgttgttgggactgactatttttgtcgtcagaacaatttgaatttgcgatgttctaaaaaaaaaaaaaaaaaggccccta

SEQ ID NO: 35447 - DNA, 338 bp, Triticum aestivum
  Clone ID: PAT_TA_35447
gccggccgggtcaaaaaactcaacccaacgacgacccgagacgagacgttaccttacgtttatcactgtgttagcccatcgtcaacacactctgcgaatatattccaagctgcccatcttcgcgaagagctgctttgattaaccctgctccgccatttactttggcctcagacgacgaccgacgaaccaccgtgtccgtactaaaaacccgactccaaattcactgatcgcgcgcccgcttggctgcccccaacacaaatacaaaacaagacgacgatagtaacgacgacgagaacatcacttctcatctccaaaaaaaaaaaaaaaaaaggccccta

SEQ ID NO: 35448 - DNA, 430 bp, Triticum aestivum
  Clone ID: PAT_TA_35448
gccggccgggatcaaaagccggccggaggccgcgaacattcaccaaaaaatctttgcagatagaagatggaacacccagaataggggcgtttggggtctccggatatcttgcatggcacatcatttctcttttgtttttccgttacgcgccttgtaccaaagagtcgtctggaggcaggaagggaaaaaaagcactgcatgggtggaaagctgagaaagccttcacacgagtgtccacgctggctctaataggttggctggacatgaggacgtggaaccgtttcttgatgatcgcttcatacccgagtgcagtgggtagcggaggatggtcactgtgcttttgcgaaattcacaatggtttccacaaaaaaaaaaaaaaaaaaggcccctaaaaaaaaaaaaccaaaaaaaaaaaaaaaaaaggccccta

SEQ ID NO: 35449 - DNA, 732 bp, Triticum aestivum
  Clone ID: PAT_TA_35449
acgctccaaagtaagatgcttgcctcggctacaaccttgggagagcggaagtttcgtgagcccactgcttgccacgaaggtgtcaagcctactggccctgcctacaccaccgaggttgtcaccaagctgaccacctactgccctgagaagaccaccctgacctacggcaaccagaccatccccgtcaccaagcccggtaccgtcactgtcactggtatccaccacaccaccactgctcccgttgtccctaccggttacgctcctcccgctactccttccacccctgctcaggccaaggactgcgctgagatgtgcactgacaagtacaactcttgccgctctgcttctggtgccaacatggccacctgtgctgctgagtactctggccggcccggatacgctccctttgacagcaacggttctctagtcaagcctactgcttgccacggccctgcccctgtcggccccactggcactggttccaagccttccggccctgcccctgttgttccctctggtactgctcctgttgctcctcccaccactcccactgccgtcactgccggtgccgcccaggttgtccctgccggtatcatggctgtcatcggtgccattgcccttctctaaacgctctctgcatagagacattagactacctattctaaatagactttttaccacatagatttataccagtatattcttcaaaaaaaaaaaaaaaaaaggccccta

SEQ ID NO: 35450 - DNA, 580 bp, Triticum aestivum
  Clone ID: PAT_TA_35450
ctggcggcgcgccggcggcggtcggaatcttcactcgagcaacaagccccggcacaatgtctcaagcatctaccaaggttcagcagcttatcgacaacaactctgttgttgtcttctccaagtcttactgcccctactgcaagcagaccaagaagactctggatgatttgaacaccgagtacgagctccttgagctcgacgaagtttccgatggctctgctctccaggacgctctcgagaagatctctggccagcgtaccgtccccaacgtctacatcaaacagcagcacattggtggtaactcagacctccagagcctgaactctggcggaaagctcaagaaccttctcaaggaggccaatgccttgaaggcgtaagaattcacaaaaacaataacgaaagatggacactatgggctaagggcatccaatacttccagttctaagctttagaggtgtttacactgcacaaggcgtatagattaggcaatcgaggattagacggtactgcagcttgggcaacagagccccaattgagtagaattcatgacttcgaaaaaaaaaaaaaaaaaaggccccta

SEQ ID NO: 35451 - DNA, 838 bp, Triticum aestivum
  Clone ID: PAT_TA_35451
aaataaaaagaaaagctccctttgagcagttaatccatttctcgatacaggtctttgcgtgaatcctttttggtttcatctctagctttccgcggttttcgaaagccactgtcacttgcatccaattctttgctaaaccaactcatccgctactataactcgcttggttcagccaacttcttaccgctctctccgcctctcaccatcatctcatattctcaccgttccttgcgagcataaataaactctttgagtcctcatcaacttttaccacttttctaccacaaacaaccgacatcatgcctcccaagcgaatccgttgcactgccgccacttgccgcgagcctgctcagcgcatcgttggcgactgtaccttttgtcaaggtcacttctgtggcaagcaccgtctactagaagaccacaagtgtaccggtctcgaggattgtaagaagcagtcctacgagcgcaacgccatacaacttgagtcggagcgaacccaggttatccggggcgtgtaaaccgaccaacgagaatcacacatagtcttttaacagatatgtgttggactggagactggcgtcactcctcaaattcacgatgcgcaactctgacggccaccacgacgtaacgatgggattgggtttcgacacaagcatctgcatgagatgagatgcagggcgttattcgccattgtatatttctatttcaccagttgagggtgcgacggcgtactggatatgctttgaggggcatagttccctattctagcggggtctgcattaaatcaattcatcacaattcattacttaccgaaaaaaaaaaaaaaaaaaggccccta

SEQ ID NO: 35452 - DNA, 701 bp, Triticum aestivum
  unsure (1)..(701): unsure at all n locations
  Clone ID: PAT_TA_35452
acggtgtcccctgaacccccaggcaagttctcggagcagcggcggaggagatgtcgtacgcccacctcttcaagtacatcgtcatcggcgacgcaggtgttggcaagtcgtgcctgctgctgcagttcaccgacaagcggttccagcccctccatgaccccaccatcgacaccgaggtcgacgtcttcgcctccaagatgatcaccgttgacagaaagcccatcaagctccaagatctgggacacgccaggcgaagacagattcagatcgatcactagatcatactacgatgaagttgatggagctcttctagtttatgacatcaccaggagggaaacatttaatcatctcgcgaactggttaagggacgtgaggcaatttgcaaaggacaacatgacaataatgctagttggaaacaaatgtgatctatctcagaggcgtaccgtgagctatgaggaaggtaggaagtttgcaaatgagcatggtctgatctttgtggaggcatctgccaaaactgcacaaaatgttgaggagggtttcgttcaagactgctggagtcatatacaagaaaatccaggatggcgccttctaataataagctgaaattgcaaaagtctatcatcaatttggtcctgcttaagtgaaataatgagcanctggtgaacaagtgctggtaggcctggcctacttcctgcgtggaa

SEQ ID NO: 35453 - DNA, 776 bp, Triticum aestivum
  Clone ID: PAT_TA_35453
acttcaaagccaattccgagctcttccgagtgactgcatccatctctcgtctccctctcccactccatcgttccgcaaagaactacgaactcttgttgagcaaatatccgactagccacgacatggtttcgtcaatgaagcatcacagagatgaggccggcgcttcctcgtccctctccctctcgctggccctcggcgccgtggccgaccgaagcaagaagatgcgccgcggcggcgtggacggcgagttcgtgtgcaagacgtgcggccgctcgtttccgtcattccaggctctgggcgggcaccggacaagccacctgcgcggccgccacgggctcgcgctcggcctcgctgccgggtccgataagccggcgaccaagaagaccacggaccagaagcaggcgcaccagtgccacatctgcgggctcgagttcgagatggggcaggcgcttggcggccacatgcgccggcaccgtgacgaggcggtcgccaccacggcgcaggcaccccccgttctgctccagctcttcgtctagctagctccattggtttctttctagtcgtaggtttactggttcacctgtgtgcacgattggatttgtacatttgctgcacactagtaagtgttgatcgctggttcattcgtccatattgacgaacacgtacatatttcgggacttgtccattcgttcactttgacgtacatgtacatatttcctgacttgttcattcgttcattacagagactatatatatgttacgttgattcgtttgat

SEQ ID NO: 35454 - DNA, 793 bp, Triticum aestivum
  unsure (1)..(793): unsure at all n locations
  Clone ID: PAT_TA_35454
gccggccgccgctcgtagaagtccggccgggccgggacagccaattccgagctcttccgagtccctgaatccatctctcatctcctccatcgttccacagacgcacgagctctcgtcgagcaggccataccggactggctagccgagctccgatggtttcctcaatgaagcagtgcagagatgaggcccaggaggtgcccctgtccctctcgctctccctcggcgtcatggccgaccgcagcaagaagcagcgccgcggcggcgcagatggcgagttcgtctgcaagacgtgcagccgcgccttcccgtcgttccaggcgctgggcgggcaccggactagccacctccgcggccgccacgggctagcgctcggcctcacttcagggtccgatcagccggggaccaagaagacgacggaccagaagcaggcgcaccagtgccacgtctgcgggctggagttcgagatggggcaggcgatgggcggccacatgcgccgacaccgcgagcaggaggccgccaccacggcgcaggcgccgcccgttctgctccagctcttcgtctagcaccgcactgatttctctcaagttacatagctaggcatttctggttctagtagagatttacaggttggcctatgtgcgcggtttggtttgtacatttgctgcacactactgtagctcgttggtctgttcgctcttgttaggtatatatgcacatattttaggactaaaaaaaaaaaaaaattactgcccactgatattatctacactttattgattcgcnnnnnnnnnnn

SEQ ID NO: 35455 - DNA, 711 bp, Triticum aestivum
  Clone ID: PAT_TA_35455
gccggccgggtatccacagccaattccgagttgttccgagtcactgaatctgcacagaacgacgaactcttgttgagctcatcggactaaccgccatggtttcgtcaatgaagcagtacagagatcaggccgccggggtgcccatgtccctctccctctcgctctccctcggtgccgtggccgaccgcagcaagaagatgcgccgcggcggcgccgacggcgagttcgtgtgcaagacgtgcggccgctcgttcccgtcgttccaggcgctgggcggacaccggaccagccacctccgtggccgccacgggctcgcgcgccggatacgatcagccggcgaccaggaagaccacggaccagaagcaggcgcaccggtgccacatctgcgggctcgagttcgagatggggcaggcgcttggcggccacatgcgtcggcaccgtgacgaggcggtcgccaccacggcccaggcaccgcccgttctgctccagctcttcgtctagctcatttgtttgattctacttccacgtagatagacatccagtgcaggtttactggttcacctgtgtgcgcgattggatttgtacatttgctgcacactagtaagtgttgatcgctgcttcattctctcatttttatgattatgtacatatttaggacttgttcgttcgttgattcagagactacatatacgttacattgatttgttcgtt

SEQ ID NO: 35456 - DNA, 727 bp, Triticum aestivum
  Clone ID: PAT_TA_35456
atatccacagccaattccgagctcttccgagtgaccgaatccgcacagaactacgaactcttgtagaggtcatccgactagccgccatggtttcgtcaatgaagcagcagtacagagatgaggccgatgcgccctcgtccctctccctctcgctctccctcggcgccatcgccgaccgcagcaagaagatgcgccgcggcgccgcggacggggagttcgtgtgcaagacgtgcagccgctcgttcccgtcgttccaggcgcttggcgggcaccggaccagccacctccgcggccgcaacgggctcgcgctcggcctcgctgccgggtccgatcagccggcgacgaggaagaccacggaccagaagcaggcgcaccggtgccacatctgcgggctcgagttcgagatggggcaggcgctcggggggcagatgcgccggcaccgcgagcacggggccgccaccacggcccaggcaccgccggttctgctccagctcttcgtctagcagcgtattggtttctctctagttcgataggtaggcatatttgcgtgccagttcagatttactggttctgcctgtggtgcgcgacttggattttgtacatttgctgcacactagtaggtgttgatccttggttcattctctcatttttatgattatgtacgtatttaggacttgttcgttcgttgatttctgagactacatacgtgttacattgatttgttcat

SEQ ID NO: 35457 - DNA, 658 bp, Triticum aestivum
  Clone ID: PAT_TA_35457
gccggccggtccgggcctcgagcccctcgccgatggcttcaccaactatggacacggaactgctcgtgctcgcaccgaggagattcttgtcgaccgtgctggtctccttactcttaccccacctgagatgaccgtcctcgtcggaggtctccgtgctctcaacgccaactttgacggctcatccaacggtatcttgaccgggaagaagggtcaattgaccaacgacttcttcgtcaaccttctgtcccctgcctacaagtggtccaagaaggacgagcgcggcgagctctggactgccaccgaccgttctaccaagtccaccaagtggactgccacacgcgctgatcttgtcttcggatctcacgccgagctccgtgctatttctgaagtttacggtagcgctgatgccaaggagaagttcgccaaggacttcattgctgcttggaccaaggtcatgaaccttgatcgcttcgacgtcaaggtgagcaagtagagacttgcataatggttagggagtcacttgcccctcttctgttttagacttatatattttcccccttcatttttacatattgcatttagccttttatactattttcgtacaatgaattaaaccaagaacatctgtctccaaaaaaaaaaaaaaaaaaggccccta

SEQ ID NO: 35458 - DNA, 1214 bp, Triticum aestivum
  unsure (1)..(1214): unsure at all n locations
  Clone ID: PAT_TA_35458
gccggccgggtcggacaaacaccaaagagaatcccaccatagaaaccaagaacagagctgaaacatggagaccacggtccccgcggcgacagccaccaccagctcgagcgtcggccacggagccggcggcggtgctgcgagagtcctgctcctcccgtacccgggggcgcagggccacaccaacccgatgctccagctcggccgccgcctggcgtaccacggcctccgccccacactcgtcgccacccgctacgtgctctccaccaccccgccccccggcgcgcccttcgacgtggccgccatctccgacggctgcgacgccggcggcatggcctcgtgcccggacatggcggagtacgtctcgcggctggcggccgtgggctccgagacgctgcgggagctcctcctgtcggaggcgcgcgcggggcggcccgtgcgcgtgctggtgtacgacgctcacctggcgtgggcgcggcgggtggcgcaggcgtccggcgtcgcggccgcggccttcttttcccagccgtgcgcggtggacgtcgtctacggggagctgtgggcggggcggctggcgctgccggcgacggacgggcgcgcgctgctcgcgagaggagcgctcggcgtggagctggggccggaggacatgccgccgttcgcggcggtgccggagtcgcagcccgtgttcctccgggcgtcggtgcggcagttcgaggggctggaggacgccgacgacgtgctcgtcaactcattccgcgacctcgagcccacggaggcagagtacatggccctaacatggcgcgcgaagacaataggcccaacgttgccatcattttaccttgatgatgaccgcttccgtttgaacaaggctacggatcaactccttcaacaacaangatcaatgttcngctttggtttgaaaacaactccgcttccngtattcccgnacccaatggactttcnanatttcgacgaaatcactanaaaantgggaacgggtntaaattnngggaaacatcatttgggttttaggccaatgaaaanaaanttcgataacttccaanatncaagganccgctnttttccttgggccaaagncnaatcttgcnaaaaagtaaagggttcctaaccacgtggtggaaccaaataaaccatttaanggtccaangggnatcaaaacggntacacncccntcaaanaaggaagttngggttgtt

SEQ ID NO: 35459 - DNA, 1418 bp, Triticum aestivum
  unsure (1)..(1418): unsure at all n locations
  Clone ID: PAT_TA_35459
gcgccggccgaccccgcacctcattcatctttacccaccatctctcgtgcgctgttgattctcgagaacgaattgccaagatgcggtcttttcttctcgctcttctccctctggctctcgccacggctgttcccagctccaagaaggttgactacaatggcttcaagagtctgcgtgtcaccctccccaagggcgctgatgccgaggccatcaacaagctcgctgctaccatcctgaaccctggtgctggcgaggagctcgacattgtcgttgctcccgagaacgttgccaaggtcaagaagcttgcctctgacgcgactgttttggtcgaggatgttggtgctgtccttgccaaggaggagacctccactgtctacgctgtccccagcgagtcgtggttcaccgcctaccacccctacgctgaccatcttcagttcctcaccgacctgcagacctcttaccccaccaagtctgaggttttcactcttggcaactccttccagggtcgtgctctgactggtatccacatctggggaagtggaggcaagggctccaagcctgctgtcgtcttccacggcactgtccacgctcgcgagtggattgccactatgactgccgagtacttggcctaccagctgttgaccaagtacgcttctgacgctgctgtcaaggctattgttgacaagtacgacttttacatcacccccattgtcaaccctgatggcttcgtctacactcagaccaccaaccgtctctggcgcaagaaccgtcagaccctctctggaagcacctgcgttggccgtgacgtcaaccgcaactggccttacaagtgggagttgactggcggtgcctccaccaacccctgtgacgagaccttcaagggccgtgccgctggtgacagccctgagctcaaggctatcgttggccagattgactctctcgctgctggccgtggtatctctttctacgtcgacttccactcctacggacagtacatcctctggccctacggttacgactgcagcgtcgtcgcccctgaggagactgctctctcatctgtcgctgctcgcatcaacgccggtatccgtggccagtccggtctttcttacactgctggtaactcttgccgtgctctgtacgccaccactggtgacagcatcgactacgtccagggtgtcgccaaggccaagtacgcttacaccattgagctccgagacaagggtacctacggcttcagcttgcccgctagccagatccagcctaccgtttgcgagacttgggctggtgttcttgctggtctccaggctatctaagaagatggagaattctcagattcaaggctggattggggagatatgaaattgngatgctggagtatatagttggtagtaaataaatgagcattttccgactggagg

SEQ ID NO: 35460 - DNA, 883 bp, Triticum aestivum
  Clone ID: PAT_TA_35460
cggccgccggccgcggcgggccggttgtttgttctatatcaatttctatatccaaaatgactgtcgtcactcttcctgagccttttgcaagcatccccagagagaactttctctttggagcttcacctcttcaacctcttcctagaatatccgctgctctcggaggaaaggttaatgtctacgcaaagcgcgaagattgcaactctggccttgcctatggtggaaacaaggtccgaaagctagagtacctcgccgctgaagcccaagccgaaggatgcgataccctcgtctcaatcggcggcgtccaatccaaccacacccgcgccgtcacagccgtcgcttcaaagctcggtctcaaagccgccacagtccaagagcactgggttgactgggaagaccctggctatgaaaaggtcggcaacatccagctctctcgactcatgggcggcgacgtgagactcgacccttcgacattcggcatcgagcacaaaacaaccctcgccaagctcaaggacgagctcaagagcaacggccagaagccctactacatcccagcaggtgcttcagaccatcccctcggcggtctcggtttcgcgcgctgggcattcgaggttgaggcgcaagagaaagaactcggcatctttttcgacaccgtcatcgtctgcgccgtgacaggttccacgtttgccggtatgatcgccggcttcaagcttgcgcaaaagaagaacggttctcccgcgcgaaagatcatcggcatcgacgcttcaggcaaagtgcagcagacattcgaccaagtcctgcgcatcgccaagaacacggcggcaaagattggtctcagcgaggacgacatcacagccgacgacgtgatcctcgacccaactac

SEQ ID NO: 35461 - DNA, 576 bp, Triticum aestivum
  Clone ID: PAT_TA_35461
gcggcgcttcggggcagcgctggtgcgcgcgcaggcgccggcgcgtgtgcgccgccggagccagtgcccgccgtggcacgccaactcgctggagaacgtcgtgccggagaacctgccccggccgtccgcgcgccggaggtataacggcgtcgcggccgccgacaaggcgcatgctcccccgcctgcggcgtcgcctgacgccgtgctcccgttcctggcgctgcgctccggctccggcatgggctgcttctccctctgaattaatctagctaggtggtgtaagttgtaattaatcgggtgattaggctagcagattaattagcttagcttctagaagaaataagctctcatattggtgagagctgggggtacatacgaccaacatattgttttatctgtgatgatatttttctatgtacttcaattcattgctcgaaaagagctagttaatcattatttatctggcttattattggccaaaaaaaaaaaaaaaaaaaaaaaaaaaaaaaaaaaaaaaaaaaaaaaaaaaaaaaaaaaaaaaaaaaaaaggaaaaaaaaaaaaaaaaagggccccta

SEQ ID NO: 35462 - DNA, 1077 bp, Triticum aestivum
  Clone ID: PAT_TA_35462
ggggcggggttcgccggccggcccgggcggacagcctctcaacaagtctctcattgtctttccacctatacaactttgcccaataagccctctccagtctctaaaccaccaaaatgcactgcaacacactctctcttgccgctgtggctctcctcgccagctccgtcaacgcccacggtcacgttgccaaggttatcgctggcggccaggagtacactggtggtatcccccacggtgctccctccaacgctgtcggctgggctgctggaaaccaggacaacggcttcgttgagcccgctgcctttggcactgccgacatcatctgccacaagagcgccaagcctgtcagcaacgctgtcactgttgccgctggcgatgttgtcaccctgaagtgggacacctggcccgagtctcaccacggtcccgtcaccgagtacctcgctcctgtcagcggagacttcgccagcatcaacaagggaagccttcgatggaccaaggtcgccgagaagggctacatctctggtagcaaccccggcaactgggcatccgacgagctcatccgcgacggtttcgcctggaagttcaccgtgccccgaaacctcaaggccggcaactacgttctccgacacgagatcatcggacttcactctgctaacaacaacaacggtgcccaagcttacccccagtgcatcaacctcaaggtcactggtagcggctcccaggctctcagcggtggtggcgacttcaccaagttctactctgccactgaccccggcattctcttcaacctctacgcaagcttcagctcttaccaaatccccggacctgccgtccagagaatctaagagattttcacgaggttcagacaagtggtttctagtttccagactgagtttgggaccaaggactagggcaatgggcagcccttcgctctgatgttattcggttgccgctagtcggttcaaatttctacacgcacggagctgtgtgattcatgtatctactcttatatgaccgtacaaatttatgcatacatacgcaattcttatataaaaaaaaaaaaaaaaaaggccccta

SEQ ID NO: 35463 - DNA, 852 bp, Triticum aestivum
  Clone ID: PAT_TA_35463
gccggccggtctcggggcaaaggccaagggaagaacagatgtcgatctcaacgatgaagaaattgcagctttggagcgacgacgcaagcgagacgaggccgcgaaaaagaagaagagcagcaagaggcgcaaggactcatcacgagtcgccatacctctgacccagctcgagtcttcttcatcgcgcaaaaaggattcattcacgagccagtcaagacagccatctcggtcaaacagcaaccttactgagggtcaggaccgtccttcgcgcccttctctgggtagtcttccaccaacatcatcaacaggtcgaccacgctcaggcactactacctcatctcaaagccgagtgagggcgccatctactagtcgacagccttccgatagttcagctgttgttcgccgaggcaggaactcaagccaagcacccgcggaccctttccagttccaggttccaggtgccccgcgtggctctggatcccgaaagagctctcgcccagtccatgatgatggctcaagtgagagcgacgatagcgatgcagagtatgttggaagggaagattcgatcgagacaacttccagtgatggcagtggtgctcagatcgttgtcgaagagtcatctcctgagcctgccaagcccgagactagcaggagaaaccctacccgatcttctacttcgtcctctacatccaagcgaaagccgacaacaacaacatcatccagtgcacgccggaagaaataaagagttatgatactaggacaaagaataccccgggttagaaaagcagtctctattcagtgttgataaattatctacttatttgcaaaaaaaaaaaaaaaaaaaggccccta

SEQ ID NO: 35464 - DNA, 814 bp, Triticum aestivum
  Clone ID: PAT_TA_35464
gccgggccgggccgggctcatcactctcatcaaacatcaaccactcttatcttcaaacaactctcaccactaccaccaacaccactcacctcttcaacttacacacaaaaacccacaaccgtcaacatgaagttcactggtatcctctctgctctcgctctcacctccgccgtctcggccaccactgtctcctacgacactggctacgatgacaagtctcgccccatgaccgccgtctcttgctctgatggctccaacggtctcatcaccaagtacggctggaagacccagggcaacatccccaccaagtacgtcggtggtgtcaacatcatcgctggctggaactcccccaactgcggtggttgctaccgcctcgagtacaagggccgcaagatcaacgtccttgccatcgaccacgccgcctctggcttcaacattggcctcgatgccatgaacgccctcactggtggccaggctaccgcgctcggccgtgtcaacgcccaggtctaccacgctgacccttctgcttgtggcctcaagaagtaaacggctgcaactctacgacttttatgagatgcattacggacgggaatttgggttaacggatacttttttataattcttcctctccttagaactttgggtttaatacttggcaatggctggctggcgtttagactatgatttaccacacacataatctaactagatactacacacacttacatatgaatgaacatagagcttagttgcttatactcaaaaaaaaaaaaaaaaggccccctaggggcgcgcccgctctaaactaagggat

SEQ ID NO: 35465 - DNA, 853 bp, Triticum aestivum
  Clone ID: PAT_TA_35465
ctgtgcggcgctcgaggcggccggttccgtacaggccgttgtcgaccctcggttttgcagtaaggaggtgagggaggtcctcaaaaaggaggctatcatccttcctccctgggaccccatgggtgcgctggcttgaagcgggcgttccgtttgtgcacccgggaggctcatcgccctgttcttcgcgtgttacaacatttatatgggatcaatatgtatatggacattctgattactgttaagctcgtatctctgaaaagatcgaatgagcaaaacattcatatggacattctaaacaaactataccgagctaaaaaaaaaaacgaaaaaagttctgtcagctaatagtgttgtttcttcagtcacgtgtgtgttgtctctgcatttgcatggccatgggtcgaagagcgaggtaacacatacagtcactcaccatatggcctgacataaggattacgagaatgttattcgaagtatgtgcgcctcggcacaggaatgcttcaccgctgtatgttatggagtacaatttacaataacaacagatatgtatttgatcctggttcccggtccgctacttacatgatcgttggtcccatatctgacaagctacacttgaagcaagtcccgtcccacatgatgtttgtactggtactatcaacggcgtttgaacatcccgacggaacactcagctgttctcagactagtcttcctgtagggcgagggttgaggtgtcacgttgtatggttttgttcgtggcgcgaaacgtacacagaaagatcagcgctgcttgggccatatggatggatgccatagatgcccaagcaagccctccaatcgagtatcattgttttct

SEQ ID NO: 35466 - DNA, 146 bp, Triticum aestivum
  Clone ID: PAT_TA_35466
gccggccgggtccagaagccggtcatcgacttggtacgccatcccttatatgtttggccagaacctgtagtggtcttatactgtgtcttataaaatatttattgatccttttctatgagtaaaaaaaaaaaaaaaaaaggccccta

SEQ ID NO: 35467 - DNA, 435 bp, Triticum aestivum
  Clone ID: PAT_TA_35467
gggtcgatctcgcgcttcacctgcacacatgatccgatcgagccagcctagatcaagacttgaaccacaaagcaacctagacgataccagagagagagagagagagagagatggtaagtgtagtgcagtgcacagaccgttatcgtcagcgtcctggatcatcaacctgacctcgtcgagcgtaaagtgctcgccggcctcgatggccagccgctggatgtccatgtccggcctcgatggcctcatctgcccgaaagatgacatggtgagtaacccccaatctgggacacctcagacgatgacagaagagagaggaggagtcatgagactgtgatagcctggttttttgccttctctctttttttcggactttcttttgcatctactttggattttgagttttgagtcaagtcaaatggacttgaacacttgggc

SEQ ID NO: 35468 - DNA, 737 bp, Triticum aestivum
  Clone ID: PAT_TA_35468
gccggccgggtcggggactcacgcccgtattgttggctaccccaaggcaattccaggcaagaaggaacaccttggcgaagttcgagtcaaggttctcaaggctttgtaaggcgcatctgacaaactgtctcaatatcttactggataactcactgtatcggcatcgaatcctgttccttttgttccttccatttttgaggacactaccagtcaactctcaactcaacacctactcagttctacaatttctatacccaatccaatccttcatcatgcacgtctccaagcttattgccttcggcgccatgttcctggctgtcgatgcctttaaatgcgctgttggccagcaaggctcatgtacatatgtcgagtctgatgccaaacaacatcgttgtgctatcaaatgcagctacaaaggtggatatgctaaatgcacctgcccccagtactacccacgaaacgacaagaaatggccttatggaggaaagcatgcttgtatttctaccccccaatacgtcgaccgctttaagtgttagagcaagtcactacaacagagtgtagatacggttgagcgatacaactaatatctggaaaacaatctctctgtcacgagttgggctcggtataccggtgaatggagaacgctttggacggaataggtctttttctgtagataggcacttatacaagtcaatttgcgctgaaaaaaaaaaaaaaaaaaggcccctaggccccta

SEQ ID NO: 35469 - DNA, 837 bp, Triticum aestivum
  unsure (1)..(837): unsure at all n locations
  Clone ID: PAT_TA_35469
gccggccgggcttcggttataccntcttgacccatccagaatgtttgaaaaaagctccgagaggagttgaacagcctcccacctgtcaaggacggccagtattctctcgctaccctagagaatctcccttacctgaacggtgtcatccatgagggattccgtcttgcttttggtcccatttctcgctcgggacgtgtggctactcaggagaacttgaagtacaaggagcatgtcatccctaaaggaactcccatttctcagtccacctatttcatgcacaccgatcccaagaatttccccgagcccgaaaagttcaagcctgagcgatggatcgaggcacaacagaagggtatccctctcaagaagtacatcaccaacttctctcagggttctagacagtgcatcggatacactatggcctttgctgagatgtacctcgccctttctcgcattgcgcgagcttacgacattgagctttatgacaccaccaaggccgacattgacatgactcacgcccgtattgttggctaccccaaggcaattccaggcaagaaggaacaccttggcgaagttcgagtcaaggttctcaaggctttgtaaggcgcatctgacaaactgtctcaatatcttactggataactcactgtatcggcatcgaatcctgttccttttgttcagtccatttttggtatgcaaggatggaaggtcatagtagcgacatctgaacgtaaaataaattgtaccctatttagacgctcgtcaatttaaacactattcatctcaggcaaaaaaaaaaaaaaaaaaaataaacaaaaaaaaaaaaaaaaaaggccccta

SEQ ID NO: 35470 - DNA, 793 bp, Triticum aestivum
  Clone ID: PAT_TA_35470
cctgtgcggcgctcgaggcggccgtcgatacatcgccaaccacgttccatcaaattaatcttagtcctcagggcgagccaacgcaaggaaccctgaatcaccatcttaatctttcctaaacatacacctcggttttaatcttcaatatgtctgaaagcgctgcctggccccttgctgatcagaagctcgagcaggagcttctcgatcttgtccagtcttctcagcatgctcgccagctgaagaagggtgccaacgaggccaccaagaccctgaaccgtggtgtttctgagcttgtcgtcctcgccgccgatactcagcctcttgccattctcctccacctccctcttctctgcgaagacaagaacgtcccctacgtttatgtcagcagcaagatgcacctcggccgtgcctgtggtgttagccgtgccgtcattgctgctagcatcaccagcaacgacgccagcgagcttgccggccagatccgagccatgcgcgacaaggtcgagcgcctcgctatctaagatacccaacgagtcgaggaggaaagcaaaagatggaaagctttttcgtctggcagccggctcttaacggctgtttattgcagcttagatatgttgctgagttttgataactccagctcggtcatatggtgcaacaattggtgtatgaaattgggcctttgggtagaatagtaatatcatcaactgtctcgacgaacgctaaatacgaaaacgagccaaagtggatatgtcaaaaaaaaaaaaaaaaaaaaaacctaaaaaaaaggccccta

SEQ ID NO: 35471 - DNA, 923 bp, Triticum aestivum
  Clone ID: PAT_TA_35471
gccggccgggtccggtgggacgaaatccgttctctggtgtagaagcagaaacaaattgatgctttaatcatgcctcccagaataccggcgctgccgagcctaggctcactgaacctttgcctccgacccgcatcgaagcccgcaacgcccaacttcctacccatcgtccagacggccaacctttcccagcgtgagaagaagcgcaaggcaaagcaagacccttatagatgggctcaagcacaacaacgaaaggctgccaatgtgcaaaggcgcgaagagctatcccgtgagagagatgaggcctggggcgatcctgtcctaggaaagaagactcctttcattgaatccttggagacggctggcctgaagaattctgattcttctgtgtcaaatattggaattcgaaaccatttccttacagacgccgaggttaaaaaggccaccgcacatgcataccaactcactaagcccatgattggcgcagttgaggagcagatggaacctgagaccaaggaagataagatgaagcagcacaaggagaaccaccagaaggttctcgaagctttgaaccgaattacgtcgcttgagaatggaagctcaaaggaccgctttcacgccaatgttcagcgcatcatcaatgagttcggtcgtcacacaactgactcaaaatttatgatgaagccccgtttatctactgacggggaggaaaagcttgggcgatgtggccctgatactggtagctctgaggtccagattggcatcttgacagccaagatccataacctctcaaatgccctgcagatcaaccgaggctataaggacaagcacaacaagcgtaatctaagattgctgttgcatcgccgacagaagctcatgaagtacatggatcgcaaggagaaaggaaatcagcgatggactcacat

SEQ ID NO: 35472 - DNA, 1413 bp, Triticum aestivum
  Clone ID: PAT_TA_35472
gcgatgccctgatagcccgcttcaggagctgcgcatgcccccggctttcgcgctggccggagcttccgaggcggttgtgctggtaggggcggcgacggcggtgcttcttgagctgccgaggctttcaacagaaatcaacgaatccagcgagcacctggacgcctctcagcaggagttgtttgggctgcagacaacaatagatgtgctcacggactcgccggttgctgctgaagaagtggcctcagaggcgttaaacgatgagaagacggctaatgcaaatattctaagcctcaccgaggagggggtcacgttagttaacgagttggttcaggctgtgaaggctgagaaacagggccttcaagcgcagctagcgcacatggattcagcagttgctgaagctagcaaggctgcgcaggcaggcaacgtctgagtgtttgcaactggaaggataggttactttataaatgaagaacgcattgccaaagtcttcaaccctaggagaaacgacgaaattcaggctagcgtagagggctgaccccatgaagaacatagaggagttatctgctctgcttgctgaagccatggaaaagaagcatccgggggaggaagagaacctagttgttgtggatgaggtgcacagttcagcgcgtgaagttgctgagacagctgcagaaactgaagacacagaaggagagagtgacaaaaaaccgagcatggaactcgtcgtcgccaatggaaactccaatggcgacatgaaccaagaggaagagaaacacgacagcaaggtcgagcagcaggaagcaaaaggtgatttcaccacgatacacgagagcgacaaagttgtcgagaagcagctgcaggcagatgtgaaacaagaaaccgaatcgtcgaaagacgacctgtcctccaaggaggacagcagcaccgaacacgcaaatgcaaacggaacagcagcatcagcagaggtgaccagcaaagtcgcaatgtccccgacaacaacaacgaaaccgcagaagaagaacaagcccctgctgaagaagtttggtaacctactgaaaaagaagaacagcaagtagtagcaggtgaacagaagaaaaacacatgtactattattggtgtttattattactctgatctttcttttcttcttcttcttgtttgatgacagcaaggtagtgtgcttaatttccacgtgtaattttatactgtcgacgcctgtacttttgcggtgattgcagtagctttgtgggtgttttcatttttctctctttttttttctataagctggacctcctgttctttgccctatggctgtggttattattatctacacgatctgtggccgtttgcttgtaaaaaaaaaaaaaaaaaaaaaaaaaaaaaaaaaaaaaaaaaaaaaaaaaaaaaaaaaaa

SEQ ID NO: 35473 - DNA, 673 bp, Triticum aestivum
  Clone ID: PAT_TA_35473
gccggccgggttgggagatcatctcggctctcccaccaacggcccaacgtcagccggctgcaaaacaaaccacgatcctcaattccaactgatcttttgttcctagcaagtaacaacaagaaaccatatctacttcgcaatcatgcttcgcacatctttccgccaggcagccgccttccgacccattcgatgcttctctactactccccgcgtcatgactgagggtgctactggagctccccgccctactggaggctctggtgatgctttccagcgacgtgagaaggccagcgaggattacgctatccgccagcgtgagaaggagaagctcattgagctcaagaagaagctccaggagcagcagcagcaccttgaccgtctctccaagcacattgatgagatcacaaaggagcagggcggcgagcagcactaagcaactcatatcacggatcaccggataaatcaggcaaagcgagtggggggaaaccatcagaattcagcgagacccaaaccggctcgccaagatcgcaatgacatgttacagtaatgagttgacgaaactcaacatgaaatcgcaattcattcagagcttgactgttccatagtcgaaactagtgtacaagaatatctacacgtttgcactctccaaaaaaaaaaaaaaaaaaggccccta

SEQ ID NO: 35474 - DNA, 691 bp, Triticum aestivum
  unsure (1)..(691): unsure at all n locations
  Clone ID: PAT_TA_35474
nnnnnnnnnnnnnnnnnnnnnnnnnnnnnnnnnctgtgccgggcccgccggccggtttcgggattctcatcatccactctacaactacaacaatcgctataccaacactcgtttaaataacctcgatctacttctctttcaaccttttactcaaaccaaacccaacaaaccaaaccaaccttcaaaatgcacgcctccgctgccgtcctcgctttcgtcgctgttgcggctgctgcccagacccctgtggcccccgttgctactcccatcgctactcccggtgcccctaccaacggtactaagcccggtcacggctctggctctggttccggatctggttccggctccggctcccagaccccctccggcgccgccgcccttggcctcagtggtcttgctggtgccctcgccattgctcttgctctgtaaatgtctttcaatgagactttctcagagttggtggatatgaggatcctgcgacagacaaccttgtagggttctggaggaatcgtgctggtgcgcgtttaactttcgatggagatagatcgggttttcgattgtcccgactagaatagaatagatcaatggagcgtgatcgctccagctacattaatactaatcgcataccaccaaaaaaaaaaaaaaaaaaggcccctaaaaaaaaaaaaaaaaccctaaaaaaaggccccta

SEQ ID NO: 35475 - DNA, 915 bp, Triticum aestivum
  Clone ID: PAT_TA_35475
gccggccggcccgggccggcatttgggatccctcgcgaaactcatcttccctcccacaaccaactccgcccagatcaatcaacaatccgacaaaatggcgcgccgtcccgctcgttgctaccgatactgcaagaacaagccgtatcctaagtctcggttcaaccgtggtgtccccgaccccaagatccgaatcttcgatcttggccgaaagcgcgccaacgtcgatgacttccctctctgcatccacctcgtttccaacgagtatgagcagctgagctctgaggctcttgaggccgcccgtatttgcgccaacaagtacctcgtcaagaacaccggtaaggagggtttccacctccgagtccgtgctcaccctttccacgtcgtccgtatcaacaagatgttgtcttgtgccggtgccgatagacttcagaccggtatgcgtggtgcctggggtaagcccaacggtactgtcgcccgtgtcaacattggccagattctcatgagcgtccgcactcgtgatgctaaccgtgccattgctctcgaggccctccgccgatcccagtacaagttccctggccgacaaaagatcattgtctccaagaactggggcttcactcctctccgccgtgaggagtacctcgacaagaaggctgccggccgcgtcaaggtcgacggtgcttacgtccagttcctctccaaccacggttctctggagcgcaacatccgtcgcttccccgacgctttcaagtctgaggcttaaaggaatgattgataggatggaatatgggttttctggcgtcaaaatggcttgtcaaataaggacctcttaaaactatctagttaaagggcgtcgattaggcaaattgaaatcttacattcagaactggaaaaaaaaaaaaaaaaaaaccgccccta

SEQ ID NO: 35476 - DNA, 451 bp, Triticum aestivum
  Clone ID: PAT_TA_35476
gccggccggggttcgggatcgaaatcctcagcacttctgccaccctcgaacgctccgcttcttcgcccgaacagcttcgcacaaataaatcagtcacaatggccgtccaacccatcatcggtatgcttcgacgaaacctcgtcctagatcttagcatcgctctcggctctggcttcgtcatggccaacttcttctggtacggcttccacatgccccgaaccaacgcccgcgacaactactacatcaagctcgaggaggaacgagctgctcagaagaacgagtaaagcaaagacatgccgagtcgaaatcgcatcacccaaagcaagggcatgggggagacaggaagtgcacatagaggccactagccaatgtttcgtttgtcgtgtagctgggtacaaagcaaaataccaccgaggcttcatccgaaaaaaaaaaaaaaaaaaggccccta

SEQ ID NO: 35477 - DNA, 589 bp, Triticum aestivum
  Clone ID: PAT_TA_35477
gagggccggcgccggccggggggggaactgcttgaccacatcgaaatcctcagcacttctgccaccctcgaacgctccgcttcttcgcccgaacagcttcgcacaaataaatcagtcacaatggccgtccaacccatcatcggtatgcttcgacgaaacctcgtcctagatcttagcatcgctctcggctctggcttcgtcatggccaacttcttctggtacggcttccacatgccccgaaccaacgcccgcgacaactactacatcaagctcgaggaggaacgagctgctcagaagaacgagtaaagcaaagacatgccgagtcgaaatcgcatcacccaaagcaagggcatgggggagacaggaagtgcacatagaggccactagccaatgtttcgtttgtcgtgtagctgggtacaaagcaaaataccaccgaggcttcatccgcatcgattgctgggcaacctgtactgtagactagggcaaccgagtcgtacgtgctttgaacaaaaaaaaaaaaaaaaaaggcccctatgtgataaaatgcaactgggactgagctcgcgattctaataataaaaaaaataaa

SEQ ID NO: 35478 - DNA, 697 bp, Triticum aestivum
  Clone ID: PAT_TA_35478
gccggccgggctgggcggccgggcccagccggaattcgcgccatttccgaccgacgacgaagacgacacttcaacccaacccccggacgtcaattgcttcctctcgattcaaaatgaagtactcgctcgcccccttcatcctccgccggccgtggcttgcccgctttttcaagcccgccgctacctggtacgtcaacactgccgggtaccgccagatgggcctcaaatacgacgatctcctcgaggaggagaacgagaccgcccaggctgccctcaagcgcctctctaaccgcgagtcctacgagcgcatctaccgtatccgacgtgctgtccagtgcagttaccagcacaagctcctccccaaggaccagtggactacatccgccgcggacaagccctacctccagcctcttatggaggaggtcgccgccgagaaggctgagaagaacgagctcgactccatcgctgtcgtccgaaagcactaaattatttttggccctcgggttgggaggacagtaggaagaagttgaagagcaggacggtggttgaaagagggaattgcccgcctcctagagaaatggcggccacacctcaacggactagacaattcccgtgtatcctatgtagacgtctaacttgactcatttgcacataaaaaaaaaaaaaaaaaaaacctaaaaggcccctaaggccccta

SEQ ID NO: 35479 - DNA, 498 bp, Triticum aestivum
  Clone ID: PAT_TA_35479
gccggccgggtctggatgggggctaccattttgcacatgccgaccagtatatccctgagcgttggttagacaacagcggccctcgcttcgcaaatgatgcaaagcaggcactgaaccccttctcaattggccctagagactgcgttggcaagaatctggcatatgccgagatgcgcatgattcttgcccgcgttctctggaactttgatgttagcctgcatcctgacactcctggatgggagaagagaaccaagtcttacttcctttgggagagaggagccatgaatgtgatgctcactccccgaaagacggagtaaagacacaaaggccgctgatttaataaaactacatacttacaaaaaaaaaaaaaaaaaaggcccctagagggaccagtgtttgtgtttctgaagcagggacagaagggacaaattgtatcaacatcaaatcattaatatacaacttgatacatcggaaaaaaaaaaaaaaaaaaggccccta

SEQ ID NO: 35480 - DNA, 515 bp, Triticum aestivum
  Clone ID: PAT_TA_35480
gccggccgggtcgggatcatgaacatttgccttcactttcaagttatactataacactccgatctaaatctatcaaaatgaagttcttcatcgcctctactctcctccttgccaacggcatcgctgccatgccttggtcttcccccaacgctaagcagtccaatggcgaagagatcactcttcacattcaggtctcccagccggcttccaaccacgcctcctcccccatgcaccgcggagtcgtcaacgtccacaactacgaggtgtgcctcaaggtctgctggcctgaggagcctacatgccctgaaggctggaactccaagaaatttggagacggtgactacccttgctggacctgctgcaagaagactggtgatgacgatctctaatcataagatttgtcatagccttacggaaaagggttgcaaatttcacttcaataggaggatacttaggcagtacaagttaaatggacattcgttctacatcaaaaaaaaaaaaaaaaaaggccccta

SEQ ID NO: 35481 - DNA, 861 bp, Triticum aestivum
  Clone ID: PAT_TA_35481
cggccgctcgagccggcggggccggcctctacctctaagtcacgacgaagtaactccaattgacctcgccagcatgaggccaacagctcgtgtgtttgcgcgctacctggaggccggtacccctaccggtctcaccggtctctggacacatgccacccccagatcgaccctcctctacctctacggaacgaccctcaacaggctccagaaagtccccgagaactccatgtaccgccaatccgtcgaggccgtgacaaagcaccgcatgtcacttgtcgagcagatggttcctcccggatacaacgaatgggcggcccgcgccaaggagctcgtcagcaagaactcgtcacagttccgcgtttccagcggccgcattgacggcagcgaagctcacaccgtcaagctcggcgacaaggtctttgtggtgggccgaaagcacgaggctggcgatgtccgaatcgaggagtgggacggcgaggaggatgagggttctgagtacgagggtatccgaacactcaaggagcgagaggaccaggctacttgggcggagcgcaagcccctcgaggatcacgagaaggttgagtgggaggatgagcctcaaatgaccgctgagcaagtccacgagctcgagcagaagatcggagctggtcttattgaggagattatccaggttgccgagggcgagctcaagctggttgagactatggagaagaccaaggtctgggaggaccttgacgagaagcctgtccctggccagtggacttactttgaccgaacctaaacaaagcagctgacgaacggggcaattgtaaaagtagaggaggttatgtatataggatgcgtgtgctgggctttgcgact

SEQ ID NO: 35482 - DNA, 915 bp, Triticum aestivum
  Clone ID: PAT_TA_35482
ctcgtgggccgacactgcacgctaaagtgaatcatattaaccagcactagagtctaatcgtagcaactcagccgctcacctgcagcaaatggaatcaggtgaaaacaacatgggctcgaatgatggaccaaacagcaaagctaacttggctgcgaggcaacgcttacggtggacagatgagttgcatgaacaatttgtggaggctgttactcaacttggcggtcctgatagagcaactcctaaaggagttttgagaattatgggtacaccaggattaacaatataccatgtgaaaagtcacctacagaaatacaggctagcaaagtacattcccgactcttcctcaagcccttaacaagcagatggaggtccaaaagcggttgcatgaacagctcgaagtacaaaggcagctgcagctgcgaatcgaggcacagggaaagtaccttaagaaaatcatagaagagcagcagcgtttcggtggcggtggtataaagtctgaaacacctggtgcaggagcaactgtcacagtgtcgagcgatcagttccccgactctgagaggacagacccctcgactcctgcaccgacatctgaatctgcatctcaaggtggggctttcaaaagagacagtggaagccagactgaagcaatcaagagcccatgtcatgatgaaccgctgctaacagcagattccaactgtcatcccgggtctcctactctcagtccaaagcacgagaaggcagcaaagaggcagcgaggcagcgatgctgaattcccggaggccgagttatccctttcgcagcatatcttcgagtcgagctcggggccagagattcagcaatgttcggtgccctactactccggtcattagcctcccggcagctacattttggcagcatcttagaagggggcttcta

SEQ ID NO: 35483 - DNA, 1483 bp, Triticum aestivum
  unsure (1)..(1483): unsure at all n locations
  Clone ID: PAT_TA_35483
cggacgcgtgggtttgggctgaaatctggtccttccgagccggtagcacagagagagaacgtcggggcgaatctcgtggaattctctctccactgctcgccggaaaccaagaaatcgccaacccacgaatcttccctcacaaccagtccacaccgccgcgccaagtcccgatcttgccggccgagctgcactccggccgtccccagttccccggctcgagcctcccgccacgaattcggacggctcgtccaccctggcagatgatgaacagtatatcctccagcactagagtctaatcgtagccactcagtcgctcacctgcagcaaatggaatcaggtgaaaacagcatgggctcgaatgatggaccaaacagcaaagctagctggcctgcgaggcaacgcttatggtggacagatgaggagcatgaagaatatgtggaggctgttactcgacttggtggtcctgaaccaacaaatactaaggcaattttgagaattatgcgtctccccggcttaaggtaataacatttaaaacaaaacttgaggaaatacaggagcagaaagtgatttatcctctggactgcagatatctgaagcgctgaagatggagatggaggtccaaaagcggttgcatgaacagctcgaagtacaaaggcagctgcagctgcgaatcgaggcacagggaaagtaccttaagaaaatcatggacggcttgaagtacaaaggcagctgcagctgcgaatcgaggcacagggaaagtaccttaagaaaatcatagaagagcagcagcgtttcggtggcggtggtataaagtctgaaacacctggtgcaggagctactgtcacagcgtcgagcgatcagttccccgactctgagaggacagacccctcaactcctgcacccacatctgaatctgcatctcaaggtgcagctttcaaaagagacagtggaagccagactgaagcaatcaagagcccatgtcacgatgaaccgctgctaacagcagattccaactgtcatcccggttctcctactctcagtccgaagcacgagagggcagcaaagaggcagcgaggcagcgaggctgaattcccggaggccgagttatcccttccgcagcatatcttcgagtcgagctcggggccggagttccagcaatgtgcggtgccctactactcgggtcattagcctcccggcagctacattttggcagcatcttagaatggtgtcatctaaggggatatgttgtatgttgacaaaagttgttaggtgttttcaggtggttgtttacatgatgcatacttacacatgacatctatatcttgcatttgtagcgccttgacttgtaaccttattggcagatgagttgaccagtttgggtggggtgggcactgttagcctgtttttacatgctatgttttctaattaaagttcttgagtcttaacaccaagtttatcttgctatgcaatttgttaaaanaaa

SEQ ID NO: 35484 - DNA, 756 bp, Triticum aestivum
  Clone ID: PAT_TA_35484
gcgccggccgggccgggatcctataacaacccaagcctaacaaagttccctaaacaacttttcaacaacaatcatctcacacattttcgagtaattcctcgtcttcacaaccgacaacatgcctttcaccgctagcgacatctgcaagatcatccttgccatcatcctccctcccgtcggtgtcttcctcgagcgtggttgtggtgccgacttcttcatcaacatcctcctcaccattctgggttacattcccggtattatccacgctctatacatcatcctgaagtactaagccttaccgcacttgacttctcagggccacggcgcttccctaatggcttaatgagtaccccgctttccaaccatcgtcaataagtggtcggtcatcggttgtcctggaccatgcgacatgctgtctgacggccaagacaccaatgactgccgtgtcgaccgggtacgcgcagtcggctggaagctctgtgtttctatttgcgcaaccttggcttcgctttgatacctcacgccggtgatccgcgcttacgagtttggacgccgattttacgacgggcatggacgcaatgcgatatcagttccttatttcctttgtttacttgcggatggaggcgcatgctggattggctctcaaggcataatgcactgggctttttattaattaattcgatacccatcaatccaacgtttccttaacatcaaaaaaaaaaaaaaaaaaaaaaaaaaaaaaaaaaaaggccccta

SEQ ID NO: 35485 - DNA, 487 bp, Triticum aestivum
  Clone ID: PAT_TA_35485
gccggccgtgtcaagggtgttctggcctacactgaggacgacgttgtctcctctgaccttaacggcaacaccaactcctccatcttcgatgccaaggccggtatctccctcaacgacaacttcgtcaagctggtctcttggtacgacaacgagtggggttactcccgccgtgtcctcgacctcctggcccacgttgccaaggtcgatgcctccaagtaagcgcagagcgttcaaggggctggaagcaaaaccaaacctaattagacgcgacacgatgaagattccagtcggtcgtgtgttttaatgaagcaaagaaatgaaagaaagtaaaaataccaaaatccggggagattgtcggaggggatgacaacgaggttgttatcatcggctcgagttccctactagacaattgatcttagtatagccgtggacagaaaaaaatatagatccatccctctcgaaaaaaaaaaaaaaaaaaaggccccta

SEQ ID NO: 35486 - DNA, 713 bp, Triticum aestivum
  Clone ID: PAT_TA_35486
gccggccgggtccggagaaccccaatgtctacgtcaggtattcatgatcaagaggggatatcatatgccttttctttcgagctgttgattcgaatctcatctcatccaaccagcagatcaccacaaactaaacatcaaaactaaactccaacaccatacacacatacaaacatcaccacaatgggcgaaatcaagaaaggaaccatcaagcaccgcaacaaggagggaaccctcgacgcctcagccctcctctggcgagccctcacctccgaaaagccagacgtcatgtggaagtacatcaccaaagacgccgtcctgtgcgagcccgaccaaaaggtctactcgccgcgcagcgagcccgccctcgacgagtatctcgaggagcagtacgagccctggaccgcatacaagatccacgacgagcccgagtttgtcgagattgacctcatggcttcggccctcaactaccgcgtcacctgctggaagctgcagaacggccagatgaacgcgactgaagcgtggtgccatagtgtttttaggcagggacctggaggagattggaagtgctgccttcaccacatggcgaagatttgagacgatataatttgaagtgttttgggtgtttgggtatggcgaattggacttcggcagatgtttcttctagccttaataaatgatgttaacgttaaaaaaaaaaaaaaaaaaggccccta

SEQ ID NO: 35487 - DNA, 819 bp, Triticum aestivum
  Clone ID: PAT_TA_35487
ctgtgcggcgctcagccggccccggcggggtctatcagttctgcattaactactcctcaaatcactcaacgaaaccacccaagtctctatcaacaaactttcaaccatcaaaatgaagttctctgctgctattctcgctgccgccgccgccactggcgctaccgccgatgctgtcttcaacgtccgcgacttcgccgccagctgcactccccacagcgccatgtgcagctactctttcaacgtcatccagcccggcaccatggacaccaagggctacgaatgtaccgccaagctccccggtgctggtcctggtgagcttcctgaggtcaaggttggcacctgccttccttcttcacgaacctttgacgtcgtccgcagcgacaagggcttgactctcaccgtgtccgtccaggtctcgcccaacagcttcaccaagggctcgcacctcatccccaccaaggacatcaagactgtcaagggcgacactcccaccggcgatgcccaggcctatgttggccctaaggacttccctcttgagcgtgtcgattaagtgtattctctttagagaatagacgatgatcttttggagctaggacgacatgaccaaggttgggttggctatgagaaatgagatgaacaatgtggatatgaacatggaatgaatgatagacgggagaggattcaatagtcgctgactaggcttatatttggtgatcttcaggtactgatttagattcatactaatagtagcgctctttgtataatgaaaatctgcaccacaaaaaggcccctaaaaagcccctaggccgcggccgctct

SEQ ID NO: 35488 - DNA, 779 bp, Triticum aestivum
  Clone ID: PAT_TA_35488
aaatagcaggctaccaataccgaaaggttcacgcattttcataaacgtatgggcgataggtcgagataaagatgtatgggatgaacctgataaatttatgccggaaaggtacctgggttccacagttgactttagaggtgcggattttgagctccttccatgtggtgtcggacgtcggatctgccctgggatgacattggcaaccaggatggtgcatttgatgctcgcttcattgttacatcagtttaagtggagtctccctattgagctggaaagagatgagattgacatggaagataaatttggcctcacacttactaaagtcgttccccttcgtatagtagcaacaccagtttgaattgaccgaaaaaatataatttgtatgagtgctttaggtgttgttaatatgtaataactcaaatgtgtcatgtgtcgaatttataccattatttatgtgacaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaggggccccaggggccggggccccttaaaaataaggggaccccccgggtgggggaaattcaaaatcaattttttcaaacccgccccccccagggggggccccggaccccaatccccccaaagggggggggaataacccgcgcccctgggcgggttttttcaaaggcgggggtgggaaaacccggggggtc

SEQ ID NO: 35489 - DNA, 736 bp, Triticum aestivum
  Clone ID: PAT_TA_35489
gcggccgcctcgagggccggccggcggccgggaacccaacccaaacaaacgactccgtcgcaaaagcatcctcgctctcctcctcccgacgcattagcgatttactcgacccgaacaggtccccagatttcaagatggccggaaactttgaggaagtcgccaagcagtttgttgagtactactacaacacctttgactctgatcgcaagggcctcaatgctctctaccgacctaactccatgctcacattcgagtctgcttctgtcctcggcgccgaggccattgctgagaagcttgttagcctccccttccagcaggtcaagcacaaggtcgccaccctcgacgcacagccctccaacgaccagggtggagtgattatcctcattactggtgctcttcttatcgacgaggagcagaaccccatgaacttctcccaaaccttccagcttcaacgcgaccaagctggcaactactacgtctacaacgatcttttcaagcttgttttcggttaaagcagcttgtcaaccttgctcaacgccttgctcccgactgagagatgaaagcgaagcctacagatgtaccaagtggggcaagagaggaggggaaattaaagcagcaatgacaatggcaatggaacagtgttttttgacgatacgatgaaatttagagtacggtctcaggtacaacatattcatgtttaacttgactgtgaaattgcaaagaccctaggccccta

SEQ ID NO: 35490 - DNA, 576 bp, Triticum aestivum
  Clone ID: PAT_TA_35490
gccggcctggtacaaaactgagaagcaggtcactgatgagatgctgaagaaccccaagcctgagtggggcaacgatatccctgataccaaggaggcgtactggtaccgatgcatgtttgacgagcacttaccccctcactgcgcgtcaactgtcatgcgctggactcccacctggtccaagcagactgaccctagtggccgagccattgccacccacaacgccaagtacgacagcgcggcttaatgacatagcgaatcgagtaaaacaccaagtagagaaaacttggtcgactcattgtaacttacactatctgaggtatctgccatgaacctgatctaaggagcaactctgggtgtcgtttcttggaggtagagaaaaaggcgtctgggatttgcttacctacctcggaatgatgatgactgtaaaaagggacggatgatatgggcaggaacatgggaatcaagaacaagacaaaagttctagaaagaaagaattgcatcgtatgcgtgctagtgcgagtgtcggtgaatgtcagatgtattgacggctaaaaaaaaaaaaaaaaaaggccccta

SEQ ID NO: 35491 - DNA, 642 bp, Triticum aestivum
  Clone ID: PAT_TA_35491
gccggccgggtccggatcctcaactcagaacatctcaacaacttcaaacaaaagctttcaggctcatatccaagacctacaactttcaaaatgtcctacaccatcaaagtccgtgtctaccagaccaaccccaacgcctatttccacatcgttgaaaagggttgctggcactacgcaaacggtagccagtggaatgagcagaacggcatcctgacactctccatgggcggcagtggtacctctggcatgctccgcttcaagactgagcagaacaaggagggcttcttcgtcgccatgggtgtacacaactacaagccctgggttgacactataactggcctgggtgacgatatcacctgcgtcaaggctctgcccgagtactacggcaacgcgtcggaccgtactcgatctcgcgagtcgcagcgtactgagcagacgattctcaacattgatcgcagaaacatttctacccattacaaggttaaggagggaaacaaccttgagcttgatatcaccatcggatagggggctgagtcgaaagcctttatcaatatgggatggagaggatctataagttatcttagcaaattgaactctcatttacaccaaaaaaaaaaaaaaaaaaggcccctagggccccta

SEQ ID NO: 35492 - DNA, 888 bp, Triticum aestivum
  unsure (1)..(888): unsure at all n locations
  Clone ID: PAT_TA_35492
gtgcggccgctcgggccggccggccgggaacttgaaccaactatttctctgctgtttcattccgaattcctagtcaaacaatcccaaaacaacagcagtaatatctcaaccagccaacatgtcagccccagagactcaacccaccgctgaaggcgatgagtacgaaaagacccttctgcagctacgatgcttcgacacaatgttcctcgtcgatgattccgaggcaatgcagccttactggcccgaaatcaagaccctgatagagcgcatcgcacccatctgcgccaaacacgatcccgatggagttgatctgtactttgtcaaccaccgacctggtggtgtattggccaaattgccaggtgttcagtcaatccgaaagtccggttacactcacatcggtggctttgccggaagcatgcttttgaccagcaaaggaaagcaagtcggcgccatctttgacaaagtcaagccagctggaaagtgtaacatgggtgccagacttggcggcttactcaagtggtactgcgacaagttcacagccggagaggaaaaggccgctctcaacatcattgtgctcacagccggcgcattcgacgacgacatcaagactcctctgatccaagccgcccgaactctcgacgaggccaaggcacccatccaccaagctggtgtccagctattccgcctaggtggaccggatctggtgcgacaaaagaccctgcagcatctcgacgacgagctgcacaaggaggctggaacccgagatatcgtcgacacagtgacttggagcggtcacggtacatccatgtcggatgatgagctgctcaagattgtgctcggcgcagtgatcaagaaagatgatatcgtgcttctgagntgcacttggat

SEQ ID NO: 35493 - DNA, 1456 bp, Triticum aestivum
  Clone ID: PAT_TA_35493
gccggccggtcacgcagcttatactaaccccctcaaccacacagcccgcccaagatgagtcaccgaaagtttgaggctccccgtcacggctccctggcttatctgcccaggaagcgcgctgctcgtcaccgtggaaaggtcaagtccttccccaaggatgaccccaagaagcccgtccacctgactgccgctatgggttacaaggccggtatgaccaccatcgtccgtgacctcgaccgacctggcgccaaggccaacaagaaggaaattgttgaggctgtgacgatcgttgatacccctcctatgatcgttgttggtctggttggctacatcgagaccccccgaggcctgcgatccctcaccaccgtttgggccgagcatctgagcgacgagatcaagcgccgattctacaagaactggtacaagtccaagaagaaggctttcaccaagtacgccaagaagcactccgagaacaacggtgcttccatcacccgcgagcttgagcgtatcaagaagtactgcaccgtcgtccgtgtcctcgcccacacccagatccgaaagacccctctcaagcagaagaaggcccaccttatggagatccaggtcaacggtggcagcatcgccgacaaggtctctttcggtcaggagctcttcgagaagcccgtcgatgtttccagcatcttcgagcaggacgagatgattgacgtcgtcgccgtcaccaagggtcacggtttcaacggtgtcactgcccgttggggtaccaagaagcttcctcgcaagacccacaagggtctccgaaaggtcgcttgtattggtgcttggcatccttcccacgtccagtggactgttgcccgtgccggtcagatgggttaccatcaccgaacctcggtcaaccacaagatctaccgtattggtaagggcgatgctgacgacaacgccgccaccgagatcgatgtcaccaagaagaccatcactcctcttggtggtttcgtccgctacggtgaggtcaagaacgacttcgtcatgctcaagggttccatccctggtgtcaagaagcgtgtcatgaccctccgaaagaccatgttcccccagacctcccgaagggccctcgagaaggtcagcctcaagtggatcgacacctcgtccgagttcggacacggtgctttccagacccctgccgagaagaagcagtaccagggtactctcaagaaggacctttcttccgcttaaagcggcagtttgtttctttttgtatcttaaccaatcattccattgcatcggtgtcaagggttggttcgttacgcctcgcgtttgggctgggtcaggtatgaactggcatggagcataaaaaaagtccagctagaagagggatggtgatcaaaaattctaacgagattcccaaaaaaaacaccaaaaaaaaggcccctacaaaaaaaaaaaaaaaataggcccccta

SEQ ID NO: 35494 - DNA, 1077 bp, Triticum aestivum
  Clone ID: PAT_TA_35494
cactgcaacccatcaccacccctccccccaatccctctcgcgcagcaggtccaagaggatcgtcggcgaccatgtccggctgtgcgccgctcgaggggcggaaagggctgaggttgaccgctcgaacgacatctcctttatcttcttcttcccatccaacaaatcttcaacttccttttcccattcatcttcatcatcatccatcatgtctgacgctgcttacccccctggaggcactattgtgcagtcgcttaagcgatctttcgtcgacgtccccgtcgatgcggccaacggcgatgctgtctctaccactgagttcctcgaggcttccgagtccctgaccaccatcttcgatgccattggtggtatggctttcggtcccgtcaagaaggatatccttggcaacgtcgagaagctccgtgcccgccaagctgctgctcctgccgagtccggcaccgtccaggaccttgtccgcaacgagctcaagaccggcaagcacactgccactgagggctgcctctggctcgtccgtggtcttgacttcacctgccaggcccttgagcgcaacgtcgccaactcctctgaggagcttgctgactctttccgcactgcctacggtaacaccctgaagccccaccacagcttcgtcgtcaagcctatcttcagcgccgccatgtctgccgtcccctaccgaaaggacttctacgccaagcttggcgagaaccctcagcaggttgaggccgacctccagacttaccttgcttccttcaccaagatcgtcaacatcctcaagacgttcatcaacggacctgagggcaagtggtaaacgatatatgatataagaaatgttagcgtacctattgcttgccaatacatggcagtgctaaagtgacaacgagtcacatgtttgagaacacgacttggttgatgagatgcatcagcattgagaagccatcctacagagacctgtggaagatggctgcaatagctgtcgtcccatattacgataacgaaaataaatatatattgcatgaccatctgcttgatcagtcaaaagcccaaaaaaaaaggccccta

SEQ ID NO: 35495 - DNA, 508 bp, Triticum aestivum
  Clone ID: PAT_TA_35495
gccggccggctcgaggcggccgccggcgggatcgcaaaccagcgcccgtcaagttactcgtttaaccatcccaccttgaactaccgccaagatgcctcaagaggtcgctgatatcaagaagttcatcgagatctgccgtcggagtgacgcctcctccgcccggatcaagaagaacaagaagaccaacaacatcaagttcaaggtccgatgccaaaagaacctctacaccctggttcttaaggacaccgacaaggccgagaagctcaagcagagcctcccccccaccctgcagcttacagacgtctccagcaagaagaagtctgcttaaatgaaggtggtttgaaaacgggtaactctggtagcgggaggattcacatggaatgggcgtcttgggaccttgcatttcatcatgtgctctgaaaggaggatactcggatgagtccaaaaaataaaaagaaccgattcgagtcaaaaaaaaaaaaaaaaaaggcccctaccctaaaaaaaa

SEQ ID NO: 35496 - DNA, 2747 bp, Triticum aestivum
  Clone ID: PAT_TA_35496
ctcccactcttctctccccgcgcacaccgagtccgccccggctcatcacccatcacctcggcctcggccaccggcaaaccccccgatccgcttttgcaggcagcgcactaaaaccccggggagcgcgccccgcggcagcagcagcaccgcagtgggagagagaggcttcgccccggcccgcaccgagcggggcgatccaccgtccgtgcgtccgcacctcctccgcctcctcccctgtcccgcgcgcccacacccatggcggcgacgggcgtcggcgccgggtgcctcgcccccagcgtccgcctgcgcgccgatccggcgacggcggcccgggcgtccgcctgcgtcgtccgcgcgcggctccggcgcttggcgcggggccgctacgtcgccgagctcagcagggagggccccgcggcgcgccccgcgcagcagcagcaactggccccgccgctcgtgccaggcttcctcgcgccgccgccgcccgcgcccgcccagtcgccggccccgacgcagccgcccctgccggacgccggcgtgggggaactcgcgcccgacctcctgctcgaagggattgctgaggattccatcgacagcataattgtggctgcaagtgagcaggattctgagatcatggatgcgaatgagcaacctcaagctaaagttacacgtagcatcgtgtttgtgactggtgaagctgctccttatgcaaagtcaggggggctgggagatgtttgtggttcgttaccaattgctcttgctgctcgtggtcaccgtgtgatggttgtaatgccaagatacttgaatgggtcctctgataaaaactatgcaaaggcattatacactgggaagcacattaagattccatgctttgggggatcacatgaagtgaccttttttcatgagtatagagacaacgtcgattgggtgtttgtcgatcatccgtcatatcatagaccaggaagtttatatggagataattttggtgcttttggtgataatcagttcagatacacactcctttgctatgctgcatgcgaggccccactaatccttgaattgggaggatatatttatggacagaattgcatgtttgttgtgaacgattggcatgccagccttgtgccagtccttcttgctgcaaaatatagaccatacggtgtttacagagattcccgcagcacccttgttatacataatttagcacatcagggtgtggagcctgcaagtacatatcctgatctgggattgccacctgaatggtatggagctttagaatgggtatttccagaatgggcaaggaggcatgcccttgacaagggtgaggcagttaactttttgaaaggagcagtcgtgacagcagatcgaattgtgaccgtcagtcagggttattcatgggaggtcacaactgctgaaggtggacagggcctcaatgagctcttaagctcccgaaaaagtgtattgaatggaattgtaaatggaattgacattaatgattggaaccccaccacagacaagtgtctccctcatcattattctgtcgatgacctctctggaaaggccaaatgtaaagctgaattgcagaaggagctgggtttacctgtaagggaggatgttcctctgattggctttattggaagactggattaccagaaaggcattgatctcattaaaatggccattccagagctcatgagggaggacgtgcagtttgtcatgcttggatctggggatccaatttttgaaggctggatgagatctaccgagtcgagttacaaggataaattccgtggatgggttggatttagtgttccagtttcccacagaataactgcaggttgcgatatattgttaatgccatcgaggtttgaaccttgtggtcttaatcagctatatgctatgcaatatggtacagttcctgtagttcatggaactgggggcctccgagacacagtcgagaccttcaacccttttggtgcaaaaggagaggagggtacagggtgggcgttctcaccgctaaccgtggacaagatgttgtgggcattgcgaaccgcgatgtcgacattcagggagcacaagccgtcctgggaggggctcatgaagcgaggcatgacgaaagaccatacgtgggaccatgccgccgagcagtacgagcagatcttcgaatgggccttcgtggaccaaccctacgtcatgtagacggggactggggaggtcgaagcgcgggtctccttgagctctgaagacatgttcctcatccttccgcggcccggaaggatacccctgtacattgcgttgtcctgctacagtagagtcgcaatgcgcctgcttgcttggtccgccggttcgagagtagatgacggctgtgctgctgcggcggtgacagcttcgggtggatgacagttacagttttggggaataaggaagggatgtgctgcaggatggttaacagcaaagcaccactcagatggcagcctctctgtccgtgttacagctgaaatcagaaaccaactggtgactctttagccttagtgattgtgaagtttgttgcattctgtgtatgttgtcttgtccttagctgacaaatatttgacctgttggagaattctatctttgctgctgtttttttttaatcaaaagagggggtttcctccgatttcattaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35497 - DNA, 418 bp, Triticum aestivum
  Clone ID: PAT_TA_35497
acccttttcggcatcaggcctacattacaagaacattggtgtaaggaatgcttgaactatataccttgtgagtcgtcaagacgcctgttgatcaatgcagtatcatcctctgcaatatccagctttcgctgcagttcggccacttcgtatttcgggtagccgcaggaggagaggcagcctgtgttccaagttaaatcaaggttagtaactgagcatatctttttgatcctccgattgcttccttcggaaggcaatccgagtctcaggggctactgcatatacaacaggtgcattctatcaatatcattcaattggcaaaactacatcacaaacctcaaaacctcttagaaggctcgagaaaggctcgttcaatccgcttttcacggatagaacctttttgaccaccgtagccatcaag

SEQ ID NO: 35498 - DNA, 639 bp, Triticum aestivum
  Clone ID: PAT_TA_35498
gccggccggtcccggatcacacaaacttttacaacaatctgatccatccttgtactttaccacccaaccttcatctcaaacatcatgaagttcatgcccatcctccttggccttgtagccaccagcatcgctcagcccatcgccaagcgtgccgtcttcacacaatcaacatatgacgatctatctatcagcggcggcactgcaggcaacgcccaacaagaagctctgcagaagcttggtggcctgcccaacgacctgtcaaccgtcgagaaggccgacctcgatttcctgaacagtgtcaaccaaatcgcgaatgacgcggaaaaagaagcgtttaaccctgctatcgatgcagcctctggagaggaggctgacgctcttcagcgaggaaagattaagaacaaggtcctgaagcttaccgctaccattctaaagctcgaggcacagcaggcccaaggtgacgatgtcgctgataaactggcggatgagaacaagatgctacagaacaacatttcacaagataaggaggctgcaggccaagcctctacgtttctccctttcaatgccagtacatagttactcaacataccaaataaataccacaatcttctgcaaaaaaaaaaaaaaaaaaggccccta

SEQ ID NO: 35499 - DNA, 435 bp, Triticum aestivum
  Clone ID: PAT_TA_35499
ggcgggatcaacaccacaatatacccacacagatcactcacaatcccctcaaatcaaaatggtctacacaatcgttgttcacctctacgccaaggacgatgaggagtccctcaagaagctcaccgccaagctgatcgaggctagccgcgtctactcccaggacaaggagactctctcgtggcacgttatgcagtccacctctgacaagcgcgcctttaccattgtcgagcgatacgagcaagagagcagccaaaagtaccacctcgagaacccttactggaagactttcgacccttacgtcattcctcttctcgagaagcccatggatttgcgacgatttgaggagcttgatactagcaaggacgtcgaggttccccaatagattattaacaagatcaattaactatcgaaaaaaaaaaaaaaaaaaggccccta

SEQ ID NO: 35500 - DNA, 476 bp, Triticum aestivum
  unsure (1)..(476): unsure at all n locations
  Clone ID: PAT_TA_35500
ggccgctcgannggccggcggggccaggcatcaacaccacaatatacccacacagatcactcacaatcccctcaaatcaaaatggtctacacaatcgttgttcacctctacgccaaggacgatgaggagtccctcaagaagctcaccgccaagctgatcgaggctagccgcgtctactcccaggacaaggagactctctcgtggcacgttatgcagtccacctctgacaagcgcgcctttaccattgtcgagcgatacgagcaagagagcagccaaaagtaccacctcgagaacccttactggaagactttcgacccttacgtcattcctcttctcgagaagcccatggatttgcgacgatttgaggagcttgatactagcaaggacgtcgaggttccccaatagattattaacaagatcaattaactatcgaataaaagaattaccgccaaaaaaaaaaaaaaaaaaggccccta

SEQ ID NO: 35501 - DNA, 504 bp, Triticum aestivum
  Clone ID: PAT_TA_35501
cagccgggccgggccggaaacttgaccccaacacaacaacatcacctccaactaccattcataatgtctgccccatacgatcccaaccaaggctactaccctcctcagcagggtggatatccccctcaaggcggctaccctcccccacagcccatgcagtaccagcaagcgccaccaccccaagaagaaaagagccacggctgcttctacacatgtatcgccacactctgctgttgttgggtctgcggagagacctgcgagtgttgtcttgagtgcctcgactgctgctgttaatcacaccacctgcatttctcccccccccccctccaaacaaagcgcttggagataataaagaatgcatgatttttattgccctttttctcattacccctacatagctactgggtctctcatccagcttctttttttgtagctctcaaataacggcctaaacacaataccacacatgtcatcaacgaaaaaaaaaaaaaaaaaaggccccta

SEQ ID NO: 35502 - DNA, 827 bp, Triticum aestivum
  Clone ID: PAT_TA_35502
ctgaagggccgtcgaagactacgacgttgataggttgggtgtgtaagcccagccgtcaccaccaaattttccacgtcgacaacctcaaccaccgcaaagatggccaacatgcgcgttcagtaccgccgacgcaacggctacaacaccacctccaaccgaacccgagtcatcaagactcccggtggtgatatccgtctgcttcacatcaagaagcgaggcactgtccccaagtgcggtgactgcggctccaagctctctggtatccccgctctccgaccccgcgagtactcccagatctccaagcccaagaagaccgtccagcgcgcttacggtggttctcgatgcggtaactgtgttcgtgaccgtattgtccgagctttcctcattgaggagcagaagatcgtcaagaaggtgttgaaggagcaggagcagagccagaagaagaaataaatgcaatcctaatcggatttggctttctgcgtgggaatggcaaggacctctggggattcggttcattgctttggtgttcattaggcaaaaagggactgaatgcatgatacatcgggccgcggccagaatggatggccctctgctgtcttaggactgctactatcctcttggtgacttgaatgacaaaagaacatcaagctggcgtggaccgctgccattcgcacgagtgatgattctgtggactggtcaatgtgtgtatctcaatgcacattggcgtgatgtgaaataaaagctaccggcgccagacggtcaaaatatacaagcctgaaattttctgatacatgaaaaaaaaaaaaaaaaaaaaaaaaaggccccta

SEQ ID NO: 35503 - DNA, 702 bp, Triticum aestivum
  Clone ID: PAT_TA_35503
gccgcgccggcccgtgcgggaacgagcccatctcttcgcccagccgtcaccaccaaattttccacgtcgacaacctcaaccaccgcaaagatggccaacatgcgcgttcagtaccgccgacgcaacggctacaacaccacctccaaccgaacccgagtcatcaagactcccggtggtgatatccgtctgcttcacatcaagaagcgaggcactgtccccaagtgcggtgactgcggctccaagctctctggtatccccgctctccgaccccgcgagtactcccagatctccaagcccaagaagaccgtccagcgcgcttacggtggttctcgatgcggtaactgtgttcgtgaccgtattgtccgagctttcctcattgaggagcagaagatcgtcaagaaggtgttgaaggagcaggagcagagccagaagaagaaataaatgcaatcctaatcggatttggctttctgcgtgggaatggcaaggacctctggggattcggttcattgctttggtgttcattaggcaaaaagggactgaatgcatgatacatcgggccgcggccagaatggatggccctctgctgtcttaggactgctactatcctcttggtgacttgaatgacaaaagaacatcaagctggaaaaaaaaaaaaaaaaaagacccctaaaaaaaaaaaaaaaagaaaaaaaaaggccccta

SEQ ID NO: 35504 - DNA, 367 bp, Triticum aestivum
  Clone ID: PAT_TA_35504
atcgaagacaaaggagtagtgtagttagctcagctgtgctcatctgcctctgttgcagaactgaattcctgctcgtatggttggactgatggatcaggggtgtagtaatccttgtttttcgaatctatagaggttggattacctgattgttcttggcaaacaacatttatccgccttcttcagtcaaaaatacgtcgggaacaggtaaaaacaggcaaaataaaaaaaaaaaaaaaaaaaaaaaaaaaaaaaaaaaaaaaaaaaaaaaaaagaaaaaaaaaaaaataaaaaaaaaaaaaaaaaaaaaaaaaaaacaaaaacaaaaaacaaaaaaaaaaaaaaaaaaaaaaaaaaaaactcctctaaa

SEQ ID NO: 35505 - DNA, 1925 bp, Triticum aestivum
  unsure (1)..(1925): unsure at all n locations
  Clone ID: PAT_TA_35505
aataaaaaatccatctccattcccggcccggatccgtcccagacgagaagcaaaactcacacaaagtcacaagaatgatgaacccaaagagccgtgtccaagagtgggaggccgaccacatcgagctcatcccggggatgcccgacgacgtcgccgtcgactgcctggcgcgcgtcccgcacgggtcctaccgctcgatgcgccgcgtgtgccgcggctggcggagcgccgccgccgccccggagttcgccctggcgcgcgccgaggccggacgccaacgaggatctggtctttctcatgcagtttggcaacccggtggccggggacgacggggcgcccgagaacaccccggcgtaccggcgtggccgtgtacaacgtcaccaccggggagtggcaccgcgagagctcggccccgccggtgccgatgttcgcccagtgcgcggccgtgggcacccgcgtcgccgtgatgggcggctgggaccccaagaccttcgagcccgtggcggacgtcaatgtgctggacgccgccaccggcgtctggcgccgcggcgcgccgatgcggtccgcgcgctccttcttcgcctgcgccgaggcgggcggcaagatctatgtcgccggcgggcacgacaagctcaagaacgcgctcaagacggcggaggcgtacgacgctgaggccgacggctgggacccgctgccggacatgtcggaggagcgcgacgagtgcgacggcatggccaccgtcgccggcgaccggttcctcgccgtgagcgggtaccgcacggggcgccagggagggttcgagcgggacgccgagtggttcgatccggcgacccgcgagtggcgccgcctggagcgcgtgcgcgccccgccgacggcggctcacgtggtggtgctcacgtggtggtgcgcggccgcgtgtggtgcatcgagggcacggccgtgatggagtggcgcggggagcgccggggctggctcgaggtgggcccttacccgccaggtctgaaggccggcacggcgcgcgcggtcgccgtggggtgggccctgacccgcctggtctgagggccggcgcggcgggcgcgggcggcggcggcggcgcgcgagcgcgtggtggtgaccggcgccatcgagtcccgagggacggcggcggcgggcacgcgctgtgggtgttcgacgtcaagtccaagaactggaccgtggtgcgccctccgccgcagttcgccggcttcgtcttctccctggcctccgtccgcgtgtgatgagaaccctccccggcgccgctcccgaccaagaagactactactactactagcgagtatgtatgcatgttcttgagttgcagtgcttctgccattgatggaactgagatccgcgatctcatcgcctgagatctgcgcatcccggatgaatcatcgccaggaaaaaagaagaaaaaaaacaggaggcatcaatcatcgccaagaagaaaacaacaaaaataactagaggattgtagcttgtcctgtcagatctgtgcgctctagtcaccatggttgtgaactctcctccctcccctcttctgctgttgagacagcctgccatttctgttgttgagacagcgtggtgttttggttctacagtatgatattagcaatgagtcgctgtacatattattgtgagttggaagatcatatcatgtggtttctccatagttctataaagaaatcgctgccccacggatcgccgcccccgcgccatcgtcttgtcgcttctttccccacattcttcaattggctgaccgctccctcgcggccgggctgcctgcaacncttnncaaatcattggatgggatggtaanaccccatgaactagaaggaatcgatccatgngcaagtggtctcatnaanacagtcnaaacctttggctttgcataaggggtggcactaacg

SEQ ID NO: 35506 - DNA, 698 bp, Triticum aestivum
  unsure (1)..(698): unsure at all n locations
  Clone ID: PAT_TA_35506
gccggccgggcttcgatttttctcttgctgcttcttcatcacccttcaaagctcgcaaagtaatctctccgttcccacaacacaatggccgctatcaagtctctcatgacccgcgactcggtcgcccaccagctcgccaagcgccagaactgggcttctaaggaggctggtgttatcgtcgtcttctgcatcgtcggcgttgttgccattggccttctcagtctcttcttttacaagaaggctgctgctcgcaaggctaacaaggcctccgccgtctaaaccgaatgttcggagaagaccgaggttagggagagaatggagggtgacctgaggcatagtcatgagcgtctttcgactatttgcctcaaaagtagacgcggtgttacgtcaaggtgcctcctgcgacacttcgggtgaccgacagtgaccccgtattccagtcaaacatcggctacgtccctcatcagctcatcgcttgccagttgccagtcgaatccccaacggccagcagtcttggcttgcatttcatcgtacataccaccggatctcgtgggacaaatgtgctggaggacgggttctcgtcgagtgttcgcggctaggtggctgtattctatattctaatgctactgatacctacctgtttgaagcaaacaataatgattctttacatgaccaaaaaaaaaaaaaaagggccctan

SEQ ID NO: 35507 - DNA, 642 bp, Triticum aestivum
  Clone ID: PAT_TA_35507
ccggccggttcggggaccttgaccacctttaaaccctctctcgccacagtgagaagcgccttggttctttaaacttgtcaatcgcatcttaaaacactccatacaccactcagtccagtaatcgccatgtcccgcaagagaaagcaagacgaagaggaggagctcgtctccctccccgaagactccgatggtgaggaggaggaagagtacgtctctaccgcagacgaagaggaacagagtgaagaagatgaagacgccgaagaggaagaggaggaggatgatgatgacgaagacaaagaagccgacgcaaaggtcgagcctcctgtaaagaagcgcaagacggccgaggcggacgaccaagaactcaatggcgacgctgaggacgacgaggaagaagaggaagaggagaaggaagagctagatgacgaggaggatgccgaaggcgatgatgaggcagccgatgttcctgctcgaaccaaagaagcagtcaagacggctgaggcgcctgttgctaccgagactccagagtccaaagcggtcacggccggtggtgacgagtaatatcgaagagatagcttatctgtcgtatagtaattcgctccttgtattcgaaccgaaaaaaaaaaaaaaaaaaggccccta

SEQ ID NO: 35508 - DNA, 1054 bp, Triticum aestivum
  Clone ID: PAT_TA_35508
ctgtgcgccgctcgagccggccgggccgggaccctcgttgtcatatcaaatctgtcactcgttagaccagactaccattcccactctcgctttttaactacattactcaactaattctaatacccacacctccaaaaaccatcaacatgcgtttcacatccatcctcgctgccggtgctttcgccaccatggcctctgcccagagcaagaccgtctctatggaccctgctcaggcttcccagatggactgcctcaaggactgtgaggctggcgatgtcaagtgccagtcttactgtatcactgttccttctcccaacgagcaggacattgagaagaccaccaagtgtgttgccgcctgccccaagggtaagggctccgaggccgatacccagaagtacaccacctgcatgaacgagtgtatcgccgacaactactggaagtccgttgacggtaccccccgtggcaccgacgtccccgatgtcaagagccaggcctccgaggctgcctcctccgccgctgacaaggccaccgctaccggtaccgcttccgagtctgatgctaccgccactgctgccgctaccaactccgagtctggttctgaatccagctccgaggagaccagcactgccaccggctccggcactgccactggcaccgctgcagaggtatccgagactggcaacgccgcctcttctctcattggtggtgtctccttcctcggtctcgttgccgctatcttcgctctgtaaattgggtttcctactttaggataatctggttcgacaggacggaaggatttaatgggttttactagagcggtaatgattggagtttgaatttcaagatgtgacacatgttggacagcatgatgaaggcctacgggctgaatcgaatttcatggacaaatttttgtttttttgggtaatcatttcgcgttcacatatggctcggcatatgagcatgaatacaatacctcttttttgcgcctcaaaaaaaaaaaaaaaaaaaaaaactaaaaaaaaaaaagaaaaaaaaaaaaaaaaaaaggccccta

SEQ ID NO: 35509 - DNA, 483 bp, Triticum aestivum
  Clone ID: PAT_TA_35509
gccggccggttcggggacgccctcaccttacgaagctcaattgaatccgcaaccatgggttccgaagcaatcactgagccgcggcaagcgacccgcgaggagatgcgcgatgccaaactccctctggcctaccgagacagctgcgcccaccttctgattcccctcaacaagtgccgtcgggatacctggtatgccccttggaagtgctccgatgagcgacacagctacgagaagtgccaatacgtcgagttcaagaagcgagtcgccaagatggacgagttgagggagtcgaagggtggtgcacgaagcaactagagaaagacaaagagaccgaattcaaatcccgggtacagacagggccgggccggaattgtacatttacaaacaagccgatgcgtttgacaagagaaccggaatagaaagaggccattccacacaaatgaaacgattcaagacgagcaaaaaaaaaaaaaaaggccccta

SEQ ID NO: 35510 - DNA, 978 bp, Triticum aestivum
  Clone ID: PAT_TA_35510
cgctcgaggccggccgggcttcgaacatcccactctaccaaatcatttacttctttttgaacccaaccatccatccaaatcatcccatccccaataccaacaaccaaactacacttgtatcacatcaccgccaccatgcagatcttcgtcaagaccttgaccggcaagactattaccctcgaggttgagtcatctgatactatcgacaacgtcaagtccaagattcaggacaaggagggcatccctcctgatcagcagcgattgattttcgccggcaagcagctcgaggatggccgcaccctctccgattacaacattcagaaggagtcgactctccacctcgtcctccgccttcgtggcggtatgcaaatcttcgtcaagaccctcacaggcaagaccatcaccctcgaggtcgagtcatccgacaccatcgacaatgtgaagtccaagatccaggacaaggagggcatccctcctgatcagcagcgattgattttcgccggcaagcagctcgaggatggccgcaccctctccgactacaacatccagaaggagtcgactctccacctcgtcctccgccttcgtggtggtatgcaaattttcgtcaagaccttgaccggcaagaccatcacccttgaggtcgagtcatccgacactatcgacaacgtcaagtccaagatccaggacaaggagggtatccctcctgatcagcagcgattgattttcgccggcaagcagctcgaggacggtcgaaccctctccgactacaacatccagaaggaatcaacccttcacctggtccttcgtcttcgtggtggacagtagattatgattagtaacgacatgattgaacggcgggtgttatccggttaaattagtattagttatcaataggcctggggggctcaggcacgatgagcaacggcatgaattcaaccaatattcttcgttgaaaaaaaaaaaaaaaaaaggccccta

SEQ ID NO: 35511 - DNA, 823 bp, Triticum aestivum
  Clone ID: PAT_TA_35511
gccggccgggtcaggatccagcacgcagcgacaattctcatctcagagacgagcaagaagcaagcccaaggcaacaagagcagaggaaacaggcacagacagaggacatggacatggacatgacatcttcctcggcgccggcagcgtcctacttcaacttctccgtggcgcaggccgtggtgaccatctccatcaacgtcatcctcgtctggctctccgccctcgtcaagtcctccacctcctcctcctcctccgccagccgccgctcggccgcccccgcgccggagccggagccagcgcagcctgcgccggcaagtggcgcctccgaggtcgacctggacgtggttctcggggtgatgggcgcgggcggcgccgcctcggtcgggttcgaggaggcggcggcgctgttcgaggaggaggaggccaccgtggaggaggccgcggcggcgttccgcgtcttcgaccgcaacggcgacgggttcgtcgacgccggagagctccggagcgtgctgaggtcgctcgggttcaccgccggcgtcgcggccgcggaatgccagcgcatgatcgacgcctatgacgaggaacaaggacggccggatggacttccaggagttcctcaacttcatggagaggagcagctcgtgaagtggccgccggcgtccgatgaccgatgatttgctcaattcaattggttcgttcgttctgcttatttgtcctttttccggcccgaactggagccgaatggtgcaccgtatatatgaaatccgatactatacacaaaacatatgcttagaatatttttatcaaaaaaaacaaaaaaaaa

SEQ ID NO: 35512 - DNA, 941 bp, Triticum aestivum
  Clone ID: PAT_TA_35512
gccggccgggttccggaacttccatcatcatcgcccaaaataatcaccaacctcatctcatctttgcttccacgagcactcaaatcttacactcacatctacagattatccccaaacaaaatacgaccgcattcaaaatgtctgagtctacatctcctcagaaggtttggctggcctctaatgacagcgcaaacatcgaagtcgaccgcgttgtcgccgagcgatcaatgctgatcaagaacatgctcgaggatgttggtgacgaaatcacccagggcaaccctattcctattcccaacgtcaacgaggcagtcctccgcaaggttatcgagtggtgcgaccaccaccgaaacgaccctcctcaggctcaggatgatgaatccgacgctcgcaagaaaactaccgacatcgaggagtgggaccagaagttcatgcaggtcgatcaggagatgctcttcgaaattatcctcgcgtctaactacctcgatatcaagccccttctcgacgttggatgcaagaccgtcgccaacatgatcaagggcaaggcacccgaggaaatccgcaagaccttcaatattaccaacgatttcactcccgaggaggaggagcagatccgccgtgagaacgagtgggctgaggaccgctaaactgcttcgatcttgctacagaacaaaattgaggggggagtctcgaaccggtttctctaccccgattctcaaatgtgttgccgcagattctttcacatcgcggtcgcccaggcctgaacggcacgaatgttatgagtcacaggggtctcattaggcgttagagtttggttttccgggttgcttggccagaattttggcgcgcgtgaacgccgataaaggcttcttcagcactgcttactgcatgacgttgcttgaaagcacttatcgaaagaaagtctagctagatatcattgc

SEQ ID NO: 35513 - DNA, 975 bp, Triticum aestivum
  Clone ID: PAT_TA_35513
cggccgcccgaggccgccgccggccctttgaacatctcatcccgcactactaacgccagtcccggaacccgactgtacagcaaaaatgtctgacaacggcgagatcgaggtcgagaactccgccctctacgaggtgcttcccaaggatgttgtcaaggaggttggcaacgtcaagctcttcaacaagtgggactacgatgttgaggtccgcgacatctccctgactgactatatttccctgcgaaaccccgtctacgtcacccacaccgctggccgatatgccaccaagcgattccgcaaggccaactgccctatcattgagcgattgaccaactctctgatgcaccacggccgcaacaacggaaagaagctcatggctgtccgaattgtcgcccacgccttcgagatcatccaccttatgaccgaccagaaccccatccaggtcgctgtcgacgccatcgtcaactgcggtccccgcgaagactctacccgaattggttccgccggtaccgtccgacgacaagccgttgatgtctctcctctccgccgagtcaaccaggctatctctctcctcaccactggtgcccgcgaggcctctttccgcaatgtcaagtccattgccgagtgccttgctgaggagcttatcaacgctgccaagggttccagcaactcttacgctatcaagaagaaggatgagttggagcgtgtggccaagagcaaccgataaaaggtgcaatggtgtatcacggttggaagggttggctttggcgtgttccggcttctttcagaattgcattttgcgttcatcgggtctgggaacgcggctatggattttcttaggtggctacagattcaataaaaaagtcgggctccctgagagttaaatgaaatgaacacaaaaaaacataaaaaaaaaaaaaaaaaaaaaacaggcgagagaccgatagcgaaaaaaaaaaaaaaaaaaggccccta

SEQ ID NO: 35514 - DNA, 991 bp, Triticum aestivum
  Clone ID: PAT_TA_35514
gccggccgggtcgccggccggaccgggaaccactaaccgactcttccaacagccgtcgccgacaaaatgggtgctaccgttcctaccaacgaccagatcctggtccccgagacccttctcaagaagcgcaagtctcaggagaaggcccgcgctgagcgcagcgacgccgttgagaagaagaaggctgccaacaaggagaagcgtcaggtcatcttcaagcgtgctgagaagtacgtccaagagtaccgcgatgctgagcgtgagaagatccgtcttcaccgcgttgccaagtctgaggactctgcctacgtccccgctgaggccaacctgatcttcgtcgtccgtatcaagggtatcaacaagatgccccccaagccccgcaagatcctccagcttctccgtctcctccagatcaacaacggtgtcttcgtcaaggtcaccaaggccatcactgagatgctcaaggttgtcgagccctggatcgcctatggttaccccaacctgaagaccgtcaaggagctcgtctacaagcgtggttacggaaaggtcaacaagcagcgcactgctcttaccgacaactccattgttgaggagaacctcggcaagtacggtatcgtctgtgttgaggatctcatccacgagatcttcactgtcggccccaacttcaagcaggcctccaacttcctctggcccttcaagctctccaaccccactggtggcttccgtccccgcaagttcaagcacttcatcgagggtggtgaccttggtaaccgcgagcacgccatcaacgctctcgtccgccagatgaactaagggattgtgataaaaaaggcttttaaggatcggtcaataggacctaatggattcaaaaaaatttgcattggctgctcggcgttttactcatgacagggattcatgacagggatatggaaattgataccttgatgaatgacgcccgagttttcaaaaaaaaaaaaaaaaaaggccccta

SEQ ID NO: 35515 - DNA, 650 bp, Triticum aestivum
  Clone ID: PAT_TA_35515
gccggccgggctgggccttcccttttcttgatcgctctactattgtttcttgttattcttgctctcccaaatacttaccatccttttaatctgtacgtgactggcgcacgacagttctttttattctgtacataatttgaaactcgctatatcaactcgattttcacttcatctcgaacttcacacttcacatcatcatcaccatggctcaattcgattggttttccaaaatcggcgctacagacgaggccgtcgctgtccttaatgatcaacctatactcttcactattcttctggtcgttcttgttgccgtcatcctacagatggtccttctctggtacattcactatgccactatgaagcccgagcagcgcaaggcagcccaggacaagaaggacaagaagaaagcggcaaagaccaaaaagcccgccaacgccagataaaacaacctcactcctataccacctttaccatttatgttgcatcagccaactcaaaccagatccacaagctcaaacccagttcttcatctcacgacctttctttcaatgggatgatcccacccatcattatacagtcctcttgttctgccatgagacaacataatataaatccttatacccgaaaaaaaaaaaaaaaaaaggccccta

SEQ ID NO: 35516 - DNA, 453 bp, Triticum aestivum
  Clone ID: PAT_TA_35516
cgcctgccggtagtggtcctagcagcacgggtcgacgggaagcatcttagtggggcatataaggttgagaaggacaggctcctctctcttatacagaatctggacgtcagggccgaatccacgattttgatgcctgctgagctccaggttaaaactgaagcagagaagaggttgaaagaacttctccgtgaagaagaattgaagtgggctttgcgggctaaggttcgcaaagtagtccaaggggacgcaaatactcaattctttcatctgattgctaatggtaagcacagaaagaagagaatattccaacttgaacaagatgagggcactattttaggacaggataacctaaaaacatatataaccgaatattataggcagttatttggacctccgaaggacagttgtgtgtctctcgatgagtccagaattgacgatgtgcctcaactttcg

SEQ ID NO: 35517 - DNA, 855 bp, Triticum aestivum
  Clone ID: PAT_TA_35517
ccggcccggttccgggaaacctaactatcaattaaaggttctagtcagacatctaaatcattctctatcaactcaacattcttttctctacactcctttaaacacattccaaattaccaaaaatcacaatgcatattcttcagttttccatctttgctgcagccatggctgcctccgccaacggcgccaaggttgaacagcgtgatatcgactcatgcacctcagcagccagcggcctcgttgatgccatgagcgacatgccaactgcagacaagacccttgcgagcttcctcgccaagcagactgacttcgaagatgtcgccgactcttgcgttattcctgcagtcactggatccatggccgctgcctatacttcctacgccaagtctatggagaactggatttctgagttcaaggacgacctctccagcgtttacgatgcttgcaaggacgttccccaagttcaggagcaactcgaatcctacgctattcccagcggactatgctcttcttatgcttgggctaccgcctccgctacggaaaccgctactgcaactgccaagacgaccaactccgtcgcagatacagccacaagcaccgccacagagtctatctccagcatctctacccctagcaacgttgctgagaactctgctgtacgcagtactgggcttggagtcattgccgttgtcgccgttgtcggtctgactgtagctggagctctctagatagatattcagtgtaggagtttattttaccagtcgctgtagacccatagtctcagccttttaaatccataaagcagtcggtttgtcatatcggccaagacaaaaaaaaaaaaaaaaaaggccccta

SEQ ID NO: 35518 - DNA, 518 bp, Triticum aestivum
  Clone ID: PAT_TA_35518
atttcaccaaaagacccgacgacaaacccaccctcagatctctcgtcaattgagtcatcatgtccgccgcacccttcttctggcgagctcccctcaagtactgccgctgggcagcccgcgagcgtcccgccctcttctggtccgtcatcatcggcgctgctggtcccgttgccatgcccattgtacctccgatccgacactactttggcgatattgatgcgcccccggttcctgtgacctaccccattcccaatactcccaggaaacagctcaccggctacgacgattaagatctcgaattaaagaggaaggaaataacacggctcggaacagaaaagaagaagcgagcatacactattgtacaaactacggcgtcaccagagaaagcgctacagcggagggggaggaatatcatagaggaattaagggacaagagtcgacgtccaaaatttaccagcaattgacgctccaattcgattttctacatccaaaaaaaaaaaaaagccccctaagggcct

SEQ ID NO: 35519 - DNA, 771 bp, Triticum aestivum
  Clone ID: PAT_TA_35519
ccggccgggtcgggaacaacattggatcccaacacctcttcttccccgttcttcttgggaacttgatcttcaaaaatccaatctctacaacaccgctactctactctccaccaaccagccaataccatcaccatgtctgccccccagagcgaagctttcaagacggccgtcgaggactccaagaagctcacctccaagcctggtcccaccgagctcctcgagctctactctctctacaaggtcggtaacggtgaagacttcaccaaggctgagaagcccggcatgctcgacctcaagggcaaggccaagtacaacgcctggaagaaggtcgccgaggatgacaagctcactcctgaggccgctaaggccaagtacgttgagcacgtcgagaagctcaagaagtcctgcggctacgacgccaacaaggtccccgagactgttggcgcttaagcgtgcgacttttttatcctctacgaaatagataaactctcaacgatgaaacgaaattaattcaaaagagttggaggccgggccgggatatggaccctacaaatgtcggaccaagttaaatggggtgaagccctttggggtttccatcctccgctgccgatagcgtacattatacttagctgagaaatcataccctttcgttttgcgccaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 35520 - DNA, 525 bp, Triticum aestivum
  Clone ID: PAT_TA_35520
gccggccgggtgccggcgaacctccccatccttcaaccgaagcctcacaacgcccgtcgcagacgtccaccaccgactcctagccgtgttccagacgcccaattgcgcaattcagtcaaaatggccttcgccaacaccctctacaggagcctgttctccaccaactacctgatgctcgcgaccgttttctctgccggcttcgcttgggagattggcttcaacaacgtcatggacaaggtctgggataaccacaaccgaggccgacaatggaaggacattcgacacaagttcatcgagggtggcgatgaggacgaggaataaagaggttgaccgggaaattgattatcgagcaacaaacgaggcgagggactgaatccatgtcactagccgtgtacaaattagaagagaattagaggcaggatttcacacacaaggcttccctatatcctttggctagaggtccatacagtttgatgcttgtgttggcgctcgcctactaaaaaaaaaaaaaaaaaaaggccccta

SEQ ID NO: 35521 - DNA, 748 bp, Triticum aestivum
  Clone ID: PAT_TA_35521
gccggccgggttgggaaccactcccggatgctggaatcaccgcaacgttcgacgaccagcttcgcagaacaccggcatcatgtctacccgaaggccccaattctcccagcaggtgcttatcgacaccactccgttgccctcagatattcccgctgtcaaggaggtcggtgccagttctgcgcctcttctttcggcctccttcttcatcggcgcccgatgccgcgactacaacgatgattacatgcaatgcaagaacgagaaccccggccgaggagagtttgagtgcttgaaggagggccggcgagtcacccgatgtgccaccagcgtcatcaaggacatcaacacccactgtctggccgagttccgcaagcactgggagtgccttgacgaccgaaaccaccagctatggcagtgccgccctgctgagtggaagctcaacaagtgtgttttcgacaacatgaaactcgagaagaagattcctgaccagcctaccaactcgactcccgttcacctccgaccagtgcagacctttgccgacgtgcgcatcggccctggtgatggcaagccttttgttccggcgcaggaggatgcgtagcaatagagtgctgggatcagttaaagttaggtcgaggctcgatcatgtatatttgccgatgaatcaaagagtggattaccagctatcaaacaaaattctatccgattttcttacaaaaaaaaaaaaaaaaaaacctagggtcgcgggcgctct

SEQ ID NO: 35522 - DNA, 478 bp, Triticum aestivum
  Clone ID: PAT_TA_35522
ggcgggcgggctcgggaactgcccacacataagaaaaagagccaaacacagctgcccacagattcaacgcccaaacgctcaccgagttcttcaaagctgtaaagcccagagaccagcatataaactccacaaagtcgccaacactctgtcgtaccaatccttgttcttcgctgaggccccagagtgatactcccgatggcttaccggttctcttcaactcaaggcgcatcgccacgttgttgccgtcacgccacatagcccgttctttttgtacaaccaaataaacaagcaattgcagtgctgcgtgaggagaaccttgagggtagcttgcgtgtgatgtactcacgcacgggacggcgcacccgtcggtcaacccagaatttgaaacttgaccaatgtaccgcaaagtagagtatgatagccacaaacaacgaatgcattccaatatgtcgaaaaaaaaaaaaaaaaaaggccccta

SEQ ID NO: 35523 - DNA, 865 bp, Triticum aestivum
  unsure (1)..(865): unsure at all n locations
  Clone ID: PAT_TA_35523
gccggcctcaatcgaaaataagaaccatcaagtttgctcactctcagttactcattcaactctctcatctcaactcaaacaacaacacaacaaacactccatctatacctcaccatgggcgtcagagttgctacccagcaggacatcccagccctcaaggaaatcatcctcaagggcttgtcagaagattccgtcttcaagtactgcttcccttcaacgcgctcagaaacagcgacaaatcacgtcgagacggtcctcaagagaatcattgacccagaaaacgccagctggttgtgttttgtcgttgatgctcccaagactcacgaccctgtttccttggccatctgccaaaccatccaccagaatgccgatgggcaaaagggcgttgccgagcaggctgagcaagtctttggcctagaagcagacgacaaccagacaaagacaataaaacgtctctctgcccttcaacaaggcatcacagagacgcagcaaaagtacctcgttcgtcacaccgagatcatcttcctccatgccgtcatcacgcatccgcactggattcgccaaggtttcgccaagacgctctccaagcaaaccctgcaagttgcccgccaaaagggcgccgtagtagtcgccctcgccagccccttcactggctacgtcttctactctggcaccagcttcgccaactgcggccgcacaaaggtagagaccgacaacgacatcgagaaccttgagctccaaatcatggtctgcactccccccaagcccctcgagcagcgccgtagctccatcatggactacctgngcgggaagaaatgtcacccgctggtagcagacgcgagtcatacgatcaagacgctgctgc

SEQ ID NO: 35524 - DNA, 474 bp, Triticum aestivum
  Clone ID: PAT_TA_35524
agtgctgatgacctgcagtctcttacaacaaacctatgctacacgtatgcaagctgcactcgctcggtgtcgactgctcctcctgcatattacgctcataagcctgcgttccgtgcgcgattctacctaggccaagtcccagacatggcgtcggagataagcgccggcagtgcacctcctccattgatgcttcctgagataaaagatgagctcaaaagccacatgttctactgctagtccatacacacatggatgaagcctgaagcctggagaactctaagattttatttcaagtatacatggcaacctgaagattttattgtttctgttggtttgatgaacatgggaccatctcttgtgtctttaatatttccccacgcgtccgcggacgattggtttatggctttatgcaagggtatgaatggaaagtttacaaaagaaaaaaaagaaggaaaaaaaaaaaaagcgggcgct

SEQ ID NO: 35525 - DNA, 2023 bp, Triticum aestivum
  Clone ID: PAT_TA_35525
cgtccgcggacgcgtgggtcttaacaggaaagatctctctcgcggctttcaaaatgaatttgattatgtgaagattaagaaggccctcaggggtctgagggttgaggtcacccaccgaggacagatgcgcaggaaataccgcattgctggcttgacaaaggattctgcaagagaattgaggttccaattatcgaccggcgaaaccaagactgtgagggactactttcgagaaacctacaagctgcagctgcgttacgattttctccgatgcctgcaagttggtacagagcagaaacccaactatctaccaatagaggtctgcaatatagttcccggacagcggtaccaaaagaagctggatgatggccaggtttctaaaatgatgtctatagcctgccagcatccagctgggcgtgagacctccattcgcaagtctgttctggagaacaaatataacagcgccaaacgtgcaaatgagtttggtatagaagttgacagcaacccaacttctgttcaggctagagttctgcctgctccaatgctgaggtaccatggtactgcgtcttgccacccagaaaatggggcgtggaacatgagggccacccacgccgccgatggtgccaaggttggtatttgggcatgtgtaaacttttgcaatgagttgcctgaggatgaagttcgtatcttctgccacaaactgagtgaaatgtcctccacaactggagtgaacttcaacggtgcaaaacttaagatattccatgctcgttcagatcaagttgaagccaaactccgtgaagtacgtcagcaagcggggaatatgaagattgacctcttacttgctatattgccaaataaaaatggcagcctgtatggtgatattaaaaggatctgtgaaacagacattggtctgatgtcgcagtgttgtctacttaaaaatgtcgagaaatcaagtcctcagtttcttgcgaatgttgctcttaagatcaatgccaagtgtggggggaggaattcggtattttctgatatacaagtaagcttaccagttgtttggaaaaagccaacgattatcttcggtgcagatgttactcatcctagtgctctagatgatactgccccatccattgcttctgttgttgcctcccaagactggcctgaggtgaccaagtatcatggtgatgttcatgcacaaggtcaccgcgtagagctcattgaaggcctcgagggcattgttaagaagctgctactttcgtttgaaaagcaatccaaacagaagccgcagcagctgatattctatagggatggcgtaagtgagggtcagttcagaaaggttctggaggatgagatcccgttgatagaaaaggcatggaaggctttatacagtgagaagccggcaattaccttcatagtggtgcagaagaggcaccatacaagactgttcccaagtgatggcaaatatcaggacaacagtggaaatgttatgccaggcacagttgttgataggcagatctgccacccaacagagtttgatttcttcctctgtagccatgctgggatcaagggaacaagccgtcctgcacattaccacgtgctgcgagatgacaacaacttcagtgctgatgacctgcagtctcttacaaacaacctgtgctacacgtatgcaagctgcactcgctcggtgtcgactgctcctcctgcatactacgctcataaacttgcgttccgtgcgcgattctacctaggccaagtcccagacatggcgtcggagataagcgccggcagtgcacctcctccattgatgcttcctgagataaaagatgagctcaaaagccacatgttctactgctagtccatacacacatggatgaagcctgaagcctggagaactctaagattttatttcaagtatacatggcaacctgttctactgctagtccatacacacatggatgaagcctgaagcctggagaactctaagattttatttcaggttgccatgtatacttgaacggacgcgtgggtcgac

SEQ ID NO: 35526 - DNA, 555 bp, Triticum aestivum
  Clone ID: PAT_TA_35526
aatttccttacatatcaacaacttcacaaactcgataccatttaccatatacccctttacctacctcgaaccctacatcctgattaagccgatcagatcccaaatcaagaacaatggaacaacagccaatcaacacccaagaggccactacgcagcctttgaacgaaactcccgtcgttggctctcctcctcaagaccgcagggcaagtgatgcagcgtacgaccgaagaatgagtgatgagtgggacgcatcaaaggtccctcccagccgcttccagaagcgcaagggatccatctatgctacgcccggttcccgtgacggccacgttgacaggaattacgcagacaagtactggaacaagatgaccgagaagaattggggtagtagtagtaaataaactccgaacgatggaaacaaatgaatttcggacggtggtcccaatgtgtaagatggaaacagagaaatggaactaaggaaataattcgtcatgggggaacgagctacatatatgatttggcgcaattcaattaatcaaaataccacctgtgttacca

SEQ ID NO: 35527 - DNA, 2506 bp, Triticum aestivum
  Clone ID: PAT_TA_35527
agtggagagaaagcggtgggcctccagctgccctctcctcagattgcccccctaggaaacacaccagtgacccgtggaccgtcatatatgaggctgcagccacagcttgtgtccctaccactgcaagcctcccgccccacttacatcccagccctaaccccccgccctacctccctgccctgccctgcggggccttcttttccgttttcttctccacggagctaaccgagcagcaccagaccatcgccggagcaggccaccgacgccagcgtcctccgccggcgttttcctcgtgaccgggagccccgtctgcacgcctcctcccgctactccgacgacctcgagctccggcgcctcgccatgcacgtgataccagatctcctccacttcgggtgaacggcgagaacgtggacaagagcctgatgcaagacttatactccacttgccgttcctccagcaccaccaggggcagcaaaaatgaagagcatactgtccgaacatgctgaaggaaatccacgggtggatcttcctatccatcctcctctacacgagggcgttggtgctgtcctgtggaagcagaatgattttgatgaatttgttgtagctcgtaataacactgatatatgaaacgattgactgctttgaaactctgctacttccgtcctcaacaatgtctgcgagcaaatattttttctggccaaggatcttccagggcaattgtcatcgaaggctcaagctttagtcgaagcactggagggaaagcggtttgattcatttatggacgccttaagagatacagcagaggaaagtggattgttatttaagaagcttgatgaaagacttgagcgatcaatgctgcattcccaccacaaggatttgatagcacaagtttcttcagaaactgatccagtttccttcctcccaaaagttgctgctctactttttctccaggcatacaacaaggctcttcaggcacctggaagtgctgttggtgctgtcatcacactactgaaggacaagctaccagctgcaaccttcaaggttttaactgaatgtcacgccaccaccgtgaaacttctcgcactacaagatgctgctacgggtgatgaagacgattgcacatcggaccgaatgctggagaagaaggaagacctagaagagaggctgatgccagaactcaaatccctggccctcggcacgagcaaagagcagtgagcagcaaacattgtgtgcatgctgatgcacccatccatcgagcatgtaaatgcacagatctatctacctatctatcctcctcggcactggagctgtggctgtttcgtgtgatagcagaatcaacttcttaaatgtttaacgagcaaccacagcatgtatgaacttgttaaacaccttgaaactctggtaccttccccgggcaccggctacgagctatgggtactccaatagtcgacaagattttatctagtctggatagggacaacaaattgaagaatggaatggagtatgaagacagtgaagaacagcatgctcagctgagcactactgaccgcacttttctggcaaaggatcttccagggcaattgtcatcgaaggctcaagctttagttgaagcactggagggaaagcggtttgactcatttatggacgccttaagagatacagcagaggaaagtggcttgttatttaagaagcttgataaaagacttgagcgatcaatgctgcattcctaccgcaaggatttgatagcacaagtttcttcagagactgatccagtttccttcctcccaaaagtcgttgctctactttttctccaggcacacaacaagggtcttcaggcacctggaagggctgttggtgctgtcatcacactactgaaggacaagctaccagcttcaaccttcaaggttttaactgaatatcacgccactaccgtgaaagttctcgcactacaagctgctgccacgggtgatgatgatgattgtgcatcggaccggatgctggagaagaaggaagacctagaagagaggctgatgccagaactgaaatccctggccctcggcacgagcaaagagtgagcagcaaacattgtgtgcatggtggggcgccatgccctcgtgtaaatacacagacctctctatacatcgtcggcgctggagctagggatgcaagcagccaccctgcgacactcggtcaactcagcgcactcatcaagtgaatctagcgtagcatgtcggttgcatgtttgcgccgtgagctcatttgttgccctctggcgtcgcaatttctgaaggaaagggaatccttgtgtgtaatacaccgtgtacattctagggggtcgtgtgacagcagaatcaacttcttaatttttgacgagcaaccaaataccgactgacatcatgtattgaggtataaacaccttgaaactctggtagtcgctataagaacattgactgcaagcaaatatttgtcgagaaccttttatcttgtgaaaaaaaaaaaaaaaaaa

SEQ ID NO: 35528 - DNA, 1039 bp, Triticum aestivum
  unsure (1)..(1039): unsure at all n locations
  Clone ID: PAT_TA_35528
gccggcncgggtcgagacgcccccgacgtcgcgagtgcggcgctcgaggctgtgatctggaggaaggagacatctcacactatctcttcgacagctctttcataaatccaattcccaataatcaacatgtctgactcttacggaaacgacagctacggctccagccgtcgcgacaacgacgacaactcttacggctccagccgccgagacaatgataacaacgactcctatggctcaagcggccgtgacaacaacgacagctacggctccagccgtcgtgacgacgacaacgacaactcttacggctcctctcgccgtgacaataacgagagctcgtacggatccagcaacactggcatcggtggaaacaccagctacggctcatccgacagggacaacaaggacaccttcggctccagcaacaacgattcctacggttctagccgcaatgacagcgacacctttggctccagcaatgacaactcttatggctccagccgcaaggacaacgacagctccaacacctatggctctggcctcagcggtggaaacgatagctacggctcttctcgtgacaacgacaacgacaacagctatggctctagccgccgtgacaatgataacaacgactcttatggctctagccgtaaggacaatgacacctacggctccagcaacaacgactcctatggttccggccgcaaggacaacgactcttacggaaccggaaacacatacggatcctccaacaatgactcctacggctcttctaacaatgattcttacggatcaagcaacacctacggtgatgacaacgacaacaacaagaagtcaggtggcttcttggacaaggtcaaggacaaggttgaggagaaggtcaagggacacaagaaccgtgacaacgataacgagtactaattgtaatatgggggtttggactctagcgtattagttttgagataactgagtgagatgagatattccttgctcttgaattgaagtttcttttgttcaaaaaaaaaaaaaaaaaaggccccta

SEQ ID NO: 35529 - DNA, 986 bp, Triticum aestivum
  Clone ID: PAT_TA_35529
gccggccttcccggggggaagctctaaccaagttggctgctagcctacggaccatcgcttcaacgttaaaaaatcgggcgatggtccggaagctctccagcaaactctgagtgtacagtgggcgagtcgaatgccttttaactgcttgggctgctgcttcgaaactacagagatttcctcttcttctcatccctcttgctactactccagcttgatgttgaggcaacagcacctatctgctatatctcccttttcttcctggttttttcatccaaaatggcgtcccgccccatctttactgccacgcacccccgtgcatgctctacggcttttgagcgagtcttcatggcccgccgcgatatcctagagagcgtccacgagcctttcggagatgccttttactacggtcctgaaattctcagtgatcgtttcagaaatgacacagccactcgtgagcagagtggtttctctcacaagacttacaaggacgtccttgacgaggtcatggatgcgggcaaagatggcaagcgaatcttcatcaaggacatggcttactacctcatgaccccagacagcaagcccaccaaggttgcgccgtctttaggcgaggaagagcctggtaaccccaccgtgttgccactagaggtcctgaagcaattccaattcactttcctcatccgccaccctcgccgagctatcccttcatactaccgatgcacagtgccacctctggatgaagtcacaggtttctatgagttcatgccaaacgaggcaggctacaaggagctcgtgcgattctttgatttcctgatcaaagagaacattgtcgacaaggacaaccttgtcgtcattgacgccgatgaccttctcgataaccccgagaaagacgtccgtctttattgcgagaagactggcatttgatttcagcccgagatgctagagtgggacgaagaagattgttcttacgccacagctgccttttgaaa

SEQ ID NO: 35530 - DNA, 883 bp, Triticum aestivum
  Clone ID: PAT_TA_35530
cgctcgaggccggcgggccgggcccgtccgtgatacctccccgacctagatctaaacttttgcaacctttcagactcagactcagactcttaacaaactcgctcctataccctcacctcacacaacatcaatcatgtcgtggcaagcatacgtcgactcaagccttgttggcaccggtcacatcgataagggcgccatcatcagcgccgctggagacagcgcctgggctgcctctgccgacctccagctcaagcctgaggagatgaaggccatctctgccattgttagcggtgacgaaaaggccaaggacaaggcttttgccgaaggtctctacatcgccggtgagcgatatgtcatggcccgagctgacggccgaagtatctacgctcgatcgggtcgttccggcgtcgctgtcgcaaagaccacccaggccatcgtcgtcggccaccacggcgaggcccagatcgccggtaacgccaccaccaccgtcgagagtcttgccgactacctcatcaagtcgagctactagatattcgttggtgtgcaaggcaaggcgaagaaggggttttgggcggaattatctgtgagaagcgtcataaaaaacgctgtatgtccgtagaccggatagtcaacgcagctgtaacgagcttatgccaggaggagcgcctttgtttttagaacactggagttgggcttcgagcttgagtgtatgtgtgtacttggaggacatttccccggccagagatcggtcaacagagtttgtttctactgcaaaaaaaaaaaaaaaaaggcccctagtgccctccagatcctgtctcttattagatttgagcgaaagggaaaaatatctttaaacgtcaaaaaaaaaaaaaaaaaggcccct

SEQ ID NO: 35531 - DNA, 567 bp, Triticum aestivum
  Clone ID: PAT_TA_35531
gccggccgttactgaactgaagatctccccgatcgatcctcgcattcagcttgtcactctctgtctctcttgtagctcggctcagttgttctgttccctgcaagccgcgaccgatccatgtcgagcctgatagatatttggacggtggaggtggacaggatccgggccatgaggagaacggtggagccgttcagacccacggcttcgcccggcgcacaagaagccggccacgtagctcagccgtccggcgacggagccaaggatcaggctgctggtgctggctcgccggcgtcgccggtgctcgtccgggaggacgccttcttgtccatcctggttgattgtttcggtcagtagattgcaccggtcgaacgctatgcagcaacacgttcctaagctctagctaggtgcaacgcaactgaagtgtctttcgtgattgctgtagcctgctgaattatcaagttcggcggcttctgaatgtctctgttacaatacaaatcaacgcctatctccagtcaaaaaaaaaaaaaaaaaggcccctagacggaaaaaaagttcaaaaaaaaaaaa

SEQ ID NO: 35532 - DNA, 774 bp, Triticum aestivum
  Clone ID: PAT_TA_35532
aattcaccatttatcttttggctagctagatccccttcgaaagcattgcttcaattgccgaaagctacaactctatcgcattacctgaacatatcacgactttcatctcgccataatgtctctcaagggcccctctcctcagcatcacgacggctccggtctgcgcatcggcatcgtccacgcgcgctggaactcgacaatcattgatcctcttgttactggagccaaggagaagctcctggcagccggcgtcaaggaatctaacattgtcattcaatcctgccccggctcttgggagctgcctatcgccgtccaacgcctcttctctgcttcccagatccagggcacctcaactggcggaccctcagctggcgaccttctggcttcgtctaccaccgatctcacttcgctctgctccctccggtgctttcgatgccatcattgccgtcggcgttttgatcaagggcgagaccatgcactttgagtacattgccgagtcaacctgccaaggcctgatgcgcgtgcagcttgacaccggtgtgcccgtcattcttggtgtcttgaccgtactcaccgaggaccaggcaaaggcccgcgctggagttgatggcaagggtcacaaccacggcgaggactggggaatggcagctgttgagatgggggttaagagaaaggagtggtccaacggtactatcgatggttaaaaaagatagatacataaacgcgaaattacaatgcaagtacaatcaaaaaaaaaaaaaaaaaaggccccta

SEQ ID NO: 35533 - DNA, 468 bp, Triticum aestivum
  Clone ID: PAT_TA_35533
gccggccgggtcgggacctgttggtaaccggccattcgacatcaattcaacgtcgccattgcgcaccccgatcctctcctttacgttcattgatagttattcaaaatgggcggcggcggcggaaaagtcccttaccctaagcatgtctggtccccagccggtggttggtacgcgcagcccgccaactggcgcggcaacaccctgattgctggtgtcgtcatggccggtatcgtggccgttacttggaagttcagctccgagcgagaacaatgggcgcaccgacctgagccaggtcaatggtatgccagccgacactggtcaaagcagctgaagcagtgggatgcggaggatcgtgagaactcaacaaagagcgaatagagtctggataaaaagacctgtgtatatttctgcgacagatgaagacaatcttgagttaaaaaacaaaaactaaaaaaaaaaaggccccta

SEQ ID NO: 35534 - DNA, 878 bp, Triticum aestivum
  Clone ID: PAT_TA_35534
gccggccgtctatggaacgctcgacgagacggtgcagtttagtgcccaccaaggcctatctaaatccgcacccagatcatcaacttcctatgtcaacacaggaaaacacccaccgcccaagtacatctccaagatgactgcctccgtggattcaactctgtcaaccgctgtggaaccctatattcggcgcactgtcacggccctcagatcggctgcctccgagcacgatgctgtgaaggaagacaccactctgcaggaggcgtttcacgaagctggtcgaactcttcctcttattcagaaagcacttgaagaatccccagcggaactccagggagtgacccagaagactctggagtcgctgcgagagtgccatgtcaaagccgagatctgcaaggctatcttcctggctgtcgctgatgcgcagcctgagaaaaggcaggaagcctacaaggaggccgttcaaaagagaagcaaaggaaggacagttgaagagttagtaatcgggattgcaactgatatttgcggactgggcgagatacttgtcatccagaagcatgttgagggactacgtggtgccattgaccgcctcagcaagatggagccgtccctgccaaaggcaaagactgacggcgtcttcaacaactatggctccggcgaccaactcaacgctcctggcggtaccgtgaacaagagcacaggcagtggcaaccaatttcctggggctaatttctctgggtcagtgtatttcgacaaggagggctctcgagagcatggaccttaagatacttaggcagagccgatcaagttagctgcgaattaatctgacacaaacttaatttgccaaaaaaaaaaaaaaaaaaggcccctaggccgcggcg

SEQ ID NO: 35535 - DNA, 868 bp, Triticum aestivum
  Clone ID: PAT_TA_35535
gccggccgggtttggattcttctcgtcctcatctgcctcactctcttcatcacataccaactcctctaacctctacaatatcattataattgcccatcatggctcgcaagttcttcgtcggcggcaacttcaagatgaacggctccaagtcgtccatcaaggagattgtcgagaacctcaacaacgctgaccttgacaagaacgctgaggtcgttgtctcccctcctgccctctacctcccccttgtccgcgagactctccgcaaggaaatcgaggttgccgcccagaacgtctacgacaagcccaacggtgctttcactggcgagatctccgtctcccagctcaaggatagcgatatcaactgggctatcctcggccactctgagcgtcgaaccatcatcggcgagtctgatgaggtcatctcctccaagaccaagtacgccaccgagaacggcctcaaggtcatctggtgctgcggcgagtccctcgagacccgtgaggctggcaagaccatcgagttcgtctctgcccagatcgagtctctcaagtctcagatctccgactggtccaacattgtcatcgcctacgagcccatctgggccattggcactggcaaggttgctaccactgagcaggcccaggaggtccacaaggccatccgtgacctcctccgcagcatcagcgacaaggttgctgatgagacccgcatcctttacggaggcagtgtcaacgagaagaactgcggcgagctctccaagcaggccgacattgacggtttcctcgttggcggtgcttctctcagcctgctttcgtcgacatcatcaacgctaccaagcagtaaactaattaattcagtaagtagtggggt

SEQ ID NO: 35536 - DNA, 640 bp, Triticum aestivum
  Clone ID: PAT_TA_35536
ccgctcgaggcgccggccggtccgggagacacttgcttagactcaccaaccgtcaaagcgaacaacaacatccacgatgtccgccgtccgattcacccgcgctgccacgcgcgctaccgcccagcttcgcgctcccgcccagcgccgatttgccagcacacagaacgagttcatcaaggagcgccagcacatcaaggagcacgctgctggtaccactgaactctggaagaagatctccctctacggtgtcgccccctgccttatcgccgccggtgccaacgcctactggctctggagcgagcactgggagcactggtctcacatgcctcctctggaggagcgcaccgagtacccttaccagaacatccgtaccaagaactaccagtggggtaacggagacaagactctcttctggaacgacgaggtcaactaccacaacaaggataagacctcctaagtatgatctgttgatagttcatacgtcagacaattgctggaccacctttttatggactgctccctctggagatgcctcgtacatgttccctagactcgaattgaccgattgttgaagtaaaaaaaaaaaaaaaaaaaaaaaaaaagaaaaaaaaaaaaaaaaaaaaagcaactaaggccccta

SEQ ID NO: 35537 - DNA, 939 bp, Triticum aestivum
  Clone ID: PAT_TA_35537
gccggccgggctttggctgttttgttccacggaaaagtggtacagttgaatgaaaaggaatgggataataaacacgataaaaaaaggcacagatattatctcactcatcaacctcatcaaacactccactattacaaacaactatcacccaacaccacaccaccaccaccaaccatcaatatgcagttcaagactcttctcgtcgccgctggcgttgcctccgctgcccctaaggataccactcccaagaacttcgaattccaaggccttgccctccgctctgcctcccccattcacttcaactacctccaggcttcccaggagtctttcgagctgaagctcaaggaccagaaggcctcttgctacagcagcaaggacaagccccaagaggccactttccagctctacggtgacgagctctggctctactccgtcggcaacccccgccagcaggcctacgttgacttctctggcatgggccagggcaagttcggttacaccactggtgctcagcctgcgcccaagaacgcctcccgcaagggctggaaggtcgacaaggacggcatgctcacctgcgacggtgccagtttcgtcgcctgccccatgggtgacaacctcgagaagacctcttggtctgtctgggtctacaacagcatcaacaaccccggcggcaacaagaactgccttcctttctccgtcaaggccgtcaaggttgagaagcccatcccctgctcttactctgccatccagcccaaggcttaagttctggctgtgatggatagcttctagtatatatttattgttacacctttacgatcatgttggatctagacatagtgagatacttctcagcatattagcgttttgacggggtcgcaaagcctcatttaatcacacaatcaattctgctcaaaaaaaaaaaaaaaaggcccctagggc

SEQ ID NO: 35538 - DNA, 967 bp, Triticum aestivum
  unsure (1)..(967): unsure at all n locations
  Clone ID: PAT_TA_35538
atttccccaaactgtatcgtaaacagttgtttgtgtcaagtgaaagttactgcatatactcgaagaaagcgcatctgcagtttggtagcgtcatttagatccaccaaccgccaactcagctcaagccagcacagccttacctatcaaccgacgcctcaatcgctggtagccgactctactggccggtcccagcaaacaatattcttcccctcacgatattcctgcacagaaacattgtttcattcttttccaattccaattaccacaaaaatggctgcccctgctgaaaagaccatcactgacctcagtggtaaatgggttctcaacaagtcactctctgatagctcagagcccatcctcgccctccagggcatcggctaccttactcgcaagggcattggaatggctacaattacacttgatgtcaaccaatacagtgcccctcctaaagagccaaacacctctactgacgtcttcactcacatcgacatcactcagtctgcctctggcttgacaagcacccaggagaaccgatgtctcgactttgagcagcgtgaacactctgactggctattcggttctgtcaagggccgttcccgattcgtcactctcgatcaggtcgaggacgactttctcaagcagggctggctcgtcgaggccgacggcaagttcgtccagagcatcgcggagagcgttgataatggttgggtcgccaaccagatctggggtttcgaggagatcaagggcgagaggagatatgtcaggcacgtcctggtgaccaaaggttcccagagggttacggccaagctcatctacgactaccaggcttagatcggacagattcgtggtactcctaacattgatagacgattaatgacttgaatactggtttctacctcgaaaaaaaaaaaaaaaaaggcccctatannatgatagatacttgatcaatcaagccaaccagatttgt

SEQ ID NO: 35539 - DNA, 988 bp, Triticum aestivum
  Clone ID: PAT_TA_35539
gccggccgttccgggcttcttcgtagtcgtcgtcgtcgtcttgacagcttgatcgatcgattgatggcgcggaaaggggagggcgcgggtcctaatcctccggcgacgaccatgatctacgcgatggtggcgcgggggacgctggtggtggcggagcacacggcgtacacgggcaacttccgggacatcgcggcgcagtgcctgcacaagctccccgccggcgacagccgcttcacctacacctgcgacggccacaccttcaccttcctcctccaccagggatacgcctactgcgtggtggcgaccgagtcggcggggcgcgaggtgcccctcgccttcctggagaggatcaaggaggagttcaacaagcggtacgccggaggcaaggccgccaccgccaccgtcaacagcctcataacgtggtcgcggccgaggctgaaggagcagatgcagtactgcatggatcacccggaggaggtgagcaggctgtccaaggtgcaggcccaggtctccgaggtcaagggcatcatgatggaaaacatcgacaaggtgatcgatcgcggggagcagatcgacggcctggtgacgaggactgagcagctccacgaccatgccatggatttcaggaccgagggcacgcggctccgccgaaggatgtggtaccaagaacatgaagatcaagctcatcgtcgccggcatcgtcgtcgccatcatcctcatcatcgtcctctccatctgccataggggaccactgcaagtagccatagcatatcatcctagcttcgtccacagcttgaacagaaaatttaagtctcaatcgttgattctataatatattactactatattactggttctcgtgatcgatccgataatgtcacgtcacatgccatgccatggattcaacgcccctggtagttggtctgctcatcagatgtagctcttcgaaaaattctcttttgagaaaaaaaaaaacctgcccgggcgg

SEQ ID NO: 35540 - DNA, 850 bp, Triticum aestivum
  unsure (1)..(850): unsure at all n locations
  Clone ID: PAT_TA_35540
ggccgctcgaggnnccggccgggcctgcggaaccggcccttgatcacacaactgtttgcgatccaacttgacactcatcgaaacttaccatattaaggacttaactcaaaaacaatcacacgctgataaaaccctcacccagattaacctcaaacgcaatcaaaatggtcaacgaacaagatcgtgagcacctccgcctcgccgtctcactcgcccacgaagctcttaaggcaggcgacgccccattcggctctgtactcgtatcatcagacaataaagtcctccagacagactgaaaccgcaccgtcacaggttccgacggcgacagtcgccccgacgcaactctgcacccagagtttacgctcgcgcggtgggcacaactcaacctcagcgccgaggagcgtaagaactctactgtgtacacgagtggagagcactgcgcaatgtgttctgctgcacatgcttggtgcggtctcggaaggattgtgtatgtttcttcgacagagcagttagaggcttggaagaaagagtttggtgtcgaggcgcctgttgcgcctctgagtatcaaccaagttgccccagggctccaagtggaagggcctgttgaggatttggctaaggaggtttatcaacttcatgttgagaattggacggggaagggatttgagtccaagtctaaggcttgagtctgggaatgttgaagcttgtggtactatgatgagcatagcaggtgtctggcagcaacctattgaatgcatatctgtttttattgtagctccaagacgtatgaggaaagaatttaggggatgcatgccaaaaaaaaaaaaaaaaaggccctaaggccggggcc

SEQ ID NO: 35541 - DNA, 475 bp, Triticum aestivum
  Clone ID: PAT_TA_35541
gccggccgtttccgccggcacgacgaccaattcgtcacgcgaaccactttagcaagacaccaatcgccgtcaatcaaaatggcgcacctcaacgtcaagccggacccggcctacctcaaatatgcggccatgatgaagtcgcgccatcactacttccgatggacgcctcgaaccgccaagatcaccttcatctacgttggtgtgatccccgccatcatgggctacattgcctacaagaccgacggactttgggacttcagggcgaagcgaaagggcgacctcgtctacgagaaataaatagaacgagaatcggagatttgggatgtgtacatttaaagcgtcatacctgggatagagcccacggtagagattcaattaaaacgaggtcaagcaaaaaaaaaaaaaaaaaaggccgctagatttatttgaatatatccaaaacaatttgtagaaaaaaagaattaaaaggccccta

SEQ ID NO: 35542 - DNA, 1285 bp, Triticum aestivum
  unsure (1)..(1285): unsure at all n locations
  Clone ID: PAT_TA_35542
cggccgctcaggcggcggtccggttttcaaagaggggctggcggctatggttgacatggaggcggccccggttatggccaacctggcggcggcttcggcggtggtggtatgggaggtggccgcaaaccgggaggtggaggcatgggcatggcaggaggcgctgctctcggtgccggtgccggtctgctcggtggcgccatgctcatgaactcattcgataatgatgagcaagaggcctatcaagacggtttcgaggacggtgctgatttcgacggcggtgactaaacaccaaatcacgctgtacatgtttgattgagtagtatgcttggtatgctgctggaatggaatcgggttgctacgctttatgacttttggaatgacaaggaattgggtattggataaataagcgtaccactacgttgagccgtctgtcagatctcggcaggatctcagactggagcctaagaatcaaatcaatcgaataatgatatccaaaaaaaaaaaaaaagacccctttcacaacttgacattgactttaaggaaggcggcgaactacaacgaccgagagtctattccctaccgcgcgaaaaacgaaagaaaaaaaatcaaaatcacacaactcatactcgcctgatcgaccgccttatagactgctcacggcagcccctgttctcgacaattcgtccctactccgacgacaacctcatacccgccatgtccgaagcctacgagcgagagcgccagaacaatgcgcgcctcgacgaactatccgccaaagtctctgctcttcgtggagtgacagtcgacatttacggtaatgcccgagcccaagatgtcattgacaacaccgtccgtccacctcttctcgcccatccgctacgacgacatagctgacgtccaacagtctgatactttctcctccatgaccacacagatgaagggctctgccggtcgcttgactcgcatggccgcatctggcaaccgtgttgcgatccttaaattgtcgggaatcgtaattggcgttttcttggtgttgttctacggtgcaaaactgattttctaagacttgggagcgcaggcgtctactatgaatttgagaagtgctataatgattagagcggaaatggggtgcctgtcatttttgctgtgtacggccaggaaaatacgactggagggatcccagacatccaagtgtccacaaccaggaagctagagagtatccccttangaagttactggttcggcagcgnttgggtcggcgttacttgaatacattcacatcgaa

SEQ ID NO: 35543 - DNA, 783 bp, Triticum aestivum
  Clone ID: PAT_TA_35543
gccggccggtcctgaaacccgttctccttctccgcaaaaaaacagctaatctcgacgaactgatttctctctccagttgtcggtagagttcgtaactttaggtccaaatgggggtctctggctgcaacaacaacaacggcaagacgctgctgctcgtggcctgcttcctcctcctggtggcttttccgttcctgcatggagtcgggtgctttgccgtcacggaagtgacgagtccagaggaagccgccgccaagcggaagctgatggtggtggggagcacgcgggcgctggagacggcggcgccgcagcatcagcatggccggggctcgggcgtgtctgccatgtcgggcaatgctgccggtggtctctggtcgtccaaatccaagccggccgttgatcgcaggttgctgccggcaggagctggccattcgtgcggctccaacggtggccagggctgctccccgtatgaagaagatggcgctctgcatgcactagtactcctatgttggttcgtccccattcgttcgtcgtggctaaagacaagtagtagaaatactgatatgttggttccttgttttagtactagtatatgaacttttttttagggtatgtgctagtatatgaactgtaaagtgttgaaacggcttaactacagctcgatctatcctgtaaatatactccactgtggtgttgtaataaaaaaaaaaaaaaaaaaaaaccctcacgaacatgcatgccttttccttctcaaaaaaaaaaaaaaaaaggccctaaggcctccag

SEQ ID NO: 35544 - DNA, 944 bp, Triticum aestivum
  Clone ID: PAT_TA_35544
gccggccgggatacggaccaaacaaatccaatcccctctccgcgatctcaccgagaaaatcctcgaccgatcggaagacaagcgcccctcacgctccttcaagatgcagatcttcgtgaagaccctcaccggcaagaccatcacccttgaggtcgagtcgtctgacacgatcgacaatgtgaaggccaagatccaggacaaggagggaatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaaggccaagatccaggacaaggagggcatccccccggaccagcagcgcctcatctttgccggcaagcagctggaggatggccgcaccctggctgactataacatccagaaagagtctaccctccacctggtgctcaggctccgtggaggcatgcagattttcgtcaagaccctcaccggcaagaccatcaccttgggaggtggagtcctcggacaccatcgacaatgtgaaggcaaagatccaggataaggagggcatccctccggaccagcagcgcctcatcttcgccggcaagcagctcgaggatggccgcaccctggcagactataacatccagaaggagtccaccctccacctggtgctcaggcttcgtggaggcatgcagattttcgtcaagacgctcaccggcagacacattacccttggaggggggagtcctcgggccccattgacaatgggaaggcgaagatccaggacaaggagggcatttccccggcccagcggcggctgttcccgcaagcagcttgggatggcc

SEQ ID NO: 35545 - DNA, 479 bp, Triticum aestivum
  Clone ID: PAT_TA_35545
gccggccgggtcgggtcttcagtgggagtctgacttccttgcccacctcaagaccaacgagaccgagctccttgccactattgacaaggagggcgccatctccaaggacactgaggccaagctcaaggacgtcgtccagtccttcgtcaagagcttcctcggttaaatgtaatcaaaagcaacttgtgcggagaatagcgggggcctttggggatgtcgctgtctatatcgaatatctattgtcgtttttctctcttgaggcggagggaacatgtcgaggggtcgcgcctggatggagcgacgggattgagttgagggagattcgcccgtcgtattgccacttgtaaaatagagcacaaaactcaatgaatgccctcgattccttttgttctcgaaaaaaaaaaaaaaaaaaggcccctaaaaaaaaaaaaaaaaaaaaaaaaaaaaaaaaagaaaaaaaaaaaaaaaaaaggccccta

SEQ ID NO: 35546 - DNA, 561 bp, Triticum aestivum
  Clone ID: PAT_TA_35546
ggccgctcgagccggccgggttcgggattaatcaaatataatcatcaacaactcacaatggccactgccgaaaccgtcgatctgggctctgctcatcctcccaaggaggattcaatcgttgcctttgagcaagtactgccagagctgaagaagacgctggttcacctccgacacgactacaacaagcacgaaccagagtactttgctgcggttgaaaacctctcagaccacgacctggttggtttcagcgccgataatttcgagtccgtccgtgctgctacttcagcatatggaatccatctctttggaaagcttcgaatccctgccatgtctgacccttcaggcccagcttacgttcatttccgcatcttcattggcggtggtgatgagcctcccaagcttcattgcattcacactgaagagcgtgatgatcccagcggtggaaagacgtacaaagccatcttcacaaaggacgacgagcttgagtggtttgatacctaattagaataataatgagaattttgtttgcgaatgtaaaaaaaaaaaaaaaaaaggccccta

SEQ ID NO: 35547 - DNA, 1791 bp, Triticum aestivum
  Clone ID: PAT_TA_35547
tcgccgccgccgccgcctcctcccaatctactctgaagccaaatggccgctgcaccatcttcgacttataggtgcgtacctgctgtttcttctgcttgatgttgatttccgtttctttgcctcggcccgcccgccgccgccgccgccgccgccccccattctactcccttgcccaatggccgctgcaccatcttccactggcagcgatgaagagccaacggcaacgcctaccagaggaatcgaaggaatcagatctacaattaatccaggaaaccttccctgcccagtggtgtgtgcaacaggcgagcaagtaggagtgtctggttccaagagaaagcgtcggaagcattacgtttaccttgtttttgatgactggtcgtacggatatagcatccacaaggtaaacttgtttccctgctctcgccgacgtaagcagactgcattctcagcaccagccgatgtgccgtgcctgcctccggcactcttccgcttggaggcagcgcatgggtcgccagagtacttcgcctcagcctttggcaccaggatcttggcgatgcataccagggatcccggaggcaagagattgttgtccgggaccttcgtccccatgttggacgtctcctcgctgagcatgaccttttgccctggccaggaatatccgattaatcccatctatctctccgtcggcaatactaggctattctgtctcagcgaagcctccttcgagatgctccactgggaacctctctgccccccgccgctgggtcgacgtcgcagcaaggagtggtcgtggcaacggcttgagaaaccgccattcaagagttataacgtcacgtcctacgctgtgcatccccagagatgtaccatcttcgtcagcaccaagatgaacgacattgaggccaccttttcctttgacatggaaaagcaaaagtgggaacaacttggcagttgggcgctgcccttcgcaggccgtggtcactttgatccgtacctcaatgcctttgttgggctctccaaagattctgacacccttgggcaagtctactcctgctgcttgtccagctccagcactggccacggccttgagtggaagctcggcaaggagaggctgttcagtcaggacccagctgagaggcatgtaggcgccaccctagtctacgtgggccagagcaaattctgcttagtgcagtgcgtctccattgaggatgaaagcgatggtccgaagcttaaggaagagggaaatgtgggcggacctgtttaccgtaccgaggaccggggtgctgatctgaagctcaatgaaggagatgttcaggagctcaaggaagagggagatgttcaggagctcaaggaagagggagatgtggatggtcccggttactctattgaggacgagggatatgatcaggagctcatggacgagggatatgatcaggagctcatggaagagcgatatgtaccttgttgctgtctgtatcgtttgaccacattttctctcagctatgacatcaaaggagacctgacgactggcaatagttgtcgggtgctatactataaagtgcctgaagcgatcacttcgtcattcctcgttagaagatcctgtcgcattttgcatgtaataaagtgctctgtggtattcagttcctttgtttacttttcccttggttgtggctcaatgtcatttttactttaatgtattaccttcctatgtttatgtgcatgagctccatgaatgtctcttctttggtacatatgaagactagatgacctgccaaatgacgcataggcccattt

SEQ ID NO: 35548 - DNA, 774 bp, Triticum aestivum
  unsure (1)..(774): unsure at all n locations
  Clone ID: PAT_TA_35548
aattccactctaatgaacttncatggtggagagataaatggtaaacatctgctatttaattggccaacaatcacaagtgccttacgtaaacacctgcggactggcgacgacctcacctcgttgatttgggtgcggcttcttcccgcccggccgtcacgaccgattgctcaattgaacgctgcccaattcgcccaacatgttcgtcgcacgacaaagggcagccttcgtggctcgacagctgcagcgaacagcacgaacctacgcctccgacgcccacgcccaccacaaggccgccgaagtcaacgagtccttcagcaccggatctctcttcgctgtcgccggtttcttcggctccgttctcgtttaccagtttgttcccgccgagggcgagcaatctgcaatcctcaacttcatcaacaagtacacttcgcgcagcaaggactgggaggaaatcaacgctcttcacaccaaggccatggagcaggctggctacgaccgaaaccttttcgagaacggcggcaacaagcaccgattcgtcgatgttgcataccccgaggcaatttcctcgtacgccaaccgaaaccacattgctggtcaccttcccaacatggattacgttgttgagcactaccgacaacagcaccttaaggaggaggagcgaaaagcgaccaagttggcacagaagcaggaataagggatgtacactagacgtgaatcgatacatgaattcatttttcattgagttaccaaaaaaaaaaaaaaaaaaggccccta

SEQ ID NO: 35549 - DNA, 663 bp, Triticum aestivum
  Clone ID: PAT_TA_35549
gccggccggttcgggaactttctgatatcctcatgtaaaactaaaagaaacatcattagagctaaagcccaaaactcttctcagaatgtctacagcagctgcaggtcaagtgcctgctaagaagcagcaagatcttcaagtcacctattccaactacaagaacactcttcagcaaatagcccagagaattggtgatatcgagcaagaagccgaggagcacaagctcgttttggagaccctagaacccctttctgaggatagaaagtgcttccgtctcatcaatggagttcttgtcgagaggacggtcaaggacgtggtcccagccctcaagacgaaccaagaaggacttcgcaaggtgctggaagatttagtgaagcagtacaaaacgaagcaggatgatcttgagaagtggaagaaaaagcacaatgtgcaggttgtacagcaataatgaatgagactacgaggtcagaattaaacaaaaagatttcctgttatacaagagcactcaggtcttgctcgaaccaccgaacatcatgacttctgccgcggacgttgagaatgctgagaatattaaatacatcacatttgacagagcgttttacaaaaaaaaattgataaattcattctttctgacagtaaaaaaaaaaaaaaaaaaggccccta

SEQ ID NO: 35550 - DNA, 1319 bp, Triticum aestivum
  Clone ID: PAT_TA_35550
cgcacgaggctgtactacgccgtcgcgaaggcgcgcccgggctcgcgttcccggccggcgtgtgctcgaccatgggcctgggcggccatttcagcggcggcggcatgggcatgatgatgcgcaagtacggcctctccatcgacaacgtcctcgacgccacgcttgtcgacgccaacgggaggctcctggacaaggaggccatggggagcgacctcttctgggccatccgcggcggctgcggcgggaacttcggcgccgtgctgtcgtggaagatcaggctggtacctgtcccgtcgactgtgacgttctccaacatccaaaagaccattgaccagggcgcggccagcgccgtgaccaaatggcaaacgctcgcgccggccctccccgaggccctcagcatacgggtgatcgtgcgccggcagcaggccgtcttccagaccctgtatctcggcggctgcagcgcgctggtgcgcgcgatgagcagcctgttcccggagctcggcatgacgcgcgccgactgccgggagatgagctggctgaagtccaccgtctacatcaactccggcgacaccaagacgccggtggagacgctcctcaaccgcacgaccagcctgagcacgttcaccaagaacaagtccgactacgtcaagcaagccatcacaaaggacacgtgggacaagatcttcccctggttcaacggctccgccgcggggctcatgatcctggaacctcacggcggaagggtcggcagcatcgccgatgaggacacgccataccctcaccggagcggcgtgctctacaacatccagtacgtcgcgttctggacgggcaacggcacggacgggccggactggatcagtggtctgtacaacttcatggagccgttcgttagcaagaacccgaggggtgcgtacgtgaactaccgggacctggacatcggggagaacgcggtggtcggcggtgtcacgagctacgaaagcggcaaggtgtggggtgagagttacttcgggggcaacttcgagaggctcgccatcaccaaagggaaggtggacgccggcgactacttcagaaacgagcagagcgttcccccacttctctcgaggaagtgaaagactgaaagtgtaacctggcagtctaatttgaggacatacaactataaattctacacttacggaatcctggtagggatttcttgcttatggacttgcccctgccccctaatttcatatgcctaatcttcaccatcattcgacaagccagtctgtaacagcaatcctgtaagggtctgtccgacgaggcaaatttgacaaatttgacta

SEQ ID NO: 35551 - DNA, 845 bp, Triticum aestivum
  Clone ID: PAT_TA_35551
gccggccgggtccggatacaacgcagtctacctctagtcaatcgctacctcgttgtgcctcttacctaccttaattaataactcagtcattctttcaatcccacaaacccaaccaaccttcaaaatgaagtacactatcgctaccatcgctgccttcgccaccatggccctggccaagcctgctttcctcaacactgacttcgctctcactgagggcaagccttacaccatccgctactctggatgtgactctggctgcaccatcatcctccagaacggagagtctaccgacctcaaggactacaagaccttgaccagcggcgccaagggtgactctttcaccttcactccttctcagctcccctcggacacctacaacttcaagatcaccgactctgctggtgacatcaactacagcgctcagttcacctacgagggttcttacgacgctccctccgtcacctccgctaccaagtccgctgtcgagaccaccgctgcccagaccaccgagcaggctaccactctcgccagtgtcaccaagcctgtcgaggaggccaccactgctaagcccatcattcccactcacgtccccgttccccccaagaacgccaccactcctattgctacccccaccaagaccggcggtgctggccagactggtgtccctgaggttcccgtcagcggtgctacccgcatgacctcttccctggctctcattgccggtgccgccatggccatggtttacctcaactaagttatggacatgatttttctgcacgaatacgcgggatgagaaagagcggtttgatgagattcaagtcttcggggtataattctactttatg

SEQ ID NO: 35552 - DNA, 498 bp, Triticum aestivum
  unsure (1)..(498): unsure at all n locations
  Clone ID: PAT_TA_35552
gccggcggccggggagcttcatcctttccaaccacaacaaaccgcctctacctctcttcccacacgaacaacacgcgcgagatcacacgatgactgtctttccggagcagatgttttgattttgaacagctttgtctgagcggtacgctctgcgtcttgccgtgtggcatgtttgctcgaggtggtttgtttggcttgcaaagaatatttctttgcagccttgtatccagcttggatcctaatgatttatgaacatttgctatacccgaaattaaccaacgcagcttcgcgaagctttctacccactaacttctagatgttgccatggagattactcccaagtcttaattaatagtaataataaaacattttctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggccccta

SEQ ID NO: 35553 - DNA, 504 bp, Triticum aestivum
  Clone ID: PAT_TA_35553
tgtgcgccgctcgagccggccgggtcgggacttttgcaggagtatgggtgtttatttctggaatgcagtgcgaaaaccaaagtgaacgtggagcagtgctttgaggagctcgtgctgaagatattggacactccgagcctgctggcggatgcgtcgtcgggggcgaagaagaacatcttcaagcagaaggcgccggaggctgatgctgcggcgagcggctgctgttgatttcattcacgcacgctaatcccgggcatctatctatgatctatctttatctttgtggaggatggatgaaaacgtttgttgtttgacgaagtgacatctaagcagctcgtttgtgtcgttttcaaaaaaaaaaaaaaaaaaaaaaaaaaaaaaaaaaaaaaaaaaaaaaaaaaaaaaaaaaagaagaacaaaagaataaaaaataaaaataaaaataaataaaaaataaaagatcataaaaaattgttttttaaattcaattgaatggaagtagtt

SEQ ID NO: 35554 - DNA, 1461 bp, Triticum aestivum
  Clone ID: PAT_TA_35554
cggctgtcgatttctccttctcctcaccgcaaagcaaaccctcctctccccgccgactagtcaatagtaagtagatctcttctccgatccgatccgatccggccggcgatcccgcgcggcgcggcggagggcgggatcgatctcagccatggactcttcttcctcgtcgacggcgtcgtcttcccaggcgcaggcgcagccggacttcgactacctgttcaagctcctcctcatcggcgactccggcgtggggaagagcagcctgctcctccgattcacatcggactccttcgaggacctatccccgaccatcggcgtcgacttcaaggtgaagatggtcaacattgccggcaagaagctcaagctcgccgtctgggacaccgctggacaggaacgatttaggaccttgaccagctcttactacagaggggcacaagggatcatcatggtgtacgatgttactcgccgagaaacattcacgaatctctctgacatatgggccaaggaaattgacctgtattcgacaaaccaggactgtataaagatgcttgtcggaaacaaagtggacaaggaaagtgagagggctgtcaccaagaaggaaggcattgactttgccagggaggtatgggtgttaatttatgggaatgcagtgcgaaaaccaaactggatcatggagcagtgcttttgaggagctcgtgctgaagatattggacactccgagcctgctggctgaagcgtcgtcgggggcgaagaggaacatcttgaagccgacggcggttgagtctgatgctgcggcgagcggcctgctgttgatttcattcacggacggtagtcccgggcatctatttgtgatctatctatctcgttgtggaggatggatgataatgttggttgtttgtataaatcacttattagcaccttgtttgaatcgttcctcttgtggttgcataaaagtaaataaaatacattggtagctttctggctctccatcttatttaatcattataaaaaaaaacagaataccttggcagctatataatgtacgtattattaagcttaagctgctggcggatgcgtcgtcgggggcgaagaagaacatcttcaagcagaaggcgccggaggctgatgctgcggcgagcggctgctgttgatttcattcacgcacgctaatcccggacatctatctatgatctatctttatctttgtggaggatggatgaaaacgtttgttgtttgacgaagtgacatctaagcagctcgtttgtgtcgttttcttttgcttgtgttgctgtatatgatatgaatcagtgggtcagttgatgctcctcatgttgaatcatcacaaaacaaaacagagtaccttggcagctatataatgtacgtattattaagctctataaatttactcacgaggaatcaatctatttgtgctgaaaaaaaagaagaagagaaagaaaaagg

SEQ ID NO: 35555 - DNA, 547 bp, Triticum aestivum
  Clone ID: PAT_TA_35555
gtgcggcgctcgagccggccgggccgggagttaaatcacaaattcagtcgttcaaatccaccaacctcactcaaatcactcaatcaaaaggcacccagtatgagccaatacaccacaattatggacggtgtgttggtgaccgataacgggatcccacccccagcgaactgggtgaacacttacgaggacatgggtggagacatgctttggggtcaagctggtcaaatggaagatgaggttcgtgggcgtggcattgagggagatatcagaccgcactatggtatggcaccatacactggagaggcactctacctcttcgaggtcggcagcagccagttctacctctttaatgctattgatgggtctatgttgatgattaaggatcagacggatctgaagagcatcgtggatatccttgatgatgataacaaagggttgcctgcgctggatattgaggaaatttagcctcgcacttgatgcttacagcctcagctctaagaatacaaacaagatctagtacgaaaaaaaaaaaaaaaaaaggccccta

SEQ ID NO: 35556 - DNA, 783 bp, Triticum aestivum
  Clone ID: PAT_TA_35556
gccggccgggccgtgtcgggagcctgcattatcgatcgacaactgccccgacagaacgaacgacgatgtcattcactctcaccgtccgccagggccctgcgcgtcttgcgcagaggcttcctgagctatcaaagactgctttccgcaactccgcatcagcccgaagcttccacatccaggccaagcccacagccaacttcttcacctcacgcatcacatcaaccgccacccgcaatgtcttccagcgaacgagtcgcgccggtggccgttcttaccaccagggttccccaactggtgtcgcaacagcgcctcaatcaaccagccggcgactcttggtcggaggtgccatctttggtggtacccttgtcgctatcaacgctgtcttcaaccgggagacccgtgaggatggtggcatgcccgtttacgagcgcgaatacctgaacaataccttcttgcacactggtctcggaattggtatcattggattgacggctcgacaaatggttcagactggcttcgtgtaccgaattatggtcaccaacccttgggttgttgggtattgggtggtcttgctctcagctttgctaccatgattggaacccgatctatcagccctgacaactatatccccaagtacgccatgtggactgccttcaacgccacccaggctgcctttgtcgcccctctcctcgccttcgttcctcccgttcttctgggccgtgccggtctctacacgttggcaatgatgggtggtctcgctatcgtcggtgcactgctaagcag

SEQ ID NO: 35557 - DNA, 519 bp, Triticum aestivum
  Clone ID: PAT_TA_35557
ggccgggccgggaccctcgctgctcaagacagcttccagcctcctacacacagagctaagcgtctgcttgctatcatctcacctcgtctcctctccgaatcaccatcggcagctaccagatggctcgcctcgccgtggtcgccgccatcatggccctcctcgccgtcgccaccgccgcgcagggccccatgccggcgcccaggatggccccgctaccggcgcctccggcgaggtcgccgaccaccgcccctgcgccggtcgccaccccgcccaccgccgcgtcgccgtccccgatggcctctaccccggcccctaccaccgacgctccctctacgatgacgccctccgtgccctccgccacgccctccggtgcccccaccggcactcccgcgagctctgccgagaaatcgtccgccgccagcttcgtcgcagtcgccggagcggtcgccgtagcggtcatgttctacatggagggacgatgactccgcttcgacttgtttatacgatttacattgagtc

SEQ ID NO: 35558 - DNA, 696 bp, Triticum aestivum
  Clone ID: PAT_TA_35558
gccggccggtttgggaccaactcgctgctcagcacatcttctagccttgtacacacagagctaagcgtctgcttgcttcatctcatctcggcctctcccgatcaccatcggcagctaccagatggctcgcttcgccgtggtcgccgcaatcatcgccctccttgccgtcgccaccgccgcgcagggccccatgccggcgcccaggatggccccactaccggcgcctccggcgaggtccccggccactgcccctgcgcctgtcgccacctcgcccaccgccgcgtcgccgtccccgatggcctctcccccggccccgcccaccgacgcgccgactgacgctccctcagcgatgacgccgtccgcggtctccgccacaccctccggtgcccccaccggcactcccgcaagctctgcagtgtactcgtccgccgccaccttcgtcgcagtcgccggagcggtcgccgtagccgtcatgttctagatggagggacgactctgcttcgtcttgtccatagaatttagattgtttctgcggattctttattagagaccgaatggagattacacgacattgctatgtaatcttgttacacatgcatgagattattatgaatatacaattctttcattaatctaaaaaaaaaaaaatgagattattatgaatatacaaattctttcatttgtttaaaaaaaaaa

SEQ ID NO: 35559 - DNA, 774 bp, Triticum aestivum
  Clone ID: PAT_TA_35559
gccggccggtccgggattttttgccgggtctggacaatcaaagactttaccacagaaattatacaacaacatccaacatggcctctgctactagcttttacgactttaagccgcttgacaagcgcggccaggaggttcccctcgccgactacaagggcaaggtcgtcctcatcgtcaacactgcctccaagtgcggcttcacccctcagtacgccggtcttgagaagctctggaccgacctcaagggcaaataccccgatgactttgtcatcctcggcttcccctgcaaccagttcggcggccaggagcccggcaccgacgatgacattcaggagttctgccagctcaactacggcgtgaccttccccatcatgcaaaagaccgaggtcaacggtgacggcaccaaccctctctgggtctggctcaaggaccagcagtccggtcttctcggcctcaagcgcatcaagtggaactttgagaagttcctcgtcggccgtgatggaaaggtcaagggtcgatgggccagcaccaccaagcctgagagtcttgagaagcctattctcgaggcccttgctgagaagcctgcggcttaaggatcatgatgaacgacgaaacaagaaaaatgcgtctttgtcaatccccaccaatctaaaacgagatacccagttggggaggaacaagggcgtagtgtgtaatgagaggcttccagactcatggaaaacagctaaataaattaatacaatgatcagtcataatctggtcaatatttggtgg

SEQ ID NO: 35560 - DNA, 849 bp, Triticum aestivum
  Clone ID: PAT_TA_35560
gccggccgggtgccgccgggaagccggagatcatcaacactcgcccttttttccctcccatctccctctcctccttcaccagcagccgccgaaatgttctcgcgacaggtcctccgcgccgcccgagtcgccgctccccagcgagccctcgccctccgagccgcccccgtccgatccttcgccgccgctgcctcgtccgatgtcaagtctccggtttccgtcttcggcgttgatggcacctatgcctctgctctgtacactgccgccgtcaagacttccagcgtcgatgccgctgccgatgccctcctcaagctcggcgctctcatcgagaaggaccccaagctcgtcgccgtcctgaagacccctaccctcgccgatgccgacaagaaggccatcgtcgatgagctcgtcaagcagatcaacaccaaggacgagaccgtcaagaacttcctcgccaccctcgccgagaacaaccgactcggtctgattcccggtgtcgtcgacaagttctccaccatcatctctgccgcccgtggtgaggtcgagctcactgttaccagcgctcaggccctcgacaagcgaacactcagccgacttgagactgctgtcgccaagtcctcttacgtcggccagggcaagaagctcaaggtcaccaacgaggtcaaccccgatattgttggtggactcgtcgtcgaggtcggcgaccgaaccatcgacctcagcgtctcttcccgcatcgccaagatgaacaagctcctcacggacactctgtaaaaccacccatagtataaattctatttagtgtctcctttgcgccgtctcgtggaagtttcatcaccacgcaaaacg

SEQ ID NO: 35561 - DNA, 947 bp, Triticum aestivum
  Clone ID: PAT_TA_35561
cgagggcaagggctacatgctctacgtcaacgacggtgtctacggaaacttctcaaacatcatgtttgatcaccagcagcccaccgccaagatcctgcgcacctctggcaagaccctcttcgagaccgccgccgccgaacccactcccgtgggcgagggcttcgaatactccatttggggtcctacctgcgacggtatcgaccgcatcactgatagcactcgtttcgaccccattctcgacgtcggcgactggctttactttgaggatatgggcgcatacaccaagtgctctgccactcagttcaacggcttctccaacgctcacgacgtcatttacgtctgcagcgagccaggtgccaaggcccttctcggactatgatctctgcaatgtcacaaacgtgctagactagatctttctttctggccaaacacttttttttcgttttctctttggagaatctttttttttgaaaacttggtttgagatccatcaaaatcgatggcaactacagtatgtctgtccacgtgagagcattagaaaaaagacaagaaaagacctagatagagtcgttagactgattttcaatactaacataatgtccttcttgaaaaaaaaaaaaaaaaaaaaaagataagaacgctagcaagtggggcgagcacaagaagatcacccctggagccaaccctgacccgtccagccagcttacagctattggcgccaatggaaccattcacttgttctaccaggctcagggcaacaagaagatcactcacttccgcgagaaggctgttggacagtaggtttagcagtggtgtttcctctagcgttatctgctgtggctattggttaagttactgaagagtagtcgtatactggagtcatttggtagacatttaatcaatcaaagacaattcagcttgaaaaaaaaaaaaaaaaaaggccccta

SEQ ID NO: 35562 - DNA, 1227 bp, Triticum aestivum
  Clone ID: PAT_TA_35562
gcggccgcttcgaggccgggccggccggggggcggaatcccatcaacacagtctacctcaacagcctttgacatacatactactctctacatctttcttcaaacttgattctatttcgcaaacatggctcccatctctgttctcctcaacagcaacgtcacagacgacaaaggcctccaagtcttctacgttaccagccaggataacctgggtgttgccctcagaaactctgctgccaaaggcgttgactcgcaggacttttacgaggcagctgccgatgcgcatgtcggtctcatccccgtcaagtccgagattggcagtgccgtcatgaacggtctcaatctcgtcgtggccatcaccaagcacaagctgaaggatgaatgcgagaagcccactcttaacgatgtctccatcgtgagccctgtctaccaggttctcgataccactggtatcaccaacaccaccgctgccatcgtctccaacgaggacaacagtaacgcatgggtctactacttgaagggctccgatcctaaggagatccaaatctgcgaatatgagttgaccaccggcaacatcggtcccatttcgaaccttaatattgatcctgactgctcgctcggggctttctatgatacaaacggcaacgggagatccatcatctaccaggataaggatcagggccacatcaaggaataccaaatagagtccggtcagaccatcgacattggcgactctgccggtgccaaactaaacactagtctcgctgtcgcctactttgagggctacgcctacctttactacactgatcagttcatgaacctgtaccgcatcatcaaggataagaacgctagcaagtggggcgagcacaagaagatcacccctggagccaaccctgacccgtccagccagcttacagctattggcgccaatggaaccattcacttgttctaccaggctcagggcaacaagaagatcactcacttccgcgagaaggctgttggacagtaggtttagcagtggtgtttcctctagcgttatctgctgtggctattggttaagttactgaagagtagtcgtatactggagtcatttggtagacatttaatcaatcaaagacaattcagcttaaaaaaaaaaaaaaaaaaggcccctaaaaaaaaaaaaaaaaaaaaaaaaaaaaaaaaaaaaaaaaaaaaaaaagaaaaaaaaaaaaaaaaaaggccccta

SEQ ID NO: 35563 - DNA, 726 bp, Triticum aestivum
  Clone ID: PAT_TA_35563
aatttcaaaaccgcccccgacgtcgcgagacctcggtgaacctcttcaacaatgtcttctcctcgtccttcttcccccgtcaacggcggcgctgctgccagcggtgccaacatcggccgaccctcatcacctgctatccctggtggtccccgtactgccatccgacgacgcgctgccgccgaccagaaggagaagattgccaatgcccgaccaagcagcactcgcgccgctggcgccggtggttccagcagcaccatgctgcgactttacaccgatgagtcgcccggtctcaaggtcgaccctgttgttgtccttgttctctctcttgtctttatcttcagcgttgttgctcttcacattatcgccaagattacccgaaagttctccagctaaacggttgcgaaaaagtctcatttcacgacgaagctcgaagagaaagggagatgatgatatcttttgtggacgctgctatttcttgttatcacctgaacgtggctggcgtagggcctcttttccacacatgaagttatgtgatgtgaacgacgcgccacacccgcaactgggagaagggttaggttaatacggccaccggaaattttgtttgtttggtattgcggtttatgaggggagcctttgtattatatctcgggaaaagaagggtccaaaccgacaatctggactttgactgttttaacgcactaaaaaaaaaaaaaaaaaaggccccta

SEQ ID NO: 35564 - DNA, 1022 bp, Triticum aestivum
  Clone ID: PAT_TA_35564
gccggccgccggccggctctggattctttgcaccatcatcaattggcagagaaacaacaatcatgttcaaccttcgtcgccttttcgcgtcggccctgttccttgggctcggcctcctcttcctcgcccagacggccgaggctgccaagggtcccaagatcacccacaaggtctacttcgacatcactcagggcgaccagcctctcggccgcgttgtcatgggtctctatggcaagactgtccccgagactactgagaacttccgcgcccttgctactggtgagaagggcttcggttacgagggctctgccttccaccgtgtcatcaagaactttatgatccagggtggtgacttcaccaagggtgacggcactggtggcaagtccatctacggtgaccgcttcaaggacgagaacttcaagctcaagcacaccaagaagggtcttctctccatggctaacgctggtcgtgacaccaacggctcccagttcttcatcaccaccgtcgtcacttcttggctcgatggcaagcacgttgtcttcggcgaggttcttgagggctacgaaattatcgagaagatcgagaacagcaagactggagcggcggaccgacccgtcgaggctgtcaagatcgccaagagcggcgagcttgatgtcccccctgaaggtattcacgttgagctctaaagaggcaacatccgttttgcacttgtccagtccgctctcgccaccattgataaacttccaaaaaggcggaatttgctgatgcgtagcctctgtcccgttaggccttgtcggcacatctgaattcgctgccgaagaggttgcctccgctggctggtctcctatgcagaaggctggcctctttgccatctttgctggtgtcctctttgttggtctccgcagcgcccgacagcactctcgattctaaacgactcgagacccggtaccacctacataaagaacaagacaagacaatgcaataccttacaatcctaaaaaaaaaaaaaaaaaaggccccta

SEQ ID NO: 35565 - DNA, 907 bp, Triticum aestivum
  Clone ID: PAT_TA_35565
tgcgggcgctcgaggccggccgggttggtattctttgcaccatcatcaattggcagagaaacaacaatcatgttcaaccttcgtcgccttttcgcgtcggccctgttccttgggctcggcctcctcttcctcgcccagacggccgaggctgccaagggtcccaagatcacccacaaggtctacttcgacatcactcagggcgaccagcctctcggccgcgttgtcatgggtctctatggcaagactgtccccgagactactgagaacttccgcgcccttgctactggtgagaagggcttcggttacgagggctctgccttccaccgtgtcatcaagaactttatgatccagggtggtgacttcaccaagggtgacggcactggtggcaagtccatctacggtgaccgcttcaaggacgagaacttcaagctcaagcacaccaagaagggtcttctctccatggctaacgctggtcgtgacaccaacggctcccagttcttcatcaccaccgtcgtcacttcttggctcgatggcaagcacgttgtcttcggcgaggttcttgagggctacgaaattatcgagaagatcgagaacagcaagactggagcggcggaccgacccgtcgaggctgtcaagatcgccaagagcggcgagcttgatgtcccccctgaaggccttgtcggcacatctgaattcgctgccgaagaggttgcctccgctggctggtctcctatgcagaaggctggcctctttgccatctttgctggtgtcctctttgttggtctccgcagcgcccgacagcactctcgattctaaacgactcgagacccggtaccacctacataaagaacaagacaagacaatgcaataccttacaatccaaaaaaaaaaaaaaaaaaggccccta

SEQ ID NO: 35566 - DNA, 1066 bp, Triticum aestivum
  unsure (1)..(1066): unsure at all n locations
  Clone ID: PAT_TA_35566
gccggccggttcgggatccttttctcatcgcccatttcttgcctcccccattccttttcctctctccctttcctttctctttggttctccctcgggtttcgcattcaactctttctttctttcttacttacggtgcagctcgacctcttctccaaccttgtctttcatttactttcatctcactcacttgtggcctgtttatcttgactgtacttcatttgtaatactcaccgcttttgtttccaagatggcctgcatattcttccccacgccgcgtgggttatctgctccgttctcgcgttgacattatcttttgaatcaccttcgcttgccacatacctgcatgaattatcaagaagacttagaccgggcactcggcccgctgtcctttcctcattcacctccaaatttcgctctcttgacaccaatcgtttacgcctatgttacgcttaaccgcccatcctttatccaaacggactcgcctcagtttcagcatgcatctttaacactcgtattctccttaatgtgacggccatcaacaaaacaaccgtttcgacacaaaacaagatgtaagtggctactgtggctaacactcgcagagctacttgttcaatttttccatgaagcagccctagatcaaccccatgtgatcgggcgtcaagatcgcgccagcagttcctacgcgtaggacctcgccatgcttggctgcgctatcaagtaatatctttttttttttaaagaagcacaccgtcggccagactggtcacttccgaacgagctccgcatagcagcatgaccgacatgtgctaagaaaggatgccggggggatgagtgattggacttgactggatatgatgtgacgtgggaggcttaatattgtatattaaagaaagtcctcttgatcactcatgaaagcgaatcttgtgtggtcatcaagactctgagacaagcaatgagacagatctttccancnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35567 - DNA, 598 bp, Triticum aestivum
  Clone ID: PAT_TA_35567
gccggccggttccggaactcacacactatactatcacatcaatcttcacttccaaccaaccgcagtcatgtacttcagcaagaacgccatcttcgccctcgttaccagcgttggattagtctcagctgccctccccaaagccaacgagtacaaaagccacgattgctccggagatttgaactacggccaccacgccttcgaccttcacatggtcaccatggacgactctagccattcggtttaccaagcaggtactggttggtacctcttcgacggaaagaccggcaacggcggacgctgcgagggagagattttgggaacggtcatcagtgggacttctaactgcttggatctggataacaccttccctggaaagcgtatcaggtgtctttgcaaccctctcattggggctaacaagaatggcatcaactcttgccagtacgcttaggaggggtttgagtacgtgttacagtggtatcaataatagcaaaatgtctgtgcttggttgtttatcgacaaccgcctcaaaaaaaaaaaaaaaaacgatcctaaatgaaaccagatataaacctaaaaaaaaaaaaaaaaaaggccccta

SEQ ID NO: 35568 - DNA, 1014 bp, Triticum aestivum
  Clone ID: PAT_TA_35568
aaaataatgaattgtgtggcgcgggccgcgccgggaaacccaagcggcccaagccagaaactcctattcacgatgggtagagttattcgcaaccagcgtaagggtcgtggatccatcttcacggccaacacgcgcctgaacaaggctcctgccaagtttagaaacctcgattatgccgagcgccacggctaccttcgaggtgtcgtccgcgagatcgtccacgatgctggtcgtggtgcccctctcgccaaggtcgtcttccgtcacccctaccgattcaagcaggttaccgagaccttcatcgccaacgaaggcatgtacaccggccagttcatctacgccggaaagaaggctgccctgaccgtcggcaacgtcctccccctcggtgagatgcctgagggtaccgtcgtctccaacgtcgaggagaagatcggtgaccgtggtactctgggccgaacctccggcaactacatcaccattgtcggccacaaccctgatgagggcaagacccgcatcaagctcccctctggcgccaagaaggtcgtccactccggatcccgaggaatgatcggtatcgtcgctggtggtggccgaactgacaagcccctcctcaaggcttctcgtgccaagcacaagttcgctgtcaagcgtaacagctggcccaagactcgtggtgttgccatgaaccccgtcgaccatcctcacggtggtggtaaccatcaacatattggtaaggcttctaccatctcccgatacgccgcccagggtcaaaaggccggtcttatcgccgcccgcagaacgggtcttctccgtggtacccagaagacaaaggagtaaagtggtggctaggttcatggtctcattgggatggtgtttactggcttgcttgcatctattgaaggtactgccaagagcagatggctggtagctccgagggcaagtactatggcatttggcgcaaaaaaaattctgaaggccgtttctctgcaaaaaaaaaaaaaaaaaaggccccta

SEQ ID NO: 35569 - DNA, 1388 bp, Triticum aestivum
  Clone ID: PAT_TA_35569
cggcacggggttcccggcagccacctccgtcgtcgtcgctactgacgcggcacgagccggcgaatccgacaggccccctacgtctcctcgctcgccgcgagatcccgcgtccatggcggtcggcatcgcgctcctgctcgaccttgcggcccgcgcgccccgctcctccgcctcgctccactcgcacgccgccttctccgccgccgccgccgccgccgccgcggcagccctgtccgcctccggcgtacccctctccgcgcggccattcttcggttttccaggattcactgttgctcattgtgatgctggtgcaacttatggatcgattgatagtcctgatcttgccaatgatcttattgagaagatacatgactcgattcatgatctccaattaccgataaaagaatacccgttggagctgaagccgcttttgtatgcatttggctttaagcatttcagtatgacgactattagggcctttttattatactatttaccacttcagcagcctcgtccgccaactgatgacgatgaccatgacgatctgcttcaaccatgattcagcgaggccgccggtcgagatggttcatccctcgctaaaagctttgagaccaacagctcctgcgactactgttggaaccccaggtcgtgcatccttaaaggttagctgcctggcttttttgacgaacgtgaagtgtggaacctttgggaattgagtccaccctttcaggatattcaattggcctaacttggggctcaaacgttgatgaataactatgcatgcatggttaatagcttttccgtggcacaatgcctttgggtattgtgtaatgcttacttttggcacatttaataactagctactgtacttccgttcccgtggtcgccacggcttgttcgacgagaaggaaaaactcagattgtttgcgagaaggatctatagtgtaaccatcaaatgtggtttctctttggtttttgcctcgattggagcaggcctcggcgtccttctgcatccagtgcatggacaatggattggttgtatccttggagattttgcaggaccagttgttgctatccttattttcgagaagttacagttcccgctagaaggttaaagaccaccatctcctgctacaaagttaagaaacccaggtcatccgaccttgtttctagcctgcctggttttcgaagaacatgaagtggagctccttggccttgagtctaccctttcaggatattcattggcctaacttggagctcaaagttgatgaataactatgcatgcatggttaatagcttttcgtggcacaatgcctttgggtattgtgtaatgcttacttttggcacatttaataactagctactgtacctcggccgcgaccacgcta

SEQ ID NO: 35570 - DNA, 873 bp, Triticum aestivum
  Clone ID: PAT_TA_35570
cccgccaaaatggtcaacgcagaggccggccgctccgggaaacccctctcagtcttcatccaacatccatcgaggacccggccgtcaccactaacgacaatcaagatggtcaacctgcgaactcagaagcgcctggcctcagcggtcatcggctgtggcgagcgcaagatctggctcgaccccaacgagcagagcgagatctccaacgccaactctcgccagaccatccgaaagctcatctccgatggccttatcatccgaaagcccgtcacccagcactcgcgatcgcgcgcccgcgagctgaacctcgcccgacgagagggccgacaccgtggttacggtaagcgtaagggtaccgccgatgcccgtatgcccagccaggtcctctggatgcgccgcctccgagtcctccgccgtcttttggtcaagtaccgtgccagcggaaagatcgacaagcacctctaccacgagctgtaccacagcagcaagggtaacgccttcaagcacaagcgtgccctagttgagcacattcaccgtgccaaggctgagaaggcccgcgagaccgccctccaggaggagatggatgccaagcgtgcgaagaacaaggctgcccgtgagcgcaagcaggagcgtgcggcggcgaagcgaaatgccctccttgccgaggaataaatgtaagcctagtggacaacgacaacatttcggtcttaagaggaggctgcatacggagtctacgggttgggtctttttttatgcccttctggtttctacacttgtaccggcggggttcaggcatgtagcattgaaaatggaatcgatgatgctcggatgaaaaaaaaaaaaaaagaaaaaaaaaaaaaaaaaaggccccta

SEQ ID NO: 35571 - DNA, 597 bp, Triticum aestivum
  Clone ID: PAT_TA_35571
gccggccgggcttgcgattcatattcccactttccagcacggaccctactactccgtatcgcatctccgaattcataactaccaaagataccccgcgattttcttgccggtcaaactttcaacttcacaaacactcttcacaatggccgacacccacacctacgagtttgacattgccatgagctgcggcggctgctctggcgccatcgaccgcgtcttcaagaagcttgacggtgttgagagctacgaggtctccctcgagaaccagtccgccaaggtcatcactgccctcccttacgagaccgtcctccaaaagatcgtcaagaccggaaagaccgtcaagtcaggcaaggcggatggtatcgagcagtcgatcgaggttgctgcttaagcaacagactaaaccgaatagaagcattatacgatcaattattctgaatacccattagcctttggtgtttaaagtcctggacaaggtgggcaggagggatgtctgatttcgcgaaccaaatcctcataaatcaataagaaagaatatggctgcacacattgttggtggcatgcccctttgaaaaaaaaaaaaaaaaaaggccccta

SEQ ID NO: 35572 - DNA, 689 bp, Triticum aestivum
  unsure (1)..(689): unsure at all n locations
  Clone ID: PAT_TA_35572
gccggccggtctgggctctttaatcgtctttcgcactttggacgtataaacatcacccgtgaactcaatacccgttgaaaaacaaacacaagtcatcatagtcatctgaaacaaacaaataaccacgatgaaccgaatcatcgacattgcccatcgccccgaaacgccaaaaccagagcggcctgttatcccaaatgagccagacgttggtgatggtgatggaactaccgactatctgcagtgaatacaacaacgtgtgattatatctcaggcaatatttgttcttttacacatgaaccaaattgatgaaatgatatctctcttttaaaggcgtttttgggtaggtatgaaaggcggggaaacgaacaaccatcatttctactaaacgagaatgcatcgactttgtgtttatttttcgtctctctttttcggatatcgatttgaatgtggaatttctgaattataagattgttcttattgaacaactgggaagattgttatacattcaggttgagttatcgtgagttatgggcacaacggttattatattgcaggttactggtacagattgttagcgacgattttctttcgaatatttacaaaggtttacttctcaaaaaaaaaaaaaagaagcacccctaaagaatgtganatatttataccgaaaaaaaaaaaaaaaaaggccccta

SEQ ID NO: 35573 - DNA, 1395 bp, Triticum aestivum
  Clone ID: PAT_TA_35573
gccggccgggtcggggagcacctcctgccatcaaatcacttgagacagtcaacatgcacttcctaggactcatcgttgctttcgcccctgcggctcttgcccagtctgctatctggggacagtgtggtggtaccggctggtctggctccacgacttgccagtctggcttgaagtgtgagaagatcaacgacttctactaccagtgtattcctggaagtgacaacggcggcggtactacccccgaccccggcacgccttctcctggtaatggcaacgctgatgccactggtcttgacgccaagatcagggccaagggcaagatctatttcggtactgagatcgaccactaccatctcaacaacaaccctctcatcaacatcgtcaagaaggactttggtcaggtcaccaacgagaacagtatgaagtgggatgccattgagccttctcgtggccagttcaccttcagcaacgctgacaaggtcgtcgactttgcccaggccaatggcaagaagatccgtggccacactctcctgtggcactctcagcttccccagtgggtcaagaacatccgtgaccgcgccaccatgacctctgtcatcgagaaccacgtcaagaccatggtcacccgctacaagggcaaggtcctccactgggacgttgtcaacgagatcttcgctgaggacggaaacatgcgaaacagtgagttctaccaggttctcggcgaggactttgtcggtattgctttccgcgctgcccgcgccgccgacccagctgccaagctctacatcaacgactacaacctcgacatcgccaactacgccaaggttacccgcggaatggttgatcacgtcaacaagtgggtgtctcagggtattcccatcgatggcatcggttcccaggctcatcttgccaagcccggtggctggaaccctgcctctggtttccctgctgctctcaaggtcctcgctggtgccaacgtcaaggaggttgccattaccgagcttgacattgatggagctgctgccaacgactacgtcaccgttgtcaactcttgtctcacaacccccaagtgtgttggcatcaccgtctggggtgtttctgacaaggactcgtggcgatcagagtctaaccctctcctcttcgaccgcaactaccagcccaaggctgcttacaccgctgtgagcaacgccctcaactaagggatcgatgtgcttgtgaaagttggagattaggatgagcgagaatacatgactatcatgatttgatcaggtttggggataagcttggatgacggggcaaagccaacggtctaggcgattgtatatattttcttcacacatgaacatattgaatgagagaacctaacgtcaaaaaaaaaaaaaaaaaaggccccta

SEQ ID NO: 35574 - DNA, 744 bp, Triticum aestivum
  Clone ID: PAT_TA_35574
ggaagaaaaggggatagcacttgcagctggttacatagatcgatctcgatcgtgatgacactgacgagggaggaggcgcacgagagcaaggagatggagagcctgcgggtgcacgccgacgcgctgctctcgctgtcctcgcccgccgcgtcgtccacggcgccggcgggcagcaagccggtgacggcggcgggcgggcaggagggcgctggcggcggagggcgtgttcgagtgcaagacgtgcagcaggcggttcacgtcgttccaggcgctgggcgggcaccgcaccagccacacgcggctgcaggcgcggatgctgctgcacgatcaggccgccgacgtcccaggcgccgccgagagggacagggcgcgggtgcacgagtgcgccgtctccgggctcgagttctccatgggccaggcgctcggcggccacatgcgccggcacaggggcgaggcgcccccggggccgtcgacgtcgtcggctgccgtgcacggcgacgccagctccggcgcgacgcagcagcaggaggtcatgccggacctgaactacccgccgatggacgactgcggcggcgatgggcaagaaacgtcggccgatcgcagctccgggcatcagctgcttgatctgcttgtgtagccttcacagaggtcataacaacatatacttgtatagataggatgtgcatatacaatacatacatgatgattccgtgctatactacatggatggcttgatttatttgt

SEQ ID NO: 35575 - DNA, 648 bp, Triticum aestivum
  unsure (1)..(648): unsure at all n locations
  Clone ID: PAT_TA_35575
attcctctggggctagcatattatggtttccaggagtatacaacgagcaattatctcgagtccgtgaaagatcttgactctgtgttttttgagatttggaagctggtcaatgggtctgatcagatgtctttcagagatgctatgaagcatgtgtatgaggagaacctgtttccattacgcaaacgtgatttggagcacgagctgagtcaacctgtctcgttgggattggagaaaaaatttcgacggtgcacagcgggcgtcaatagggaagttccagagtggctagcgcgtgtgttaatttcgcaggaagttagtttcaagtgtgatctgccaaggaggtatgtgcattatgccaggaagaagctcaagattgcagaaatcataggtttgattcccatatccaagataccagcctagtgtgtttattgctggccggcgtggggtggtcttttggggtcagtttcagaaacagaagtgtaatgtctatcctaaccccaaggtagctactccatctacggtttaatgcctgtgcatgtgtttatttcttgcccccctggcgcccctgggagcatatggttgcccttctacccgtccgtcccgctccccgtgccttgcgtcnatcctgggcnatgaataagaatcaatggg

SEQ ID NO: 35576 - DNA, 1731 bp, Triticum aestivum
  Clone ID: PAT_TA_35576
atcactatttactgggcggtgtgtggtcccaatgcgctaacctgacgctctgccttcttcccccaccatggctgccatgtggtctctgatcatcagtctcctcttcctcctgctcccaatcgcgccatcctcctccatcaagttcctggctcgaaggcaatgtctaccctgttggccacttctatgctacgttgaacattggtgaacccgcgaagccctacttcctggacgtcgacactggcagcaacctcacctggctggagtgcgaccaccccgtcaacggctggaacggctgccacaaaggaacacagagttccagcagaggagtgagaccccagagtgcaaaccacagctctgccttcttcccccaccatggctgccatgtggtctccgatcatcggtctcctcctcctcctgctcccaatcgcgccgtcctcctccatcaagttcccgctcgaaggcaatgtctaccctgttggccacttctatgctacgttgaacatcggtgaacccgcgaagccctacttcctggacgtcgacactggcagcaacctcacctggctggagtgcgaccacccggtccacggctgcaagggctgccacccgaggccaccacacccatattacaagccagcagctgacaagttgagggtgcaatgtggtggcccgctatgtgctgcaatgcgcagagacgtgcctgggatccctgagtgctccaggaaagatccacatcgatgccactacgagattcagtatgtcaccgggaagtcagaaggtgaccttgccactgacatcatttctgtcattgggaaagacaagaaaaacatcgctttcggatgtggatacaatcaggaggaaccagcagacgcaccgccctcgtcggtagatggcatccttggacttgggaggggaaaggcaggctttgccgcacaactcaggggctaaagatgataacagagaacgtcattggacattgcttcagcagcaaaggaaagggcgtcctcttcgttggggacttcaatccgccctcccgcggcgtaacctgggtacccatgagagaatccttgttgtactactcacctggcctagcagagctgttcattgacaaacagccgataagagggaatccaacatttgaggctgtatttgacagtggtaccacctacaccttcgtgcctgcccagatatacaatgaacttgtttcaaaggttagaggcactctcagtgaatcatcacttgtagaggtgaagggtcgtgctctgcctctatgctggaaagggaaaaagccattcagatctgtcaatgatgtgaagaaccaattcaaggcactgtcactaaaaattacccacgccggcggcaccagcaacctggacatccctcctcaaaactacctcatcgtggaggaagacgggaaaacgtgcttggctatccgcgatgcctcgtcggatcctgttctgaaggaactgaactttatcttgatcggagctgttacgatgcaggatctgtttgtgatatacaacaacgagagcaagcagctcggatgggttcgtgcgcagtgcgacaaggcgcaggagcttgaatccgtcatcgattcgcgtctctgaacaatgttcagatcgacatagacaaaaaccttaacgagaacaaatgagtgctctcgtatatatggtgtttgaaacgctgtatgatgctcccgcttattacgaataaaatgttggcatacggaaaaaa

SEQ ID NO: 35577 - DNA, 599 bp, Triticum aestivum
  Clone ID: PAT_TA_35577
gatctatagaatgccggccgggccgggatccggatcttcataccacactacacaatccaacactgcctaccacgagtttatccttcatcaaagggtatccacgatcacaaccactacctaaacacacgtttacttctctaaacaaccatcataatggattccggtgctccccagactggtgctgctactggcaacgtcagcggtcgtcgtcgaagctcaggcttcatgcccgccttcgctggcctctccgagcagaagcgtggttctcaggacagcgctgcccgccgagcgagtatgtctgatcaggcacccaagagtggcttctttggccagttcttccacaacaacttcggaagaaacgctcaaaagtaattgaaatgaatcacgaagaaatgaaaggcattgtcctattgtataattagtatcatcacggcgaatcgcagggcaagttgaagcccttttcattattgaagtttggtaatttgacctaggagttgacgcggaagcgaactcagatgtcaagctggagttacatagcagaataatcatgcaatgaattcactttcggttcctaaaaaaaaaaaaaaaaaaggccccta

SEQ ID NO: 35578 - DNA, 346 bp, Triticum aestivum
  Clone ID: PAT_TA_35578
aacgaaactcataagtaagctgcgaccgccctaaataattaacgtctttgtaatctttaacatcattttaatataaaaatctcacactttgttacatacttttcaggctgaacaatagtggcaggggttgttacgactggagtgcgcacaacattcaatggatagaccagtgaaacaatgaagcgctaataaatacagtacatcaacataggtaattttgaatttatgttactttatgtacatatacatgctgatgaaattatttcattatgtagaccgtacgatgaaactagaaatgatgcgtacaaccagtggtaccacaacaacacgtgtactcgctgtaggc

SEQ ID NO: 35579 - DNA, 900 bp, Triticum aestivum
  Clone ID: PAT_TA_35579
gccggccgggtcccggacagaagcaaatatcaaattcatcatgtttaccggaatcgtggaagaagtgggagttgtctccaagcttgacaacaatgattctaccggtggcacttctctgaccatctccattccttctggctcccagctcctctccgactgtcacgatggcgattccatctctgtcaatggtgtttgcctcaccgtcacctctttcacacctgaagccttcaccattggtgtagcccccgagactctgagaatcaccaacctgggtgaccttaaggagaacagcaacgtcaaccttgagcgcgctgtccgtgctgatacacgcatgggaggccactttgtccagggccacgttgacaccaccgccaagatcctgtccgtcaccaaggacggcaatgccctgaccttccgcttccagcctgcccgcagggatatgctgcggtacattgtgtacaagggctacatcgccattgacggcactagtttgaccgtcaccaaggtcaatgaccaagagggctggtgggaggtgatgctgatcgcctacactcaggagagggttgttgtggcgcagaagaaggagggtgacacagtcaaccttgaggttgacatgatggccaagtatgctgagaagtcattgggcggagttgtcggttctgagccaggatctgtggcctcttttcctttcatcgagaagattgttgagaggatcgtggcacaaggatttggcgcgaagcaataaaggattagatgggtttgattgctaataacatgggtatcattctcctcatcgttataccctgatattcccgactgtgacttgtcgctgtttcaaccacaaacgcctaataccaatattcctatcatacctaaaaaaaaaaaaaaaaaaggccccta

SEQ ID NO: 35580 - DNA, 881 bp, Triticum aestivum
  Clone ID: PAT_TA_35580
tttccaacgcaaatcctcccccatagaataatgtgccttggcctcccgagggacgctcgaggactctcttttctcccatacaattctcccacccaaattcgtctctacactcaacacgcctcaatacgtctttgtgactacatcaacaccacaaatccctttcttctaaattcatccctcagaacacaatcaaaatgcctaaggctgctgctcccgccaagcgtgcgaccagaactaagcgggccaagaaggaccccaacgctcccaagcgcggcctgtctgcctatatgttctttgccaacgaacagcgtgagaacgtccgtgaggagaaccctggtatctctttcggtcaagtcggcaagctcctcggtgagcgatggaaggccctcaacgagaagcaacgtgctccctacgaggctaaggctgccgctgataagaagcggtatgaggacgagaagcaggcctacaatgccgatcaggaagaagaggagtcttcttagaatggagcctccgatgtcaaacccaagcgtcgctcgcagaagaagtctgaatcggattagtcccagcaccagcgccgtgttgtagattctggccaggaagtccttcctctttgcattttggtctgggcggtgttgtatgatggcacaggaagagtgccttgttttttactaggaattttctcgggttaaggccgtccccgatgttatgatcttgagggcgatcgattgagctactggcttctatttcagtgtccttggccatgagaaacagatcgtgaactcgaggatcatgggacgaggaaacgcaatgcttgtacaattaagggaactcccgaccaaataatcgaactacgaaaacaaaaaaaaaaaaaaaaaggccct

SEQ ID NO: 35581 - DNA, 549 bp, Triticum aestivum
  Clone ID: PAT_TA_35581
gccggccgggtcgccggagatagcatcatacctcaatctaccagtttccgacgactgttactcctcaacccaaccgtttcttctctaattaaataaacaaaatgttcggaggattcgccccccctcagcaatcacaggaggagatccgcgccctcgaggccgatgctgcctttactgtccagggtgccatcaccaccgctgttcttctgtacctctctcccttcgctctcgaccttgtcggcaagatcctctagactacgatcatccgttgtgtaaacgtagagcggttcatgcgaagacagtgaaaggcattatgattcttgcggacgatggctttgccagcacgccatgtacgataaaaccggtttagatggaacggacggaagactcatgattaatctgtaccaatatatttttcaagacgcggggaaaagccgcgcaataacaaaactctcaaaaataacacatgccttggcatttttttgctaactctactttttaaaaaaaaaaccgttgttgtggtaaaaaaaaaaaaaaaaaaggccccta

SEQ ID NO: 35582 - DNA, 676 bp, Triticum aestivum
  Clone ID: PAT_TA_35582
gccggccggtccgggaaagcagttcgtctcgagatactttacactacgcaactaccgtcttcaaataccgactacctttttcaaacgttcatcatgaagcctatcgccgttctcgctacaatggcagctgtcttctcgaccgctaccgaagccagggcctgcacccagggactcaagtactgcagcttcaacctcttgaaaatcggggactactacaatgagattgaagctgagcttaagaggaatgggcttcctaactcatactcatatgtacggaattctcttttcagatgtgctagtgatgggtggattgtgtttgaatcttattgcggcgtctgtatcgatggcggaagtggaaagagtgatcgatgcccaacaggcattggcaaataagaggtatgagatacctaggttgccaggaataacatttcgattgtttctttctaggaaacaaacactgctactccagttggcaactgttcgttgggacaagttggggagagtctcgcgggagttcatgcggtgacggccaatggtttgcgcgattccaatgaaaacttagatagctagatctccaggtttgagcaggaccgggacgaagaaacggatcttatcaatccagtcaatccagtcaatctttcaaaaaaaaaaaaaaaaaaggcccctaaggccgcgg

SEQ ID NO: 35583 - DNA, 949 bp, Triticum aestivum
  Clone ID: PAT_TA_35583
gccggccggttcgggcggtgtcctccgcctcaccgttgactccgctaccgaaatcaccggagagaagaagagcggagctaagcgactcttgcaaaagatcgtcaaggatattcccgactgctactgcgacgtcaccgtcggcgcggagggcgagtggcgcacttcgacaatcaagaataagcacgatcctaagtggaacgagactcatgatttccttgtcacggactacgagcagcagattaccattgacatcaatgatgaagaccttggtggtgacgatgacattggtatcgctactactaccgtcaagcagcttctactaaacggaggcacccaagagctcagcctcagccacaagggccagcctatcgataccagagtcaccatccacggcaaattcttcaactttgtcggcgaaaccaacagcatttctaccagcagccagaacgagggagagatctgcggtcttgccaccgtcctcatcgccaatgtcagcggtctcaacggcaaccgcgatgagctcaagcccagcgtcaaagttacatggggcgacaaggaattcgtcacgcccgtcaagtcatactctcctggaacagatatcttcaacccctcgttcgactcagcattccgattccccattactgctgagcagctatcgagcccttctagtttccgcctcgtgctgcagaacggcaatagtgagcagggaacagtcgagattccgttcaacgatgtgtcgggtgctgatggtatggttcatgaaggcgagtttgatgttgggtctggtgcatctgtgagggctcgtgtcgctattcgcggtcttcagttggccaagtaatgtagtgtaataaaatgagtttgagacccgtgagatagtctttatagcacctattttcccaatgaatcccattcatttccaccacaaaaaaaaaaaaaaaaaaggccccta

SEQ ID NO: 35584 - DNA, 919 bp, Triticum aestivum
  Clone ID: PAT_TA_35584
gccggccggtccggggccacgccgtgccgagcacacacagagacacagcaggcatcacacagctaacttcatcggcgactaatcaagctaagtaagcgcgagcagccatgacggggatgactatggccggcgcgtcgtctccctccaagaaaagcggcctccgggggccgcggccgcagccgctgaaggtggcgtcggcgccgccgtcctccaggccgtcgaccaagaaggcccacggtggcggtgcgccggtgatcgtctacgagcacacgcccaaggtcgtgcacgcgcggccgcacgagttcatgaccgtcgtgcagcggctgaccggcaagccggcgccggctccggcgctgttccctggcctacgatgtccccgtggcgcctatggaggagggagctggagtaggagacccgctgctgctcaccctcgggcacgggcagcatccgcccatggcggccgggcagctcatgtcccccggcggcttcatcttctcccccaacaccatgcagtccatccaggagctctgctcaaccccttgcgctaattgatcagcaagcatatgcagttgatctgcagaggttgcttactacggcaggtaccagcctagaagattacacatgcatactcctagtactgtatatgtaaataggacaaatcagttagccaggcagagttcgcgctgttcgtgtgaaattttccacgaggtcgatccatcgatcgagggactgaaatttcgcacgcacagcacagcagcttcttgatacagtttttatacaattcttatacagttacgcacaacatctgtacaatttttttcgtgtgtaagatacaccgttcgattttcgcttgagtattctagggataagaaacatatccggagttccaaaacagaatacggtgtcgctttccctgttc

SEQ ID NO: 35585 - DNA, 436 bp, Triticum aestivum
  unsure (1)..(436): unsure at all n locations
  Clone ID: PAT_TA_35585
ggccgctccgaggcnccggccgggtctgggaaaaaaaagaaggagtagatggttggttatctgggtataaggggctaggatccgaattcagcccaggcgtctgtcactcctgcacctccgatcatgtttctcggacctcaatatcgggaagttcaagagcaagaacaaggtgtcaattgtgcgggatgaagggtgttgttggtattctcatgtcaggtcttgcatcttaacttgtcggtgtattggtgtcaaatctggatcgtgcgttcttcgtcgacctgaccaggcgcataacaagaattgtgaaagttggggaggatgccatggcagagcgggaggtgggatataagcaagcaagaaagaaagaaagaggagcgagagaagccctttttgatgttttacgcatggtaaaaaaaaaaaaaaaaaaaggccccta

SEQ ID NO: 35586 - DNA, 502 bp, Triticum aestivum
  Clone ID: PAT_TA_35586
gccggccgccggcggaagagcattgattgcccaccatggccattacgccgacccaatttgctaagaagacggcgcagtcggccaattggtccgacgccaagcgtcgagtactttcctcctaccgagaatggattcgagctgcccccgaagtccaaaccatgtacaacatgcccatgcccgtttccaccatcagaactcgtatgcgacaagaattcgagcgacaacgatttgtgaacaagctttccgttgttgacgttcttctattcaagtcccacgccgaataccaggagaccatgaacttctggaagcagaccaaccatattatggcctacttcaaggaggagaacttccgaggtgacaagcgactaccaagcagcttcatgactggcttcctcgagggtcgcaactagatttggacaaccaggggcttgtttgtgtaaatatctcattgaaaggaattcctgaaaaaaaaaaaaaaaaaaaaaaacggcccctactcctg

SEQ ID NO: 35587 - DNA, 2253 bp, Triticum aestivum
  Clone ID: PAT_TA_35587
gggtccccgcgcccctgccgcccccttctccacaaaacctcccgccgcgaagaccccacccattaaaccctacaagtcgagcctccccttgccatcgccgccgcagccaccatgggctccgccaagtcctccaaatcctccaagaagcggaaacctgtcgccccgccgccagagtcggactccgagcaggaggagacggtccacgagaccgccgctgccgaggaattcaaccaagaggagcagccgcagccgcagcagcagtcggacgcaggagacgagcaccatgagcatgacaaggaggtgcaggagacgggaaaggagaaaaagaagaagaaggacaaggagggctcgggaatcctcaccagcatgctcttctcggagctccccatctccgagctcaccgccaaggccatcagggagatgaactacacccacctcgcccagattcaagctcggtcgataccacatctgttggaaggaagagatgtgatgggagctgccaagactggctcagggaagacccttgcgttcctcataccggcgattgagcttctctataacctgcatttctcgtcgaggaatggcacaggagttattgtggtttgccctacaagggagcttgccatacagacacacaatgttgctaaggaattgatgaagtatcactcacaaaccctcggatatgtaattggtggtaatggccggagaactgaagctgaccagcttgcaaagggggtcaatttgttagtagctacaccaggcaggctgttggaccatctgcaaaacaccaagggtttcatatataagagactaaagtgtcttataattgatgaagctgatcgcattcttgagcagaactttgaggaagacatgaaacaaatatttaaacgccttccccagaatcggcagacagttcttttttctgcgacacaaactaaagaggttgaagattttgccaagttgtcatttgagaaaaacgaagaaaggaaagaaaaacctgtttatatctcagttgatgatggtaaatcaaatgctaccgtggaaggcttacagcagggctattgtgtcattcctagcgacaagaggtttttggttctgtatgctttcctaaaaaagaaacagtctaagaaggtcatggtgttcttttcatcatgtagctcagtaaagttccatgcagagcttctaaattttctccagatagagtgtgaagatatccatgggaaacaaaaacagcagaaacgaactacaacattctttaacttctgcaaggcagaaaagggcatcttattatgcactaatgtggcagcacgtggacttgatattcctgatgtggattatattgtgcaatatgaccctccagatgaaccaaaggattacattcacagagttggtcgtactgcacgtggtgaaaaaggcaaaggaagcgccttattgttcttgttgccgcaagaactgaagtttcttatttacctgaaggcagccaagatttctctcacagaatacgagttcaataataagaatgtgccaaatttacaatcacatcttgagaacatcgttgtcgagaattacttcctaaaccagtcagctaaagaagcctacagatcctacatcttggcatacaactcacacgccatgaaggacatttttaatgttcatgatcttgatatgaaggctgtagcagcatcattctgttttaagaaccctccaaaagtgaacctcgacttggagagcagcgcttctaaacgtcggaagacaaggaaagtggatggtggggcgaggaggcatggtatcaatgccgcaaatccttatggacggaagggcggtgatgataacaggcaatttgcaagattctagagggccagccagccagcctttgagtggtctgtaatgatggtaaactctaatgttaagcattgataccatgcctttgagtgttttatgatgtctctgcggtaaactctaatgttaggcagagtctggaaggctcttctttgctgtgtaagattttgttagatactagctcgatattatggcactggggtgtgatgcaattttccgtgtggaatggatttatgtactagcttaatgcattgatgattgagagacaaagagtcagtcagtcagtccccgtttgttatcgcaagtgctttagccgatgtttccttcagttttgttcatgcagtaatgatgagccatcactattgttgcctgaaggaaggagatgttctttggagttgatactttgtagtgcca

SEQ ID NO: 35588 - DNA, 914 bp, Triticum aestivum
  unsure (1)..(914): unsure at all n locations
  Clone ID: PAT_TA_35588
gcgccggcggtttgcggggacgacaccacaacatcatcaccagctttctctcttcccccaccgaaacctctctccttcaccaaacacataaataataaaccgtcaacatgcctaagaacaagggaaagggtggaaagaaccgcagacgtggtaccaaggagaacgatgaccagcgccgagagctcaccttcaaggaggacggtcaggagtacgcccaagtaatcaagatgcttggaaatggtcgtctcgaggctttgtgcttcgacggcagcaagcgtctcgccaacattcgtggaaagatgcgaaagaaggtctggattaaccagggtgatattatcctcctgtccctccgagacttccaggacaacaagggcgatgtcattctcaagtacaccgccgatgaagcccgtaccctcaagtcctacggcgagcttcccgagaacgccaagatcaacgagaccgactccttcggacagggcgaagatggcgaggcctacttcgagttcggcgacgctgactcagacgaagattctgacgatggcgctgctggcaagaaggaggtcgacattgacgacatttaagctccttccgggaaccaccaaatccccttcttcctccaccgagcccccgacctggccccggatgctccacgtattcctcggctggcgttgttgatactgtcttctctctcaaacccggagctgagcactaaaactctgtgcgtcgggtcccacgacagtagttgctgtggagtcttaagacagccatgggtgggagggacgtcatggcttgtcgctctcttgtcgatttgcaatatcgtgtttgagttttctgtcttggnctggttttaaagaagttactggacgaacatgggttttttcttaacgcgtcatgatcatcgcattcgtctcaaa

SEQ ID NO: 35589 - DNA, 755 bp, Triticum aestivum
  unsure (1)..(755): unsure at all n locations
  Clone ID: PAT_TA_35589
gccggccgggttccgaggngattgatgtgctcaacagaagttctgcggctttcctttgccttttgtacttggttgaatcaaagcacgtcgcatgtgcaccctttcatgatctctcagagcgggggataagctgcaacttgcgaggatggcaatggtcttatgacacaccattatgagtttcatgcgacgacaactctattgcttcataaggcatttttatgagcctttttcacgtgcgaaagctgatgcaaaattgccatacaaatatcatgtgttattccctctgttgttggattctgtaggccaacaacagacaacacatagagccactcacaaaaccgttcacaacattaacatgtcttcaaacaacatcaaagaaactactgcctctgtacccaaagatctccaggggggtgctggaccggatctgaccgacggtcgcgaacagccttggaagaaattcctcgccgcagagaacgagtgcaacaaccgtccatggactggatggcagccaactgaagaaaaacctttcgagaagccatggctcaggtggagtgtcgagtttggggttgacaactttcgccatatgactggttcttgagatggaagcagctctacataacataacaatcgttttgaatcctgtttggtgaggtctacaatggaatggaattgcaagctcgacagcacaatctttatattacttttcaatcaatcttgtttattataaaaaaaaaaaaaaaaaaggcccctan

SEQ ID NO: 35590 - DNA, 1601 bp, Triticum aestivum
  unsure (1)..(1601): unsure at all n locations
  Clone ID: PAT_TA_35590
ccacgcggccgccctcgcctccgcgggcccgtggggtccgtctccccacccctgcgtgcgccccgccggtctgcccagtccacaccccccactattttagcaagtgccataatgttcaaggattggtctgggcagagcgcaagcattattgcctccgagacttgtggatttctcacagttcttgccggtattattgtgctacattccaccaaagaacctgatcaaaatctgtccccagacctttatgcatctctcactgcgcccctccctccaaagatatattggcacatccaaggaaacggtgacgtagggaagcaaaaggaggacgagtcgcttccctgcgacttcatcaccgtcgtgcgccaggactacttcgtctagaaaattctcatgacggcatatgcgtttcatatgtgccagccagcctcaagaccttcacgtggagagggtggatgccggggcctgttaccgacggtacaccgccctcaatggccatcctgacctgaaaaaatgtgaaaattttgcacgagacatcgtgttcgtaccataccatgaccaaaccggttgcgtcggaagctatgcgtgcgtacactgggaggcccccggaatcggtggagtagatttggcggatggcattggtgcctgccgttctttgctatgttgctttagtgatgtctgtttcattgcttcttatactatattgtgctccacgttatgggcatacgaacataatgatctatgttggtatttgctctgttatcggatccctcacggtaatgagcatcaaggccgtgggcattgcgattaaacttaccattcagggcgtaaaccaggctgggtatttccagacgtggatgtttgtgacggtttcagctatatgcttaatcatccagttagtttacctgaacaaggcattggatactttcaatacagcgctggtttctcccatctattatgccatgttcacaaccctcactattttagcaagtgccataatgttcaaggattggtctgggcagagcgcaagcattattgcctccgagacttgtggatttctcacagttcttgccggtattattgtgctacattccaccaaagaacccgatcaaaatctgtccccagacctttatgcatctctcactgcacccctccctccaaagatatattggcacatccaaggaaacggcggcgacgtagggaagcaaaaagaggacgactcacttccctgcgatttcatcaccgtcgtgcgccaggactacttcgtctagaaaattctcaggacggcatatgcgtttcatatgtgccaaccagcctcaagaccttcatgtggcgagggtggaccccaaggcctgttaccgacggtacaaggccatcctggcctgaaaaaatgtgaaaattttgcagagacatcgtgttgtaccataccatgaccaaaccggttgcgtcggagctaggtgttgtatgacttgtggacccctgtaccgccgtgtgtgaggatttgttgtagggggtttgtccggcggtggaaacgttgtgctgtcgagtatacaancaanaagcnttcgtgcatgtaaatttgttnccctgngctcgatgttatc

SEQ ID NO: 35591 - DNA, 736 bp, Triticum aestivum
  unsure (1)..(736): unsure at all n locations
  Clone ID: PAT_TA_35591
gccggccgggttgggacgcccggnactcagttcgccgagcccccatcccagtttgctcctcaagatactggcttcaagctccaggctccccctgtcaaggctccttctgctactcctaagctgaaccagtccgctttcacgcctactgacactacgcctccgtcgcttcctatggtccccaccgttcatgtttccgagcacggtcctgtaggctcagacgagcccacgtatgatgctgtccctatccctggtgcctacaccggacaggctatcaagagcccgccacccgcacaaacatcctttggccaaggttattactagaaggtgtcaaaggttgaaaacggcgagcttttgtttgatttgttaattatggttctgcgggctttagccaccttatcttcttggtggctactgaagttatatttatcacggggcggcgataccacagatggcgttacaaggatgggtctaagacttgaccctgctacatttttttatctttgatttcttttgtttctaacctcctcaaagatatcaggagttgtatatagtgtgccgtaatttgggaatgactgtacaattggcaatgtgcaaaggatgacgaagatgatggatcaacgagctatacagcactttagtttgtatgagagaaccttgataggttgtcactttaggaaaaaaaaaacaattgtaaaaaaaaaaaatacttgaaaataaaaaaaaaaaaaggccccta

SEQ ID NO: 35592 - DNA, 718 bp, Triticum aestivum
  unsure (1)..(718): unsure at all n locations
  Clone ID: PAT_TA_35592
gccggccgacctcttacgattaggaacgacgaatcgacgaacgacacctcaatcgaaaccaccactcgtcattgtgaattcttccgcctgtcacaatgggtatctgggacactttcaccgatattgtcgaggctgtgacgccatggagcgtcgttgaggccgaggctcctgctgaggagccccaggaggagaacgagtccaagaccgagtccaaggacgagcccgaggaggaagaggcggccgaggaggatgaggaagaagaggaggaggatgaggatgacgaggaggaacttgtcgaccagaaggagaccctcgaggaagagtgcaagaacgctccccaatgtgcccccgccaagcaccactttgacgagtgtgttgagcgtgttcagcagcaggagagcgagggtggtgccaaggaggactgtgtcgaagagttcttccaccttgcccactgtgcgaccgcttgcgccgctcccaagctctggtcccagctcaagtaaattcatatcatggggttaccggttccaacgacgatggaatggctacatacacgtcgaaaagatacctagagccggaacgaggcaatgctatccagtatggacgcaaaaaaaaaaaaaagaatgcccccctgttgngtgtcaagtcgtccagaagtttttctgatgtcggctctctctgtaccatacgctcttacgcctgaatagattctttgcacttt

SEQ ID NO: 35593 - DNA, 359 bp, Triticum aestivum
  Clone ID: PAT_TA_35593
tgcttgactttatgaaggccaacactgatgtctggaagggttccatggtggtctgctggtccttggtggggtgactacatgtacagcttcgagcctcccagtggctctgcgtaccagtactacaactcccttctcaagacttatgtctaagagttgacgagtttgagaggtcgacaagacagacatcaagcaaaaatggcgcatcaaagcgtttgggaggatatcgtttctaccgttgttaattcaacgccgtcccctttagcttagtccagtacataggcacttggccactttctgtatatatttttatcagtacaaatctttcactatcggaaaaaaaaaaaaaaaaaaggccccta

SEQ ID NO: 35594 - DNA, 872 bp, Triticum aestivum
  unsure (1)..(872): unsure at all n locations
  Clone ID: PAT_TA_35594
gccggccgggtcgggactttcttccttttactctttcttcctccttttttctcttccttcttgtcggccacttgtcatcttctactcaaatcatcggctcgtccgacagcagctctcgacaagacctcgtacactagttctcttctctccacgatcgtcaaatcacacccaataccgcaatcatgtccgcgacaaaggaattcaccatgcaggatgttgctgagcacaacacctccaaggacatctacatggttgtccacgataaggtctacgactgctccaagttcctcgacgagcaccccggtggtgaggaggttatgcttgatgttgccggccaggacgccaccgaggctttcgaggatgttggccacagtgacgaggcccgagaggttctcgagggtctcctcgttggtgagctcaagcgtctgcctggtgatgagggccccaagcgcaggatcgccaactcgaaccagggcagcggccaggatcctaccggctccagcttgatctcttacgctcttgttgtcgctgttggcttcgccgcctacatgggctacaactacctccagaagcagaacgaggctcagggctccgcataagcgtctaacctcaatcgcactacatgaggaaggagagttataaaaagggagcctttgtgatttctttatggcatcaatgcaggtctatggatgattgaccgacaattgcattggggagttttcttttggcctagagagaagaggccagtcggcgatagacggttggcgcgcaactattacatcgacaaaaagggcagtttagcttaccccggcttggacattanggtggatggatgagaacagtgngtgggctattgtcctggaccgacccat

SEQ ID NO: 35595 - DNA, 491 bp, Triticum aestivum
  Clone ID: PAT_TA_35595
gccggccggccgcgggccggatatcgtgtcaactacatcaactcgttctttcatccattatcaatacctaaaccatgaaggttgcattctttctctccgctctcttctctgctcaggtcttggcaatccccgagcctgacaacacggttgtcaaggacggtgaatacacttacactggcatcgataaggggcttctatccctccgcggtcttgaaaagcgctgcaattgcttcccagaatgccgcaggccggcctccaactgcagtccaggcaaatgtgaatgttctggggactatggctgctggtcatgcagtggtggtcgtatgcagtgccagccaggacctggctcaggagtctgctggacgaagtagatatgggtttccgataaggaacgttaaagcaagggctcgttgttcatttctggatgacgtacaatgcaatatatctcaccatcctttattgttgaaaaaaaaaaaaaaaaaaggccccta

SEQ ID NO: 35596 - DNA, 832 bp, Triticum aestivum
  Clone ID: PAT_TA_35596
gccggcgggcgggggatacgactgtcttgtcaactcctcgcaacttcactaaccagcagacaacacaccgccggacaagatgaagttcctcaaggtcggccgagtcgccatcatcacccgcggcagatacgccggaaagaaggttgtcatcatccagcccgttgacaacggcaacaagcctcaccctttcggccacgccctggttgccggcattgagcgatacccctccaagatcacccgccgcatgtccaagacccgccaggagaagcgaaacaagatcaagcccttcatcaaggtcatcaactacaaccacttgatgcccactcgctacactctcgagctcgagggcctcaagggtgccgtctccaacgacaccttcaaggaggtttcccagcgcgaggatgccaagaagactgtcaagaaggtgctcgaggagcgatacaccagcggcaagaaccgatggttcttcacccctctcaagttttaaaaaaggaatcgtttctccatcacggttagggagttggcgggatgtaaagagcatcgatggcattaaggaaccccggtttttatgggctcaatatgaagtttcttaaaacaagatcagatctctactttgccccgtgattgtagcgtcaatatacaacgcggatcggacggacgtgttgtcccgaccgaaggataccaaaggtagagaaaaatgaattggtgtcatatgaggtgttgaatagaccttgaggactcttcttgacggttgaatgtctacgaggtacatgaatccataaaatgaatcaaaaaacaataaaaccgaaaaactaaaaaaaaaaagggccct

SEQ ID NO: 35597 - DNA, 526 bp, Triticum aestivum
  Clone ID: PAT_TA_35597
gccggccgggctcgggataaacaagcatacacgcaatgtccctctctcgtctcgtcccgtcactcatcaaaaccaaatctataccctgtttcactactgtcagaacacttcgaacaatggcttcaggcgcagttaccgttcctcctggaaaatacgagtttctcgtcgttgttcatgacaagcccggtatgcttgagaagcgacttgaagttcgaggacagcatttcgataacatgaaacccaatgttgagagcggaaactggaagatgggaggtgccatcctcaactctgttcccaaagacgatagtcccagtagcttggatttcgccggaagcacacttgtctgcattgctgattccgcagaacaagtgcgagagaacttgagcaaggatatctatgccacttctggtgtttgggatatggacaaggtccaaatctaccctttcaaggctgcattcagattcaactaatatcaataatccaatctcatttactcgactaaaaaaaaaaaaaaaaaaggccccta

SEQ ID NO: 35598 - DNA, 946 bp, Triticum aestivum
  Clone ID: PAT_TA_35598
aactctcgagcgcccatttctaaacgactttgtcctttcgcatcgtgagactgtttgttcctttcttcatccacactctaccttcgcccgaccacccctcatcctaaacatcccgtctcctgacgtagaccgcaatcatgtctcaatccggagccaccgtttcccaggactgcattactgctttcaacgacttgaagcttaacaagaagtacaagttcatcgtctacaagctctctgacgattacaaggagatcgttatcgacaaggcctctgagagccgagattgggaggacttccgtgagacgctcgtcaacgctaccgccaagagccgaactggcgctgttggcaagggtccccgttacgccgtttacgacttcgagtacaacctggcctccggcgatggtatccgaaacaagatcaccttcatcgcctggtctcctgatgatgctggtatccagcccaagatgatctacgcttcctccaaggaggcccttaagcgatcgctcaccggcattgccaccgagttgcaggccaatgacactgatgacatcgaatacgactccatcctcaagaccgtcagcaagggtcttgccgcttaagcgcgtcgtcatgaaatcgcctaatcgccgccccgcgctcccttatagaagcgggtggtgatggagtttgaacatacctatggccgtttcaagagttgagacgccaaaataagcaagcaatcaaatgagtaggagtgcatagtgtgcggatggaaacaggcgcggggagaccatggggttttcgtttcttttggggacgtaaccaacgagtttgcttcaggaggcgaaacgtaaattcgcataattgccagccctgaccatgtatcgtacgtaaccccggaaaataaaaccgcatgctggtatatggcaatcatggcaaaaaaaaaaaaaaaaaaggcccctagggc

SEQ ID NO: 35599 - DNA, 1355 bp, Triticum aestivum
  Clone ID: PAT_TA_35599
gccggccgcgtcgcaaaaaccattaccaaaccatcatcatgaaacacccttatctcgttatggacgagaaacagccttctcaaagagtcatgttgccaatccaggctcgccgcagtcgccctaccatgacactgattgtcatggctattgtgacatacaccttttggatatggcaacccttcaggcctctcatagacgacgagtcttgggttcacatcacaaacgacgatattcaacctaccgatagtctcgtgcctttggaagcacatatcatgagcaaatgccccgacgcaaaggaagctctcgaattattggtgttgcctgtcatgcagcgcgttcatgacaaggtcaactttactctatcttatatcggccggccaactgccaacgatggcgtcgactgcatgcacggcccttcggaatgcatgggcaacatcattgaactttgcgcccgcgagctttaccccgaccctaagataaatctgggtttcattatgtgcctgagccgtgactactcagatatccccggccgatcccttgtcgaagactgcgcgctcgaatccgctatcgacttccagcaactgaacgaatgtgctgtcaaggaagatggcggctatggtttgagtctcttgcgccacagtatcaaaaggaccgcagacgccggcgtgacgaagagtgctaccattcgtttgaacggcgaaatttactgtatccgcgatggcggcgagtggtccgactgcccccacggttctagtgtcaacgatctccttattgcgattgagaagcttcgccgccagtcttaagtggctcaaagatctcagtccacaactcactcgcctctcctagcgtatagctcatcgcgatgccgtccatgcccgcctcgtcgtctcccgccatcgcccccagtgtctgcataatactttccagtccgaccgccttgcctgtcgcctgcgtcgcccccgcctcgagctgaacatgtacaacatgaatgtggaagtggtaataggttggctggtagtgcacgtagagcttgagctgatccggctcgatggacggatacgtcttgacggtagcgtcaataagacgggtcttcatgtgttgcagccagggaatgtgcttcttgcgaaggtctctcagcgaccagatgtcccgtcgctcgaccagcgccagtagatgcagcgcgtccagcgtcttgcggtcccagttgaggtccggcaacatcaggaagccttcgtcgccagcctcgcccagctttgttctgtacataacatcttctacttctttacgtccttctaaaaaaaaaaaaaaaaaaaaaaaaaaaaaaaaaaaaaaaaaaaaaaaaaaaaaggccccta

SEQ ID NO: 35600 - DNA, 542 bp, Triticum aestivum
  Clone ID: PAT_TA_35600
gccggccggccggggattgcatctgtcccttcacattctacacctttctctcctaccaaaaaaacacaacctccttcaaatcttcatcatgtctggctactccaacgttggtaaccgtggcgtctacgaggctggcgaccagaggaacgtctctgaggctgagcgcaaggccgaggagtctgacccctacaacgagggcaaggagaactcccacaacaacctcgactctaaggatgagcgatccatcgccaaccgactcgctgctgaggagaagaagtccgagtctggcgacgatactgagactgcccaattaaagaaggaccctaccctgcctgctcgcgctcacggtaacgaaccctccaagggcgccaagattgatgctcagttgcaagctgaggaggaagaggagctgaagcgcaagggcaaggcttaattgtaaaaatacatggatcacggccgcttcattgcaggcaaatgatgcggaagggatgaattaatgaacaataattgaagccaaaaaaaaaaaaaaaaaaggcccctaa

SEQ ID NO: 35601 - DNA, 1099 bp, Triticum aestivum
  unsure (1)..(1099): unsure at all n locations
  Clone ID: PAT_TA_35601
nttactgacggtatgattgttatcctcctcgattagttgctccaaaagggctacggtctgggcagcggtatctctctgttcattgccaccaacatctgcgagtccatcatgtggaaggctttctctcccaccactatcaacactggccgtggtcccgagtttgagggtgctgttattgccctcttccacctcctcttcacctggcccaacaagcagcgagctctccaggaggctttctaccgccagaacctccccaacatcatgaaccttctggccaccattgccgtcttcgccgctgtcatctacctccagggtttccgtgtcgagatccccgtcaagtcttctcgccagcgtggtgctcgtggttcttaccccgtccgcctgttctacacctccaacatgcccatcatgctgcagtccgctctctcttccaacgtcttccttatcagccagatgctctactctcgcttctctgagaacctcctcgtccgtcttttcggtgtctgggaggccaaggatggttcttctcagctccacgctgcttccggtctcgtctactacatgtctcctccccagagcatgaaggacgcccttctcgaccccatccacatgagtgcctacatcatctacatgctcggtgcttgtgctctcttctccaagacttggatcgaggtttccggctccagccctcgtgatgttgccaagcagctcaaggaccagggtctcgttatggccggtcaccgtgaccagtccatgtacaaggagctcaagcgcatcattcctactgccgccgctttcggtggtgcttgcattggtgccctctctgtcaccagcgaccttctcggtgctcttggctcaggtaccggtactctccttgctgtcactattatctacggctactttgaaatcgccgctaaggagggtgatatgtccggtatgaagggcatgatcatgggctaaaagccttcgaaacgaacgaacgagtggcacgattgattttcagctcgacgttggagccccgttaaagagngncgtattatgtatncacagtaaagagatgagaaagataaatagttaccatggtttttttggttccttg

SEQ ID NO: 35602 - DNA, 1446 bp, Triticum aestivum
  unsure (1)..(1446): unsure at all n locations
  Clone ID: PAT_TA_35602
gccggcaggttcgggatctttattgttttgtttttctttctcatgttgtttcgcgatatcaagtagccttgatggcagtttgacaaccgaataccagcctttcttattcctgaaacctgaccagaccattctttctaatgtcgttccccgttgtaaatggtgtcgaggtagcagttccaccacctgctgggtaccaggtcgattttagcaaccccgaaacggatgggtcaatggttaggaatgcctattggatctttggaatggagtttgcgtttgcgacggcctttttgggacagcgcatgtatactaatggtgtgatcttgcgcaagtttatgattgatgattatctgatccttttcgcatggatcctttcaatagccgctcaatcatttcttcttgatgcgtatcgacgaaagcttcttggtgtccatgcctgggaaatgcccgttgacagcaacactgaatctgctctgcttgttatgtgtacaactctgacgtatattcctacgaccattctatcgaaactaacgctttgcttcttctactatcgcctctcgccagcaaggtggtatcaatactcggtctacgttacgggaatcatctgcacaacgagtctagtcggcatttggttcagcgttctcttcgcctgtaaacccattgcggcgggttgngacgtgagactatctgtcaatgctacttgtatcaaccgtcctcccatttacataacgcaagctggccggccctgcatggcagacgttatgcttctgatattacctattccactgtcgtcgggctgcaaatgtctacgcgacagaagctcggagtacttggcttatttgccattggttcaatcaccctcatcacatccgtcgttcgactggtcttactactgccaagtttatcgaacccagaccagagttggtccttggcagaaggttgcctgtgggtcatcatcgaagccaatctattgatcatgtgcggttccctccccactcttcgggttttcctcaaaaacgtcgcacctcgggttctcggcgacaaaagccaaagtaaaccaagcgaacaaaatagcgccagtgcaagctttgggctacgaacgtttggtggttcaaatggaccgcggcgaaagtttgataccctggtggaactggagcacgatgtgcatttcaacagaaccaccttgaggcctgaagggatgggcaaaacggacgtgaaagtcttgagtgggcagtcaaatgagtcactgatgaatcacggtccaactggggatanataatagtgaggatgggattttacagacgcgcacgacaacagttcgatatgacttatccatagtttggattcagacatataattgctctcatccacagatcggttgaaagacaggatattatttaattttgatacaaattttaacacaaaaaaaaaaaaaaaaaaggcccccta

SEQ ID NO: 35603 - DNA, 784 bp, Triticum aestivum
  Clone ID: PAT_TA_35603
cgccgggagccggccgggattctcatcattcaaagtaacattcacctctcgataatcaatcatcaaaagcaccaacgactctttcacgtcgatcataccaccaacacaacaacctccctccacacaatcattcacaatggctcgcggcgagactcagcagaccaaggtccacttcaagggcagcgatgactttgtcatcttcatcgacgatgtcgagacctaccagaagtggaagaccgacaagagcgtccccctggctcacttcatctcctctttcaagatcttctgtacacatggacaaggagcccagggaacactcgacgcagcttccaaggccgctcttgagaacgagttcggcacctctgtcgatgacgatgtcattaagcagatccttgagaagggcgagactcagaacactgagttccccgagcgccagggcagcaagaacgacagcaagggtcctatggcctcccactaaaagaagcaaggtgccagacgatgtaccatgcagcgggcgttagggtttttatcaggtttagcgcgaagtcgagtacgacaaacagggcggttgtcttgaacaacaacattgatctcatccgaaatggtaagagattgttgttgggcaggtagcttggtccacgatcatagtaataggtgatcgggatcactagcatctcaacgatctgatgctctgagagacgggcatatttgatgatagcgcctcataaatttcaacaagcctttcatatttgaccatcaaaaaaaaaaaaaaaaaaggccccta

SEQ ID NO: 35604 - DNA, 1437 bp, Triticum aestivum
  Clone ID: PAT_TA_35604
accgtcccactccatcaccaaatttcgacgccgcacgacgcccgaggtccaagtctcaaccttcacaatggcttcccgacctaccgtcaccattctcggcaaagatggtgctcccactggagctacccacgccattcccgctgtcttcaccagcccgatccgaccggacatcgtccagcaggttcacaccggcatggctaagaacaagcgtcagccttactccgtgagcgagaaggctggtcaccagacctctgctgagtcttggggtaccggtcgtgctgttgctcgtattcctagggtttctggtggcggtactcaccgtgccggtcaagctgccttcggtaacatgtgtcgttccggccgcatgttcgcccctacgaagatctggcgccgctggcacattaaggtcgctgtcggacaaaagcgatatgccgtctgttccgccctcgctgcctccgcggccgttcccctgctccaggcccgtggacaccaggtcaactctgtccctgaggttcctctggtcatcgactctgctgtcttcgaggctgctgccatcgccaagacttccgctgctctcggtctcctgaaggctgtcggtgccggtgaggacgtcagcaaggtcaagaactccaagaagatccgtgctggtaagggcaagctccgtggccgccgccaccgccagcgacgtggtcctcttgtcatctactcccccgagaccgatggcaaggagctcgtcaccgctttccgcaacatcactggtgtcgagacctgccccgtcaccgctctcaacctcctccagctcgctcccggtggtcacctcggccgattcattgtctggacctccggtgctttcaaggctcttgacagcatctacggatccaccaccgaggcttccgctcacaagcgtgacttcctccttccttccaacgttgtctctcaggccgatcttactcgtctgatcaacagctctgaaatccagagctccatcaacgcccccaagggagacgctatcacccgccgatctgctgtccagaagaagaacccgctcaagaacaagcaggtcatgcttcgcctgaacccctacgccactgtcttcgctcaggaggctcagaagaagcagaactaaaaggattttcgacttgctgggtgcgcagcgcgtttttacggaacaggatgacgggtcctagcatggtttgatatcgaggcgtaatggctatcctcgaagattgagctgcattaaacatgaatcagacatttgatatgaaaaaaaagagcttcgagggtggataccggccgcgaccggccaatcactattggatgccgcgggctgcgcgagcacaagacaaactgcctcgattcgaggcaaccggagcgaaggcccgccaaccccctccccaaaaagggcgctgcacacctgacccacacggctaggaggaa

SEQ ID NO: 35605 - DNA, 798 bp, Triticum aestivum
  Clone ID: PAT_TA_35605
gccggccggtccgggactcaatcacatcaactcttcatccatcaacactacctttcaccttcacctccaactaaacaaaccttcaaccttcaccttcaaccaaccaaccttcaccttcaccatgctcttcagcaaggtcgtcatcctcgccgccgctggcctcgtcgcctcagaggctgccccccaagtcacccaacccgccgtcctccgccgtgacctcggcgacgacctcaagaactgggccgagaccaaggccggcgaaaagatcacaaacgtcgaagactgggccaagaccaacgccaacgaggtccagcagtgggcttccgagcacggcggcgacgccaagagctgggtcaaggacaactacagcaacgccggcgactacgtttccacaaaggccgacgcagctggtgattttgtgtctaccaaggccgacgccgccagcaccaagatcgaggctgccattagcggtgcttccgccagcgcctctgctgctgccaaggacgatgacaatgctgctgctagcctgagcggtcagtctggtgttgttgccatgatggctgctattggtgtcaccgcctttggcttcttcctcgcttaagcgacctaattctttttttcgcaccaagataccacgcagcatgtacacttttacaattcggagtttgggaccctagggcatagacggtacacatagatgtgcggacctggctaggggaggataatgacgttgaatgaccagctaggcatacaatgaaacaattactacaagaaaaaaaaaaaaaaaaaaggccccta

SEQ ID NO: 35606 - DNA, 412 bp, Triticum aestivum
  unsure (1)..(412): unsure at all n locations
  Clone ID: PAT_TA_35606
tttaacacaccaagaaacctgtcaatcatcctttcttcagtggccacgtcatattgagagtatgtgacagatgattgaatttttgcaaatattctcccacagactgacttccttggaggagcgcgagaaattcatgctacttagtcgtcataattcccgcagggatgtgatatttctggaatcgttccttgaatcttgaccaggtaatttcttcatcagcaaaccacatggctttttcatattcccaccatatggcagcagcaccttcaagataatgtgttacatatggaaccttatccccttcatcagtttgagcaacctcaagcttctttcccatagttctcaaccaatcatctgcatccaagggatccaaannnaaannnnnnnnnnnaaaaaaaaaagcggccgctct

SEQ ID NO: 35607 - DNA, 953 bp, Triticum aestivum
  Clone ID: PAT_TA_35607
gccggccgggtcgggatacctctattctcttcattctacacacaaaaatgtctgctcctgctcctcttcgtctgggctctaccgcccccaacttccaggccgagaccacaaagggaaacattgacttccacgagttcatcggcgacaactgggtcatcctcttctcccaccccgaggactacacccccgtctgcaccactgagctcggtgcctttgccaagctccagccagagttcaccaagcgcaacgtcaagctcatcggtctctccgccaacaccatccagtcccacgagggatggatcaaggacattggtgaggttactggcggcaacgtcgagttccccatcattggtgacaaggagcgcaaggtttctcttctctacgacatgatcgaccagcaggatgctaccaacgtcgatgagaagggcattgccttcaccatccgatccgtcttcatcatcgaccccaagaagaccatccgcaccatcttctcctaccctgcctccaccggccgcaacgccgccgaggtcctccgcgtcatcgactccctccagaccggtgacaagtaccgcatcaccacccctatcaactgggtccctggtgaggacgtcattgtccacccctccgtcaagaacgaggaggccaagactctgttccccgagttccgcatcgtcaagccttacctccgattcacccctctcgccaaggagaaggtcctcccccagtaaattaattatacaaaggatacagcaaaaagcatgagaattttatgataccttgcagatgagcgaaaaggaattgaagggtccattgggtgttgggattagtacaacagacatgatggaaaggccaatgttcccatatagatcagtctagacttgagccatctgcgactgctctgagatgaagaataaatgaagaaatgacaaaaaaaaaaaaaaaaaaggccccta

SEQ ID NO: 35608 - DNA, 595 bp, Triticum aestivum
  unsure (1)..(595): unsure at all n locations
  Clone ID: PAT_TA_35608
gcggccgccggccggaaccggaaaagcgacaatcacccacagccgtcgccatgcctacccgtttgtcgaagacccgcaagcaccgcggccacgtttccgccggtaagggacgtggtcggaaaaaacgcccgatcccggtgccctataaagctagtgtcagcacgccacgcaccacataaacagtacatcccnnatatcccccccgggtgggtccggtgggggttcccttttggcccttggggggggggggttccaaagggaaaccccaacccaaccccgggtaacccccaacccattgggggaaacccaaagggttaacccccctttccccccgggggttttaccctttcccgggggaaaaaaaggggtttggggggaaaatggggcgggaaaaaaacttttcccccccccaaaaggccccaaggccccaaaaaaaaaccccccccccttttttcttttggggggaaaaaaaaccccccccccttttttttttttttaaaaaacccccccccctccgggaaaaaaaaaaaaaggctcccccccggggggggggccccccccccccccggggggggttttttcccccccccccccc

SEQ ID NO: 35609 - DNA, 1399 bp, Triticum aestivum
  Clone ID: PAT_TA_35609
gccggccgggctccggactcactcagtctcagtacagcagtttcattccattcactttgatctttgcacattctttcactcttctttgacagaagcagttctattcattctttcaacaccgccagccggaatcaactatcacaaacactttcttttacaaccacttcttttttacacaaccaaatcaacaaacaacatgtcttctttcatcaccaagaccgttctcgctgccctcgtcgccgctgctggcgttcgtgctcacggccacgtcgagtccatcaccgtcggcggaactgagtacgagggtctcaaccccggtgccgctgccttcgagaacccccgcaaggagctcgccgcctggttcgccaccaacaccgacaacggcttcgtcgagccctctgctttcggtgatgccgatatcatctgccaccgcggcgccgagaacgccgtcaagtccgccaaggtcaaggccggtgagaagatcaccatcaagtgggacacctggcccgagtctcacaagggccccgtcatcgattacctcgcttcttgcggttccgctggctgcgccaaggttgacaagaccagcctcaagttcttcaagatcgccgaggctggtatgacctctggtggtaagtttgcctccgatgatctcatcgccgctggcaacacctgggaggttaccgtccctacctccatcaaggccggtaactacgtcctccgtcacgagattatcgctctccacgccgctggccaggagaacggtgcccagaactacccccagtgcttcaacctcgaggttgagtctgacggtaccgctgagcctgccggtgttgctggtaccagcctctacaccgctagcgagaagggtattgtctttgacctctacaacaaccccaccagctaccccatccccggtcccaagatgaacattgctggtggttcttccggcgctgccccctctactcccgctacccccaccactggctccggctccgacaccccttccaacaccgctgctcccgttgagtccgctcccgctgagtctgctgcccctgtcgagtctgcccccgctgccggtaacggtaaccagaacaacggtggtgcttctcccgtcgagactgaggctcccgctactccccagcccaccaagactggctgcaaggctaagaaggcccgccgccacgctcgtgacatgatgaactaagctctcttttttgagctccagttctcttcagcaacacgctgagcgtggttgtgtaaaaacctttcaaggatcattgtgtcctgtctacccaccctgacaaatgggatgaaccttcaatattctgctgtatattagtgaccttgagtctgattaataaaactactttgagaaagaaaaaaaaaaaaaaggccccta

SEQ ID NO: 35610 - DNA, 604 bp, Triticum aestivum
  Clone ID: PAT_TA_35610
cggcaaggagatggacagtgagaaatatgacagggttcttgagtggtgttcgctgaagaaagacttggagatcttgccattcggtgacaagacagtcattggagagcgaggcataaatcttagtggcggacagaagcaaaggattcagatagcccgagctttgtatcaggatggccggccctatttggttgatgatccattcagcgcagtcgatgctcatacaggatcccaccttttcaaggaatgcttgcttggggctttggcttcaaaaacagtggtttatgtcactcaccacattgaattcctgccttcagctgatcttattctggtaatgaaaggtgggagaatagcacaagcaggcaaatacaacgatatacttggttcaggggaagagctaatggaactggttggtgctcaccaagatgctctcacagcattggatgtgattgatgtcgctaatggaggcagtgagacaatctcttcaagcctgtccaggtcattgtcatcagctgaagagaaagataaacaaagtggcaaagacaacggtgacaaggttcagagtgggcagctggtgcaggaaaaaaaaaaaaaaaaaaggccccta

SEQ ID NO: 35611 - DNA, 1758 bp, Triticum aestivum
  Clone ID: PAT_TA_35611
cgtccgcggacgcgtgggtcgccatcgacggggcttctccccggaatcaggtggcgcggcgcagctcggctgtcctctcctctctcctccgggtcgccgcagcccaccgccgataccaaccgtaataatcccccctacggccccctcccctcccctcccgcccgcctgcccagattaacctaatcccgcgtacctagggtttgtgcgatggcggtgccgcggccgtcgtggtcgcggtcggtcacagagaccgtgcggggatcgcaccagtacacggtcaagggtttctccctcgccaagggcatcggccccggccggcacctctccagtgacaccttcgccgtcggcggctacgactgggccgtctacctctacccggacggaaagaaccacgaggacaacgccagctacgtctccgtgttcgtcgccctcgcctccgaggggtaccgacgtccgcgccctcttcgtccgcacccggctcgaccgtccggccgcgcccgccacaaggtccactcccatttcgaccgatccatgcaggccggaccatacaccctcaagtacagaggatccatgtggggttacaagagattctacagaaggacacagttagaagcatcagattttttaaaggatgattgcctagtaatgaactgcacagtaggtgtcgtcaagaaccgtctcgaaacaccaaagaatatccagattaatgttcccccatcggatattggccgttgcttcaaggagctcttcgaactccacattggctgtgacataacttttgaagtaggtgatgagaaagtccaggcacataaatggattcttgccgctcgctccccggtgttcaaagcccaattctttggacctattggtaaacctgacatggacagagttgttgtggaggatgttgaacctatcgtcttcaaggcaatggtcaatttcatatattctgatgagcttcctagtattcatgaagtagctggatctttctcaatgtggacatctactgtggtaacacaacatctgttggcagcagctgatagatatgggttggaccggctacgaatcctatgtgaggcaaagttatgtgatgaactcacttctgaaacagtagcgacaaccttagccctagctgaacagcaccactgtgctcagctcaagtctgcctgtctaaaattcactgccgttcgacaaaatctgggagctgtgatggagacagaagggtttaattacctggaggagacttgcccatccttgctgtctgatttgttagcaaccgtcgcagtagtggttgatgatccttcatctgttaaccggaaaaggggagtttgtatcaacgaagatgtgaatcccgttgaaagcgttgaggctagtgacaggcgcacccgcaggagggtttaggcggaggctgtcaactaatgtagctatttgctgtctcccatgaattttactatggctggagttatgtcaagtgctctgtgacaggaactttgatttgggtgagagcaacttgtgaataatctccagcattgacggctttctgtggcattagttgcaactctgcctgttcattgacatattgtatgctgtatttaggtactccctccgtaaagaaatataagaacatttatagatcactaaagtagtgatctcaacgctcttatatttctttacggagggagtaataagtaatgctggattccactgcttttcaagatggttgttttcgaaatgaatgaatctaataaggtaagtttctat

SEQ ID NO: 35612 - DNA, 568 bp, Triticum aestivum
  Clone ID: PAT_TA_35612
gccggccggtacgttgagatcaattgtcgctcaaaccgccatcatgtcgacagtcggaagaacgctgaccaacctgcgaaaggttggaatcaaggactactttaagcagatgctgtacatcggtgacaccaaggctggtgttctcatcggtaccgatcgcgccggaaacaagtatttcgagaacaatgaggaacttcccctccgaacacgctgggtcgagtacgccgtgcacgattacgacgctgcccatatcgagcccggatggcacgcctggatgagctattccgtcgacaagccccctacccaggatcccttgttaaatgccggtacacgagctttcgagccttctcgcgccattcccaactttacccagaccaagggcgccttcaagacctacaacaccgcaaagcccaagatggcgacgtggcagcctgttgctgcacctcgggaataaggatgagatgcggttaagtgtacataaattcacgtagggagcagttcggcacaaccaatatggtattgaattcaaacgaaattctacgaaaaaaaaaaaaaaaaaaggccccta

SEQ ID NO: 35613 - DNA, 655 bp, Triticum aestivum
  Clone ID: PAT_TA_35613
gccggccggccggggaaggaagacccggccattcgaaagattctcgacccgacgacgtaccaggacgacaggtcaggcctggtcaatttgatctcccattctccgagtaatataccgaatacgtcaaagtctgctcaagcagcgccaccgtcataatgcccgttccttttgaggctcttcttccctatgccatcatgattggtatgttcggtatctctggtactggccttgccgtcattaagggcatccaaaacgagggcaagcggcctcgttactcggttgatcagtgggatagacaaatgatggaccgtgaccgtcgccttacgggaaccctacgaggacaaacagacaaggcagaggcacccttagggttcgaattgaacaacccctggaagctggaaacacgcttttcttaaacaacagtacgatggcttagagcggatggttacgaaggcaacccagatcaacaaatgtaattacacaatttgggtccgaggcataaatagcaaggcctgtagaatgggcggcagttacgagggagaattcaacaatttcaaacaaaaaaaaaaaaaaaaaaggcccctatgctagaggtcgaagggtttggtcatgacagcaggggtatctccaaaaaaaaaaaaaaaaaaggccccta

SEQ ID NO: 35614 - DNA, 1063 bp, Triticum aestivum
  unsure (1)..(1063): unsure at all n locations
  Clone ID: PAT_TA_35614
atctgcaggccacaaggctggtggaactacgctggtcagttcgtcgtctacgatcttcccgaccgtgactgtgctgctgctgcctccaacggagagtactcccttgacaaggatggcaagaacaagtacaaggcctacattgccaagatcaagggtatcctccaggactactctgacacccgcatcattctcgttatcgagcctgattctcttgctaacatggtcaccaacatgaacgtccccaagtgcgccaacgctgctagcgcttacaaggagctcaccattcacgccctcaaggagctcaaccttcccaacgtctccatgtacatcgacgccggtcacggtggctggctgggatggcccgccaaccttcctcctgccgcccagctctacggtcagctctacaaggatgccggcaagccatctcgcctccgaggtctcgtcaccaacgtctccaactacaacgcctggaagctatcctccaagcccgactacactgagagcaaccccaactacgacgagcagaagtacatccacgctctgtctcctcttctggagcaggagggctggcccggtgccaagttcatcgtcgaccagggccgatctggtaagcagcccactggccagaaggcttggggtgactggtgcaacgctcccggaactggattcggtctccgaccctctgccaacactggcgatgccctcgtcgacgctttcgtctgggtcaagcctggtggtgagtctgatggtacctctgatacctctgctgctcgctacgactaccactgcggtattgacggcgctgtcaagcccgctcctgaggctggaacctggttccaggcttactttgagcagcttctcaagaacgccaacccctctttcctgtaaacgaactacaggatccatggtgagcaagccaagaacaacactcgccaaaggatgggggaaatgtgacatgatcaccagtcatttctggaccttcaatattctttccgtatatatttagttgcacatacaaaattgactgatgctttcgagtaaaaanaaaanaaaaaggccccta

SEQ ID NO: 35615 - DNA, 830 bp, Triticum aestivum
  unsure (1)..(830): unsure at all n locations
  Clone ID: PAT_TA_35615
gccggccggggcggggatcctcatccaccacagcctcttctctcacagcactctcgctcagccactttcgctcagaaccagttcaatcatcaaaatgaccagcttccgccgtcttgctctcgctcttggagctctgctccctgcagtcctcgccgctcctactgagaagcgacaggaactcactgccgcgcctgacaagtacatcatcactctcaagcccgaggctactgagaacaagatcgaggctcacttgaactgggtcagcgatgtccaccgccgcagcctgaacaagcgtgacacttctggtgttgagaagaagttcaacatcagcagctgggacgcctactctggcgagttcgacaaggctaccattgatgagatcaagaagagccccgaggttgctttcgtcgagcctgactacactgtctacctcgacttcgagaccgaactcactgaccgtgctctgaccacccagagcggcgctccttggggtctcgcctccatctcccgccgaacctccggtggcagcacctacacctacgacaccactgccggctccggttcttacggatacgtcgttgacagcggcatcaacgtcaaccaccgagacttcggtggccgtgcttctctcggttacaacgnctgccggtggtgcccacgtcgacaccctgggccacggtacccacgttgctggaaccattgcttctcccacctacggtgttgccaaggctgccaacgtcatctctgtcaaggtcttcactggcaacagtgcctctacctccactatcctcgctggtttcaactgggctgtcacgacatcacttccaagg

SEQ ID NO: 35616 - DNA, 810 bp, Triticum aestivum
  unsure (1)..(810): unsure at all n locations
  Clone ID: PAT_TA_35616
ctgtgcggcggtcgaggcggcgaaactcacccttcccatcttctgagcttcacctcaacgagtatttcccaactccaatgccttcctctcacgctatctatcccagcctgcgggacaagacagtgctcattacgggtggtgcagaaggtataggttctgcgactgtggaactcttttctctccagggctgtcaagtcatttttatcgacattgctgaagattcggcccagaaaacaattgatcgagttatttctcgtcagaaagatagcaattctccgatcaaaccaccaatcttttacaagtgcagcgttgcagacctacctggattgcaggaaaccgtcaagagcatccaggataaacatggcgcggtacatgtactggtgaataatgcagcggcggctggaaacagagctagacttaccacggagaatgtcacctcagacgactgggactttaacgtcaataccaaccttcgtcatgttttctttcttacccaagccgtgataccggcaatgaaggaggcaggaagcgggagtatcatcaatcttggttccatcacttggcgtatccccgccgcaggtactccagtctacggtgcttgcaaagccgctatcatgggtctcacgcgtacacagagcaaagaatatggcaaatacaacatccgcatcaacagcgtcatgcctggagccattgcgacgcagcgacagagagacgaagttcttacgcccgagtatcgtgaggaggtgatgcggngccagagcttacagcgggatcttgagcccgagaggtggccaaggtgattgtgttttt

SEQ ID NO: 35617 - DNA, 764 bp, Triticum aestivum
  Clone ID: PAT_TA_35617
gccggccggcctccgattggaacccgtcatcatctccctcctccctcttcttcctttttccctcaaccacaacctttcgactatttagctgcctgaaaccaacagtcatcgcgacacttgaatccaacacacttaccgcctccacaacaaccatcaccgtcaacatgcgcagcaaattcaaggacgagcaccccttcgagaagcgcaaggctgaggccgagcgcattcgtcagaaatacgctgatcgtattcccgttatctgcgagaaggtcgagaagagtgatattgccaccatcgacaagaagaagtacctcgtccctgccgacctgaccgtcggccagttcgtttacgtcatccgcaagcgaattaagctgtctcccgagaaggccatcttcatcttcgttgacgaggttctacccccgacagctgccctgatgagcagcatttatgaggagcacaaggatgaggacggcttcctctacatcacctactccggcgagaacacttttggcgaagcgtaaggccggtgatgcaggatcggttctatcttctaagtcggaaatgaagaaggcgttacggtcgtatttttgggtgaacgttttttgatggttacttgttatattcttatcaactttctatgtccagacaccggactcgaatagagtgttcacagctccttataataacaataaaaaaaaaaaaaaaaaaataggctagcggagacaaattgtaaccatcaaaaaaaaaaaaaaaaaaggccccta

SEQ ID NO: 35618 - DNA, 439 bp, Triticum aestivum
  Clone ID: PAT_TA_35618
cctgctgtaccggccctaaattctcgagtcgacctggacttcatatcgatggcatcactctagtcgtttgccatttggatcgcggagtttgaattaccataaatgtgggcatctcacacaatgtggtgttatgcacacgagcatagctctcggatataaatgaatgagatgctcctgtatcgaaaagcacagatgccgggtggcgattaacaaggagcgtaccgagaacgacgttgggatcttcttgagccccttccgcagaaacacaattaacatggccacgagcagtggtggacggcttggcgtacaacactttccctgtcggctttccgcagccaacagtttttgctgtctggttggggttggtttggggacactcgcgcatatagtggactgattccccacacttgaaacaagtcacggtactggtaccttggca

SEQ ID NO: 35619 - DNA, 858 bp, Triticum aestivum
  unsure (1)..(858): unsure at all n locations
  Clone ID: PAT_TA_35619
cggccggccgaggcgggaggagaacagcctggttaggtcttcagtctccgtacaaactttgcctgttacagagatgcgtttcagtattcttcccaccgtggccttggccctttacaatggcctggttgcagccaaccctgtgccggagctcgagtctcgacagacttctggcctggacgccgccatgaaagccgccggcaagaagtactttggcacagcgctgacagtccgcaatgacgctggagagactaacgttctcaacaccaagggtgaatttgggtccatcactcccgagaacgctatgaagtgggaggctatccagcctaaccgtggccagttcaactggggtccggccgatcagcatgccaacgcggctacgcagcgaggcatggagcttcgatgccacactttagtctggcacagccagcttccctcttgggtggctaatggtaactggaacaaccaaactctacagcaggttatgaaggaccacatcaatgctgttatgggtcgatacaaggggaagtgcacccactgggatgttgtcaatgaggctctcaatgaggacggaacttaccgtgacagtgtcttctaccgtgtcatcggcgaggcattcatccccattgctttccgcatggctctggctgcagaccctaccaccaagctctactacaacgactacaacctcgagtatggtggtgccaagactgcaggcgctatccgcatcaccaagcttatccagtcctacggcctccgcatcgacggtgttggtctgcaggctcacatgaccagcgagagcactcctactcanagcacagttactccttcgcgngcgaatttggcgtccgttctcacagc

SEQ ID NO: 35620 - DNA, 2340 bp, Triticum aestivum
  Clone ID: PAT_TA_35620
ctaagcaactttcaatccaagcaagcttttcataaattcaagcaactaaactgttgtttgaagtttttttggcaatgttcagatgaatttcatgttctctgtgcattgaaatgctgtttattttattttcatgttttgttttcaccctgtgaattacatccctacaacttaatgcttgtttctgcgctgcagatggataatagccctccagcaagaacaggttctgggccatcaagaaaggcgaagctgaattcaaaagatctcagctttgtgggatatacatacaaaaactttgatgctggcgcaaggatgaggccttgcagactggcgcggcagctagctacttctgaagttcccagggagcagcaaatcaatttaataaaagacctggagagaaaggaaactgagtacatgagacttaaaaggcacaaaatctgcgtggatgactttgagctgctcaccattattgcggggggcgcctttggggtgctgcgactgtcccgggagaagacctctggccacatatatgcaatgaaaaaactgaagaagtctgatatggttatcaggggattaagtggagcatgttagagcagaaagaaacttgatggctgaagttgctagtcactgcactgtgaagctatactattctttccaagatacggagtatctttaccttattatggagtacctccctggcggtgatatcatgacccttctcatgagggaagataccttaactgaacccgtggctcgattctacattgctgagaccatccttgccattgagtccattcataagcacaactacatccacagagatatcaagcctgataatctgcttctagacaagaatggtcacatgaagttgtcggattttgggctgtgcaaaccaattgattgttcaaagctctcaaccttgagcgaagatgaacccatgggcgatgacaacctgaaggagtcaatggatgtcgacagttcactctctgaaactgcaaatggcagaaggtggagaagtcaacatgaacaacttcagcactggcagatgaacagaagaaaactggcattctcaactgttggaaccccagactatattgctccagaagttctgctaaagaaaggatatggaatggaatgcgattggtggtctttgggtgcaataatgtatgagatgcttgttgggtatccaccattttattccgatgatccaataaccacatgcagaaagattgtgcactggagaaaccatgtgaaatttccagatgattcaaggctgtctcctgaggcaagagatctaatctgccggttattatgtgatgttgaccacaggattggtggtgcaggggctgatcaaataaaggcccatccttggttccgtggagttgcatgggataaactttatgaaatggaagcagcatttaagcctcaagtaaatgatgaattggatacacaaaatttcatgaagtttgatgagatggataatagccctccagcaagaacaggttctgggccatcaagaaaggcgaagctgaattcaaaagatctcagctttgtggggtatacatacaaaaactttgatgctgtgaaaggattaaaacatgcagatatgcaaaggagctcatcgcttacaaggccctctattggtgctatattcggatcaaatggcatggagtcatcgagagaaccaaatggaaaggacacacacatgcacaccttttcttccggggatccgatgagtccataacccggcgtggttctgtttgttgctgagatttttctaaactaaattagcatgcaaacgactgaatgaagtggcttcgtctggacaacctgcttgtttttagccaggtttctgccctattaaatcgttggcgagcagtttgtagaaatccaagaaagcttctagctgtaaaatagtatgctaaggactagacaaatggtccatccaccggtgggctcgtcgtgtttggtgtagcgtgttccgaccaagtggagatgggcatgtttgggagggctggctgcccaggttggcagagcaaattgctgccttctcttgtggcagttcctggtccgctaacatttgatcatggaagcgaaataaggtggtaactgaggcaggctaagctattgttgttggtggtgtttgatacatatgtaccagaagatttccattcagagacatggcccttggtcaatggtctcccgttgcagaaatgcctaaatttttgtttactgtattgttcgccagttatatttgaacattgaacaatattggtggaagtgtcccttattttctttccgcaacatccatatgcaagaactgaattctgtgagagtgattat

SEQ ID NO: 35621 - DNA, 787 bp, Triticum aestivum
  unsure (1)..(787): unsure at all n locations
  Clone ID: PAT_TA_35621
gccggcctttcttggactttcttatcaacgtcacatctcgattttgaatgaatcgatcttggagaaaagtcttttgtcatagatttaaactatcaaccattatattcattagcaccctactcaacagacaaatgtcaggcccagctatagctactatcgccaccggcgttgcaatcgtcgcagttcctgccattgtcgcgggacctattcttggagccttaggcttcggcgccgctggtgttgcggcaggttctaccgctgctggagttcagagcggtatcggaagtgtcgctgcgggtagtctctttgcaactctgcagtccgctagtgccggaggttatggtgttgcgattgtccatggagccgtccaagctgttggagcggtagttggtgttagaggcatcggtgcttggtttcgaggctagagcgatgaaacacgctggccatgatgttgaagatgatcccgatgactcttacgatgaatacagaagcgagacagaagagcttagaaaggacaactcggtcaacgatgggcactcgaagtcgcccaactgagaagtatcgacggggcgtcgtcacattcgcctttacactacttcgacaaaacacaactggccgaagataaacgatagatgtgtcagcacggtttgttccccaagtgcctgtacttggttaaggcaagaatactttcgatgatgccttatgtaggatgacagacccaaggggagtcatagattgcaacaaagacgcaaagttcactccaaaaaaaaaaaaaaaaggcccctan

SEQ ID NO: 35622 - DNA, 851 bp, Triticum aestivum
  Clone ID: PAT_TA_35622
acgactactaaccccaacccgaccggtaccggcatatcacagcgacggacttccccggctgtttcgccaacccacgactactaaccccaaccctcccgcgaccggcagatcacacgattcgagatgggtcactcatacggaaagagagcgggcacccgctatgccttcagccgggacttccgcaagaagggtatgattgccctgaacacctacctccgacagtaccgcgttggagatatcgtcgacattaaggcgaacggtgccgtccagaagggtatgcccttcaaggtctaccacggaaagactggtgtcatctacaacgtcaccaagtccgctgtcggtgtcatcatctacaagcaggtcaagcaccgatacatcgagaagcgaatcaacgtccgaatcgagcacatctcgcagtcccgatctcgtgaggacttcctcaagcgagtcaaggctaacgccgaggccaagcgtgaggccaaggccaccggaaccgttgtccaggtcaagcgtcagccccttggacctcgtggcgcccacacactgtcgctctccgagaacccccccatgaccgttacccctcttgcctacgagaccacgatctaaaagaaaagatattgcgggggttggtggtgcttgcttctatttatttggggtattgcgtccggatgggaaagaattctgcatggcaagggcttgccttttgatgtctgtacggcataggaccagaaaaaagacatcgtttgaagcatccccaaatataaaaaagaccctacctctggtgaattgtgaccggcccatatagaaggcccggtgatgacttggcgtaaatgaactgacgcttctcccgg

SEQ ID NO: 35623 - DNA, 608 bp, Triticum aestivum
  Clone ID: PAT_TA_35623
gccggccccaccagggcccatatgtgctctgaaccttggtttattaagtggcggagctttgacagggcgaacctgggcagcccaggtcatttatttagaagacgagcactccaccaggctgtttctcaatgtatcattttggtctcttgtagtaaaaactttggcgatgctcatgacaggcagtgacactctgtggtggtgtcgagcgttggggtaggaaagcagaacatcatcaactctgcctcacctcttccactcgtgctgtctgatgatgttcaagctggaggatgttctgcaatgagatgtggaatgaaggctttgatgtcaagtacgagaatgatgcaaggatgttggtggaaggctgtgaggatgggtatgtagttacccactacaaggagccaaggtagatgatgtgcctcttagaaaaattctagtaaacactaggaatttttgctctcagacaatgaaccataatgtctcctctatttcattagttacataagtttacaggaaacttggatggtcattggttcataacatatgcactatttatatgtgaaaattaaaattatgtgtgttatcaaaaaaaaaaaaaaaaaaggccccta

SEQ ID NO: 35624 - DNA, 1087 bp, Triticum aestivum
  Clone ID: PAT_TA_35624
gccggccgggtcgggctaacggcgatgtcaaccaccccactgtccagttcgagtaccgcgagattcgcgagactatcaaggctgaacagatggctgataacacctcttcatatatcgatttcttcaagaccaagggaaaccgttaccgccttgttgttctcttctctcttggtctcttttcccaatggtctggaaacggtgttgtctccaactactcatccatcctatacgagcaagctggattggagagtgagcaggatcgtctcattattactgccggaaagacaattcttgacatgattgtttcgattggatgcgctttgtttgtcgatcgcctcaaccgtcgtttctctttcctgtttgccactggaggcatgttccttgtcctcatcttctggactctcacttgtggtctgtacgagcaacaccaggctgctggagctaactacggcatgatcttccttgtctggatgcacggtgtcttctactctacctgttggtctggtctcctcatcggttacgccgttgagattctcccctactctctccgtgccaaggctcttatgatcctaaacatctctgtccagatcgctctcctcctgaacaactacctcaaccctctggctttcaaagcctggcaggctggcgatgaccagatctttggtggaaacacctggagactctacctcatctacaccatctgggttttcggagaggttaccttcatctacttcatgtatgtcgagacccgaggacctactcttgaggaggttgccaaggtcattgatggtgacaacgctgctgttggccacgtcaccatggagaaggttgagaaggaggctctgaatgaggaggtcgacaaaatttcgtcggagggtcaacagatccacgaggtggcccccaccaaggtctaagcctgaacgatattgattaacgtcttattgaaatgtattctgggattgtcgacacttaaactgttgtttgacacgccgattctacctttttactttatgaagctcctttagcgagtttaatactacttgtacgaatgattcttgtctaaaaaaaaaaaaaaaaaaggccccta

SEQ ID NO: 35625 - DNA, 904 bp, Triticum aestivum
  unsure (1)..(904): unsure at all n locations
  Clone ID: PAT_TA_35625
gccggccgccggcgggccacggcacatctaatacttcccccaccacaaaccacactatcgccaacatggcggaaatacactttgggaatcactggaaaggacttcaccatcatcgcagcatccaaggctgcgatgcgaggcgccaccatcctcaagacaaccgatgacaagaccagagctctcaacaagcacacgctgctcgcattctctggagaggccggtgacacagtgcaattcgccgaatacattcaacgaaatgcccagctctactcgatgcgaaacgagtccgacttatccccctctgctcttgcccactttgtccgtggagagctagccaccagcttgcgatcccgaaagccttacaatgtcaacctgcttatgggtggtgttgatcccatcactggcaagccatccctctactggctcgactacctagcgtcgctggccgaggttccctatgccgcacatggatacgcacaatactactgcctctccatcctcgacaagcaccaccaccccgatatcactctccaccaaggcatcaagattctgacgatgtgcatcgacgagctgaagcgccgattaccgcttgatttcaagggtatggtggtcaaggcggtcaaggcagatggaattgtggacatagagttcgacgacgacaaggtggtcaagtgtgcttaagaggcgaccgcaaatggaaaggaaacatgaatttgtattactagatgggtcctggaggccaatgcttacacaaagatggtttcctccccgacggcataatgaaaatccaagttacagttgtcttccacaactcactttacgtgcaggctacagtggntgtatagcaagatggcttctaaatgagacacgntcagcaaaaaaaaaaaaaaaagggccctagggc

SEQ ID NO: 35626 - DNA, 664 bp, Triticum aestivum
  Clone ID: PAT_TA_35626
gccggccggttcgggtggcgcccgctttttcttttgtcacatttgttttcgatcacagcgacagcgttggcaaggccgtttcgatcttggtcaaccgcgaccccagacttgttcttttgagcatacgaatacggctttaaccttctatcacggctggtcaccgcccgacaacacgaagcaacctgacacgggaaaatgtgttatgaccttcttatgacttttcttctatgaatgtatgaatgaagaagacagagcgttttagttctttttatcatattttttgttttttaaattggaggcggaggagaacatatcatacaatccagagcgaacctcacccactttgtggtgttattatgggatcatgtttgacgacctggcatttgcgatgactgattttgcatggctgatgggcctaaatggaggatgtgtgatttatcttttgagggcgttggtgagctcaagtgggctggactcgcgacaagacatggtcgacagagaagagctgaagagctgagcagaagggaagagcgaatcattttattagcagcttgacaaagggatatgggtagttacaaaaaaaggcatcatgctgggcaagcgctatagcacagccgcgaatatattgaattgaatttaaaaaaaaaaaaaaaaaaggccccta

SEQ ID NO: 35627 - DNA, 489 bp, Triticum aestivum
  Clone ID: PAT_TA_35627
gccggccggttcgggccggccctctcctccaaacacaccgaggtccatactcgccgtcattgaccaatctcctctcccttaagtcaatttctcatcaatccattcaaaatgtcggacgacggtcaggagcttgttaccaagcccttcaagtttgtcactgctggcactgatgctcgtttccccaacatgaaccagaccaagcactgctggcaaaactacgtcgattaccacaagtgcattatcgccaagggcgaggactttgcgccctgccgccagttctggctgtcttaccgatccctctgcccctccggctggtaccagcgttgggatgagcagcgcgagtccggcaacttccccgtcaagctcgatgcttaagctcaatctgtagatatggaatagtggatgatgttagaagattcagagcagacgcagacacactgcaattgtatcatttgtgaaaatgaaaaaaaaaaaaaaaaaaggccccta

SEQ ID NO: 35628 - DNA, 589 bp, Triticum aestivum
  unsure (1)..(589): unsure at all n locations
  Clone ID: PAT_TA_35628
gccggccgtgcgccgctccaacgtcgacgcagccggctctccatggaaacacaccgaggtccatactcgccgtcattgaccaatctcctctcccttaagtcaatttctcatcaatccattcaaaatgtcggacgacggtcaggagcttgttaccaagcccttcaagtttgtcactgctggcactgatgctcgtttccccaacatgaaccagaccaagcactgctggcaaaactacgtcgattaccacaagtgcattatcgccaagggcgaggactttgcgccctgccgccagttctggctgtcttaccgatccctctgcccctccggctggtaccagcgttgggatgagcagcgcgagtccggcaacttccccgtcaagctcgatgcttaagctcaatctgtagatatggaatagtggatgatgttagaagattcagagcagacgcagacacactgcaattgtatcatttgtgaaaatgctttaaaagccaaccccaaatattgactgttgtgctttgaaaaaaaaaaaaaaaaaaggcccctannnnnnnnnnnnnnnnnnnnnnnnnnnnnnnnnnnnnnnnnnnnn

SEQ ID NO: 35629 - DNA, 605 bp, Triticum aestivum
  Clone ID: PAT_TA_35629
gccggccgggtccggactcttgtctcaaaatctacttttcacacacgttgagaaatggacgagaaccagatcaccggcagcgtacagtacgcctttggccccgacggggtcctggtaacaggcccagtattgatggatgatccagcaaccggcaaaatcatttgcgcctgctgccgggtccccaagtcagagcacagctttctgaccatgggcccgtacaatttcaaaagtcagttctgtctagactgcgaaagacctcgactggagcagcctccaccctcgacattgggcaagcgaggtttggatactgagtcagaaccagaacacacagtatccaagcctgaagtggcaaagaagtcgaagggtacagagacggatgagaaaatcgagtcatcaggttcttgattttgttacagattgagtacttgggtaaactgtcatcaggaaaaagggtctggggagttccacggtacgccaaaagagcacacgagttttgtagctaagttaaaaatgggatcttggcggagagcagtttggaattagtttccagccaagaatgaaaaatgattctcaagttcataaaaaaaaaaaaaaaaaggccccta

SEQ ID NO: 35630 - DNA, 492 bp, Triticum aestivum
  unsure (1)..(492): unsure at all n locations
  Clone ID: PAT_TA_35630
gggccgacacgccacgtaaaacagactactgtcataaaaatgaaaagaagcagctctgcttacggagataagttgtcccgaaaggaatctggaaattatttcacctacttttctccatctactgaagatgaagatgtctgcccaacatgtcttgaagattatacttcggagaatcctaggatagtaatgcagtgctcacatcacttccaccttggctgtatctatgagtggatggaaagaagtgaggcatgccctgtttgtggaaagaaaatggagttcaacgagacgacttagacctcagactggagcaagtttaacatctcatatgggaacctgaaaatataggtacctagtcctgcaaatactctgtaaatacacctttgtaagtattgaatcagcaaggtgctatatttagtatactggaattcctgatatgttggaacggtgcatataaacattccttcntttcaaaaaanananaaaaaaactcan

SEQ ID NO: 35631 - DNA, 1837 bp, Triticum aestivum
  Clone ID: PAT_TA_35631
gccggccgggtcggggcaacacggcgacgtacagtgaacaagctagctagcaaagatggccatggccaagagctccagcctagtgctcgtcgccttcaccttgctctgctgctacgcctccaccgtctcctcccagggtaattcgtccgatggtttcctctcgtgtctgtcggcgagcatcccccgccagctcgtgttcacgccgagctcgccctccttcacgccgctgctcaagtcctccatccggaaccccaagttcttcacgcccagcaccgtgaggccgctgtatatcatcacgccgacgaacgcctcccacgtgcaggccgccgtgctgtgcggccgccggagcggggtgcggcatccggtgcgcggcgccggcggccacgactacgaggggctgtcgtacccgtccgtgcgcgccgagtcgtccgccctgcttgacctgtccagcctccgtgccgtgcgggtcgacccgcaggcggcgaccgggtgggaccactccggcgcccagcgcggggaggtctattacgccatcgggaaggcgagcggggtgctcgggttccccgccggcctgtgccaggagcaggggatcgatcagcagtttgggcccgtagctctttgttgtgtctacatgatagctaagtagctagctacgcatttatctttatttgcacatgtatctgttgatattggcttgagattgcttacaccatggggagcgacgttttctgggccctccgaggcggcggcggcgagagcttcggcgtcgtggtgtcgtggcaggtgaagctcctgcccgtcccgcccaaggtcacggtgttcaacgtccctgtgaccgccagccagggcgccgcggacctcgtcaccaggtggcagcaggtcgcgccggccctgccggaggacctgatcatcagggtggtcgtccagcagaagacggccaacttccagtccctgttcctcggcacctgcgacgcgctgctgccggtgatgagcagccgcttcccggagctgcggttcaaccgctccgactgcagggagatgacctggatccagtcggtgccctacatctacctcggcagcgcctcgaccgtggaggacctcctgaaccggaccaccgccgagtccgtcttcagcagcggctacaaggcgacgtccgactacgtccggcaggccatcccgcgggacgcgtgggccagcatcttcgccaagctggcgcagcccaacgcggggctcatgatcctggacccatacggcgggcagatcgcggccgtgccggagtcggcgacgccgtacccgcaccgcgccggcgtgctctacaacatccagtacatgaacttctggtcgatggcgtcgggggacggggccgtgcagaccaggtggatcagggagttctacgcgttcatggcaccgttcgtgagctccaacccgagggaggcctacttcaactacagggacctggacctcggcgagaacgtcgtcgtcggcaacgtcagcagctaccaggccgggatggtctggggccagaagtacttcaagggcaactaccagaggctcgcgatggccaagggccagatcgaccccgacgactacttcaggaacgagcagagcatcccgccatttgccaacagcaggtgatagctcagcaaaatgggccgctagctctttcttttgtgtacatggtagctaactcagtagctagctacacatttatctttatttgcacatgtatttgttgatattggtttgagattgcttaccacaattactgattgtgtggtatatatgtacatgtatttgtatcttgaacaaagtttataataaaattacacattgtgcg

SEQ ID NO: 35632 - DNA, 495 bp, Triticum aestivum
  Clone ID: PAT_TA_35632
gccggccgggttcaaaacgtcgactggtgccccactggtttctcgcttggtatctgctaccaggctcccgagaacgtgcccaacggcgacctcgccaaggtcagccgcgctgtctgtatgctctctaacaccaccgccattgccgaggcctggtcttccctctccctcaagttcgatcttatgcacagcaagcgtgccttcgtccactggtacgttggtgagggtatggaggagggtgagttctctgaggctcgtgaggatctcgctgcccttgagcgcgattacgaggaggttgccaccgactccatgggcgatgaggagttggaggctgagtactaagcggtgacggatgcgatgactggattgctatctttgaaccagctttagcctgctaccgacagaggtgtattttcttattttcgcaaaggttaagccaaaacgagttttaatgccaaaagaccaagatccgaaaaaaaaaaaaaaaaaaggccccta

SEQ ID NO: 35633 - DNA, 722 bp, Triticum aestivum
  Clone ID: PAT_TA_35633
gccggccgggtcgggatcgccgttttctctttttttcggttctcgttattttgagaccgttttctaactcttcccgacactcatttacaacaaatcttgctactacgatccgatctttgcgacaggcaaaaaaaggggtttccaactcgcttctcgacactcattacacactttgttctttttactagccatttgatacacaacacacaatcaaaaaaaaaaaaaaaaaaggcccctaggcggctgctgctgccagcgccaagctcgagcccatcaccatgaagggttccaagctcttctacaccaacggaacccagttcttcatgaagggtgtcgcttaccagcaggactctgctgctggaggtgagagcacctgtttattaagacctacgccgaccctctcgccgacgagaaggcttgtaagcgcgatgtccctctcctcaaggagctcggcaccaacatcatccgaacctacgccattgaccccacggtcgaccactctgcttgtatgaagctccccgatgatgccggcatctacgttatctctgatctttccgagccttccctctccatcaaccgagacgaccccaagtgggacattgagctgtaccagcgataccgttgacgttgtcgatgagctcgcccagcaccacaaggttgccggcttctttgccggtaacgaggcttccaacaaggtttcaaaccccaggactcctgccttt

SEQ ID NO: 35634 - DNA, 850 bp, Triticum aestivum
  unsure (1)..(850): unsure at all n locations
  Clone ID: PAT_TA_35634
gccggccgggccgggatcaagccaatacaagacaggcccacttcattctttcaaacaccattcgtttaaaaaccactcgttcaaatacctctcatctatcatgaagcccacccaagtcctcgttgcccttgcggccattgcctatgctgcccccgtctcagacgacaccaaggccaaggctttggagattgatgatgacttccctcttgctgagctcgaagcttacttcgaagcccacatgaacggcgaaacctccgaggccaactctcttcatgctcggcagttcagctccagcacctacaaccagctgactgacggaacaccctgccgtcccgtcaccatgatttacgctcgaggaaccactcaggcgggcaacgttggagacccagctgccgttgggcccgtcttgttcaacaacctcgcctcccgtattggcttgaacaacttggctgtgcagggtgttgcctaccccgcgaatatcgctggatatctcgctggaggtgacgctgctggcagcaggaccatggctgacctgatctctcgggccgctacccagtgtcctagcaccaagatcatcatcagcggctacagccagggtgcccagctcgtgcacaacgctgccggcatgctgtccgcttctgtgaccaaccgagtcactgctgctgtcacctttggtgaccccaagcagaagcaggctttcggcaccattccttcttcccgcactcgcatcttctgtcgcgctggagacaacatctgcgacggtggcatcattgttacccccgcgcacagccagtaccagcaagatgctcctgctgctgctgagtggattgctgcccgngttttaagtatt

SEQ ID NO: 35635 - DNA, 722 bp, Triticum aestivum
  Clone ID: PAT_TA_35635
gccggccgggtcggggacgagaaacctctatttctacggccattctgtatcttcaatcgcacaacatactcacttccactactcaaaatgcccatcaccaacgccgacgtccctcccacctcaaccgacgacacccactatgtcgtctactttgcctcaggcgaaccctcatggtgccctgactgccgcaatgccctccctgcgctgaacgccgtctttggcgatgcatcagcccccaatgcgcatctcgtcatggcgggttcgcgagaagagtggaggggaaatcctgacaataaatatcgcaaggcgccttatgacattcagtgtcttcccactgtcgtcaaggtcaaatacggcgaggagattggacgtctgggagataatgagagtcagaatgagtctgatcttcgcaagcttgtgaagctatgagggaaacaatcctggcctgggttatggtaaattggttgcgggttgctcatgaacgataaagcatgggcagaaatggccccagcacgtataaaatcccggcatttcagacatgtggtcatcccttgactcccaattagtcaatcatcataaatcaggtttcccattcaaaaaaaaaaaaaaaaaatcacccttcaaaggacatctccccgagattatcgtcaagtcggccgcaaatatagtatccgaacaaatacataaagtggaaatgaaaaaaaaaaaaaaaaaggccccta

SEQ ID NO: 35636 - DNA, 1102 bp, Triticum aestivum
  Clone ID: PAT_TA_35636
gccggccgttccgggagttcaactcatctttcaatcatccaactacttacaatcttttaaccctggtggtttatactctcttttcacaacaaacaaacaaccctcaacacttctttctacaacaaccaacaccatcaaaatgaagttctccatcgtcttcgccggcctcttcgcctccaccgccatcgccactccccagggcaatgtcacccccaacaccatgggcgccctcgagaagcgcgcctctttccccatccccgcctccaagggctccgtcacctacaagaaggtcgagtacatctccggcaccttcgacggtggcatgaagacctacggccgtggtgtcaagtgcactggtcaggctgaaggtggcgacagcgacgccgtcttcatcctcaagaacggtgccaccctcaagaacgctatcatcggcgccgaccagatcgagggtgttcactgcgagggctcttgcaccatcgagaacgtctggtggaagaaggtctgcgaggatgctctctccctcaagggtgacggtaacgctctcatcaagggcggtggtgccaccggtgctgctgacaaggtcatccagcacaacggtctcggcacggtcaccatcgatggcttcaccgttgtcgacttcggcaagctttaccgatcttgcggtaactgcaagaagatgggcacccgtaacgttgtcgtcaagaacgtcaaggcctacaacggaaaggtcctcactggcatcaactccaacaagggtgatatctccaccatcaccggtacttgcgcttcttccgtcaaggagatctgcgttgagtaccagggtaccacccccggcaacgagcccaagaagattggctctggtcccagcaaggcttgcaagtactcttccgtcagctcttgctaagcgcttcgctatagatttgtagactggacgctcagggtagtggccggtctataaaaggaatcgagaggggctaatcaaggtgcttgaagtacccgtttgtgaagattgaggaagttaccaattgtattttcctgtatatataaattctgcttaatacatactctggacaaggaaaaaaaaaaaaaaaaaaggccccta

SEQ ID NO: 35637 - DNA, 886 bp, Triticum aestivum
  Clone ID: PAT_TA_35637
gccggccggtccgggaacggttccccatattctcttcatcgcactgacactgaacgtaccgcttctaccaagaaatactttgctctcaagatggcgcttatggactcagtcaaattgtgcttcggttatgtccacgcagcgctgataacaccatggctgctctcacacttccttttcgacatcaccctctgcctcatcccatatctccgaccctcgcgaaaatggtccctcaaccaagctgtccgcgtccgactcatccgtctcgtactactctactggtcacttaccaagtacggagaccgattgagactcgatccaaaacgggagaagaaccgattcgaagtagtctctccacgatcgcccaaactctacagaggaattctttcggattatgttgtacggccagcacaactgggaatgacttggacgccagcccgacctccacctgcgggactggtcaactccaatatggttgtggcactgcacttccacggtggaggttatgttattgggaatggtcgggatgaagatactggatttctggcaaagacgcttgtgagacgtatgggttgcagtcatgtttgcactccgcagtaccgtctctcgagtagcaacaacggacaatttccagcgcctctccaggatgccctcacagcgtatctcgatctgatcaagagcaagggaattccagcaagccagattattctgtcaggcgactcagcaggagccaatcttgctctcgcattggtacgatacattcacgagcacggaaaagacgacaacattccattcccgaggccatggctctttggtcaccttgggtcgacatcgccggtgctttggagcaggatatcaagcagtcacccaattacaagaccgattatct

SEQ ID NO: 35638 - DNA, 1064 bp, Triticum aestivum
  Clone ID: PAT_TA_35638
ctgtgcggcgctcgaggcggccgggtccggaaaactcttacgagtacgagtgttctttcgcccttggtgagaacgttggcatgaagaacgagcgatgggttcccatgatgtctgctgacaacgcctggttgccccgaaacgagcttttggcctctcatcagaagatggttgctgatgtcgatatgaaggaggcccttgcctctggtcagttccgacctctggtccgaaaggagattgagtctcactgcgccaacttcggtctcgacgctgagcttgtttctcactctcgtatgcgtggtctgtccggtggtcagcgtgtcaagactgtccttgccgcttgctcttggcagcgaccccatcttatcgttcttgacgagcctaccaactatcttgaccgtgactctctcggtgctctttccaaggccctgaagaagttcgagggtggtgtcatcatcattactcactctgcggagttcaccaaggacttgactgaggaggtctgggccgtcatggacggcaagatgactccttccggccacaactgggttcagggccagggtgctggtcctcgtctcaaggctgacgatggtgatgaggaggagaagttcgacgccatgggtaacaagattgtcaccaccaagaagaaggtcaagctgagctcttctgaggcgcgaaagaagaagaaggggcgtatggcccgccgaaagcgtggtgaggaggtgttcagtgacgcggatgacttgtaaacgcatccttcttgacacgtatactcagccatctcttgtaacgacttctcttgatgactacataccattttcctttgtcatgcgttgatcaaaaaagttaggggtgcgtcttttgataatggacaactgcacttttgggctccgatagacggattgctctgttagactaccaccgtggaggaacgaggaaatgacatgggggattggaggatcctaactgtgtttgagccctcgacacggtgggtttggaggttggcaaatagttagagccaaaatagacttgattacgatcaaaaaaaaaaaaaaaaaaggccccta

SEQ ID NO: 35639 - DNA, 641 bp, Triticum aestivum
  Clone ID: PAT_TA_35639
ctcaggccggcctggtcgggatcatttttcttctcttcactcctcaagctctggctcgcgcacacgatgcgaaagcgttgtcaattctgcgcaaccatggcttttcacctcttctagttgttttgtttcacttgctactctatgttggacgcgcttgctggtcaagcgcgtcaacttttgctacaaaattaaaagatgaacacttgacttccaattgtactcgcatatgttatgaacaacagctacgacactagcacgccatgcagcaatctactcttgatgctgcaagcatatgttattcagtgcaaatgctattgatttcgcacaccaagagggcactggccttgataatatttccccaggcatgggaggagtggtattggtggttgtcatttcaataaggtcacaaggctataatatgacgtgaaatcttatctcgatacaatattttggcactgatagtatagccttgttaccttgttgaaattaaggtgccgctgccgccactgttacaattttggggaaacactatcgatcgctggccttttggtttcgaaaggtggtgttatagccacatatttacatctgctggaaatataatacatcttaattgccaaaaaaaaaaaaaaaaaaggccccta

SEQ ID NO: 35640 - DNA, 1130 bp, Triticum aestivum
  Clone ID: PAT_TA_35640
aaattcgactccacttccaacaatcagaaacatagtatccaccatgcttgactttctctccccgcgtaagctgttgacccagctcaccctgggcgctggcctggtagcggctcagctccagactatcagcaacttcggaccaacctacgacacccgtctggtgatgcaggcctatgttccgagcaaccttcccgctaacgcagcagttatggtcgctcttcacccttgtggtggcactggaccgggctatttccagcagaccaagtacaagtctctcgccgactctcgtggagtcatcctcatcttcccatcttcacccaaggactctaactgctgggatgtcgccagcaccaagacccttaagcacggtggccagggagacagccaggtcattgtcagcatggttgactatgccatcaacacgtggaaggcagaccgcaacaaggttttcgtcactggtaccagctccggatgcatgatgaccaatgtcctcgccgcaacataccccgaccgcttcgctgccgccacctgctactcgggcgttgctgccggatgcatggccggatcacctggatccagccccatcagctctgaccgtaaatgctctgatggaaagattgtcaagtctggacaagagtgggccaaccaggtcaaggctatgtaccctggctacagtggctcttaccctcgattcaagacctggcacggtaccgccgactatcttgttacttatcagaatttgcaagagcagatcaaggagtggtctactcttcatggcgtttctcttaccagcagccagcagaacactcctcagcctaactacaccaccatgatctacggagatggaactaagtttgtcgctgtttctgccgctggagttggacatgttgtgcctactcatgaagacgacgactttaagtggttccgtctcacctaagtggatgttacccaaggactagcaaaaggagatggttcaatgagtcaagagttatgatgacatggggttgatgacatgagagtgatacttcagaggtatagcttgttgtttatgtaaattaccaaacaatataaccttctttcgattctggcagcggactgcctagtaaaaaaaaaaaaaaaaaaggccccta

SEQ ID NO: 35641 - DNA, 587 bp, Triticum aestivum
  Clone ID: PAT_TA_35641
gccggccgggccggggtacagtataccgagttaattatctattcacaaagccacataaaaccgcccaacatggttaactttgtcacttctatcactctcctcctcactgctgtctctacagttgttgctcttcccaacactcttgagaagcgtgctgtgacatgcagagatgaccgtcctaacagtgaactggccaatgccaacgaagctgctgcatgcatcgactacctcgccagcctaggcaaccaggcttgtgttgctactatctctggccagtctttctgccgacgtggagatactcagatcactggcctcgctagaggtgctcctacaagaacatctacctgccaagaggtcgctcgcggtgctggtttgattctggatagatgcactcgtggtgatggcaaggtcagaggcgccaatgaggcctggggcaatggcaacctcctcgtcgatatccgccgagttgttcaataagctcccatcggtcataagtttgaaagatcggtcaatatttaattaaacttcataataccaatgatttactattgcctaccccgaaaaaaaaaaaaaaaaaaaggccccta

SEQ ID NO: 35642 - DNA, 1179 bp, Triticum aestivum
  unsure (1)..(1179): unsure at all n locations
  Clone ID: PAT_TA_35642
ggcgagggggatcggcaccacgagcatgggcagcacggcggcaacggggagtccgtcccgatggacgccgaggccgtggcacaggctgctgctgcagctgcggccggcgcaccgttggacccgcacggggcgatggtctctgcgattgtgccgcccgccacgggtaaccagctcaccctttcatttcagggcgaggtctacgtgttcgactctgtttcccctgataaggtgcaagctgtgcttttgctgctagggggaagggagctgaacccaggcatgggtgccggagcatcatcatctactccatacagtaagaggttgaattttccacaccgggtggcatcgttgatgaggtttagggagaagcggaaagagcggaactttgataagaagatccggtatacagttcgcaaggaagttgcactaaggatgcagcgtaatagaggccaatttacatcttcaaaaccaaaacctgatgacggaacatctgaactggcaactgcagatggctccccaaattggggatcagtggaaggtcgacctccgtctgctgcttcatgccatcactgtggtactaatgcacataatacacctatgatgcgtcgtggacctgaagggccaagaacattatgcaatgcttgcggcctcatgtgggcaaataagggcatgttgagggacctatcaaagtctactcccccatctcttcaaatggtgtcaacaggtccaaatgatagtcagaatggaaacaccctctctcagcagaatggaagcaccctctctcagcagaatggaaatgctgccatagtgccctttgccgagcaacaaaacccagcaccagcgaccgatgccaacggtcacgaccatggttcttcgacatgatgagcgggattgctgcttgtttttaatggtggatggatgaaggagcgccatcctctttgagagtgaacttcctgtgtaggcgaaaactgcttgtaatataacctgagagttaggctgtcggtattagtgtcgtctagggtttaaagagctgctgtttttatctgatggaattgtgcttaccgctgttgttgtggctatataacaattatgtttcttgtttgagtccaatgtgaatgccctgtggcctgttgttataaaaaaatgataacaaagtaggcggcttattttctagnaggnatn

SEQ ID NO: 35643 - DNA, 670 bp, Triticum aestivum
  Clone ID: PAT_TA_35643
gccggccgggtcgggatctcattctttttaacctcgctggcgagtgatccttttccacccaatttatatctttgtaataccagaacgaacctctctttaattttactctggttacactctgtcaaagaacaaacaccacacacaagtctgtacacaaaccaccaaaatgggcgccaatctttcctccacattcgttccggatctctcgggcgtcgtcctcagccctcaagacaaagactcagacattcacctcgccgtcttctggggcgcaactctctacatctgcgccatgatctttagcacatgcgcactcatcgaccgctggaagggtccttacgaccgcatccggacgacgggaggttcagtgatcggagcgctgttactatccacggcttggcctgtcgtcatggcctacctcatgtttaaccccgcgtttgccgattgatgagcatcaacatggaaatgggaacgggaaatgggttgcgttgctggttagcgattcggatggacggcgcattttgggagatgatacctcgaggtaccttggatacaaaagatgggcggatagcatattaaatcaaacctggagtttgaatgcataccacatcgatataacatctaatacatattcttttctatgtctcaaaaaaaaaaaaaaaaaaggccccta

SEQ ID NO: 35644 - DNA, 736 bp, Triticum aestivum
  Clone ID: PAT_TA_35644
gccggccgggtcgggaactcgatcatcacgggccgcactcactcactcaacacccctttctttcacgtctcgcaaccacaatcacaatcacaatgtctggtctctttgctcgtcaagcttgggctactgcctccaaggtccgatctactgctctgcgagcaccaaaggttgcgtttacctgcagagtcaacaacattgctccccgacgatcattttcagtttccatgaaccttctggctagaaaatacactgagagccacgaatggattgacgtagccgccgatggcaagacctgcacaattggcatttcaaactacgccgctgaagctctcggcgacgtagtctacgtggaactccccgcagtaggcgaagagacagcccagggcgagtcctttggcagcgtcgagtccgtcaagtcagcctctgacatcaactcgcccgtttctggttccgtcgtcgaggtcaacgaccccatcgtcgagacacctgctgatctcggcaaggaccctgagaagagtggctggttgatcaaggttgaggctgaggatgtttctgctttggatgcactgatggatgaggctgcttatgccgagcacatcaagggggagcactaagcgaagaggcagtggtttaattaatgtttgtgatttaaaaagcaagatatcaagacactttccaacaagaaatttcatttaaaagaaaaaaaaaaaaaaaaaaaaaaaaaaaagcgccccta

SEQ ID NO: 35645 - DNA, 786 bp, Triticum aestivum
  unsure (1)..(786): unsure at all n locations
  Clone ID: PAT_TA_35645
gcggccggtcggggcttaccttacaatttcgcctttctcagtttatttctgccactcagtccagcactccagcattatagccagcgttctctcaacctcgacgaatcaccagcaaaaccggccttatcctcgctacacaagtaccagcagcccatccacaaccgccaacatgagcgcacaacaactcaacattgacaacgccgaccttgagaagctcaacgacaaggaccgcaccgagcttcgccaattcctcgccaacgagcagcagcgttctcagatccaagcccaaacccacagcttgacacagatgtgctggtccaagtgcgttcccggaaccatcaagaaccccaagctcgacaagtccgaggagacatgcttggccaactgcgtcgagcgatttcttgacgtcaactacctcacgatgaagcacctcaacggcatgcgcaactaagcaagcggctttgggggtcattataagtcatgtatgatgaaattggtgtataattagacgggacttggatcggggtggaaaaaattagatcatgtccaggactggttcagctttgctggttgcagagtttgacgatcacgatgtgtacaacatgaaagaataaaggtgtctcaacttttcggtaccaaaaaaaaaaaaaaaaaaggctcctattggtgtgacccaatgacttgatagaattgatggcatggctcaggcagaccaaagatcatctttttatagccatgagaaatcttatacgatagcagcaaaaaaaaaaaaaaaaaaggccctan

SEQ ID NO: 35646 - DNA, 657 bp, Triticum aestivum
  Clone ID: PAT_TA_35646
gccggccgggttcgggatctcatctcaactcacttcaacacaactactacaactacaacacacaaacaactccaaaaccaacccaacaaacagcaccaaaatgaagttctccgccgccactcttctcgccgccgctgccagcgtctccgctgctactgccgtctttgaggtcaaggacttcactgccagctgcattgcccacagcaccttctgcgactacgagttcaaggtcatccagccccactccatggagacctgggagcacgccgtcgtctgcaacgcccgcgctcagtccaccgactacactcttcccgacatcaaggacggaaagtgcaaggactcttcccgcaccttcactgtcacccgtggtgacaagggtcttctcgtcaagatctctcagcccgtcagccccaagagcaacaccgttggagagcacttcatccccaactctctgctcttccagtccgaggttcccaacgccgaggtccagatgtacaacggacccaaggacttcgagttcactcagagctcttagattggctcccttttactttctgtgtctttatgcatgcatgtttagacagttttgcttagattagactattcttttgaatatacttacctaaaccccaaaaaaaaaaaaaaaaaaggccccta

SEQ ID NO: 35647 - DNA, 591 bp, Triticum aestivum
  Clone ID: PAT_TA_35647
gcggggcgtgactcgggaattcattattctcatcacaaataaagaccataaatcacttctaaaacctttactacgagaaactacaaagatcgactgagtagatcgaccaacaacaaattaccacaatcaattggccctactcatacacaacttggcctcaaatcgcattcttacaaacatcacaaaaactatcccaaaatcgaaaatgtgtcttcctttcggacgaagcagcaacaaccgtcgctacggtggcagcagcggaggcatgatgggtgctcgcccagtcaaggaggttcaccaccaccaccacggaggaatgggcggcggccgcatgggtggtggcctgggaggaatgggaggaggacgtaggatgggaggaggtatgggaggaggacgtatgggcggcggaatgggcggaatgatgggaggtcgacgaatgggtggtcgctgctgagagggatactgtgattgaatgattgagacatgactgttcatggaagagcattatatgtataatagagcgcagcgtttaattgatagcacagacgattcgacataccgacggaaaaaaaaaaaaaaaaaaggccccta

SEQ ID NO: 35648 - DNA, 418 bp, Triticum aestivum
  Clone ID: PAT_TA_35648
agagacgaggaattccagtccttcgatttcaacacggacgtcattgcaaatcatggaggtccgacattggcccgcgggagtgtttactaatagcgaagtgttcatgtactcgcttttaatgccttgcatgaatgcaaaatcctctgacatgaatgaatgtgatgcacctgtatcaaataaaacagatgcaggtactgaatttacgaggagtgtacccatcacagtagcaggctggtcctgagcttcattgagatcaacgtggttggcatgaaaatgaccataagacatgtcattgttgtagcgaggctggttgcttccacgaccagctgcgggaagggccagttgattctggttcggattctgatagcagttcctggcaaggtgacctggttggccacacttgtagcacagaccatta

SEQ ID NO: 35649 - DNA, 1158 bp, Triticum aestivum
  Clone ID: PAT_TA_35649
gccggccgggtcgggaacgaatttcccaaatctgatacccaaaatgtcgccttctgctgatattccagaaatctcaaactcagccgactccacggttctgagcttgaagaagtccctctgctccgaggattcacctctacctattcgtttccgtgctctcttttctttgaagcacgttgcgaccactgccgatgacgatgctacaagggtcgctgccattgaggccattgccgccggtttcgcctcgccctcggctttgttgaagcacgaactcgcatactgtctgggacaaacaggcaacactgccgccgttaagcctctgcgacaggttctctctgatcttaaggaggaccccatgtgccgtcacgaagccgctgaggcccttggtgccctgggctgggcagacaacctggacatcctccgcgaataccgtgatcgcaaggaggaggatattagcattgttgagacatgcgagattgccattgagcgtatcgagtgggagaactcggcggagcgacaaaaagagaagctgcgccctagtgactttgcctctatcgatcccgcgcccccaatgcccgaatccgacaaggaggccgaggttgaagaccttggccgaaagctcatggacacaaacgcggatctcttctcccgttaccgcgccatgttcgccctccgagctgtcgcctctccccctgacttgccaactgctactcctgccgtcctcgccctcgcaaagggactgtccgattcatccgccctgttccgtcacgagattgcttttgttttcggccagctatcgcatcctgcgtccattcccgcccttactgaggcattgagcaacaccaacgaggccagcatggttcgtcacgaggcggccgaggcacttggaagcttgggcgaaaaggatggcgttgaagataccctaaggaagttcctgcacgacaaggaaaaggttgttcgagagagttgtattgttgcgctggatattgccgaatacgagaagggtgaggacgctgagtatgctttgattcccgagtccgcaggagctgctgcatgatttatgaatgcgttcgcatcgtcgagtattacgtctagttgttttcattccatctaaaagtaaaatgttaggagtaaaaaaaaaaaaaaaaaaggccccta

SEQ ID NO: 35650 - DNA, 1012 bp, Triticum aestivum
  Clone ID: PAT_TA_35650
gtgcggccgctcaggccggccggtctgggatccaaaccattgatctcgagaactcatttaatacccgtaccagcttatcacaccctcttcaatctcaattcataaatacaacatggcttctcatcacgtccttcttgtcggtggtcatggcaagatcgcccagcttcttactcctctcctgctcaagcgttcgtggactgtcaccagtgtcatccgaactgcagagcagacccctgccattgaacagcttggagccggcctccccggtaaactcaatgttctcgtgcgtagcattgaggatatcgattctagggacaaggctctcggtgttttgagcgaggttcaacccgattatattgcttggagcgcgggtgctggaggcaaaggtggcgctgaaaggactttcaaggtggaccgagatgctgccgttcacctcatcgaagccgcagcttctgtacccagtattaccaagttccttcttatctcataccttggctcacgtcgtgctggtgccccatggtggcccgccggtgagtgggacgacttccacgagaaggtcaacaacggcgctctagccaactactacaaggccaagatcgaggccgacgatgttctttacaaggtctccaaaaagagcccttccctcgttggtatcaaccttcggcccgggaccctcaacgacaagcctgccacaaaggtcgaacttggaaagaccaagcatatctcttcccctgacggtattagccgagaggctgtcgctgaggttgcctcacatcttcttgctgctgatggtgttaagaacggatggtatgatctccttgacggtgacgaggatattcctgctgcggttgatagggtcgttaaagaaggcgtggatgctgctcagggcgaagccatctacaatgcttaagaatgcctggaatctaaccacgacaagaatgttatatgaaacatttagccgagatgaaacactctgatttacagcaaaaaaaaaaaaaaaaaaggcccctaa

SEQ ID NO: 35651 - DNA, 972 bp, Triticum aestivum
  Clone ID: PAT_TA_35651
gccggccggtccgggatccactctttgtttctctgaatattcctgtacatacttattcgaaaatgaagtctttcctcgccactgctctcagcaccctgctgctcgtcaacaatgttgctgccgctgctattgaagacccaattgagatcttcaaccgtcaggccgctggacaagtcatccgtcaatgctccaaacccggcgttctcgctctcgcctacgatgacggccctggccagtacactaaccagctgattgacactctcgacagagccggcgccaagggcaccttcttctggaccggcaagctctacggatgtgtgtacaacaaccaagccgccgtcaagaaggcctacaactcaggccatcaggtcgccagtcacacatggacccacccccagaactttggcagtctgagcaccgaccagctgaagcaggagatgcaaaagttcgaacaggccatggtcaacatcatcggcaagaagcccgcctacatgcgtcctccttacctcgccactggcggtaacgtccttcccaccatgcagcagctcggctacaaggtcatcaccaacgacgtcgactccggtgactggaacggtcaatctgctcagcaaagccagcaaaagttccaacaggctggcgctggtggcaacggccacatccctctcatgcacgagacctatgccagcactgtcaacaccctgactccctggctcctcaactgggcaaagcagaacaacctcaagattgtcactgttgctgagtgtcttggtaacgctgctggtgcttaccagcctggaaccttccagggtaacggccaaaacacctgctaagtgttctgacagatgtcaatgagactgagggtttagtgaggatcaaattcttgtacatgtaaatatgtttggctcacgacagaagcctgaaacgtctcaatatacttaaaattctgaaaaaaaaaaaaaaaaaaggccccta

SEQ ID NO: 35652 - DNA, 982 bp, Triticum aestivum
  Clone ID: PAT_TA_35652
gccggccgggccgggatctgatcgatcctgacttgctattaatacctgctttttacttctgcttttctacctcttatcatcgactaagaatctgaaaacactgcaagatgtccaactgtattttctgtaaaatcatcaagggtgatatccctagtttcaaactcttcgagagcgacaagactcttgccttccttgacattggaccccttagcaaaggccacgcccttgtcatccccaagtatcacggagcaaagcttgccgatatccccgatgaagacctcgctgaggttctgcctgttctcaagaagattgtcaacgcgactggtgccaccgactacaatatccttcagaacaatggtcgcattgcccaccaagaagttgatcacgttcacttccacatgatccccaagcccaacaacgaggagggcctgggtgttacctggcctactaaacctgccaatatggaacagctcaaggcctactgcgaagagatcaagtcaaagatttagagggatgtatcaaaactgtggtatccagtatccagtgcaagtgttggttcttaagaagcccgtctggtattattgtcaacgtgccaggtaccgccctgcgcccacgaaatcaatatgattgtctacagcccacgtccattttgcgcttcgttcgtctaatctaagtcatcggcagaagtgctggccgcagcagttgggggcttgagtgagtaccagtcggttttgccaccgctctggatcgctccctgtctgtcgtacagtgttcgcgctcggatgtacgggtcaagatgccagtagtcctcttttagtaatttggcaatcttctcgcgctcagacttgatctgcttcccttgttcgccctcagggtgacgaatccattctcgagtcgcttgttcaaacttcttgaccaactcttcacgctcgaccaggagccgttttcgcgattgcggtccttcatcttcgggtcgaagaaa

SEQ ID NO: 35653 - DNA, 693 bp, Triticum aestivum
  Clone ID: PAT_TA_35653
gccggcgccggtcggaaccctcctttctacaacccccgcgactttgactttaactcaattcgacgactgtattttcatttcctcccattatcttctctcattcacgcaacgtacttttaatatctctctccgtttcttccaccatccaaaatgtccgaccaggttcaagagattctcgaggttccctccgagttcgtcagagacggtgttcaattcatgcgacggtgcactaagcccgaccagaaggagtttctgcgactctgccaagctgttggcgttggtttcctcatcatgggcgccgtcggctacgttgttaagctggtgcacattccccttaaccacgccctcgtcggaagcgcataaacggtcacgcgatacgttgatgagattctggatggcgacttgataatccaaaaacccgcaacacgggaacgaggacaatcacacctttcttgcttgcgggtatgcttaacggggcggagttacatgacattatggcgggcacgcgacacacttctacgctgaaattcgaccgagcgccatgggagatgagaaggaggatgtgctttcacgtccaaggcgctatttgtgtggattgagaaatatccactacgaaaaagacggctacagtgattaattgtacaaatatatccattgttatttctgcaaaaaaaaaaaaaaaaaaggccccta

SEQ ID NO: 35654 - DNA, 616 bp, Triticum aestivum
  Clone ID: PAT_TA_35654
gtgcggccgctcgggccggccggtccggaaaccagtctctttactcatctcttcatatgcgctacctccaaaacattgtccttttgatcggtttcctgggagcagctcctgccgttcttgcagttgcgccatccactgagagttctggagttgagattgcccagcccaatgcggccgatgcacagccaccacaagccatccagcctcaggatgtagaggaggagaatgacgaggaagagaatgatttgacgggcaatgatggcgccgccgtgttggctcagcttgagtcccgagctcgtgttaaatgcttgactagaggccgacctggcaagaactgctatcactcacaatgccctggaaataaacagtgcaaggtcaacacgcgaggaaactgtgtattcaagctttctcagaagaagaggccctttggttgcagccaatgtctttgctaccgctcgagcttgtgaggagtcaagactggaatctccctaagtagtgttagatattatcttatgcccccccgctcttctatataagttttacatattcagtccctggagcttcaaatacatacatctgttggatatgcaaaaaaaaaaaaaaaaaaaggccccta

SEQ ID NO: 35655 - DNA, 933 bp, Triticum aestivum
  Clone ID: PAT_TA_35655
gccggccgggctcgggactctatattcatcattcagaaatctatctcacaatgtctatctcatcagagccaggcacacgcggtaacctcaccgccgagcagaaccacagtctgcaagaagcttgggtacacctgcttcgtctctgtggaaaccagacaatttgtcaggatgttcccgagaaaacaaacgatttcttgcagcatctgaacaacaagtctccagagaacttcagtcggagtttgtgggaagcctttttggctgaccatcccgacactacacttctccgattccttcgcgccagagactttgatgttgtaaaggctgtcgacatgtttgtgtcctccatcaattggcgagaagagcgacaagtccagaagactatcatcggaggtggcgaagcggtcggtttgaagacctcgcttacacctgatgaagaggctttcatggcgcaatactgctctggcaagagttatgtcagaggcacagacaaagacaaccagcctgtctacgttatccgtgttcgactccacgatccccataagcagaccaccgaagctatggagacgtacgtcctgcacaatatcgagactctcagaatgatggctcgagcacccaacgacaaggtctgcctaatttttgacctgtccggtttcggccttcgcaacatggatttccacgtggtcaagttcctgatcgacgtcctcgagacgcgatatccagagactctgggagtcgtactcgttcacaacgcgccgtttgtattctggggtgtttggaccgttatcaagcactggttagaccccgtcgtcgcttccaaggtccatttcacaagcggagccaagggtcttctcaagttcatacctaagaataacttgcaaaagtcctatgggcggggacgacccctgcgagtacaaatacgtccagccagtccct

SEQ ID NO: 35656 - DNA, 1802 bp, Triticum aestivum
  Clone ID: PAT_TA_35656
gagtcccgaatccaatccgccattgcacagccggaccagtgccactcgaaccccacgtaccctctctatcccaaccctagcgcggcggcggcgtcgatggcgtcgatgcgcccgtctgacgaggtctccgagaacggccacggcaacggaaacggcccatccccgccgcgcggcaagcgcccccgcgcagcgttgatctcggtcgcccagatccgcgacgagttcgcgcaccacgaccccgcagttgcccgcgtcaacaacggcagcttcggctgctgcccggcctccgtgctcgaagcgcaggcgcgctggcagcgcctcttcctcgctcagcccgacgccttctacttcgacggccttcagccggggctccgccgctcccgcgcagccgtcgcggcccttgtcaacgctggggacgtctccgagatttccctcgtcgacaacgctaccaccgctgctgcaatcgtgctgcagcatgccgcctggagctttgccgaggggcacttcgctcgtggcgacgctgtgctcatgctccattacgcctacggagcagtcaagaaatctatccaggcctacgttgcccgcgcgggcgccactgtcgtcgaggtacccctcccgtttcccgtcacctcccctgacgccattatcgcggagttccatgctgcgctcgctgttgccaaggccggtggtcgtaaggtccggcttgctgtcattgatcacatcacctccatgcccagtgttctcattccagtcaaggagctagttgccatttgtcgccaagagggcgtcgacaaagtttttgttgatgctgcacactctgttgggcaagtccctgtcgatgtgcgagacattggggcggatttctacactagcaacctccacaagtggttcttttgccccccggccgtggctttcttacacacccgcaagggtggcccgataacctctcagctccaccaccctgttgtgtcacatgaatatggcaatgggctacctatggagagtggatggattgggacacgggattacagtgcccagatcgtcgttcctgaagctattcactttgtgaaccgatttgaaggtgggattgaggggatacgcagccggaaccatgagaaggtgattgagatggggaaggatgcttgccgaagcatgggggacagttcttggatcaccaccagtaatgtgtggaagcatggctatggtagggatgcctagttgtctttgcattgagagtgacgatgatgcactgagagtgcggaccatgttgaggaaggatttcaaagttgaggtgcctatatactacaatagcagacaggttaaagtgcaagagatggcaaaggataatagtagtgatccagtgacggggtatgtaagaatctcacaccaggtttacaatgtcaaggaggagtatgagaggctgagagatgctgtcaataagcttgttgctgaggggttcaccagtgccgaattgaggccagctgagaagcaagaagctctggcttgatgacgtggcatctagccagcactccatccgaagatggattaattagttgtggatctgtgccagaagcctgtgctgcaccgagatcgagttctttggtagcccgctcaatggcatcgccatttgatgtagtgtactttcacatactgacaaatgttgtatttgagcttgcaataacgtgcactggaatggaatgtatgtcttctcccttcacttgcatttttgagctgtaatgtaagaataatgatctgaatgcaaggagacttgcatgctttctagattgattgcagattacaga

SEQ ID NO: 35657 - DNA, 835 bp, Triticum aestivum
  Clone ID: PAT_TA_35657
gtacctgattatttacttacgctttgatcatcatcgacttattattagcagggttctgcctgtcttattgggcccccactaacaaagagacaactcatcaacccaactcgccctgcccattatcctgagctgagctttgggaaaaaaagaaaagaaaatacaaaaatcagggagacagggaattgatataaacctcttcatttctctctcagctttgttctcatcatcacttcaaacacaactcaactcatcacttatacaatgtatcgtcaaaaccaccccggtcctctctccctacccacaacctggagtcctcccaccaacgacatgatgcccaacaaatcccctaccaccgatacaaaccagcgaagccgacaagcaagcacatgctccgaacgtagctgcgaaggcatgacgctcgacgaaacaagagagctgtggagatgcatgctcgaactgcagcttcgctacggatgttataactccaccaggatagacatggctgttgatgctggagaagatggtctcgacttgatgccaaaccgctttattatcgatactctcaatgagtctgtcattgaccttcccgatgaaggccgcgaactgcttaaccgctatttatgtccttcatcaccaaacaataagcaaaagtggaagttctggaaaaaaaaaaaaaaaaaaggcccctatttgatatatcttatggcgttgcgaaagcgggatggaaaatggcattgagcatcgatacccacgatatcagaatggcactgatttattaaatacgacataattatttaaacattgatcatactctcaaatacttactcactaatcc

SEQ ID NO: 35658 - DNA, 478 bp, Triticum aestivum
  unsure (1)..(478): unsure at all n locations
  Clone ID: PAT_TA_35658
gccggcgccggccgggaattatcaacatctacatctacaacatctctacactacaaaccaaacctacttacttctttttccctttcacaacacaaacttcacaatggatttcgtcaagaacgctatgggcggtggtaacaaggacggtgctaccaacagcaacgccggcggcgcccagaaggaagactacgtcgacaaggccttctctgccctcaacgacaaggctggcaccaacgtctcccgcgacaaccaggagaagatcaccgactttggccgcaacgcctacgagaagaagactggcagcaaggttgaccccaagtactccaactaaagagaggaacaatttaatgagatggatggatgggatgctctcaaagcgataaagagctagtatgaattaatatgacataattattgatccaaaaaaaaaaaaaaaaaaggcccctannnngaannnannnnnaaaaaaaggccccta

SEQ ID NO: 35659 - DNA, 883 bp, Triticum aestivum
  Clone ID: PAT_TA_35659
gccggccgggctttcgccgcctacatttcaattttatagacaaaatgcagtcaggaatatcagcttctcaggagcttcagaacgagttcaactcgttgctgtcgtcgaccggcacctttggactcctcgcaaccatcgagaaggagtccatggtccctatcaccacgatcccctccaagtcgagctctttttctgataacctttctggtcttgagcctcacctcaagcccgatgtcgctctatacattatccttcgtcgtcacgaggatgctcctcgattcatagccatcacctacgtccccgactcggcaaaggtgcgccaaaagatgttgtttgcttctactcgcttgacctttgtgcgagagctaggcacagagcacttccgggagaccatctttgtcacaacgcccgaagagctgagtgttaagggcttcgagaagcacgatgcgcataacaagttggctgcccctctcaccgaagaagagcagcagctgggcgaggtcaagcgtgctgaacaggaggctggtcagggaacgggacacaaggctattcatctgagcaagaactttgctatgcccatctccgacgaggccattgctgctctgaaggaagttggcgaggacggcggtcgacctgtgacgatgctgaaaattaacccctcgactgagaaagtggagctcgttcccgaggcacccacgccgagcggcatttcagaactgacaaaggccatctcgtcgaccgagccgcggttcaccttttaccgctttaccacacacacgacggtgccgagtcgagccccgttctcttcttctacacctgcccctcgacgcccggcacaagtccatcaagttccgcatgatgtaccccctgatgaaagcgtccg

SEQ ID NO: 35660 - DNA, 766 bp, Triticum aestivum
  Clone ID: PAT_TA_35660
gcttctcacccagtgccgcccgcgcgcgcccacccaaccatcagctttcaatccagctaccagttcccgtctcagcatcagcacacggatttctcctcgggccaacctccggatccatcaacaatggcgaactctgtctccggggtggcggtgaatgaggagtgcgtgaaggtgttccaggagctgcgggcggagcgcaagcaccggttcgtggtgtacaagatgggacgacgacgcgcagcaggtggtggtggacaaggtggggcgccctcgacgccaccttcgacgacctggcggcggccgatgcccgccgacgactgccgctacgcggtgtacgacctggacttccgtgtccgaggactcggcgggggacacgccgccggagcaagatcttcttcatccactgggtccgccgggagtctgcgggacgcgacagaagcaaggattgctgtatgccagctccacggaggggctcaagaaggagctggacggcgtgcagattgacgtgcaggcaaccgacgccaagcgcagctcaccctcaacatcgacaaggactacaccacctaattaagctaatccatcccggacgctcgcacgagcggtcggtgtctggataataattttcttttttccatgtgtagtggtttgtgaatgattgggttttcctttttacttcctcgagattgataattgagtgcttgatctattccttaccagaaaagaaacttataatgacagcaatagatccccgggggggccgaccatc

SEQ ID NO: 35661 - DNA, 421 bp, Triticum aestivum
  Clone ID: PAT_TA_35661
gcgaggcgcctggaaagatggcctcggtgtgaacctgggtggcagggcggtgttgggtacccacacgcggcgcttctgaggaccagcaccggacgaggaacccatgtcacgtccatgcttgcgtgttgcgtcatagtcagtctgaccagtttcagcactgatggctttgttaacaagtttcgaaaaagatgtgcactcatgcagacggaggtcgcggcgaagctcaggactaaggcccttacggaaccttgcttgcttcttggcgtcagtagaaacttcctcagttgcatatcgggcgaggttaccaaactccctgctgtaagcatccacagaaagtcggccctgggtgaaactgcaaaattcttcacgtttacggtccatgagaccctccggaatgtgatgttcacggaaagcctcgctg

SEQ ID NO: 35662 - DNA, 461 bp, Triticum aestivum
  unsure (1)..(461): unsure at all n locations
  Clone ID: PAT_TA_35662
gcacgagggccgccccgtcccttcattcccacccgcctacttcacgcgcaccaaccaccccctccgctgcttcagttcgtccgctccatccatcccgtttctattccgagtggacgccaggcgcataggtatatttggctgtagagagcctgatttagaagataggaggagcacatctttgagagggaggagcatgccgacgggaaccatgaggaggatgttcgtcgagtcgtcctcgtcctcctccgggagcggcagggaggcggagccggcggtggtgctgtgcgcgccccggccccgcagggtccacgcccagccctgcagcgccgacctcatcctcggccccccgcccttcctgctcaacgcctcctccggcagcataaagcagagacaagggaagagcaaaacgcgggaggaggagggggagggggggnnnnnnnnnnnnnnnnnnnnnnnnnnnn

SEQ ID NO: 35663 - DNA, 889 bp, Triticum aestivum
  Clone ID: PAT_TA_35663
gacggctgcacggcgtggctcgacagccagacggacggaaccgtcgtgtacgtgagcttgggcagccttgccatcatttcggtcgaggagttcaccgagttcctgtccgggctcgtcggcgccggccaccccttcctttgggtgctcaggccggacatggtcggggcgagccagaatgccgtcctccaggacgccatcaaggcggccgggagaggcaaggcccgcgtcggggagtgggcgccgcagcgggacgtgctgcgccaccgggcagtgggctgcttcctgacgcatgccgggtggaactccacgctggagagcgtcaccgagggcgtgccgacggtgtgctggcccttcttcgtggaccagcagaccaacagccggttcatgggcgccgtgtggggcaccgggctggacatgaaggacgtgtgcgagagggccgtcgtggagcggatggtgagggaggccatggagtccgtcgagctaaggaggtcagctcaagcgctggcgcagcaggtgagacgggacatcgcccaaggtggctcgtcggcggaggagttcaagcggctcgtcggcctcatcaatgagctcagcatcagcacgcggggctccacaccaagtccagacaaagaataatgggcggccggcattggcacattgttgctagtatcattcgatgttgctgtgtgagtcttgccgaaaggcagtacgaacatgacaatgcctatttgacatggcatttgttgctgctagatccttgtgataccacattgcactgtgacaattcgctaggatgttcaagtgtcacatctcagatctcactaccttggcttaccagttactacatgattaacaatcaccgaacgaaaaaaaaaaaaaaaaaaggccccta

SEQ ID NO: 35664 - DNA, 765 bp, Triticum aestivum
  Clone ID: PAT_TA_35664
attctgctggctatctcttctttaacaccatcttccattcttactacacacataccaacctttcgtcactacctacccaacagcgtggcctagtgcaataggctcccagcacctccatcacttaacgtgacgaagtcgtccgtcacccccacttgcttgacctcgcctaccactgtcaaccaccatcgtgcaaaggacaaagcacaacaacaaatcaccaataatgtctgacgagaacgcgaacggtacacccggcgagcaggcccctgccaactcggaacacctcaacattaaggtgacggataacaacaacgaagtctttttcaagattaagcgcaccaccaaacttgagaagctgatgggcgccttttgcgaacgtcagggcaaggcaactagttccgtccgatttctctttgacggaacgcgagttcagcccacggacacaccagatgcgctcgagatgcaagacggcgatactcttgaggtgcaccaggaacaggttggaggatcttcactgtaaagaggagaggaagctcggcgagggatgcatcacaagaggagcacatcagatggcgaattagccacacgacctggtctttgaaactagatcccgaccgtcacaggttggatttattggctttttgcacctctgatgacagcgagattgaagccagctcgacaacttatttacgactggggtaatacaacctgactatttacgcgaaaaaaaaaaaaaaaaaaggcccctaggaccgcgtccgctct

SEQ ID NO: 35665 - DNA, 681 bp, Triticum aestivum
  unsure (1)..(681): unsure at all n locations
  Clone ID: PAT_TA_35665
gtgcgcggctcgaggccggcggtcaggtgcggcggctggtctcggcgttattcccattctaaacaaagtcccaccaagtcaacatgtctggaaaccccgtacctctcaccgtcatcaagggcgctggcttcgagcacatccctctgccaaacggcgtcaacgccactacagccgacttccacagcatccgcacaaagaccgactcccccgctcacatcacctctggtttctacaagattgaggccggccctgcccgtcctgcgcagtacaactttgaagagtcaaagtatgtcctgagcggtcaagtcgatgttctggacgaggccactggtatcacccatcacctcaccgctggtgactttgccttcttccacgtcggctccaaggtccagttctctaccaagtctcagggttttgctttctacgtcgtcactcgacctgttcgtgatgcccaccctaacttgaagggtcgggaggaggagaccaagtcgcgcttgtaagggttttatcgcaaaaggaataatgggaaaccggttttacgatacccgtctgctatgatcaatagacggtaatagataagaacaattcattcatcaattcaaaaaaaaaaaaaaaaaaaaaaaaactactccctannnnnnnnnnnnnnnnnnggaaaaaaaaaaaaaaaaagggccccta

SEQ ID NO: 35666 - DNA, 696 bp, Triticum aestivum
  Clone ID: PAT_TA_35666
gccggcctgccggccgcttttcccgtctatctcgaataatcgtgaaatcccaatgagaatggacagtacgaccatgacctcttcaatgaacaaatactggattccgcatcaagacatccacagaaaagtcataacccaagagcttcagtgctatctgggacctcaggcaacagttcgaccatatacgttggagggagaggatggtttcctcatcagcactccaggctcctgcctcacagatgaacaaatcgatgatatttgccgaaagtcgaaagatctttgggatcgacaagccgcagccaaggtccaacagaatccggagaaactgttgaaacgaccgttacaccagcctgtcatcgtttcgagagggtcgtccagagaacctcatcgacgttactatgattgaccccggcatgattatcattgagctccgatatgactcagctgtcatgatcatgctacctcgtggtggatgccaagactctggcaggcaatcgtagggggttgtctgcatatcaaatgttgtgaccagcaaaaagaaaaaaaaaaaaaaaaaaggcccctacgtttcgtgtgcaacgcttctagacggcggtgaagcaaaaggcactgaggtgaaacgccaacggtggagtaaatgctgtatggtgcccaatacagacgtgtggaggatctgatatacccagctgttccaat

SEQ ID NO: 35667 - DNA, 799 bp, Triticum aestivum
  Clone ID: PAT_TA_35667
ctgtgcggcgctcaggcggcggttcggaggattccaataacctgaagctttattgtaattaacgtctacgtttatatacactcatgggcgcaaaatctctcagtgttcttggtaacgatggggctggcaagaaagccctaatcggcagccttatctataagtgtgggcttgagcttccccaactgcagcagctggaaagtgagggcattagtcagtatgagaaaattgtaccattcttcgagaaaaatggacttgctcaatctttttatgccccttctggagcttttactgttcagaaaaaccagacgccagacgttgctttctgggttgttgatgcttctgattcatctagctggggttcatctgccgagaaactctcaactacgttgtcgagtggtgtgctcaacccacgggagaaactcatcattatagtaaataagatggactcagtcaactggtctgagcagacattcaaagacgtcgtgggcgcattcagttcggtcaatatgaacaatgcatatatcatcccggtttctgcccttcgacaagaaggaaacatactcccaactcctgaagcgccctcatgggtacagaagatatctgctggccagtttgagggatccgcatcagcctcgggtgaatcgttaatgaatcttcttagttaggtgaacgttcacgtatttcagttctatctactccttagctgtagcgtattattaacagaagggaggagcggaatcgttggggatgaatagacagtttcgaactgagaaaaaaaaaaaaaaaaaaggcccctaac

SEQ ID NO: 35668 - DNA, 989 bp, Triticum aestivum
  Clone ID: PAT_TA_35668
ttttctctgaagactttggtcccaaggatactgatacttatgggctcggccctctgataaaagttaccaatgataacgtccgagcacgctacagccaagaagatggtggaaagagggacatgttgagctccttgaaagcctctggacttccggaaggcgaggcccaagccgagacacttttcctgttcattgcaggatccgatactactgcggcagctattcgcgtcactatgttttatatcatttcatcaccgcgcgtctatcaaaagctcaaaaaagagatccgaaaggcgatacatgaagggcgcgcatctagtcccatcactgttgcccaggcacgagagttgccctatctacaagcggttatctacgaaggtctccgtattcggccagtgacaacgggaccgcagtctaaagaagttcctccaggcggtgacactatcaatggacactttatccctgaaggcacatcaattgccatcaacttccccgccattatgggctcaaagaagctattcggacccgacgctgatgtctttcgacctgagcgttttaccgatctccaagaccccgatcttgccgagatgcgacgcaatgttgagatgaactttggcaacggacgctggatgtgtgctgggaagcccattgcctttatggagttacataaagtctacttcgagttgctgcgggcatttgactttcagctcgtagaaccgcttaagcctatgacttccgagagttattctctgttccgagatcatggactgaatgttcgtgttacgctggcggaggatatggagtgaagagaattctactacagcataacagattgacatacggacgtgattgttgggaatgggtggcacatcaggttccagaagtttctacgcttcatggaatagcacttttgattgcaagataggtcttacataggcagaacttaataatactcattgatctgcaaaaaaaaaaaaaaaaaaggcccctaa

SEQ ID NO: 35669 - DNA, 817 bp, Triticum aestivum
  Clone ID: PAT_TA_35669
gccggccgggtccgaaccagcatcgacttctcctcaccagcaactaaacaaccaacctcttcactattattccatataaccttgccagcctcgactccttcatctatccatccttctacatcaaccattaatatgcaattcctcagcctcgtccttatggctacctcaaccctggccatccccgccaagctaccctccaaggccccagcaccaacatgtatggaaaagggcacaaaggtttctgaatggaaactcacagacttcgtctacaacgtccagaagagcacaaacaccgccacagtcgagtttgacctccacaacgccgctctcgactacacggccaactgctacggcaagtcagtctccaagaaggccctctttgacggcaagaccgactacacctgcaaggtccccaacggagccgactctgccaccttcaagtacaaccacaagaagggcgtcatctccatcttccagcactgggcctgcgtccaggagggtggttggttcgaggccattggcaacaggacttctaccgagaccaagtctaactgccactctacgaccaagtccgagacttgcacaaaggcctccttcacggtccccgttctcgagatgcgcgcagtcttgtaagaggcggaaccgcgacatcatcttcttttcttttgcggcagccttttccgacaaacatttttaataatatctaagcgcaagcttatggcgttggggccatgaccctttcttcatccacactatgccgaaacgacggctggataggatctaattttatgatctccatgacattcatttacgacca

SEQ ID NO: 35670 - DNA, 671 bp, Triticum aestivum
  unsure (1)..(671): unsure at all n locations
  Clone ID: PAT_TA_35670
catttccctccacaccagccngacacctcaagctcaaccccgatcgatggcgcccaaggccgagaagaagcccgcggagaagaagccggccgccgaggtcgcggagaaggccgagaagacccccgccggcaagaagcccaaggcggagaagcggctgccggcgtccaagtccgccaaggagggcggcgacaagaaggggcggaagaagaacaagaagagcgtggagacctacaagatctacatcttcaaggtgctcaagcaggtgcacccggacatcggcatctcctccaaggccatgtccatcatgaactccttcatcaacgacatcttcgagaagctcgccggcgaggcggccaagctggccaggtacaacaagaagcccaccatcacgtccagggaaatccagacctccgtccgcctcgtcctccccggcgagctcgccaagcacgccgtctccgagggcaccaaggccgtcaccaagttcaccagcaactagggttccgtcgcggtgtctctagggttccgtccccgtgttctcttctagtagcttttgtgtcgccgtcggtcgtgcccatgtgtatcgttataggtaggtagcgcgcctgctttgtaaatcgtgtcaggttgtgatggacggctttgatttcatttaatgggagaggttgtttgtg

SEQ ID NO: 35671 - DNA, 1017 bp, Triticum aestivum
  unsure (1)..(1017): unsure at all n locations
  Clone ID: PAT_TA_35671
gcaccaacccgcccatttccctccacatcccccccacagcagcccgacacctcaagctcaatcccgatcgatggcgcccaaggccgagaagaagcccgcggagaagaagccggccgccgaggtcgcggagaaggccgagaagaccctcgccggcaagaagcccaaggcggagaagcgtctgccggcgtccaagtccgccaaggagggcggcgacaagaagggccggaagaagaacaagaagagcgtggagacctacaaaatctacatcttcaaggtgctcaagcaggtgcacccggacatcggcatctcctccaaggccatgtccatcatgaactccttcatcaacgacatcttcgagaagctcgccggcgaggcggccaagctggccaggtacaacaagaagcccaccatcacgtccagggagatccagacctccgtccgcctcgtcctccccggcgagctcgccaagcacgccgtctccgagggcaccaaggccgtcaccaagttcaccagcaactagggttccgtcgcggtgtatctctagggttccgtcgccgtgttctcttctactagcttttgtgttgccgtcgcttgtgtccatgtgtgtcgttataggtaggtagctcgtctgctttgtaaatctgtgccaggttgtattggatggctttaatttcaaggtactaattgtggattttgaatgcgcctgctttgtaaatcgtgtcaggttgtgatggacggctttgatttcatttaatgggagaggttgtttgtgacaaaaaaatcgccgttgcgtcattctgccaaaataattggggatctagggtttgagggagtgggtgctcgagccgccgtcgacgccgccgccactgccgatatttgcgagggagggtgatgcgtttggcctctcgtcacttgggttccatggcttcagcaccgagatatttgtgaagcagtaagcaatcatcctctgtttcaccccattccgtgcttgaattaaatgnttggtactccttgtac

SEQ ID NO: 35672 - DNA, 714 bp, Triticum aestivum
  unsure (1)..(714): unsure at all n locations
  Clone ID: PAT_TA_35672
aagtgctatactgccggccgtccgattgttcattccactcatactcacattcagttttatcaattgacaatctctctcttcaagcaaccacgaacaactcaacctttcccaccaacaaaacaacccatcaccaccatgtctttcctcaccaagaacgtcatccgccgtgcggctctcgctcctcgcgtcattgctttccaagctccccgaacattcaccactagattcgccctgcagcgaactgctaccgatgctgtcaaggacactgctcaaaaggtcgatcgtgttgtgagcgataagattgtcgatggcattgaggctggacaggaggctgctgccaccgttaccaaaaagacccaagagctcaagggagatgcttctgctaaggctcaagagctaaagggtgaggctgctggcaagaccgaggagctcaagggcgaggccaagggcgctgctgagcaggccaagggcaaggcaaagggtgccgctgaggaggctaagcacaagttgtaagcgaagaaatgcttcaacttgtcaagatcgagaagggaaataataaatatcagacccaatgacggtctgttgtacaattacaagccatgcatcatacggttaggcgatcaatcataatgcattattttttttccaaaaaaaaaaaaaaaaaatgcccctaaaaannannaaanaaaaaaaaaaaaaaaaaaaaggccccta

SEQ ID NO: 35673 - DNA, 874 bp, Triticum aestivum
  Clone ID: PAT_TA_35673
atgattgctctcgtcttgctaattctgacattccccgaataaactcatcttgtccgtcctcctctacgaactgccactctgcgctcacggacgcaccaattgagctccctcacccctcgccctcccgacgaccaaaattacaatatatacgcccgccatgctgcgcacatcggccaccaacctgctgcgcaagagccttgtgcgcagcactcccgccctggcctcgcgagctgcctcgactcacgccatctccaacccaaccctcgccaacatcgagaagcgatgggagggcatgcccctccaggagcaggccgagctctggatggctctgcgtgaccgcatgcagtccaactggaccgagttgaccctccaggagaagaaagctgcttactggattgctttcggccctcacggtccccgtgctgaggacccccctggaaccaatgcccgcgtcgcctggggtatcttcattggtattgctgccagtgtcggtctctttggcctggtccgccttgccgccaagcctgctccttacaccatgacccaggagtaccaggaggagaccaacgagttcctcaagaaccaaaaatccgatcccttcactggtatcacctctcctggttacgccggcaagggtatggtccagtctcctcccaagggcaactaaattcaatacacaacgtcgtttcttttgtgctagaagcttgggtgactctacggagacgtattggtgtgtaaaacagcctctggtgtgcgcgggcatgactaggggtttcgaggtcgctccagagaaattaagtcctcctggtgtaaatactgtactaaaacaacggaacccgagtcgcgacaaaaaaaaaaaaaaaaaaggccccta

SEQ ID NO: 35674 - DNA, 1886 bp, Triticum aestivum
  Clone ID: PAT_TA_35674
ggatgtcatctggcgtcggcggcaaccggcgtcggcgtgggcggcgctgggcgcaggtggacccgggcgtccatatcaccgctcacggcgtgccgcaaggtggcaacgacctcaaacgcatccgattcagccgtgagatgttcaacaaatggcaagcgcaaagatggtgggctgaaaactatgacaaagtcatggaactttacaacgtgcagaggtttaaccatcaaagtgttcctctccctactactccaaagtctgaagatgagagctccaaggaggacagcccggtaacaccaccactggacaaggagcgagtacctcgttctttacagagaccaacatcgggaggcggagcgatgggttactcttcatctgattctcttgagcaccattctaaccactactgtaacggtctccaccctcaccatgggcaccagtgctatgattcagtgggactggcatcgacaccgaagctgtcaagtataagtggggccaagacagaaacgtcatcgatggatgcgtcaatgaggacgagttcatctccagaagaggtcgacagatccggtgagctctcggtgtccatcagcaacgcgagcgaccaagagagggaatgggttgaggaagaccagcctggtgtaccgattaccatccgggctttgcctggtggcatcagagaactccgccgtgttcgattcagccgagagaagttcagcgagatgcacgctagaatatggtgggaagagaaccgagcgaggatacatgaacagtacctctgagacaggagaagaatgggtacagatggtgacaataccggggacttcgccgttgacatcgctcagccgaggtggcatggagtacatttgcagtttgagctaacatgacatgttcaacgcatggcaagcgcaaagatggtgggctgaaaactatgacaaagttatggaactttacaacgtgcagaggtttaaccatcaaagtgttcctctccctactactccaaagtctgaagatgagagctccaaggaggacagcccggtaacaccaccactggacaaggagcgagtgcctcgttctttacagagaccaacatcggggggcggagcactgggttactcttcatctgattctcttgagcaccattctaaccactactgtaacggtctccaccctcaccatgggcaccagtgctatgattcagtggggctggcatcgacaccgaagctgtcaagtataagtggggccaagacagaaacgtcatcgatggatgcgtcgatgaggacgagttcatctccagaagaggttgacaggtccgatgagctctcggtgtccatcagcaacgcaagcgaccaagagagggaatgggttgaggaagaccagcctggtgtatatattaccatccgggctttgcctggtggcatcagagaactccgccgtgttcgattcagccgagagaagttcagcgagatgcacgcgaggctatggtgggaggagaatcgagcgaggatacatgaacagtacctctgagacaggagaagaagcacagatgaaaacaataccgaggactttgccgttgacatgagccagccgtggatccatgttgtacatttgcagtttgagctaacattactccctctctgggcagcgtgtgtgaggtgaaggcgtctacagaaactgaactatactgatctgctaggctctctctgattatgtggccatccaaatgttctcctgcatgggtttttagctttagattgcgcaggaacttcgtttgtgtcgggtagctcgaaagggtgcgtactgtgtcattaggctaaagataccatctgttctgaaactgtggcttgccaaaatcaattccccacctggaatgctgggaacttttttgttgg

SEQ ID NO: 35675 - DNA, 590 bp, Triticum aestivum
  Clone ID: PAT_TA_35675
accatcgccgaatcatccatcgatacacaagtcatccgtacgcatctcgtttgccagtcttttcgattgattgaccgatccatctctcgccgccggtgaccgtgatggaggaggcgctcatctcgccggagctccgggacgtgctggccaaggtggcggtgttcctgctcgtgcaggggctggtgtacctcatcctcaccaactcctccgacgtcttctccaagaacaagaggctccggtccctcagcttccggcccatgcgctccatgagcgtgcgccgcgtcctggcgccgctctccgacgtccccgtcggcaccgacgacgactcgccctcgccttcgctgttttcgtcttcttcgtggtcgtcgcgccgctggggtagccgcaaagaggattgagcagcttggagtttggaccggttgcttaattagttctgacgccagatgggtagctatagcttggtgattctgaactgccgtgggtttgagatttgagaatggtagtatttgttaaactttcatgtgagctagatttagatggagtcttgtacatatgttcattgatttgaattgggaggatgaacaagtatt

SEQ ID NO: 35676 - DNA, 685 bp, Triticum aestivum
  Clone ID: PAT_TA_35676
cccccgggccgctatcgccccctcatcatccgccacattgcatcgcgttcacagcctcatcttcagccgcgagggacccgtacgcctctcgttcgccgacctctttggtggactggttcatcgatcgacccctcggcgccggtgaccatgatggaggtggccctcatctcgccggagcgccgcgatgtgctgatccagctggccgttctcctgcttgttcacggggctggaggtacctcatcctcaccaactcctccgacggcttcccccgaggaagaagaggctcagggccctcatcttccggccccttcggtacatccgcgcgcagccggtcccggccccgctctccgtcttccccgttggcgccgaccccctggggccctcgccagtcgctgtgagcggtatgcagcttggagggggcgctgttggggtgttcaggcaagaggatggggcagattagggtttggagccattgcaatgctcttgcgcctgaagaatggctatagtggtttcagtcttcgttattctagaatgagatggggtcttgttcatatgttcatcgatttagatttggaggtggaactagttttgaaaaattgttttgaaaaatgatgaagaagtagccgattcttttctatgagaaaatgttgaccatgtataaaaaaaaaaaaaaaaaaggccccta

SEQ ID NO: 35677 - DNA, 775 bp, Triticum aestivum
  Clone ID: PAT_TA_35677
agccggcccggtccatctctcgcgactgccccatgagcggcggcagcggccaggccaccgagtgctacaagtgtggtgagatcggccacattgcccgcaactgcaacaagtcttcctacggtaacaactacggtggtggtttccagcagcagggcggtgccggcaagacctgctactcttgcggaggtttcggccacatgtctcgcgagtgtgtcaacggcatgaagtgctacaactgcggcgagtctggccactactcccgtgactgccccaaggagtccgctggtggtgagaagatctgctacaagtgccagcagcctggacacgtccagtctcagtgccccggcaactaaaatggtgactcgatttctcagcataacgactgaggcgagaaggacgtggcgacctgttgatacccacggacgatattttcctagttctcttatggcatttccacaaaagttcatttcctcacacgactttaatgatcatcacggcagaatggcggctcacaaaaacacaacgtgcgcgatcctcgacgacggctgacggcgctcagccttgattggaacatatcagcattggatttcgtcaccgaacggacggacgactacgaccatacatacgactcaactttgagagaaaatggtgacgggtggagagtgacgagatcaaaaaaaggttatctggtggcttgttggtggagagcccaagctcagcagagctgggtgtgctcctttggtagtcaagtcgagatgaaaagtgttgatcccga

SEQ ID NO: 35678 - DNA, 627 bp, Triticum aestivum
  Clone ID: PAT_TA_35678
gccggcaattcggcggtgaccttgctcatctccttcctctctctactcctccctcccctaccccctactcccatcgggctattgagagtgcccgcgcgacacccttcagagctgctgcaaagggggagttgcgctgctagcgtcaccatgggtcacccaggtgagctcgtcgccatggtgcgcacgtcgtcgccctcgaatgctgcgacaacacctgctgctgttgccctctttttctaggtaggggacggcgggcgggggtgctgcaagcagcagagccccctgtttttggggaggcgacgacgggctacaagcgagcggccaccgccatgcaccgatgcgattcgccggcgaagatgctgctacactagcgtggcggagctgcaaccgtagttcggtgcagctacaactgtaggccggtggagttgcaaccggcaaaactaatgctggaatcggcgacaaccgtgttgcgacggcgacggcggcgatccatcattgctggaaccaactatttttttgctggaagcggtgtttctttctacgatgcgcgcgcggcgatcatagttattttttgcaccatttataacttttgctgcaagcgtgaaaaaaaaattgttaccacccttt

SEQ ID NO: 35679 - DNA, 878 bp, Triticum aestivum
  Clone ID: PAT_TA_35679
ctgggcggggccggccgggtctgggccatcctacacatttccgtttaattgtttgatacatttgtatctcaataccttatctcttctttcagttctatttcatcctcaaaaaccacattcacaatggctgctcctattacctcaaggacggagactctccagaagtatctcaagcttgatcagaagggtatgatcatggctgagtacgtctgggttgatgctgagggtggcactcgatccaagtcccgaactctccccgagaaggactacaagcccgaggaccttcctgtctggaacttcgacggttcatccacaaaacaggcccctggcgagaactctgatgtctacctccgaccctgcgccgtctaccccgatcccttccgtggatctcccaacatcattgtcctggctgagtgttacgactcagatggcactcccaacaagtacaacttccgtcatgactgtgtgaaggtcatgaagacatacgccgacgaggagccttggttcggtctcgagcaggagtacactcttctcggatctgatgacagaccttatggctggcccgctggtggtttccctgctccccaaggcgagtactactgtggtgttggaactggcaaggtcgtccagcgagatatcgttgaggcccactacaaggcctgcttatacgccggtatccagatttctggaacaaatgccgaggtcatgcctgcccagtgggagtaccaggttggtccctgcactggcatcgagatgggtgaccagctctgggtttctcgcttcttcctcaccgcgtcgccgaggaatcggcgcaaaggtctccctgcaccccaggccatagccggtgactgggatggcgctggactgcattcaacttc

SEQ ID NO: 35680 - DNA, 815 bp, Triticum aestivum
  unsure (1)..(815): unsure at all n locations
  Clone ID: PAT_TA_35680
gccggccggttcgggccacacatccgatccaatccaatacagccccccatccgatctcgccgggaaatctctccgatcgaagcgaagcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccagcagcgtctcatctttgctggcaagcagcttgaggatggccgcaccctcgcggactacaacatccagaaggagtccaccctccacctggttctcaggctccgtggtggtatgcagatatttgtcaagaccctcactggcaagaccatcaccctggaggttgagtcctcagacaccattgacaatgtgaaggccaagatccaggacaaggagggtatcccaccggatcagcagcgtctcatctttgccggcaagcagcttgaggatggccgcacccttgcagactacaacatccagaaggagtccactctccacttggtgctcaggctccgtggtggtatgcagatcttcgtcaagaccctcacaggcaagaccatcaccctnggaggttgagtcctcggacaccatcgacaacgtcaaggccaagatccaggacaaggagggcattcccccggaccagcagcgtcttatcttcgccggcaagcagcttgaggatggccgcacccttgcggatacaacatccagaaggaatccaccctcaccttgtcctcccgccttcgtggtggcatgcaaatctttgtca

SEQ ID NO: 35681 - DNA, 871 bp, Triticum aestivum
  Clone ID: PAT_TA_35681
gccggccggccgtggacgtcattcttaccttcgttcctggcttacaacatgaagctatcatccatcctcagcgtctgggtcttcaccctcatcagcaccgtcttcggtgccgaacttgtcccccgatccaccctcaaggaagtcaccggctatggcaacaaccccacaggaactcgcatgttcctctacgtccccaagaacctgaaggcgaaccctgctgtggtcgtcggtcttcactattgtaccggtactgctcaggcttactaccagagcaacaagtgggcttccaatgctgagaagtacggcttcattgtcatctaccctcagactccttacactcctggtaactgctgggatgtctcctccaagatgaccttgacccacgagggtggtggttgcagcacctctgttgccaacatggtcaagcatgttctcaagaactacagtggtgactccaagagagtctttgtcactggtgactcttccggtgctatgatgactaacgtcatggccgctacctaccccgacatcttcgccgctgccattgtctacgctggtgtccccgctggctgcttcatgagccaggctaaccaagccgctgcttggaactcgacctgctctcagggccagtcccgctacactcagcagcagtgggccaacgttgtcaagaacatgtaccctggctacaacggccctcgccccaagatgcagatctaccacggaactgccgaccccactctcaacgtccagaactactacgaggaaatcaagcagtgggaccggtgtctttggctactctgctacccccagtctactaccaacaacttccctcgcagcccctacaagcgagaggtctttggtgataagctcg

SEQ ID NO: 35682 - DNA, 805 bp, Triticum aestivum
  Clone ID: PAT_TA_35682
gccggccgggtcgggagggaatggcgacagagaaggtgttgagcgacgacaacctgctggaggagatcctcctccggctcgacctccccacctgcctcgtccgcgcctccctcgcctgctcccgctggctctgcgccgtctcccggccggccttcctccgccgcttccgcaggcttcacgcgccccgtctcctcggcttctacgtcgtcggcgacggcgtcccgcgccaagacttcgtgccggtccccagccctcctgagctggccgccgtcctccgccgtgccagctctggcctcgacgcctactccgatttctcgttcaccatcgacgactgccgcaacggccgcctcctcgtcgatggctacagagtcggcggcactcaggtggtcagcccgctgctgcatcggcagcaccacctggcgccggcgctagtccttccgcctccgccgccggccagcctcgacggggtctcacacggctacaccttcctcccggaggacggcggcgacggcgcgtcgtaccaccgcgtggatctggagcaccacggtcggcaggtctcggcgcaggtgtcgacgcttggatccggcgcctggacggtccagatcgccaaagcggagctcccggagccgccggacagaatccccgacctaaccgtgctcctccgcggcaagctctacatggtgaccacggccggatacatcctcgggttagacttggccgcggcgagctttcttcgtggtccagctcccggacggcgtcacgtaccagtacttcggcagcctggtcctgtccccgagatacgacg

SEQ ID NO: 35683 - DNA, 859 bp, Triticum aestivum
  Clone ID: PAT_TA_35683
actctcagattttgaaatccctccactcatcgtcattgccgacatcatagctgggtctcctgtttaattcttgaaaagtgtactttcatattttcccatctttctcatctcaacctaaatccatcaatcctaagcaccaaaaacagaaatcatgggtgtccaagaagtcctcagtcgcaagtccggtgtcatcgtcggtgacgatgtcctccgtctcttcgagtacgctcgcgagcacaagttcgctatccccgccattaacgtcacctcctcttctaccgtcgtcgctgcccttgaggctgcccgcgatgccaaggctcccgtcatccttcagttctctcagggtggtgccgcctactttgctggcaagggtgttagcaacggtgaccaggctgcttccattgccggctctgtcgctgctgcccactacgtccgctctcttgctcccacctacggcatccccgtcgtccttcacaccgatcactgcgccaagaagctcctcccttggctcgatggcatgctcgatgccgacgaggcttacttcaaggagaagggcgagcccctattctcctcccacatgattgatctttccgaggagcccgttgagtggaacattgagaccaccgccaagtacctcaagcgcgctgcccccatgaagcagtggctcgagatggagattggcatcactggtggtgaggaggacggtgttaacaacgaggatgttgacaacaactctctctacactcagcccgaggatatcctcaacatctacaacactctctcccccatctccccctacttctctatcgccgctggctttggaacgtccacggtgtttactagcctggcaacgtcaagc

SEQ ID NO: 35684 - DNA, 572 bp, Triticum aestivum
  Clone ID: PAT_TA_35684
gccggccccggcctcaaccttattacttccacgtacaatcgtctcactccacgtctttctagactaacctacatccactatcaagcatcgcaactcaatatgagaatcaaggcttttatcaccgctgccatgacggccatggttatcgccgaccaacatcccggcgccgaaaagatgtgcggtcgtcttgggcctatgacgtgggatcccaatgacctccctgatggtgttgatgttagccagatccgcatgtgtgccgaccatcctatgggagcaggtaattactggggctggggcgaatatctccccagctgggttcctcgtaaccccctggctgatattcaatggggacgaacctacaggtcaaaggtggtgacttgatactatatatgcgcatcgttcatttgaaacgatgttttggacatgtatacgtagcgtgtggtaccaagaataagttgtatctacctgctttcaggccagccattagtatccagttgtcaaacttctatgaacagcatcctcgaaaaaaaaaaggtataagtccttaaaaaaaaaaaaaaaaaaggccccta

SEQ ID NO: 35685 - DNA, 968 bp, Triticum aestivum
  unsure (1)..(968): unsure at all n locations
  Clone ID: PAT_TA_35685
gccggccggtccgggatttcccagttgcaactgcacctaatcacaagttgggagcacgagacgaggagaccacgtcctcttccacgcacgccaaccccattaggacctctcgctagcttgccggcgagcgtcgaccatggcggccaccaacccacgaccagccgcaccaactccacctcccgcatgccttaattgatccaccgatccttctcacctccgtacaccgccggcctgctgcgcagtcacgtgctgtcctcctccttcttcgacgacggcggcaggcgaccggaagctacgacgagcgccgtgaaccctgctgccgcggccggcgacgatgatggtgatgggctacttccgcgcgcccaggatcggcggcaggaggaaggagaagaagagcaaggccggcgcggcgccgcaggccgaggaggcggggctccgggaggcgctgctggagccggccggcggcgtgctccccaaggggtacttcgcggtgtacgtcggggaggaggcgcgccggttcgtggtgcccacggggtacctgcgggagccggcgttccgggacctcatggagcgcgccgccgacgagttcggcttcgcgcaggccgacgggctgcgcgtgccctgcgccgaggaggacttcgaggagctgctccgccggctccaccgcaagaacggctcaggaagcggcaaggggaagaactaaggaaggaggccattgctccattagctagccagagcttggacgacgccatggcagcggcaccggcggccgtggcgccgtgccgcgctcgcgcgtacgtagaacgatgagtttatttacttttaaactagcagatcgcttctcgcttngttgaagattgtacagagtgaaacggccacatgcatgatgcttacttaacttcntgcgtngtgtgttnatcgtcatcgttggttcatggaagatttganntcatatcaaaaaaaaaaaa

SEQ ID NO: 35686 - DNA, 829 bp, Triticum aestivum
  unsure (1)..(829): unsure at all n locations
  Clone ID: PAT_TA_35686
gccggccgggtctcgattcctctttttctctttcctctgaactccctcccaaatcatctcttcttggcttctagacaaacactcgtctacaagtttctatcactctcaccgcaactcccccaaactacttacacacatcacatcaaaatggaggccatcaagcaggcacttcaccttggcaagggctctgacgcccctgctgagcctactcctgaggctctcagcgagctcaaggagaagtacacaaaggccggccaggagcaagtcttcaccttttacgactctctatcctccgccgagcgaggaactctgtaccagcagctttctggcttcgacccttcccacatcaacgacatcacacagcgcgcattgaaccctgccaagaccagcgatgagcccgaccgcctcgagcctcttcccgaatctgccaccgccagtatcctcgactccggcgccgatgatattgccaagtggtacgactccggtcttgacctcatctccaagggtcaggtcgctgttgtccttatggctggtggccagggtactcgtctgggtagctctgctcccaagggctgctacgacattggtcttccctctcacaagtctctcttccagcttcagggtgagcgaatcgccaaggttcaggagctggctgccaagaaggggtcaaacgccgttgttccctggtacgtcatgaccagcggccctactcgcggccccaccgagaagttcttccagaagaacaactactttggcctgagccaggagaacgtcaagatcttncgagcagggtgttctgccttgcatctccacgatggcaagatctcct

SEQ ID NO: 35687 - DNA, 640 bp, Triticum aestivum
  Clone ID: PAT_TA_35687
gccggccgggtcgggaacactaatcgaaccgaatcgaatcctccagtccagatcaaaacaagggagcgagcatggcgtcgtcctctgctgtgacgcatggcgtcgtcctctgctgtgagcaagcgcggcgacgcgggcggcgtcctggctgccatctcgcggtcctcggtggcggcgcacggccgcgaggccgcggcggtggcggggaagctgctgcggagcacggggaaggcggcgtggatcgccgggacgaccttcctggtgctggtcgtgccgctcatcatcgagatggaccgcgagcagcagatggtcgacctcgacctccagcagcaggctcttctcggctcgccgccgcccctcgccaaataaatccctcctctttcgtccgtctttgttgcctgccgctgctgctgatgcggtcacatttcgttttgctagtatcataagttgtcgagaattttatcactagtctgttttgggggagaaagatcatgccttgttgtgactgctcctgctcggtacaattattatcgcaatatcaccgacttgtcttgaactcaatcctgtgatatacaagagtgctttggtttgtgatgccttattagtcgcattatcaccgacttggcttgggactgggatt

SEQ ID NO: 35688 - DNA, 1155 bp, Triticum aestivum
  Clone ID: PAT_TA_35688
gccggccgggtcgcggaggaatgtgactcgatgagttcttacggtcgtcaatcttcactatgcgttttttctccatccctagtcaggcccttgtggcattcctagctcttgggtcagtgtccgctcgagttctgacaaagcgcgacagccctgtcctcccaggactctgggccgaccccaacattgccatcgtcaacaacacctactatctgtttgtcactaccgacggcttcgagggctggggtggtaattcgttttactggtggaagtctccagacttagtgtcatggacaaagggcgagaaacccttccttgtccttgatggcaagaacggaaatgtgccctgggcaactggaaacgcttgggcacctggatttgctgcccgtggcggaaaatactacttctaccacagtggtaacaacccctccgtcagcgatggacacaagagtattggtgttgcagtcgcaagccatcctgaaggtccctggaaagctcagtctacgcccatgatcaagggcacttcagatgaacccatcgtcagcaaccaagcgatcgaccctgcagctttccaagaccctaaaaccggaaagtggtacatatactggggcaacggggtccctgttgtcgccgagttgaacgacgatatggtgtccctcaaatctggaacatggaagcgcatcactggactccaagacttccgcgaaggtcttttcgtcaactaccgtaaagggacctaccaccttacatactccatcgacgacacaggctctgtaaactatcgcgttggatatgcgacagctgacaaccctctcggaccatggacgtatcgcggtgtcattttgaagaaggacgagtcaaagggaatcttgggcacaggacataactcggtgatcaacatcccaggaactgatgagtggtatattgcgtaccaccgattccacattccagatggaggtggtttcagaagggagacaacgattgatgtattacctattaagaaggataccggattgtttggagaggtcacgccgactttggagagcgttaagcctaggcccttaccatgatgagaagttagtaaatatttatctgcttttctccagacgttatcatatttttgatcaaagaagtacaataaaacgccatcaattatcc

SEQ ID NO: 35689 - DNA, 826 bp, Triticum aestivum
  Clone ID: PAT_TA_35689
gccggccgggctcgggatcaatccatcaatacatccacaatgagtttagacatccaacttactgcccccaatgggcgcacttacaagcagcccaccggtttgttcatcaacaacgaatgggtcaagtcgtccaatggcgagaaaatcacatctataaacccaaccaacgaggaagaaatcacatccgtctacgctggttcgtcagaagacgtcgacaaagccgtccgcgctgcccgccgtgccctccacaacccatcatggcgagatctcccaggcaccgagcgcggtaaactgctcagccgccttgctacacttgtcgaagaaaacaaagagatcctcgctacgatcgaaacatgggataatggaaagccttacactgtcgctttgaacgacgacgtcaatgaagtcgctgagacattgagatactatggtggctttgcggataaggtgtatggacaagtcatcgaaacaacaggtgacaagtttggatacaccattcgtgaacctattggcgtctgtggacaaatcattccgtggaacttcccacttgcaatggcagcttggaagctcggcccagctctagcatgcggcaacgcagtgatcctcaagcccgcagaacaaacacccctctcaatcctctaccttgccaatcttatcgtcgaagcaggctttccccctggtgttgtcaacatcatcaacggtctaggaaccgttgccggtgccgcacttgcttcaatatggacgtcgataagattgcctttacaggttctacacccacagcgcgcagcatcatgaagatggcaagcagcaatcttaagaacatcac

SEQ ID NO: 35690 - DNA, 951 bp, Triticum aestivum
  unsure (1)..(951): unsure at all n locations
  Clone ID: PAT_TA_35690
gccggccgggctgggatctcacttcttaacgcttgacgacatcttcagccttgtgctatcactctccttaaccgattcttgacaacgttctttgtgccttgcactcttcagtctctcattttttgctcaacgcaacaagaatcacatcacgatcctttatagtcactacaattcgtttcagacaaacacaatcacaatgcactacaccagcatcttcgttgccgccgctggcgcctcggtcgccgctgctcaggactacgctcctcctgctctggacaccacaactctcacctcgaccactacccgggttatcactctcactcagtgcaaccccacagtgaccgactgccctctgcgcactcatacctccactgaggttgttgttacaacctcgactgctgagcccgaggtccctgccgagcctaccacctctgtctacgttgctcctaccaccagcatctacgagcccgttgtcaacacaactagccaccacgaggttcctaccatcgtcaacactcccaccatttccaccaccaagaaggcgcctcttcctaagaccacctattaccctgctggtaacacaaccgtcaatgctggtcctactgctcccgtctctcacgtcaccaagcttcctgtccccagcagcaacggcacccccgagaagcctggttacgaggctcctcctaccacccccgaggctccttcaagcgtccccaccgctggtgccaacggtctcatcgcctcttcaggcttccttggtgcgctctggtcgccgccatggttgctctcttctagctcaacccttccatttgggtgacctatctggtctgtctcttgacagatgtcggaccttcacttcttactatgatacctttttattcttcggngacggacgtttggagacttatttcagtgcatgattctttgctctgcagcaaggcatcttctctt

SEQ ID NO: 35691 - DNA, 513 bp, Triticum aestivum
  unsure (1)..(513): unsure at all n locations
  Clone ID: PAT_TA_35691
gccggccgggtcgggcttttcatcgaactcagtgagaaggtcatcttggagggaacactatggcgatctacgagtacaacttcatggccttcatcgaccacaggaaaaccttggacaagttcgttcaagagcacattgacctcgccaacgcctctgcaatttcacgtccaccgactggcccaacaaagtaaaagctcgattgatatagttggctaactagctgcaagtaacacgaaggagccaggagagtcattgatggatacttggctagcttccttccctatgtaggttgctgcatcattgttttcggtccgagaacaaaaacgactactaatgtatgtattatggtacttgtcagcgaccgagcatgtcttaagtcgtagtaatagttgctatcaaaccccgccctgttctattattaacagtctatgtgttaaaaaaaaaaaaaaaaaagatacctcttcttcaagcacaatataccttatatttgcctccttttanaaaaaaaaaaaa

SEQ ID NO: 35692 - DNA, 818 bp, Triticum aestivum
  Clone ID: PAT_TA_35692
gccggccgggcctggagacctcgcgcataaaatacacgccctttaacccactacatcgcctactcttttgcgaattgtacacaatggctccttcgaccttcaaactcaacactggccaggagattcctgctgtcggactcggtacttggcagtcccccgcaggcgaggttgagaaagccgttacatatgctctaaaggacggatacaagctgattgactgcgcctactgctacggaaacgaagaggaggttggcgctggtctcaaggctgcctttaaggctggtgtcaagcgtgaggacatctttgtcgttaccaaggcctgggctacctacaacacccgtgtcgagctggctctcgacaagagcttgaaggccctgggccttgactacgtcgaccttttcctagtacactggcctctactcctcaaccctgatggcaacgacgacaagtttcccaagaagcctgatggttcccgagatgttattcgagactacaaccatgtcgatggctggaagctcatggagaaactacccgctactggcaagacgagagctgtcggtgtttgcaactacagcaagaagtacctggaagagcttctgcctcatgcaactatcgtgcccgctgttaaccagatcgaaaaccaccctgagcttccccagcaggagatcgttgacttctgcaaggagacggcatccatattgaggcttacagtcctcttggcagcacaggtggtcccgtcatgagtgctgagcccgttgtcaagattgctgataagaaaggcgtttctgcctctactgtgctcctcagctaccacgtcg

SEQ ID NO: 35693 - DNA, 441 bp, Triticum aestivum
  Clone ID: PAT_TA_35693
taggggaagatgaaatgaatgttgatactacctctgatgaggatgcggacatagatgatgaaatgactagataccaaagttctgattcacatgttgtggagaagaaatatacattgacaaaatgcagcgctgaacctgagaccaataaaacaaagcattctagtttgagttatgaggagcaacctgtttcttcggcaccaataagagcaagcaaaactgttgctgttccagttaaccccatttccgtggaacctccaaattttggaacaccaaaagatgttcatgttgtggagaagccggacatcacacccatgaatgctaatgttgcctctccagctattaatgtcaaagaattaggtcatggagaagtccaaaaggattcacagcggtctgcaacatctgtttctagttcatatagcactgcccatcccacagaagatg

SEQ ID NO: 35694 - DNA, 982 bp, Triticum aestivum
  Clone ID: PAT_TA_35694
gccggcccggcctgggaacgtcaccaacacaaatacccgcaaactcccaaagactttgcatctcgcaaaccgtcgcaagacatattcatccctcgtataaccaaaccagtactcaacccatatacagcgaggcgctattctagccagcggtcgctgaacacatccccaacccttttacaaaacccatttcccaaggtcacccccagtacctccgagtttatgtccatcgaaaatctcaagacctacgaccccttcgccgaagccgacgaggacaccggagaaaccaagcagacgcagaattatatccatatacgcattcagcagcgtaatggacgtaagactttgaccactgttcagggtctccccaagaaatttgaccagaagaagattcttaaggtcatcaagaagaagttcgcctgcaatggcaccatcgtcaacgactccgagatgggagaggtgatccagctccagggtgatcagcgtaaagatgttcaggattttctttgtgacaagaaggaaggcctcgagctagatgccaagaccatcaaggtccacggtttctaaagctctgcatgccccgtcgtcctgtcagtcgccgttcccgggcgtcttgacgtagagggacagggatgcatggccacctcggcttgtgccttttccggacgtgttctcttgctcttgcaacagacacaccgaggctcggctccgattactctaggacgacgggcatccactcagggcgagctttcgctcctggtggctttttggaagagtattattctatgcagcacgttttgatgcgggtagagaaaccgttatcgacatctacctcgatcatgtgtacgaggacggagctacgggcaaagcatatgtttatcaaacggcttgtcagtcactcgttagtcagatatgtctacatgggcaagccccgcagtagtctcaggcaaatacaatgtcgattccgaaaaaaaaaaaaaaaaaa

SEQ ID NO: 35695 - DNA, 925 bp, Triticum aestivum
  unsure (1)..(925): unsure at all n locations
  Clone ID: PAT_TA_35695
gccggccgggttccgactttgctttctcttcctcctcctcagccaagtcattgttgtaaaagccttgcctggcctgatcttttttgtcgtccttttctctgtggtccctcttctttgctcttgcatacttcctccatctccatacttgtaaatcaacaacatctgcaaacatgcgtgaggtcattagcatcaacgtcggacaggctggttgccaaatcgccaactcctgctgggagctttactgcctcgagcacggtatccagcctgatggttacctcactgaggagcgcaaggcgcaggaccccgaccagggatttagcacattcttctcagagactggcaacggaaagcatgttccccgagccatctactgcgatttggagcccaatgtcgtcgatgaggtccgcactggtgcttaccgcaacctcttccaccccgagatgatgatcaccggcaaggaggatgcttccaacaactatgctcgtggtcactacaccgtcggcaaggagctcatcgatggcgtcctcgacaagattcgccgcgttgccgacaactgtgctggtctccagggtttcctagttttccactccttcggtggtggtactggatctggtttcggtgccctccttatggagcgcctgtccgtcgactacggcaagaagagcaagctggagttctgtgtttaccctgctcctcagaccgccacctcagtcgtcgagccctacaactctatcctcaccacacataccactcttgagcactccgactgctccttcatggtcgacaacgaggccatctacgacatctgccgccgaaacctcggtctcgagcgacccactacgagaacctgaccgtcttattgctcangtcgtctcttccattactgctttcctccgattcgacggttccctcaacgtcgacttga

SEQ ID NO: 35696 - DNA, 1164 bp, Triticum aestivum
  Clone ID: PAT_TA_35696
ctgtgcggcgctcgaggcggccggggggcgggccttcttctgaacagggactgccagacagaacctattcgcttcttccttctatctcacgaaaaagactatcaagtcagattcatcttctcccagcaacatgcgctcacctatcgctttctgcctcgccctcctgggcgctgctcagcttggagacgccgcctcagctggctgtggcaaggctcctcagtccagcggcaccaagtccatgcaggtcaacggcaagaaccgccagtacatcctccaggttcccaacaactaccagaacaacaagccccaccgccttgttttcggctaccactggcgtgatggcaacatgaacaacgttgcccagggtggcttctacggcctccagggtcttgctggcgactctaccatcttcatcgcccccaacggtctcaacgctggttgggccaacaacggtggtgaggatatcactttcaccgaccagatgctcaagttcgccaaggacaacctttgcatcgacgagaagcaagtctttgctaccggttggagttacggtggttccatgagccacagcgtcgcttgctcgcgacccaatgacttcgctgctgtcgcagtcatctccggtgctcagctctccggctgcaacggaggaaactcccccgtcgcctacctcggtatccacggtgctgccgacaacgttctcggaatcaacctcggccgccagctccgcgacaagtggattggtaccgacggctgccagcagaagaacgtcaacgaccccggcccaggtgctcagaaccacgtcaagactacctacacctgcagccgcaagcccgttacctggatcgcccacggtggtggccacgttcccgaccctactggcaccaacggtgtcaagtttgctcccggtgagacctggtcattcttcaacgctgccgttggtggtggccgcagcactggacgtcgctgctagatgtagttctctatgtagcacgagcttcttttaagtcaaagttagaagtcgtgtgaggggatgtgtggaaaacctttattcttgtacatagtaaccccgaaccggcgggttatgttatataaaaccagtatcgaattttgtcaatagtatttagcctgataggtctatcagaccaatacatcactgtacatacc

SEQ ID NO: 35697 - DNA, 893 bp, Triticum aestivum
  unsure (1)..(893): unsure at all n locations
  Clone ID: PAT_TA_35697
gccggccgggtccgggccggcgtttgaggagagacctaagttcatcgcctcgaccaccaagactttccatttatttatcaagatctcgaatacgatacaacaggaccgaacgtaacgcgacgaaccatactacaagatggaaggtctttattacaacgtcaacaacggttacgtcgagggcatcgtccgaggctaccgcaacagccttctcacaggcgcagcctacaacaacctgacccaatgcgaaaccattgatgatctcaagctccaacttggcccttcctacggcgacttccttgcttctctaccgcctaacccctcgacttcagctcttgcggccaagacaaccgacaagctcatctcagaattccgatatgttcgcgcccaggctgttggctctctcgctacatttatggactacgtcacttacggctacatgatcgacaatgttgcccttctcatcacaggcacccttcacgaacgcgatacccgtgagctccttgatcgatgccaccccctgggctggtttgaaaccatgcctgtgctttgcgttgctaccaacattgaggagctttacaacagtgtactcatcgagacccctctcgcccaatacttcaagggcagcctgagccatcaggacctcgacgagctgaacattgagattgttcgaaacacactctataagaactaccttgaggatttttacaactttgtcaacactcaccctgagatggctggcactcccactgctgaggttatgtctgagattctcgagttcgaggctgaccgncgtgccatcaatatcacactcaactctttcggcaccgatctatcncagcaggaccgtaacaagctttacccagctttgggaagctgtaccccgagggactctc

SEQ ID NO: 35698 - DNA, 1064 bp, Triticum aestivum
  unsure (1)..(1064): unsure at all n locations
  Clone ID: PAT_TA_35698
ctctacttttatcccgtctcatcatctgtctcccgttgtttgctagccacttgcgacgactccaaaacctcgccaccaaggaaaaagagaagtcgccgtcgccgtcctcgaccgatccgatggagtccgagaaggcgtcgcggccggcgtcgctcctggggacgctccggacggcggtgaagaaggtgcggttcctgctctccttcagcgccacgcggtggatcatcaactccatcgccggccgccggagcgcgcccggcgcgacggcgccgctccgcctcagcttcgggtccaggcggccgggcctgctcgacgcggaggacgacgacgacggctcccccgcgtccaccaccgggccgtccaggacggtgagcctcgggtcgggcggcgtgtcgcggacgagcagcgcggtggcggcgtcggagtactcgaggtccgcgtcgtcgggcgcgacgtcctcgtcgagcggggggtcgtcgccggcgggggacgacgacatcgaccggcgcgcggagctgttcatcgccaacttctacaagcacatccagatggagcggcaggtgtcgctgcagctgcgctactgcagggtcgacagcctgcaggagaggtcgcctccccgcagggtttcttgaccgatttgatccccggatatgcgttgcgattcttgtttaatttcgtgtgaaaacaggtgtgtgtatgtggatttagatgggtgttttttcgttccatcatttctgcgcgtcgtcctctaggattaatttgttctgtaagatcgagattacagagtgcgagtagtacaaataaacagagttctttgagaacttgggggagactgagtattctcctcaacattgagaaatatctttgtatgtgcatcaccccttgaaagtgaggagaataggctgaatagcaggctagcctagccagaatcaattaatcaagaatccaccggttggtaactatctccttggtaggtccacaatattccgatgtcacaatgggcagccgggaaccaatgaatcaagtatttccttaaaaaaaaaggggggggcccggtacccaan

SEQ ID NO: 35699 - DNA, 991 bp, Triticum aestivum
  unsure (1)..(991): unsure at all n locations
  Clone ID: PAT_TA_35699
gccggccgggtcaagagtccttccattccctttttgatatcttccagctacatcttcattagactaaccgcttcttctactgccttgcgctgttatcacgtctgactgaccatcttctgttctcattatacagcatcaaacatacaaagccgctctctttgcccttccattcgcccccggacgccatcccgtgacatcattagggggaatcctccaactacaactctttgctttcagccccaattcaacgagaaatactatctatcctccaccggtaacgctcgaatcctgagcgtccgttggcctcagccgtgaatccgtccgtcgttcccttctatccgctcgactgtcgcttttttttcgccctcaccccgtcaataccgccaagctgtcttccccaattctacttcagcgcaccgtctcctacgacgcggcgaacaaacctccgcgccggggaagcatctatctcaacatgcccgagcgaaacacaggaggagaaggagctgctggagctcgaaggaggagatctagcagtatcctccaggtctaccacgagcctccggagactctcgagcaaatcagtgatcaggcttctctgcctaatctcaacgccaactggacaaatgccaaaggtgcttggaccatccatcttgtcctgattctctctgccaagattatcttcgacgcgatccctggtgtctcacaggagacttcatggacccttaccaacatgtcctacatgttcggttcctacatcatgttccaccatgtccgcggtgttcctttcgatttcaacagtggtgctttcgacaacctcaacatgtgngagcaaattgataacggggcgcaatacacaccaaccaagaagttccttctcagtgtcccaatcgcccttttccttgtcagcacccactacacacattacgacttgacgtacttttacattaacttactggctgtcttgggagtcgtcatccctaagctacctttt

SEQ ID NO: 35700 - DNA, 740 bp, Triticum aestivum
  unsure (1)..(740): unsure at all n locations
  Clone ID: PAT_TA_35700
gccggccgggttccgattctttccatcgtgagctttgcctgcctgcctaaccgccttcatagctcaactcaaccaacaacaccttacagccaaaatcatgtctgcttactctggattcacaaaaacaagttacggtgcccaagggggcgatgactctggaggtttcttcgctggtggttctcagcaaggcagccaaggtggtggtggaaaggcataccaggatgagtccttgcgccccgtcaccattaagcagattctcgacgccgaagaggcctatgccggcgccgacttcaagatcgatggttcccccgtgacccaaatcacattcatcggacaagttcgcagcgtccaaccccagcctacaaatatcaccctcaagatcgatgacggtaccggccagatcgaggtcaagaagtggattgatgtcgacaaggcggacgactccgaagccggtttcgagctcgactctcacattcgcatctggggtcgtctcaagtccttcaacaacaaacgccatgttggtgcgcatgtcatcaggcccgtctcagatttcaatgaggtcaactaccacatgctcgaggccacatacgttcatctttacttcaccaaaggacctctcggtggtcagggtgggggcgccaacggagatgatggtatgtttgtgngatggntggtggttacaatgacaacgccggtggcaacaccaactcgcactccaagctcgctggttgcagtccact

SEQ ID NO: 35701 - DNA, 1362 bp, Triticum aestivum
  Clone ID: PAT_TA_35701
ggggtcgccagtttggcgttgtgagcacgcttcccccccatgatctgaccgacatgggctgcgcgcctcctggcctgccaacctgtgctctctgcgacgtgggctctctcctcctgatcaagctgctgtctgcaatctggcatcaattgctttgccacgttttgtaagagaaaagggtgttccgatagagtcccatccagctaagcttgttggcagcattgggtcaaaaaatagatacttcgacttcgataaattagctgagattacttcaattgttacatggaatctcaacaaaataattgatatcaactactacccaattgagacagcaaggaggtcaaatatgaggcacaggccaattggaataggtgttcaaggcttagcagacactttcattttacttggcatgccattcgattcaccagaggcccagcagttaaacaaggatatctttgagactatctattatcatgcattgaaagcttctgccgaaattgccgcaaaatgaaggcccttatgaaacttagtgatggctgtccagtcaagcaagggcattcttcaacctgatatgtggaatgtagtgccatcagacagatgggactggcccgcctgtagggggatgcctcccatagttgcgtgtagctactcgcttcttgtggctccaatgcccactgcttctactagtcaaatcctccctcgcgtccggtgctttgaaccctacacgtcgaacatttacagtcgaagagttctaagtggtgagtttgttgtagtgaacaagcatctcctccatgatctgaccgagatgggtatctggtctcctgtcctgaaaaacaatattatctacgacgatggctctgtccaaaagatcaccgagatcccagatgatctgaaagcaatctacaagactgtttgggagatcaagcagaaaactgttgttgacatggccgtcgatcgtggctgctacatcgattaaagtcagagcctcaatatccacatggatcaagcaaactctgggaagctaacctccctgcacttccacgcttggtccaagggcctgaaaacagggatgtactatctgaggacacgtgctgctgccgatgcgatcaaattcacagtggacactagtcttctcaaggataagaagcctgcgaatgctgaggaggaagaggatctccaggctaagatggcgcgcaggtgacctgctccctgaacaaccgggaggactgcttgtcatgtggaagctagattcatccgcgacaccctacgctaacctatactatcctcttactgttggcttgtcgttgggttcgatgatatatctgtagtggtaatctgcctatgcatgatgaactctgaattaaa

SEQ ID NO: 35702 - DNA, 951 bp, Triticum aestivum
  Clone ID: PAT_TA_35702
ggatgctgatgttaactctctagtgttaaggtttggtggggagtgtgaattggtttggctgaatgacaagaaagctgctgcagtctgtcttgatctagctagcttagctacggccctgagtgggcttgattatgaggctgcttaccagggtgctgcacctgtttacccaagcagcatcacgctctctagttttacgagcaatgtgtgggttggagcaccgagagatggagggcaagaatgccgctgcagtcttcagcgatccagctagagcagcgacagcgctgaggcggctggattatgggtctgcttaccagggtgctgcaatgttttgcccaagcagcatcactcaggcttctgtgtcaagcaatgtgtgggtcggagcacagagagatggagggttggctgcaaagagcagtgccaatccatggaaggcctctcaatctgagcccgacccatctggagactggacagtgctcagtcatgcttcagggtcagtgtggaaacgtggtgatactcctgctcaggtcatgggttcttcaaaccgctggaatgctctggagtctgatgctgcaaccagctctgggccaaccgacaaacgtaagcctcctcttcgcactgaaacaggatccagcagttctgctccccgcgttggtgctggatccagcgcagcaccaagtgctgggcaatcggtgagcaagctgcagcctgacgtcgaagttgaagactgggaagaatcgtgtgaatgatgagaccgaggtagtttggtcaagatgactcgtttttattcagatgtcatttttatctctaatacaatgtatatcgaagctgaaaaaaaaaaaaaaaaaaggcccctaggcctggtcccgggtctctgctcggttggttcaactgtgcctcgccgtgttctttggcccgtcccttgttgctagatatagaaaaaaaaaaaaaaaa

SEQ ID NO: 35703 - DNA, 413 bp, Triticum aestivum
  Clone ID: PAT_TA_35703
ctgcgacaagacgacagatcggggttctatcctctaactcagggattgctcactttgtcaagatattccctggggtttctcatggatggaccgtgagatacaaaagcgaagacgcagctgctgtgaagagcgccgaggaagccctggcggacatgattgactggttcaacaagaacctcaagtgaacctaatgaattggcggccatccttttgtaataagccagtgtcactcttcaggagtcaccacgcgagcatccacggtttatgttatggtcttagctatatagcctatagggcatgcgtctttgtctgccgcaggtctgctggtatgtgtgtgattgctcatattggggtctgcttgtgctgaacactgaaactactgcactcaaataaaatgtggtatttgcagtttt

SEQ ID NO: 35704 - DNA, 1143 bp, Triticum aestivum
  Clone ID: PAT_TA_35704
ccgccaggcccaatccaacttcatcgccaagcaatttctccatcactccagccctccccaccagtgtgacctcggcagtatggaaagactctagccctccccacaaccgcgacctcggcagtatggcgagcccgcagtgctgcgcgaacccgccgaccgctcaaccccgccgtccggcgagggcaaggtcgtggacagctttggcgggatcaaggcgtacgtcgccggcgcccaagagtccaaggccgccgtcggttctcatctccgacgtctacggttttgatgcgccgaatctgaggaagatagccgataaagttgcttcgtctggatattttgttgtcgtgccagatttcttacatggggatccatttgtacctggaagacgctgacaggaccaatagcagtgatggataaaggagcataccccgggaaaagcatttgaagaggcaaaacctgttattgctgcctctaaagggaacaaggagcgtctagtgttggggctgcaggttattgctggggtgcaaaggtagttgcagagttagcaaaagctaatgagatgcaggcagccgttaatgtcgcacccttcatttattactgttgatgatataaaagaggtgaaatgccccatcgctatacttggagctccaactgacaaaatatccccaccagaattggtcaagcagttcgagcaggttctagcctcttctaactctgggattgctaactttgtcaagatcttccctggggtttctcatggatggaccgtgagatacaaaagcgaagacgcagctgctgtgaagagcgctgaggaagccctggtggacatggttgactggtttaacaagaacctcaagtgaacctaatgaattagcggccatccttttgtaataagccagtgtcactcttcaggagtcatcacgcgagcatccacggtttatgttatggtctcttagctatagcctatagggcatgcttctttgtctgccgcaggtctgctggtatgtgtgtgattgctcatttcggggtctgcttgtgctgaacactgaactattgcactcaaataaatgtggtatttcagaactactgcactcaaataaaatgtggtatttgcagtttgaaaaaaaaaaaaaaaaaaactcgaac

SEQ ID NO: 35705 - DNA, 1407 bp, Triticum aestivum
  unsure (1)..(1407): unsure at all n locations
  Clone ID: PAT_TA_35705
gccggccggttcgggatcatctctaggggagaccaggccagatagctgcccagaaacggtttaattacgcttctcagcacctaggacgggcgatttaaattctgaagatctaccccttgacctcaacacttcatcaacatcaaacttcttggcgtcatactgcgtcacgtctctttttaatctttatattccgctgttttcctgactgcggtttctttttccttttcccctcctccctcatctaccccaccatctactaactatccttcacaatggcctcgaaccccaagtacgataactatgatttccctgcccagggtgctgagaagcaggatggtcacgctggttacctcacagaggaccagactgccaagcttgaacagttccgcatgatgctcgaatcagagggctgcaccgaccggttggacacattgactctgcttcgattcctccgagcgcgcaagtttgatgtcgaagcctcaaaagccatgttcttggataccgagaaatggcgaaaggagaccaagctcgacgagactgtgcctgtctgggactaccctgagaaggctgagatcaacaagtactacactcagttctaccacaagaccgacaaggatggccgacccatctacatcgagactcttggcggtatcgacctgaacgctatgtacaagatcaccaccgccgagcgtatgcttaccaaccttgctgtcgagtacgagcgcgtcgccgatcctcgtcttcccgcttgctcccgcaaggccggtcacctcctcgagacatgctgcactgtcatggacctcaagggtgtctccatcggcaaggttccccaggtctactcctacgtcaagcaggcttccgtcatctctcagaactactaccccgagcgccttggcaagttgtatatgatcaacgccccttggggtttctccactgtctggagcatcgttaagggctggctggaccccgtcaccgtttccaagatcaacattctcggatccggatataagggtgagcttcttaagcaaatccctgccgagaaccttcccaaggccttcggcggtgagtgccagtgtgagggtggctgtgagaacagcgacgctggtccttggcacgaggctgagtttgcccgtcctgcttggtgggagaagaagcaggacgccaatgttatcgagaacaagggctctgagattgaggagcccgcaaaggcccctgaggctgctcctgttgccgagggtgctgacgccacccagacagctcctgcccctgcccctgctgctgcttanaggataggaggagatgcgtgatgggattgatgtcgatgaaagatagacagagcggtttctctgtgtcttaatatagaccgcatactttctctcgtttattatacctttttttcacaacgag

SEQ ID NO: 35706 - DNA, 607 bp, Triticum aestivum
  Clone ID: PAT_TA_35706
ctctctttccttccttggccacactttcaacactcaaacgatctattccacgtctttggctaacgccccttgttgtaaccactactacttttaactccttaatcaataacccacattcacaatggctggcggcgatatcaagaagggtgccaaccttttcaagacccgatgtgctcagtgccacaccgttgagaaggatggtggcaacaagatcggacctgctctgcacggtctctggggccgcaagaccggttccgtcgagggttactcttacaccgatgccaacaagcagaagggtattgagtggaacgacgacactctcttcgagtacctcgagaaccccaagaagtacatccccggtaccaagatggccttcggtggcctgaagaaggctaaggaccgcaacgacctcattgcctacctcaaggactccaccaaataagcgactacaaatcgcgtgtaatgttacgactttcgatagatgggaaccgccaaggggcgactgtactatagatttttacacagcacttgttaagacatgccacgtgctttacccagaaaaaaaaaaaaaaaaaaaaaccctaattgcaccccgatacaacacaac

SEQ ID NO: 35707 - DNA, 844 bp, Triticum aestivum
  Clone ID: PAT_TA_35707
tgtgcggcgctcggcgcggcaggccgggacatcatactctcataaatcgtcacaatgacaaacgaagggcgcattgctactctggattcaaccatcgccgataggcttcctgcattctcaaagacactctttgacggcaaggccgccaaagacctaagctttgaggcaattgcaaagcatctaggccgtagtgaagttgcggtggcagcattgttctacggacaggccaccgcctcgtctgaggatgttgagaaactatcagagatccttgaccttcccaaggaggcgttggctgcccagctaacaggcttccctaaccgtggccaggcgggacccatgcctcctaccgagcctctcatctatcgcttgtacgagatcgttcaaaattacggttatgcctataaggctatcctcaacgagaagtttggagatggtatcatgagtgcaatttgcttctctaccacagtggagaaggaagtggatgaagcaggctcaccatgggtcgttatcacattgaagggcaaatggctccctttcagtcgtttctaggcattgttctctcaagagaattggttgatagctcggagttataaccactctgcatgctgtgtcactttcattaatgactactcaaagcgtatttacataacggaaaatgcgggttggagcatcgctaagttcacacaagcctcactcaagaatgacatgtatttcgagtaaagcggacggggcaggttgtggcaatgcgcgtgaagacaatatgaagcgagaggacaatactaagcaatttacaaacaaataccaaacaaaaaaaaaaaaaaaaagaaaacaaaaaagggcccta

SEQ ID NO: 35708 - DNA, 842 bp, Triticum aestivum
  unsure (1)..(842): unsure at all n locations
  Clone ID: PAT_TA_35708
gccggccgggccggccggaggtgcacccattgtttctgtttgttcttcacaccagttcacgatgagacacttcgtgtccccccttcttgcacttggctgcctcattggcaatgccgcagcagcatggcccaatggacccttcaaaacttctggcagatggatagtcaatgccaataatgagaaggtcaagcttgctggcgccaactggcctggccacggtgaagtcatggtccccgagggtctacagtaccagtccatcaagggagttctgtcagatatcaagggcattggcatgaacgccattcgtcttaccttcgccacagagatggttgatcagatctatgccaacggcggcaaggacatcgatatcaagactgctttcgaagagggtcttggaaaagagaacggaactattgttctggcaaaggtgttgaagaataaccctacctttactgccaaaacaacacgtcttgaggtttacgacgccatcgctgctgagtgtcttcgtcaacagatctacattaatcttgacaaccacatctctgagggcaagtggtgctgtggtgggtgaggatggcaacacctggtggggagatacccaatttgacactgccaaatgggttcgaggcggtgcctacatggccgctcatgctaagaagtggcccgcaaaggtctctcagtctcttcgcaacgagcctcgcgagcctaccaacaacaacaagctccgtgacgcgtcatacaactggagtgacctttacagtacatgcgcagggtgccgatgctgttcaccaggctgacccaacgcaatcatcgntatttccgcattacaatacgatacctat

SEQ ID NO: 35709 - DNA, 1069 bp, Triticum aestivum
  Clone ID: PAT_TA_35709
gccggccgggcctgcgcaattcgaggcatttgacagacggcagttgattacagcggcagcgcacaagaatggcggggctgtatgagaaaccgtcggagacgtacgccaagaagcggccgcggtaccccaaggagtggttctccatgctcgcctccctcaccgccggccaccaccgcgcctgggacgctggctgcggcagcggccaggcctccctcagcatcgcggagcactacgacagcgtggtcgcgacggacgtgagcgagggccagctccgccacgccatcgcgcaccccaaggtgcggtacctgcacacgccggaggacctcgcggaggacgacctcgtcgccctggtcggcggcgagggctccctggacctggtcatcgtggcgaccgcgatccactggttcgacgtcccgctcttctacgccgtggtgaaccgcgtcctcaggaagcccggcggcgtcctcgccgtgtgggggtacaactacgacatccacccgttcggggacaagctgcacggggcgctgtacccggccatgcggccgtacatggacccgaggacgaggctggccatggagcggtaccgcgacctgccgttcccgttcgagcccgtcggggtgggccgcgagggcgagccggccgacgtcgacatggaggcggagatgacgctggaggacctggccgggttcgtgatgaccggctccgtcgcgaccacggctagggagaaaggggtggacctggaggcgctggtcaagggtgtgatgaaggaggtggaagaggggtggggggatcggccgacggtgcccaggaagcttgtgttcaaggccttcatgctggccgggaggcccaggtgatagatgaactgctgggtggtgaattgggatcggtaccgtacagtaaaataataaaatgtgaagtttgcgacttattactgccttcttttcacaatactttaaggctctagatttatcctaagtcagagcgccccttgtgtcactaagttgtcattcgtagtctaaaaatcttgatgtaatttttattgaaaaatgtaaaaaaaaaaaaaaaaaaa

SEQ ID NO: 35710 - DNA, 1130 bp, Triticum aestivum
  Clone ID: PAT_TA_35710
agccgtgagatcgatcacaccgcagcacgcagacaaagcagacggggacagcacagcctcagcgcacggaaagagaggagagatcggagaggtgaccaccgccgcgccgagatgctggccgtgttcgaccagacggtggccaagtgcccggagggcctccgcagcccgccggcggccggaggtgcggcggcagggggcggcggcgcggccgcgctcatgaagggcttcgccgccgccaacgacgccgcggtcaccgtcagcctcggcgccgccggcgccctcgcctactcctcggccaacaagaaccccctcgtccccaggatgtttggttctgtgaacgacatattttgcctgttccaagggcatgttgagaacattggcaacctgaagcaacactatggtctgagcaagacagcaaatgaggttaccatcctgattgaggcctacagaaccctccgggacaggggcccgctcccagccagccaggtcgtgagagatctcagtggaaggttcgcttttatcctgtacgacaccgtgtcgaaatccaccttcgtcgctgctgatgctgatggcagtatccccttcttctggggcgtcgactctgaagaccaccttgtgttctctgacgacaatgagcttctcaaggcaggctgtggaaactcatttgcgccattccccaaaggctgcttctacaccacatctggagggctgcagagcttcgagcacccgctgaacgagctgaaggccgtgccacgtgtggacagccagggccagatgtgcggctccaccttcaaggtcgacagcgaggccaagaaggactcggggatccctcgcgtcggtagtgctgctgattggtctaaccactactagcttgatgacccttgttgtaaactgccaatcttgacactgaatcgctgagacaccgcactgcatctgcattttatttttgagcagtttacgacgctctagacaatgctgtttcaataaatgtactgtctgatgggtaatgatactgctgtaagtttaccgatactcgaacaaactctgatgccaccacctggtggtagaggtttatcagccaccctatatatgtctcgataaataaagttcagtgaaggcttagtttgttt

SEQ ID NO: 35711 - DNA, 652 bp, Triticum aestivum
  Clone ID: PAT_TA_35711
aattcccaagaccccagcgccctccacctgctcccagatcccggccatctctccactccggcgaccaccgcacgagcgcgctcaccctccaccgccacccgaagatggccattgccggcagtgggaggggcaaggcgaagcccgcggccagcgccaagtccgtgtcccggtcgtccaaggccggcctgcagttccccgtcggccgcgtcgcccggtacctcaaggtcggcaagtacgcgcagcgcgtcggcgccggcgcccccgtctacctcgccgccgtcctcgagtacctcgccgcagagaccctggagctcgccgggaacgcggcgcgggacaacaagaagaaccggatcgtgccgcgccacatccagctggcggtgcgcaacgacgaggagctgagccggctgctgggctcggtcaccatcgccgccggcggggtgctgcccagcatccacaccacgctgctccccaagaaggccggcaagggcaagggcgacatcggctctgcttctcaggagttctagattagattattatggtccttatgaatgtttggaatgcatctcgcaatcttgttcttgatgttactgcttgtgacgcccttgtcaatactaatatgaatgaaacggatatgttgctattgtttgcctgc

SEQ ID NO: 35712 - DNA, 1464 bp, Triticum aestivum
  unsure (1)..(1464): unsure at all n locations
  Clone ID: PAT_TA_35712
gcgccctccagctgctcacagatcccggccatctctccgtcgacaaccgcacctgcgcgtgcaccctccgtcccgaaccagaagatggctattgccggcagtgggaggggcaaggcgaagcccgcctgcagcgccaagtccgtgtcacggtcgtttagggccggccggaccgaggcggagcgcacgcaaacgacacgcggacagagcagagccagcgcacggaaaaagaggggggagacacgcgcaccgcgccgagatgctggccgtgttcgaccagacggtggcccaggggcccgaagggcccccccggcccccgggcggccggtgcggcggcaggggggggaggggcggccgcgctgatgaccggcttcgccgccgccaacgacgccgcggtcaccgtcagcgccccgtccgccggcgcccccgccgccgcctccgccaacaccaacccccacatcccccccacgttcccctcgggaatggtcggtttttgcgagttccaaagacaggttcaagggcatgtgcagcccgaagcaaaacctggagtctcacgcaagacagcagatgaggttaccatccggatcgagccctaacggagccttccgggacctgcgccccatcccagctagccaggtcctgaagagacctcaatgggacagttcgcattcctcctcttaatcataccgggctcgaaatccagcctcaccgtcgctgcttgtatgctggatggacatggtccccttccctcgtgcgtgggttcactggtgcaacttgagccatctttggttatcttgctataccaagcagcctactgcagactctgttgcgccatttccgacacgccgctccaccaccgcattttactacaccacagagggctggagcactcggtagcacccgctgaacgagctgaagcacggttcgaagagtcgggcccggcagggccacggcgtgcggcaacaacctctgacggcgaccacgaggcaaaggaggactcggcgatccctcagcgtcggtagtgctgctgactgcttctaaccacttgtacctcgttgacccttgctgtaaactaccaatcatcacagtgaatccccgagacaccgcaattcatctgtattttatttttgaacactttacaaagctactagacaatgctttttcaagtaaattgttactgtctgatgggtaattgataccgctaaaagtttacccgatactcgaaagaaactctgatgccaccacctggtggtagaggtttatcagcccccctatatatgtctcaataaataaagttcagtgaaggcttagtttgtttataaaaaaaaaaaaaaaaaaagattantttggttttcgtgtaccttgctgccgagaccctggagctcgccctgaacgcggcgcgcgacaataagaagaaccggatcgtgccgcgccacatgcagctggcggtgcgcaacgacgaggagc

SEQ ID NO: 35713 - DNA, 1573 bp, Triticum aestivum
  Clone ID: PAT_TA_35713
gccggccgggctcgggaatagtttcatccaaagctatctgactttggccttgcaaaacttggccctgttggtgataagacccatgtttcaacacgtgttatgggaacttatggctactgtgccccagagtatgcaatgactggacagcttacagttaaatctgatgtgtatagctttggtgttgtgttccttgaactgattactggtcgtaaagcaattgacaacaccaaaccacatggagagcaaaacctagtggcgtgggctcgtcctctgtttaaagaccgcagaaaatttccaaaaatggctgatccggcacttcagggccgttttcctatgaggggtctgtatcaagctttagccgttgctgcaatgtgtttgcaagagcaagctgccactcggcctttcataggagatgtggtcactgctctttcatatcttgcttctcaggcgtatgatccaaatgcacccactcaacatagtcggagcaatgcatctacccccagagccagagaccgtggtagtgtgaacggcgaccagcggcgtatccggtcgccaaatcaccattctccagatatgaggagaaaagaagtcacaacaacatcgaagtatgaagccgaggttagcaggaatagttctggtggtggttctggtagacagtcaggcttggacgatagggatgtgacaggttcacaacagggtagtcctgctcgggcaggaaagaggagggaaacttcaaggacctctgagaggcagcgtgctattgcagaggccaagacatggggtgagaattctagagagaggaaatggccgaatgctcggggcagcttcgatagtacaaatgaatagaactctggagcaggtctgagtcatcattctagaaagaggatgagtgcaagccagtaccaagcagggggcagtttagggacatggggttcgatttcggttccatgtttaatgtgaatagagctttccttttctttcccggccatcaccactgcttcatagtttctctcttccacacaaatatcaccaccgcaatcaccatcgacacgcctattcctggcgtccgttcctcgtgaatgtgattatgcagatgtgccttcatcatcatggcacgaacgacatctggctggaaagttagtaagcaaaggggagaactgttcttaggaggacatggtccaatcaaatgagtctcttctgttgcctgcatgcatgacgggtatgacagttgttccgagcgtagagctttattgtgaagtctgagtaccgagcgatgtggtgatttttctttcctcgagggtttgtaccgagggggtttacccgtgttccatacgtctgtattgtgacatttttggggggatcggttcggcggacctcatcctatcaaatgagcctcctctgttgcctgcatgcatgatgggtatcacagttgttccgagcgtagagctttattgtgaagtctgagtaccgagggatgtgatgattttctttcctcgagggtttgtaccgagggttttacccgtgttccatacgtctgtattgtgacatttttgtttgtaccaatttcagacaa

SEQ ID NO: 35714 - DNA, 772 bp, Triticum aestivum
  unsure (1)..(772): unsure at all n locations
  Clone ID: PAT_TA_35714
agccggctgacaacacatcctcaaccactagtcttcttcttcaaacctctctacaaatcaacaaattctcaagatgaaggctgtgacctcgctcgttcttcactgcgccgtagtgactgtcgctgctgcggctcttcctgacggtagtcaagtggttgctgaccctctggagggctacgaaattgttcctatgcaatggaagggtgttatcaaagagggagaggctcctgtctccctgaacggtactattgagtcggttatctcccagatcaaggagcttaacccggagttcgagttggtggaagaagacaccgccgagtcatccggactcgaagcacgcaacccatccaacatcatttgcaatgttggcggaagcggttatgtcgatgtgaaagcggcccaacgtgagcaaaggtaccttcgctccttgggtaccagtgtatgtggtgtggatggcgggcctggcaagtgcgctcgcgtctcctgttcttatggcgatgctatctggctttgcaacgacaacagccactacatccaacccaggtgcagctacttggctgactatgttgatcgcattattgcaagctgccaatcgaaaaccagcagcccgccttgtacagtcaggccttgcgctcctagttggaccgcatggttcgttcgtggccagcagttcgatactgacagatacaacgttattggtggaagaaagcactgctagtatgntgatcggctgcatcatgggtgcgtgaatctacgatgagcgtcgtattat

SEQ ID NO: 35715 - DNA, 1264 bp, Triticum aestivum
  Clone ID: PAT_TA_35715
gccggccgggtcgggattgatctctgcttgagcccttgtgtcctccgactccgagaacgacctccccatctcgccgcctcacattcgatcgcagcagtgacggtctagctcgcccataatgtttgctaggtcgtgtttgcgctcgacgcgcaccctcaatggccttcgcaagggcccttccgctatcgccaagcgtgctgcttcctcaagcgccaacgccgccggcgatgccactgccactcgactgaacctggccgccgccgcctcgaccactctcgccctcggctccatggcctggtactaccatctttatggacctgtggcttttgccatgactcctgctgaggagggtcttcaccctaccaagtacccttgggtccacaaccagtggttcaagaccttcgaccaccaggctctccgccgtggtttccaagtctaccaggaggtttgccagtcctgccactcccttagccgagtcccctaccgaactctcgtcggttccatcttgaccgtcgacgaggccaaggcccttgccgaggagaacgagtaccccggtgagcccgatgagcagggcgagatccagatgcgtcccggaaagctggccgactacatgcttcccccttacaagaacgaggaggctgcccgatttgccaacaacggtgccctgcccccggatctgtctctcatcatcaaggcccgccacggtggctgtgattacatcttcagcttgctcactggttaccccgaggagcctcccgctggtgtccaggtcgcccccggcatgaacttcaacccctacttccccggtaccggtatcgctatggctcgtgtcctctacgagggccttgtcgaatacgaggatggaacccccgccaccacctctcagatggccaaggatgtcgttgagttcctcaactgggctgccgagcctgagatggacgaccgaaagcgaatgggtatgaaggttcttgttgtctctgcctccctttgggctgtcagcgtctgggtcaagcgatacaagtgggcctggctcaagtctcgaaagatcgcctacgaccctcctaaggaggtcaaggtccgccgctaaacgggcaagatctcaaaatctcatatgtatactagtcgccccctagagcagctcctttgtcggcggtggcgggtataaaagaagtttggttgtggaatggaatgaagtttggaagtggatgttagagtgtaaatcagatgaatcgttcaataaaaaaaaaaaaaaaaaaggccccta

SEQ ID NO: 35716 - DNA, 336 bp, Triticum aestivum
  Clone ID: PAT_TA_35716
gccggccgggttccggcaccaatgcgtccacgcatcgttcccctgatcgctaccctcgcccgctcgccgcaccccaaacccacagggccatccccatccagatccatccgtccatgctgcgccgccagcccacccgcatcgacctccgcagctccgaccgcgacgagctcgaggagcacctccgctccaaggccgccgccaagtccgccgccgaatccacgcccctctcgaccccgcgcccctccaaccccatctccaacccgctcctccgcctcctccacccgccgcccgacgccgcgccctccaaggcccagcgcaggttgctccacctcccgc

SEQ ID NO: 35717 - DNA, 872 bp, Triticum aestivum
  Clone ID: PAT_TA_35717
gccggccggtttgggaaatgccggccgcgccatggaagtcgacaatccattctcagtcttccccagggaagtccgagacatgatgtattcctactccattccggaaatcccagccacagacgccacagtctccaaaacagcctacaacaccaagaatgcccctcttctgttcctcaacgaagccatctccaaagacgttcagcacgtgctctatcaagatcacgccatcgtcatcccagtactgaacccaagcgaatacgaactcaaagaaacaaaattcgcacctatcgtcagccaatgctcgcgtctgatgaaacagcgctctaacagagtaatcatcggtacatcacgcttcattgccgcaagctactcaccgctgcttcacataaacatccacgacggaacatcagctgaagactggatccagaaattctgcggttttgataatcctgagccgctagccaagaaactcatcgatgagttgatttcactacgacctgaactgccgaatgtcaaggtcattgagttcaagttttttgaggggtttaatgtccttgtcgctttgaggtggagggaatactttttagaattgaaagaggcatggccggagattgagattgagatcgattttattcctgcgtttctgggctgggaacatgttgaagcattttttcaggacgctcaggatagtatggaggaagacggtgtttttaaaccggataggctgagggatttggaagagaggagtatggactgtatgacgggtttagttttctacagatcaagattgcattctgttttcacacgaggcaagctagcatcaattttcatttgcacgagtttaagtaggcataatagtattcagaatcttt

SEQ ID NO: 35718 - DNA, 936 bp, Triticum aestivum
  unsure (1)..(936): unsure at all n locations
  Clone ID: PAT_TA_35718
gccggccgggtcgggccggtttcttcgggagcaagtcctcttcaatcgcaagtccggtttctgtttttgggtcttttaccctttccccctttgtgttttcgttatccccctcctagagcaggtctctattatacttctaatttttgttgtctctaatcccaagaaatcacccgcatcaaccacctcgaatcccaaatcaatcaagttgctggtcagcttagagacaatattcccattttaacgactatttttgtttttcgttactcaatcacgcctgttataatcgtctaattacagaaattcacggatttcacttgctcgtgccaactactatcaaatcaacaactgcactcttttcagcatcctgctacccaaaacaacttcataaattaatcaagtaaagtcaacatgtcggctattcaactttctttctctctccgcgtctccgccggtgtcaagactgtccatcttctcggctcctgggacggttatgtcggtcagctccctctctccaaggacaagtcctcttcaaagtccggctcctggaagggcacctttcgattccagaactcaactctcgaggctggccaacgatactggtactactacatcatcgacggttaccacgttgcccacaaccccagcgtcacctcaactgttgagcccaccaccggccgtgagctgaacgttctcgacgttcccaccgactcccacaagtcttcatctcgttcctcttcttcaagtcttcctccaagtcttcctcttcctcctcaaagtcctcgtccaagtcttcttcctcttccaagtcatcgtcatccaagtcttcatccagcagcaagagctcttctcactcctcaanggacaaggagtctcgattctcgcatcctnagcnaaagtctaagtctcagttgaatcccaagggtcgcccctatnatn

SEQ ID NO: 35719 - DNA, 795 bp, Triticum aestivum
  Clone ID: PAT_TA_35719
gccggcccggccgggatggctatcacgactggggaaagaagcacttcatcatgattctcttcaaagctactgtactcgccacgggcattatctctttagcccttccaacatatggccaggcacccaaggtcaatgatttggccgatgcttttgaactgtccgacgtgtctctgacagacagtcgatggatggataaccaaggtcgaacagtcaactatctcctctccatcgacccagacagacttctatacgtctttcgaaagaaccacggcctagacaccaagggcgccaccaagaacggcggctgggatgcaccagactttcctttccgaagccacgtccagggccactccctcacagcatggtcaaattgctacgctaccctgggaaataaggaatgtggttcacgagctagctactttgtcaaggagcttgcaaagtgccaggccaacaatgcaaaggctggcttcacatcaggctatctctccggattccctgagtcagagattgccaaggtcgaaaacaggactttgaacaatggcaacgttccctactatgccatccacaagacacttgctggccttctcgatgtctatcgtcgtgtcggtgacaatgatgccaaagctgttatgctttccctggctggctgggtcgatacccgcactggaaagctgagctacgcccagatgcagcagatgatgcaaactgagtttggaggcatgaaacgagttcttgctgatattgcctactacacccaagacaacaaatggctcaagggtcgccagcgcttcgatc

SEQ ID NO: 35720 - DNA, 746 bp, Triticum aestivum
  Clone ID: PAT_TA_35720
gccggccggggccggattcaacgtcgagcctgtcgaaccgatccgcacacccggaaaccgacttattcacaatggctacgtctcaattgagggcaattggcgtccttgcgcgtagcgcgcgcgtctcccagcgtgctttcaccacctccgctcggcaattcgaggccgctgtctcaaccaagaccaacgaggcatcacccgctgccgccgacgagaacaagcccgctgtgattaaccaagcccccaaccgtgtgggtgtctggtcacgtagccagaagccccgtgctcaggctatgaccggcccccgattcgagcagaccgacttcgaccttcagcctcaacccaaggctgctattgagatgatccacaagcagcccgtcacatggactcatgaccgaattgttgcttgtaacggtggtggcggtcctgaaggccaccccagggttttcatcaacactgacaagcccgagattgctgtctgcggctactgcggcctgccttttgctcatgaacaccaccgcacccacctcgaatccctccctgagacttcctaccctctctcataatcacccaggaaagattgaatctgaagggaaggaacatcatctacatcactagacctatgcgagggggataaagaaacccaaatactatgctgctttgcaagcgaaaaaaaaaaaaataaatataccatgcgaatacaacgaacgaatcaaccataaaaaaaaaaaaaaaaaaggccccta

SEQ ID NO: 35721 - DNA, 859 bp, Triticum aestivum
  unsure (1)..(859): unsure at all n locations
  Clone ID: PAT_TA_35721
gtcaactggttcgttatcagcctcgtctctttgtttgtcaacctgttctcagctgcctagcaaagcattcaagatggctttcggaactctcttcacccgcgagaacaactgccgctctactgccatcaaggctgtagccaaggcgaacgacatcgagctcaacatcgtcgaggctgagaagggcaacgctaccgctgagcacctcaaggccaacggtctcggcaagatccccgcctttgttggcgaggatggcttcgctctctctgagtgcatcgccattgccatttacatcacctcccagaacgagaagaccactcttctcggcaagaccaagcaggactatgcttccatcctgaagtggatgtccttcttcaactctgaggtcctccctaacctcattgcttggttcagccccctcaagggcgactctccctacaataagaagactgttgacgaggccatcaaggctaccgagaagaacttcgccgttgttgaggagtacctccttcacaacaccttcctcgtcagcgagcgcatcaccctcgctgatctcttcgctgctgccattgccacccgtggcttccagtacttctttgacaagcactggcgcgcggagcaccctgccgtcacccgatggttcgacactgtccgcagccagcccatcttctctgaggttgctgagaaggtcgagctcctcgagaccgttactctgaccaacccccccaagaaggccgaccagcctaagaaggaggctaagaaggaggccaagaaggagccaagaaggaggccgctcccgctcccgctgccgctgcggnntcctgctgaggcccccgctgctgacgaggnccctgctgccccc

SEQ ID NO: 35722 - DNA, 957 bp, Triticum aestivum
  Clone ID: PAT_TA_35722
ggtccagacaccccaagaaagcatggacgccgccggcgagagcgccgtgacgtgcgtcgacttctgggccaacgggttcggcatgcgggcgcggatcgcgctgcgcgaactaggcgtggcgttcgagtacgtcgaggaggacctccgcgtcggcgtgaggagcgacctggtgcggcgcatgaaccccgtccaccgctcggtacccatcctgatccaccgcggccgtccggtctgcggctccctcaacatcctcgagtacatcgacgaggtctggagtgcaccgggcgagacccgccgcttgctccccggcgacccggccggcagggccgacgccaggttctgggccgacttcattgaccacaaggtgttccctactcagacaaggttcctcaagagcaagggtgaagagaaaaaggcggccaaggaagagctgcttgagcaactcaaacgcctggaggaggtgcttggggacaaggtcttcttttcgggtgaagaattcgggttcttggacatcgtcctcatcccattttcaagcatgtttcgtgggtacgagcagcatggagggtttgacctcgaggttgagtgccccaacctcatgcgatgggtgaagaggtgcaaggagagggagagtgtcggagctgttcttccggatgagacgaagatgtaccaattacacaaggagtggtacggtattgagtagcgaagccggcttccgtagctgcgtgcggctgagttaatctagtgcgctattgtatatctatatatttggtttcattatttttttccgtaatagtatgtaagttttagctctttgtaccttcttccatacacaagttctcgttgtcataaagaaacagagtttgactctgcgatggatgcacgcacttgtataaccttttggccaaccagcaaaagactgacatatgtgcttaaaaaaaaaaaaaaaaaaggccccta

SEQ ID NO: 35723 - DNA, 815 bp, Triticum aestivum
  Clone ID: PAT_TA_35723
gccggcctgtgcggcgcaaccactcagaacactattccacttccatcatggcccgaatcctcattaccggatctaccgacggctttggcttcgaagctgcccgccagctgatcgagcgaaagcaccaagtttacctccatgctcgcaaccaagagcgcgccgatgaagtcaagaccaagctgccaggtgctgctggcgttctgattgccgacttgacaaccgttgcggaaacgcgcaagctcgctgacgaagcgaatgcgatcggcacctttgacgccgtcattctcaacgccggactactctacgggccgttccgaaagtcagatcttggtgttccagcaagcgtctttgtcaaccttgtctccccatacatcttcgcagccctcctcaacccgcccaagcgtctcatctttattgcctctgttctgcaccatgaggccgacacaagtctcaaggacatcttctggttggagcgcggagagaaggagtggaaggatttcccagcatactgcgatgccaagttccacgttgtcctcctagtcaacgcaattgcgcgacgtttcaaggacacctcggtcattgctgtgcaccctggatacgttcccaccaagcttgcaggtcaagacgctcccggcaagatggaggatggtatcgagacatatgtcatgttggctgagggtgattacgatacttctttgactggtgtttactttgaccctaagaaggagagggctcagcctcacgccttgacagcggatctagacaagcaggaagctgtcgtcaaggccttgtgaagagcttacgggaaatcaagc

SEQ ID NO: 35724 - DNA, 873 bp, Triticum aestivum
  Clone ID: PAT_TA_35724
gccggccggccggccgagatgggaagcgcattgcagtctttcgctacatctcaatatttacctactcaagatgcgtatctcaactatctctttcggtcttcttgtagctggctctgccacagccactattgagaagcgggcaccgcttatcacccgagatgaaagtggtattgagggaaagtacatcgtcatgatgaagccaacatcaggtaatgagatcagcactgcacgcgtcaagtcagcagccaaggccgttgatgtaaagcctgatatggtctttgacaacctgggtggattttctgcgagcctgactgcccgcgatgtggaggacctacgcaacaaccccaatgttgcatacattgagcaagattcagttgccaggatctctgctactcagaaacaaccaccatggggtcttgcgcgggtttcaagcaagacgactggcgcgacacgatatacatatgatgattcggctggcaagggcacatgtgcttatgtcctagacactggtattgacaccacgcatcctgactttgagggtcgcgccgaattcattgccacatatgttgacgacatctgggtggatgatcacggccatggcacccactgcgccggcacaatcggatccaagacatacggagttgccaagaagactaagctttacggaatcaagctcttcaactccactggagaaggagttgcatcttctatcatcgctggcatggacctggtccttcgtgatgctcccaagcgagactgctccaagggagttgtgtaagcatgtcgttcggagagatcccttccaagggcatcaacgatgctgcccaagccctcgtcacggctggcttctttgccgctgcagctgctggtaac

SEQ ID NO: 35725 - DNA, 853 bp, Triticum aestivum
  Clone ID: PAT_TA_35725
attaaccttgataacgacttcttccatcacttcacacgactttcatcaatatcttgtaccacttcgcatcattttgtaaacaattcagtccagaaactattcgacttccgataaactctaggcgcaatgcgattctctaccgtcaccgcctgcctgactgcctgcttggcgccagcagcggctctgagcgttctcaatggcaaggctcccgaactcaccatcagcgacgacctcaagattcctggcgattctcctctcgagttttgccccggagatcacgcagccgatcttatcaagatcgaccgcgttgatttggctcccaaccctcccaaggctggccaggaactcttgatcaaggccaagggatcagttaagcagaagattgaagagggcgcttacgttctcttgactgtcaagtatggtctcatccgcctcatcagcaccaaggccgatctctgcgagcagattggtaacgttgacctcaagtgtcccgtcgaaaagggcgaggtcgaggttgttaagaccgtagaccttcctgctgagattccttctggcaaatacactgtgctggccgatgttttcactgccgacgatgtacaaatcacatgtttgacggcaactgtcgccttctctcgtagcagcaagggtttctttggcagcgatctgtgattgggattatggcgcacgcaacatacgcatgatggcatgacttacagctgggcacgttttcattgatttctttgttgacgttggtttttgggtgaatttatagctcaagtagagcatactgcagcggctttcgaatctatttagcatacttgataaacgtaaaaaataaaaaaaaacgccccct

SEQ ID NO: 35726 - DNA, 831 bp, Triticum aestivum
  Clone ID: PAT_TA_35726
gccggccgttttccgatctacctctttccttctttccctcccgcatttctatctcctatcagcagactcccccccatcccgaggtcacccatcatgtctttcttcaagaagatcgccaaggagtttgagaaccttggaattggcgacaagaaggaggaacagcaacagcaacaacctcctcaacagcagcctcaggacggtaaccgcgcctacggcgacaacggatacgcatctcctcctccccagcagcagtacggcggcgcgcctggatacggtgctcctcctcaacagtacggttcgcccgctcctcagggatacggcgctccccctcctcaacaatacggctcccctgctcctcagcagcaatacggtgcccctcctccccaacccgcctatcaacctccttccgatcgtcctcctctgcctcagggctggactgctcagttcgaccaaaattcccagcgatggtactacgttgagcaagctaccggtcgcacccagtgggaggctccccaggctcagcaggctcctcctcctcctcccccggactctcgtcctccttatgagtctcagccttctgatggatctcgcggctacggcggtgctcctggtggatatggttccccagctcccggcggatacggttccccagctcctggtggctatggctctcctgctcctggtggctatggtgctccctcaccctatggagcccctggcggttacggatcgcctgctccaggtggttacggtgccccctcaccgtacggtgcccctcagggtcagtatggtgctccccagggccagtatggtgctcccagggtcagtacg

SEQ ID NO: 35727 - DNA, 633 bp, Triticum aestivum
  Clone ID: PAT_TA_35727
gccggccgggccggggacaatctcgcatcacactgcctcacttatcgacgtcacaccctcagagttccaggcttctcaacgacttcccggccgttgtgacttccaattctacgacacctacagtatactccacgtccctgtctccgccccgaccaccatcatgaaggctgctctcttcctttccgctctcgcctcaaccgccgttggcgttgttgctgaggagctcaagatcgatgtgactcttcccgttatttgcgaacgcaagacacagaaagggagacggggttcacatgcactaccgtggtaccctcaaggactcgggcaagcagttccatggtaactaccatcgcgggactcccctttccttccagggcggtggtgggcaaggtatcaaggggtgggaagaagggcctcctgacatggggattggtgagaaacgaagcctgaacattccccccgaagtccggtaacggcaacgaagcaatgggcctattccccgccggttcaccctaatttttcagaacgaagtccgccgaattgaaggcggcccccaaacccaaaagaatcagaaccaaggtggccaaaggggccaagctggccgccaaggcctccacgaaggtaaccaaggtggtg

SEQ ID NO: 35728 - DNA, 807 bp, Triticum aestivum
  Clone ID: PAT_TA_35728
ccggccgggctgggaaagaaagactacacagtctctttgaactctgaaggctccctctgcactctgcaatggcaggaggaggggaaggaggcgaactgcagctgctgggcgcgtggttaagcccctgggtgatccgcgtgaaggtggcgctgcagatgaagggcctcagctacgagtacatcgaggagaacctgcagcacaagagcgacctcctgctcagctccaaccctgtgcacaagaaggtccccgtgctgatccacgccggccggccggtgtgcgagtcgctcgtcgtcctcgagtacgtcgacgaggcctgggccggggccgggacgcccctcctccccgccgacccctacgaccgcgccgtcgcccgcttctgggccacctacgtcaacgacacgttcttcccgtcgtggaggccgctgttcagggcgacgacggcggagcagagagcggaggcgttcgagaacgtgctgcctcaggtggagacgctggagcgggctctcacggagtgctccaaggggaaggccttcttcggcggcgacgccgtcgggatcgtcgacctcgcgctcggaagcttcgtggtgtggatccgggcggtggacgaattgggcggcaccaacctgctggacgaggccagggtcccgggcctggcggcgtgggccgagcggttcatggccgtagacgccgtgggaggaggtgatgcccgaggccgggaggatcatggagcactacaaagggtttctcgcgaaactggctgcacctgctggttctagctaattgcgatgctcgcctactttttcgtca

SEQ ID NO: 35729 - DNA, 711 bp, Triticum aestivum
  Clone ID: PAT_TA_35729
gccggccgggcttcgagttggtgctcctcaagtgcagcaacctaattttggctcagctacaccggtgcagcctgggtttggtagtcgaccgcagcaaccaacacatgttgctcatgagactcaacatcctgggtttggcacatctcgtccatggcagacagggtatggcgctcaccaagcacaacagccaggccatggtgctcagcaagcacaacagcctgggtatggtgctcatcaagcgcaacagcctgggtatggtgctcatcaagcgcagcagcctggatatggtgctcatcaagcgcagcagcctggatatggcgcccatcaggcgcagcaggccggatatggcgcccatcaggcgcaacagcccggatatggcgcccaacaggcgcaacagcccagatatggcgccaatcaagcgcaacagcctgggtatggggctcatcaagcacaacagcctgggtatggggctcatcaagcgcaacagcccaggtatggggctcatcaagcgcagcagcccaggtatggggttcatcaagcgcagcagcctgggtatggtactcatcaagtgcagcagcctgggtatggtgctcctcaggcatcacggccatcatttggtgcccctgaagcaccacggtctagtttgggctctgctcagagtctcccacactatggccgcataggaaatgagcatgatcagcttggatcttc

SEQ ID NO: 35730 - DNA, 896 bp, Triticum aestivum
  Clone ID: PAT_TA_35730
ggccggctcgaggcccggccgttttccgggaaaaaaaaaaaaaaaaaaaaaaaaaaagaaaaagctctccgcagcttccccaacctctctccactcccatctctgatcgctttgtgtcgtctggcaagatgttcaagagcggcatttcctccttcgcccgcgcggctcgcccggccgtccttcctcgacgtgccctccgaccttccgctctccgacttcccatctccagccgatgggccagcactggcgttggcgccggcaagattcaccaggtcatcggtgccgtcgttgacgtcaagttcgatggtgctaagctccctgccattctcaactctcttgagtgccagaacaatggccagaagcttgtcctcgaggtttcccaacatttgggtgagagcgtcgtccgttgcattgccatggacggtactgagggtctcgtccgaggcgctgctgtccaggacaccggtgctcccatcactattcccgtcggccccgagactcttggtcgtatcatgaacgttactggtgaccccattgacgagcgtggtcccatcaagactgacaagcgacttcctatccacgccgaagcccccgagttcgttgagcagtccaccactgctgaggtcctcgtcactggtatcaaggtcgtcgatcttctcgccccctacgcccgtggtggaaagattggtctcttcggtggtgccggtgtcggcaagactgtcttcattcaggagcttatcaacaacatcgccaaggcccacggtggttactccgtcttcactggtgtcggtgagcgtacccgtgagggtaacgatctgtaccacgaaatgcaggagacttccgtcattcagcttgatggcgagtccaagtcgccctggttttcggtcagatgaacg

SEQ ID NO: 35731 - DNA, 1017 bp, Triticum aestivum
  unsure (1)..(1017): unsure at all n locations
  Clone ID: PAT_TA_35731
gccggccgggttgggactgtaaacccgtcaagccttaaagccaacccgttccctcaaagtttctacttcggaaaccctacatcttcaattcgcttgtcgtcctcttctcttttgacttcttgtttatcttcttcgtcttcacttcacttcaatactccacaccatattcaacatggttgcctcatcgaacaccggcctcgagcgcgaggatcaccagcgcgatgccgacttcaacaaggccatgcacggctcctcagcccaggctcgaggtggtgttgctgccatgttccgcaagggcggtgctgctaagcaggctgctgttgatgagtacttcaagcactgggataacaagcccgcagagaacgagactcctgaggagcgagctgcccgtcaagccgagtatgctactttgacccgacactactacaaccttgctaccgatctctacgaatacggatggggccagtccttccacttctgccgattctcccaaggcgagcccttttaccaggccattgcccgtcatgagcactaccttgcccaccagatcggtatcaaggacggcatgaaggttcttgatgtcggttgcggtgtgggtggtcccgcccgtgagatcgccaagttcacaggtgctcatattaccggcctgaacaacaacaactaccagatcgagcgagctacccactacgccttcaaggagggtctgtccaaccagcttgagtttgtcaagggtgatttcatgcaaatgtctttccccgacaacagcttcgatgccgcttatgccattgaggccaccgttcacgctcccactctcaagggcatctacagcgagattttccgtgttcttaagcccggtggtgtctttcggtgtgtacgagtggctcatgactgacgagtacgacaacgacaacctccgccaccgnntgagatcgattgggtatcgaacaggggtgatggtatttcaaacatgtgcaaaggtctctgagggtatcgctgccatccacgactctggcttcg

SEQ ID NO: 35732 - DNA, 619 bp, Triticum aestivum
  Clone ID: PAT_TA_35732
cgtccgcccacgcgtccgaatctgttgatattctaaaaaatgttgttatggatgatacaaatatcatcaatgcttgaagtgctagagcagcatcaagattctgttgataatctacaaagtgttgtttcagaagaacaatcaggtagggaggaaatctcagtggtttcaggggaccttgaatgcttggtagaagctggtcatgatggaaacgatagaggtcttactggtacatcaaaagatgagtttgaatcatcagggcatgttgcacctgacaattcttcagctggtttatttgatgaaaatgagaatggtccaaacgtttcctcagtaaatcatgaggggccagtcaaggaagatgatacacctgttttagaagacgagtctggaactaattctgggcctcaggaaaaagagatagcacctctaagcaatttaagcagcgatataatttctaccacggttgctgatacatccaataaatcaatggataaacctgactgttcaggaggtgttccattcgatggttctcctgctggtgtgcttgaaggaaatgattcgacgatttcctcaataaatcatgtggatgcagttgataaaggtgctaattcttcttcagaag

SEQ ID NO: 35733 - DNA, 866 bp, Triticum aestivum
  Clone ID: PAT_TA_35733
aattcataaatgaggccgctctctctcggaactctcttcatatattctcttcacctttgatacccctctctctatatcatataacacatcatacacaatggctctcaccgtcgagctgtccactcccgttactggtacctaccagcagcccattggcctcttcatcgacggcaagtgggttgagggtgtcgacaagggaaagttcgaggttatcaacccctccaccgaggaggtcatcacctccgtctgtgagggtaccgagaaggatatcgacctagctgtcgccgctgcccgcaaggctttcgatggcgagtggaagaacactgctccccagacccgaggaaaccttctcctcaagctcgccgacctcgccgagaagaacctcgacctcctcgccgccgttgagtctcttgataacggaaagtccatcaccaacgcccgtggtgatgtcggtgccgttgttggctgcctacgatactacggtggttgggccgacaagatcgagggcaagaccattgatattgctcccgatatgttccactacacccgatccgagcccatcggtgtctgcggtcagattatcccctggaacttcccccttctcatgctggcatggaagatcggacctgctctggccactggtaacaccgtcgtcatgaagactgctgagcagactcctctctccgctctcgtcttcactcagttcattgagcaggctggtttccctgctggtgtcttcaaccttgtctctggttacggcaagactgccggtgccgccctctcttctcacatggacgttgacaagatcgccttcactggttctaccgtcattggccgacagatcatgaaggctgctgcttcttcca

SEQ ID NO: 35734 - DNA, 853 bp, Triticum aestivum
  Clone ID: PAT_TA_35734
gccggccgggcgccggcctacctcacagagatactttcatcatgggcatctttcgcatagtgagaaaaaccattgtgccgggtcttctcggtacatcgacagccgccgcttacctggcctctcaaaaccctgtcatctccccgcttccagccaatgatcctatttggtcctcaagactcttcagaagggccaatcccaacggaaaccctgcgacgcaggatgtcgtgatcaaaagaatcccactagacaagattcgccctgaacttcttcagaagaacggagatttggcactcgagttttgccgtggcatttggagcggttggggttacgatattcagcgcaggtatctcagcttcaagtggcgtggtcccgaaactgaacagcaactctgggatcctgaacagctttccacaagcacctacgacagaggcactgtcatcaccgaccatttcgaggtcgttgaaaagactgctacatccgtcactgtgcgctgtggtgactcaccccgcaaccaaccactgcggccatcagacggtcttttccagatcagcgccaccattgacaaggcgcacgaggaggttgagcttcggctcaagagcgtattgttctcgagtgagggcaaggttgccggaaacaagggacctatgcctggctggatgaccgagttgcatcagtggtatgctaggatctgggctgaaactggatcttggagacttctcaagtaaagctcatgacagtgatgagggatgatgatataccatgttgatacgaaggtggactttacaggggatttatgatgactgggcaatgaaaattgccctaccccctcaaaaaaaaaaaaaaaaagggccct

SEQ ID NO: 35735 - DNA, 799 bp, Triticum aestivum
  Clone ID: PAT_TA_35735
gccggccgggctactcaaagtttccagccattccagctccaccacgcggtcaacagagccaacatcacgtccggatcccaaatctcccagagctcgtccagatccatctcgccattccatttcttgcacacggcacacccatggctgttgccggaggagtggcgctgagcctgcgcgtcccgtcgtcttcggcgtcgccggcggtgagggggcgccggcaggcggcggtgaggtgcggggcgacgcgggcgaggccggccgtcccgggcggggggctggaggaggaccactaccggacgctgaggctgaccccgggcgccaccacgggcgatgtcaagagggcattccaccgcctcgcgctgcagtaccacccggacgtcgtgcgggacggccaccaagacgacgacggcgtggacttcgagcggatcaacgcggcataccagagggtgatgagcaacatgcgggaggcggaggcgacgctcgagtactggcgccgccgctacggcctcgccgacgaggacctcgatcgctaccggctctacctcaacgccgaggacgacgaagactggttctcagacctatgaaacgggcgcgatgccttccagcggcacgtaattaatttgtgcaatgtcactctctgcttctctcccccctgttttattgtgaaggggagctagagatgtagaaattcagggctttagcgattgtaattcgaacatgtccatttccattccattccattgtgaatataaatccgtcgtaggaatttatctggaaaaaaaaaaaaaaaagcccctat

SEQ ID NO: 35736 - DNA, 1219 bp, Triticum aestivum
  Clone ID: PAT_TA_35736
cgctcgcggccggccgggccatacaaacaagtcactagtagcctacccacacacatcacatcaaagcgcagcaagcaatggcgtcctcctcctcgtctccactgctcctgctgctgctgctgccgctcctgctcgccatggcgcgtccgtgctccgccgtcgacgccatcggcacctactgcgccaagaacggcaccagcgcggagacgcaggccagcatcgaccaggtcctcgcggcgctcgtcccgcgcgcctcggccgcctactacgccacggccaccgccggccgctcctcgtccgcggtctggggcctcgcgcagtgccgcggcgacgtcccgcgccaggactgctcgctctgcctcgccgccgcggccaaggaggtcgcgtcgtcctgccgcggcagctcggacggccgggtcttctacgactactgcctcctccggtactccacctccaacttcatcggcctcgcggacacggggtacacgctcatcctcctcaacacccagaacgccaccggcgtcgacctggccgcgttcgaccgggcgcaggggaagctcatgtcccgcgtcgcgtcggaggccggcggcgccgccaacaaggggctggcgacggacacgacgcggctaggaaatgacggcggcggagccaagacgaccatctacgggctcgggtggtgcaccagggatatcaccgcggcggactgcgggctgtgcgtggcgcaggcggtggcggagctgcccaactactgccggtaccggcgcgggtgccgtgtgatctacagcagctgcatggcgcgctacgaggtgtaccccttcttctttccgcccgacagcgccggcgactcggccggacggaggtcggcacagtgcgacaagatcgtcttgaactaccccgtgatgggtggagtacagctagtcaagtagagtgctatctacaagcactctagctcgttgtgcgtatctgggtggtgggcgaatccatttgttagtgtatggctggctcgtagctagcataaaattccaaccggggtccaaataattaattctcgtgaagtgcaaaataataagcaaaataatagcctcgtggttgtttgtgtacccgtgtgcttgtgaaaataaatttcgtgcaaactaccgtcatgtaatttccatatttgcaaaactactacccaccaaaagttaattaatttcataaaaaaaaaaaaaaaaaaaactcg

SEQ ID NO: 35737 - DNA, 605 bp, Triticum aestivum
  unsure (1)..(605): unsure at all n locations
  Clone ID: PAT_TA_35737
gtgcggcgctcaggcggcggctccaattcactcccaatctcccgagcaatcctctctccgcgcccacgtagcaaaccctccactcccaatggcccgcacgaagcagacggcgaggaagtccaccggcggcaaggcggcgcggaagcagctggcgaccaaggcagcgcgcaagtccgccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtcttcgagtcaattgcacagaactagatttgcggaaaaccaccaactcgttaatctgttgcaaaaagcaccgtcgttgcaaaaagcactgattgggtgatttgggccgtttaaaaaaaaaaaaaaaagtgggcccagattgtaaggagcttagatggcaaaacgttgacatacacacccctgaaataaataaataaatgcaatcaactccctaatatgcacnaaaaaaaaaaaaaaaaaaaaaaaaaaa

SEQ ID NO: 35738 - DNA, 768 bp, Triticum aestivum
  Clone ID: PAT_TA_35738
gccggccgggtccggaaaaccagtggaggggagggagcaccgtcatccatcagcagaggagagcagagcatggcgccggtgaaggtgttggggtcggcggcgttcacgaacgtggcgcgggtgctggtgtgcctggaggaggtcggcgccgagtacgagatcgtcgacgtcgacttccgttccaaggagcacaagggccccgaccacctcgccagaaacccgttcggccaggtcccggcgttccaggacggggatctcacgctcttccagtcccgcgcgatctcacgctacgtgctccgcaagcacatgaccgacgaggtcaacctgctgagggaaggcgaccccaaggagtcggccctcgtcgacgtctggctggacgtggaggcctcagcttcgaccccgccatgcgctcggtgttctaccagcaccgcgtcgcgccggcgctgggcggggcgcccgacgagaagtcatcggcgagagcgtcgagaagctgaggaaggtgctggacgtgtacgaggcccggctgagcaagcacaggtacctggccggggatttcctgagcctcgtggaccactcccgcttacctgagacgcactacttcatggggagtctgtatgcgctgtggttcgacgcctaccctcgtcctagcgcgtggctcgcggagcatgccgacagattcgacgtcaagaaggtcatcgcgctcatggcaaaaaaaggcctctagacagttcttctgagtaaagggtttcgcctggcaggttacattat

SEQ ID NO: 35739 - DNA, 844 bp, Triticum aestivum
  unsure (1)..(844): unsure at all n locations
  Clone ID: PAT_TA_35739
gccggccgggtcggaaactctcagctcgatcatcatcgtctcctcaaggccctagctagctagctccgctatacagaccaccgagggcgcatggcgctgacgagtcacctcctggtcgtcctcctcggcatcgcagtgccgctgctcttcttctcccgtgcagaggggggccaggtaggcgtgtgctatgggaggatggccactaacctgcctgacccgacgtccgtggtgcaactgctcaagaagaacagcatcaccatggtgaggatctacgacaccgacccgacggtgctgcgctcgctggccaacaccggcatcaaggtcacggtggagctaaccaacgaggagctgccctccgctgccacggaccaaaatttcgctgatcaatgggtgcagaacaatgtcaaggcgtactaccctgccacactgatcaatggcgtgacgatcgggaacgaggtcttcaaagaggctagtcagttgaactctcagctcgtcccggccatgacgaaggtgcaagcggcgctggctcgcctgggcctggcggaccccgtgaaggtgaccacgcccatcgcgttccacgctctcaacatgtcattccccgccgtctgaaggcgcgttccgtgacatatcgctttcttggtgatgacccctaggcgactcttcttgcaagaaaaccgggtccctctcggtgaagatcttcccctaccttgcgtttacggagaacccgggcatgtcaantaactacctcntgttccgccncaataaccnggtgcctgacactgttagcgggcaaacctacttcaccctcttcgananccaagctcggangcaantctaataanng

SEQ ID NO: 35740 - DNA, 847 bp, Triticum aestivum
  Clone ID: PAT_TA_35740
gtgcgacgcctcagattgctcgacacttttccacctcctcatcacccaccggtcctgtctcaaagcaaaagcccgacatggcctccaactacaccgtccgcaaggttgcggctcccaacaccctcgagcaccgagtctacgtcgagaaggatggacagcccgtctctccttttcacgatattcctctctacgccaaccaggagcagaccatcctgaacatggtcgttgagattcctcgatggaccaatgccaagcttgagatctccaaggaggagctcctcaaccccatcaagcaggacatcaagaagggcaagcttcgatacgtccgaaactgcttcccccacaagggttacctctggaactacggtgccttcccccagacctgggaggaccccaacactgtccaccccgagaccaaggccaagggcgacaacgatcctctcgatgtctgcgagattggtgagctcgtcggttaccccggccagatcaagcaggtcaaggtcctcggtgtcatggctctcctcgacgaggaggagactgactggaaggtcattgtcattgatgtcaacgaccctctcgcctccaagctgaacgacgttgaggacgttgagcgacacttgcccggtcttctccgtgccaccaatgagtggttccgcatctacaagattcccgatggcaagcccgagaaccagtttgccttcactggcgagtgcaagaacaaggactacgctcttgacgttgtacgcgagtgcgccgaggcttgggagcgtcttgtcactggcaagaccccccgctggtggtgtttccaccaccaacgtcactgtccagcactctcctactcgcgtca

SEQ ID NO: 35741 - DNA, 739 bp, Triticum aestivum
  unsure (1)..(739): unsure at all n locations
  Clone ID: PAT_TA_35741
gccggccgggctcccagccagaatcgtggtgatcaaacagtcgaaacatcgctatccctcaacttcgatcccgatccttagcgtagcgacagctccgccattctctagacctacggctctttgcgcttatacacatcaaaatgactggtcgcggtggtggcggtggtcgccgtgttctcgttcctcctatcaacttcatcttcaagcttcttcaatcacacgccagggtcagcgtctggctgtacgagcagctctctatccgcatcgagggcaagatcagaggtttcgatgagttcatgaacctggtaatcgacgatgccgtggaggtcaagcaaattaccaagaccaacgacaaggaatcccggagacctctcggtcaaattctgttgaagggagacaacgtgtcgctgatccagagtgccgcaagctgaagacgtggtaacgaaaccgatcgcgtggatttggaaaacagacggacaatgagccagagtggagtggtagcatgaaggtatacccaaaaccgcccaggccgattaatggctgatgaggcacttccaaggtagtcacggcgctcagtatctcttgagttgcacaaagtccgtcacgtcgctgatggggtcgaatgcgtcgaggataaagacttgacctgaccatgtatctttgtgtctgcttttgggagacatttacgaaccaataaatacatgtacgcttcctanaaaaaaaaaaaaaaaggccccta

SEQ ID NO: 35742 - DNA, 780 bp, Triticum aestivum
  Clone ID: PAT_TA_35742
gccggccggtccggatgaaccctgatgcccgtgtcactgaggacaagaagtcgtctgagctcaagtacggtgctgatttcatgaagcaatccgaaaaggttgtttcttctaccaaggccaaggagactgagcaggtcatggaggcccttgctctcaaggttgccaacaagaacagccaggttggtgtcgatgtcgaggacatttctgccgtcaacattgacaacgagacctttgttgagcgaaactttactgccaacgagatctcttactgccgccaggctcccagccctcagagctctttcgctggtcgctggagtgccaaggaggctgtcttcaagtcattgggtgttgccagccaaggtgccggtgccgctatgaaggacattgaaattgttaagggcgagaacggcgctcccactgtttctctccatggtgacgctgccgctgctgctcaaaaggctggtgtcaaggacatcaccctgtccatctcacactctgatagccaggctatcgccgtggctgttgccaacttttagatgcatacaataagtagaaggaggaggatttgtacatgtttgctttgtacttggtaatgggcgtttgatgaagatgtatttcgatatgatgccttgcgcttgatgatatatgccgatggccatggtcgatcgtactgggcccatgttgctgatagaactcgatgtgaattacaccgaggaacgttttacgcataaaatagacaattccgttaaatttgaaaaaaaaaaaaaaaaaaggccccta

SEQ ID NO: 35743 - DNA, 859 bp, Triticum aestivum
  Clone ID: PAT_TA_35743
gccggccgccggccgacgataaatcggttctactcctcgtatctcttctgaatcatcaatcgcctacctatctcttcacttgtcgacataccaaactagcgaactttcctcttacacctgcctacctaccagatcaacttcgcaaccagttaaatactgtccactgcctatccgccctctctgagaatacgaattggcactgtaacatcgcctttatcaacccaagtcctgcttcaagaagtgtctcgtttttcatcatctcccactgcgagggcaagcgacctttgactgaacttgaagcaacaacatctcgtcttaagcatcccatacatatcctcaattaccgcactcgcaaatcgcctcgcgctaactacaccctctccatcctgcaaaatgacccgatctcacaaggccaacgaccgtgaccacaagggcatcgccgaggggactatgctccctacggaagctgtccctcgcttctttggtaagagcggctttgccgacgtcgaccccaagaaggtgaagaaggacggctctggtcgaggcaactggggaactgtcaacgatgacatcgctggcgagcagttcacctttaccaatacccgccgccgctccaacagtagcagcttctctcatgttaccgatttcaagactaagtttgaggtcaatgagcccgaacccgtcttcgaggagtcacttcacggccctgaagaggaagaccatgaagacctcaccaagaccgactcttccgagagtggtcgatcttcttcttgatcgatctactgtatctttactgagggatcgcattcactgctggtcgctctgtatagtggcagcggcacattgagggggatggcat

SEQ ID NO: 35744 - DNA, 870 bp, Triticum aestivum
  Clone ID: PAT_TA_35744
gccggccgggctccgcctaccgggctcgacagcaatccaccagtaccttcagcttcatttcaagatgctcttctctcatctatcggagttgtggctcttgccacattgaccactgctgccccggagcgaaagactctcgcaacccgtgaagttggaagactcccagctttgggatggaacggctggaaccaaggacaatgcaatgcagccagcgagaaggttgctttggccacggccaagaccttcatcgatctgggcctcaaggacgccggataccaatacatcaacattgacgattgctggtctacgagacagcgtgactcaaagggcaaccttgtacccgaccccagcaagtggccaagaggtatcaagcccgtcgtcgatgagatccataaaatgggcctgaagtttggtctctacggtgacagaggtgtcaagacttgtgccggatttcccggaagtcagggtcatgagaagcaagatgccgacttgcttgccagctggggtgtcgactactggaagtacgacaactgttacacgccatgctacaacggcaaccaagccgacatccagacatgccccatcggcaagggtcctagctccagacccggttacgaattgatgagagacatgctccgcaacacaggaaaggacatcctctactccctctgcaactggggctgggatgaggtctggacttggggtgcttccgtcggccacatgtggcgtatgagtgttgataactggggtaaatgggacgatgttgtgcgaattgccaaccaggctgcacctatcctcagtacacccagcctggtcgttacaacgatctcgacatgatgattcttgccaatggtgctctgacaccagctg

SEQ ID NO: 35745 - DNA, 740 bp, Triticum aestivum
  unsure (1)..(740): unsure at all n locations
  Clone ID: PAT_TA_35745
ctctgtgcatcttgtctcgtatcatgcctatccaccaaggacttctcccacgcgaaggcttctgtgccgacgtggtggtgcggttgatccggcaaacagcgttgaatccagccttgatcctccctctcgtgctgcttgctcgcctcaccaagaagggccaggacctctcgatccttcatccaagcgccgcgcagaacctcaagacactattgtaccttgggctcgcgcgatgggctagtggctggttatccgaaaagacgagaaacaactggtcagacgataaatatgactgggagcgcgagattgtactcgtgacgggtggcgcaggaggcattggcggccgagttgtcaacttgttctccgagatgggcgttaaagtggttgtgcttgatgttcagcccatgtcctttaccacttcggccaacgtacactactatcaatgcgaccttcgagcacccgaaaacgtggaagccgttgccgaaaagatcagagctgaagtcggacacccgactgtcgttatcaacatcgctggagtagcaagaggaaagactatcctggaatctcagccaagtgacatccgctttactttcgatgtcaacgcctttgcgccattttggacagcaaagacatttctccctaacatggtcgagaaaaccacggaatgatcgttactctaacctcatatgcgagcntggctgacgatccctaanctggtcgactacggcgcctcccaagcagct

SEQ ID NO: 35746 - DNA, 886 bp, Triticum aestivum
  Clone ID: PAT_TA_35746
gccggcggccgggggccggcttccattctcactcacgcaacaatcaacacttcttccttattataattccttccgacttccgaaccactttcgaccacacatatacatttccaagccacattacaaacttcaaaatggatgactgggataccgcaaccaagatcggcagccgcgctcgtggccctggcaatgctcagcgagagaccgttgtccgaggaaaggctgctctcaacgctgcccaacgggctggaggtctcactaccgagaagaagtactcttccgccaacgccggttccgcacctgagggtcagcgtatgaccaaggttgaccgttccgacgacatcatcaagcccaacaccatcggcaagactgttggcgacgtcatcgcaaagacccgacagcagattgagcccaagatgacccagaaggacctcgctacccgctgcaacaccacccaggctgtcgtcgctgaattcgagcgaggtagcgctgcacctgaccaaaaggtgctcggtgctatggagcgcgtgctcaatgtcaagctccgaggcactgacattggtgctcccaagttccctaacaagaagaaatgatcaattcatgcctgtttagagggaaagatctgtaacaaggcttcagagccgagtcgagcgttagcgaatgatgatatcttggctgggaaatacgggagtttcgtgtgggccgtcacgatgcgtttatgacaatgggtacatgagcttctaccgtttttttatgatggggcttcaggattcacggcgatagaaagaatggactcctcagatatgggtgttctggtttcttaactcatgagcgaggcaaataagccggctcaccgaataaatatcctcatgcatcatgtaaaaac

SEQ ID NO: 35747 - DNA, 835 bp, Triticum aestivum
  unsure (1)..(835): unsure at all n locations
  Clone ID: PAT_TA_35747
ngatttcgccgaccctaaaaataactgcgacttcaaactcccgcaaaccaccaaacacaacccgccgtcaaagaccgatataccgaccgacatcatgcctcctaagaagtgggatgaagaggagagcgaagacagctcctcctctgctgctcctgccgttggtgccgccgccaatgctgctcgccgcaagttcgacgatgaagaagatgaaggagatgtcctagattcgtgggatgccgatgactccgaggccgagcgtgaaaaggagcgcaaggctaccgaggccaagcagaaggctgctgccgccgccgcagctgccaagaagcccaagggtctgcgaatcgcccagcaccaagccgagcgtgctcagcagaaggctgaagctgaggaatccgatgaatacgaggagaccgagggcgagaagcgtgagcgactccgacgcaccgagcaggaggccgatctcgcacacgctgccgatatgtttggagatattggaatcagtgccaaccgttccaaggctcgtcccgctaccgtcgttgtcgacgccaatgatcccaccaagaccgtcgacatctccaagctacctctcttccagccaaagacaaagctccagttcgagaccctccgaacaagtatcgcccctctcatctcagccaacgcaaagagcgcccactactctttgttcctccaagacttcaccaaggcccttgccaaggatatgaacagcgaacagatcaagaaactcgctagcagcatgactgctttgggtaacgaaaagatgagggaggagaaggctgccgacagggcggcaagaaagtcaaggctgccaagacca

SEQ ID NO: 35748 - DNA, 640 bp, Triticum aestivum
  unsure (1)..(640): unsure at all n locations
  Clone ID: PAT_TA_35748
cggccggccagcctccggaggtcgccatggacgggtcctacacgctcatggttcgcagcttctcccagctctgcgcggcgcttcgtgccgaaggggacggtatctactccaggcacttcgccataggggggagcagatggtacctcaaattctgccccaaataccatggacggtccttcttgtgcctcggccgcggccgcatggccaagggtgagatgccgatgacagtggagttcagcttcgacctcaaaggggtggtgaaccaccagtcccagaagatgacgcacacgttcgaccgtgacaacgatgacttcttctacgatctagagcaaattagaagaacgtcgcccatgcaggacgacagcctccttgttcggtgctgcctcaccgttgtcatgccggaggagactcccatcgccgtcccagtgtgcagcagcgaatcagtgctcactcctctactcagcgccatgcatggctagctagtttgggctacagaggacagacccacacaaaattgtcgaaacggaaaactggttgtttcagcggatcaatctctttgttctgcaaattttgatatattatatgtatttttctgaaaaaaaaaaaaaaaaaatgagcctatgccaaatnccaacaactt

SEQ ID NO: 35749 - DNA, 858 bp, Triticum aestivum
  Clone ID: PAT_TA_35749
gccggccggtccgggatctacctcttggtctcactcttgagcaactcattcaacatatcgaatctgtcataaacagtcctccaaccagacatcgactataaaccccttcgatatacatcccaaatgcagctgaacactatgtcccaccttcctcacgagcccgagttcgagcaggcttacggcgagcttgcctctgccctcgagaacagctccctcttcaacgagcaccccgagtaccgcactgctctggctgttgccgccattcctgagcgtgtcatccagttccgcatcgtctgggaagatgacaagggcaacctccaggtcaaccgtggttaccgagtccaattcaactctgctctcggtccctacaagggcggtcttcgattccaccccagcgtcaacctgtccatcctcaagttccttggtttcgagcagatcttcaagaatgctctgactggcctcagcatgggtggtggcaagggtggtgccgacttcgaccccaagggcaagtctgatgctgagatccgaagattttgccagtctttcatgactgagctgtccaagcacattggtgccgagactgatgttcccgctggtgatattggtgttggtggccgtgagatcggctacctctttggtgcttaccgcaagcttcgcaaccgcctgggagggtgtccttactggtaagggtctcttttggggtggcagcttgatccgacctgaggccacccggttacggtcttgtctactacgttgattacatgcttaagcacgccaaccgcggcagcttcgagggtaagcgcgttgctctgtctggttccgggcacgttgcccagtacgctgccctcagatcatcga

SEQ ID NO: 35750 - DNA, 687 bp, Triticum aestivum
  Clone ID: PAT_TA_35750
ctgtttatgtcttctgaagtgttcagctgatgcaagttaggcagttctgcatattcatgccctatgcatgaccaaactgacttgtcatgcttttttcttgaaaaatacatacatactagtggatagtaggttttacttgttcatcttagatcatagtagaaagccatagcggatggactgacttgtttttgtttggattgagcagaccaagaacagcccgctgagcgtgaaggccttgaagcgcaccctggccatgcgaaacacggcatgaactcgtcgggagacggcggtgtctaaggtggagtagaaggatgcggctgctggagcttttctccctccgtgcacccaacaagcctttgtgcaaaatttgaaccagacattgcttttgtagaattatcgttgcttagtattacgattctctagcagttctgctcgctttatatatcccctacttctacatgtactcattgtacatagctcgcccccatttgtactcgtatactatcttaaagaatattcgtcaaaaaaaaaaaaaaaaaaaaaaaaaaaaaaaaaaaaaaaaaaaaaaaaaaaaaaaaaaaaaaaaaaaaaaaaaatgtaaaaaaaaaaaaaaagtgaaaaaaaaaaaaatcggaccgctcaaggggttcaagttttatttacggcgtacaggcaacttcaaacctc

SEQ ID NO: 35751 - DNA, 828 bp, Triticum aestivum
  Clone ID: PAT_TA_35751
cggacgcgtggggcgggagcagtggctgcaatggtgggcttatggatgacgcctttgagttcatcataaagaacggtggcattgatactgaagatgactacccttacaaagccgtggacggcagatgtgatgtcctcaggaaaaatgcgaaggtggtgagcattgatggctttgaagatgtccctgaaaatgatgagaaatcgttgcagaaggcggttgctcaccagcccgtgagtgttgccattgaagctggaggccgggagttccagctcttccatccgggtgtcttcagtggaaggtgtggcacgcaactcgaccacggtgtggttgctgttggctatggcaccgagaatggcaaggactactggattgtccgcaactcatggggtccaaactggggagaggctgggtacctccgcatggagcgcaacatcaacgtgaccagtgggaagtgcgggatagccatgatgtcatcataccccaccaagaagggcgctaaccctcccaagccagccccaacacctccctcaccgccgacgccgcctcccccagtcgcccctgaccacgtttgcgacgagaacttctcatgccctgcaggcagcacctgctgctgttcgtttggcttcaggaacctttgcctggtgtggggctgctgcccggctgaaggggccacctgctgcaaggatcattccagctgctgcccaccggactaccccgtctgcaacatcagggctgggacttgctcagcggtaacgacttctgctttcttagtttattattgttgctgcagcattgcgataataatatctacatctgttttctgtttat

SEQ ID NO: 35752 - DNA, 1790 bp, Triticum aestivum
  Clone ID: PAT_TA_35752
gccggcgtcgccccggcccgtgagtagtgccattgaagctggaggccgggagttccagctctaccactcgggtgtcttcagtggaaggtgtggcacgcaactcgaccacggtgtggttgctgttggctacggcaccgaaaacggcaaggactactggatcgtccgcaactcatggggtccaaactggggagaggctgggtacctccgcatggagcgcaacatcaacgtgaccagtgggaagtgcgggatagccatgatgtcatcgtaccccaccaagaagggcgccaacccgcccaagccagccccgacacctccctcaccgccgacgccgcctcccccagtcgcccctgaccacgtctgcgacgagaacttctcatgccctgcaggcagcacgtgctgctgctcgttcggcttcaggaagtcttcgcctggtgtggggctgctgcccggctgaaggcgccacctgctgcaaggatcactccagagaatggccacggcaccaccccgtctgcaatgtcagggctgcgaaattcgcagggatctagatccgcccgctgagcgtgaaagctcaaagtgacaagtgggaagtgcgagatagccattatgtcagcggacccccagaggaagggccctaacccgcgggagcaggccccgcaaccgcggtcttctccgtcgccccttccccctctcccccctgaccgcggctgtggagactgatgctcacgccctgtagaaagcccctgccgccgcatgtgcggtctccgggaactttgcgtggtgtgtggccgctgctcggcctaaggctcaacctgcagctggtgacactccatcgcctgccccccttactaccccgtctgcaacatcagggctgggaacttgctcagcgaccaagaacagcccgctgagcgtgaaggccttgaagcgcaccctggccatgcggaacacggcatgaactcgtcgggagacggcggtgtctaaggtggagtagaaggatgcggctgctggagcttttctccctccgtgcacccaacaagcctttgtgcaaaatttgaaccagacattgcttttgtagaattatcgttgcttagtattacgattctctagcagttctgctcgctttatatatcccctacttctacatgtactcattgtacatagctcgcccccatttgtactcgtatactatcttaaagaatattcgtcaaagctaatcatgccctgcaggcagcacctgctgctgttcgtttggcttcaggaacctttgcctggtgtggggctgctgcccggctgaaggggccacctgctgcaaggatcattccagctgctgcccaccggactaccccgtctgcaacatcagggctgggacttgctcagcgaccaagaacagcccgctgagcgtgaaggccttgaagcgcaccctggccatgcgaaacacggcatgaactcgtcgggagacagcggtgtctaaggtggagtagaaggatgcggctgctggagcttttctccctccgtgcacccaagaagcctttgtgcaaaatttgaaccagacattgcttttgtagaattgttgttgcttagtattacgattctagcagtaccgctcgctttatatatcccctacttctacatgtactcaattgtacatagctcgcccccatttgtactcgtactatcttaaagaatattcgtcagagctaattggtgatcatcgtgtacatgctgtttgatgcttatatgtggatgcaacagcacggttcgagctcccactgcacaaaaaaaaaacaacatat

SEQ ID NO: 35753 - DNA, 866 bp, Triticum aestivum
  Clone ID: PAT_TA_35753
gccgcttcgagccggccgggcccggaccactcactctcatcctctcaacacactacaactcgtacttttacaaacaactctttaattctttaattaaaccaccaacaacaaccgccatcatgcagttcaagaacatcatcctcactcctctcgttgctgctggcatcgcctctgccgctcccaaccccgacatcaagattttccaagctgttgctctccgatctgcgagccccattcaccataccaaccttcaggcttccaacaacggcttttccctgaagctcaaggaccagggcgcctcttgcgaccgtggtgagaaggtcgactccgctacctttgccctcaataccaaaacaaaggagatgctcctttacgccacatcttttccacgtcaaagcgcgtggaccgatagaagtggcatgggccagggcatgatgggataccgtaccggcgctcagcctctctgcacccgctgcgaggacaacaagtggtccatctctgaggacaacttcctcaagtacgatgaccgtgacaacttcatcgcctgccctcagaccgatggctcttacaccgtctttaccagcgctggtgtcaacaaccctgctggtaacaaggactgtgtctctgtcacctttgccgtcagcgaggtcagcaagcccgtcggctgcctctactcccagcagggccagtaaattctgagctctgatgttccaaagggatctgtctagactgccttctacctaccttcttggctgagatctttcgatcttgttataacgattcacaatgcatatattagcgtctccgtttggttcttagaaccttgatctagagtacatatacaatttacaactgcatcattatgc

SEQ ID NO: 35754 - DNA, 869 bp, Triticum aestivum
  unsure (1)..(869): unsure at all n locations
  Clone ID: PAT_TA_35754
ggccgctcagccggcgggcgggtttcgccggttacttcgacatcttcgccttaagcaaccgacccgttatccaacgacttcatctcccgacaattcagctcgcctgtcgtttcacgaacacttcgtcttctccaacacgacctttttcgattaacacctactccgttttcgcgtaacaacagtcaagatggtcagcgaactttgccccgtttactcgcccttcttcggtgccatgggctgcacctgcgccattgtcttcacctgtctcggtgcctcttacggtaccgccaagtctggtgttggtatcgccgctatgggtgtcctccgccctgacttgatcgtcaagaacattgttcccgtcattatggctggtatcattggtatctacggtctcgtcgtctcagtccttatctccgatggtctcaagcaggacttgcccctgttcactagcttcatccaattcggtgctggtctttccgttggtccgcaggtctcgctgccggtttcgccattggtattgtcggtgatgctggtgtccgaggaactgcccaacagccccgtctcttcgtcggaatgattctgattctcattttcgccgaagtcctcggtctctatggtcttattgttgctctgctcatgaactccaaggccaccgtcgacgctgtctgctaaacggccaacacgacacggcctgctcggaacccagcttgacaataacctactcaaacacacgagcggttctgagccatggcacaaatcaataagatcatatatggcgttacgaatttccctgcttcttcatccagacatggattcaaagcagggaattggagacgtgngcgcatggtcaggntcgaccttgcatctgc

SEQ ID NO: 35755 - DNA, 558 bp, Triticum aestivum
  Clone ID: PAT_TA_35755
gccggccgggccgggatggtgcggctcgtggcctctgatagccaccttttatagtcatcccttttctatttgtttctttttgcgctgtaactctgggtgtgaaatcaaacaaaatgtcggcgcaagttatctccaactccggtcatgaggacatgattcatgatgctgtcctcgactactacggccgcaagctagctacatgctctggcgacaagacgatcaagatcttcgagattgagggcgagacccagcgattggtcgagaccctcaagggacacgagggtgctgtctggagtgtcgcctgcgtgcatcccaagtacggcaacatcctggcatcggctggttacgatggaaaggtctttatctggaacgagcacggtggacagagcaacgcacggcagcgaatctacgactttcccctacacaaggcctcagtcaacattcgtctcttgatctccccacgatgatgtctgcctgctagcatgcgcctcttccgacggcaacgttagagttctcgagctcaaggacaacagcatcgaccacagcaccgttgccgct

SEQ ID NO: 35756 - DNA, 837 bp, Triticum aestivum
  unsure (1)..(837): unsure at all n locations
  Clone ID: PAT_TA_35756
gccggccgggtcggggcatttaaaaacctcggctgtttctctccatgttttcttaacttcttcaaaactgtatactgcccttagtttgattatactcatcaatctcaactcataccatctaaccagtaaccatgtctctcaagaacgacaagtttcccgcctcggccgccttcgacgccatccaagaggctatcaacgccagcgatgccgatcgcaaggacgccatcaagcagggcaacggtgtttacgccttcaccctcaagaacgcgagcggcgacgtggccagctggcatatcgacctcaaggagaccggaaaggttgccactggcactggcgaaaagcccgacgtcaccctcgtcctctctgaagagaactttggcaagctcgtcgctggcaaggccaatgcccagcgtctcttcatgggtggcaagctcaagattaagggcaacgtcatgaaggcgaccaagctcgaccctgtgctgaagaaggcccagaccaaggccaagctgtagttgaagcgtgtttttttatatgcctttttggatagcattgtacattgttttgttgtttctttctgtatgatatccacttgctggttgtcaatcgctccatgcttcctggatgcgaatgcatataggagtacacgcgtcaatatcaattttgatacattttcgacaatgaaaaaaaaaaaagatctatcacagtcctcagtggggacatgagtggncgtgtcttgactatcaatctctggattatatgtggacctacgnctttgccagcatagcacaagtttagcaagtcactattgtcgaaaaaaaaaaaaaaaggcccctaggg

SEQ ID NO: 35757 - DNA, 859 bp, Triticum aestivum
  Clone ID: PAT_TA_35757
gccggccgcgatccgcccgggagcgggcgctccgggccgtccgtcagtcgcccggctacaacgccaaaaccaaagaacagccgcccgcttgcagcctgaggcgggcgccagagctggcgataccgatccggtgcgcctcccccgatccttcctcccactgcgcgccaatactcaccaagcctagcccccaatcgccgcctcaacgcgtcaaatcgaagcctcaacgcctcccaaccacccataaaccagtccatccgccggcctcgaattcccggcggcgtcaaactcagcaagctggtgggcgtcgacgccccggcttttccagccgacgccgctgccggtctcagcgtcgaagcttcgtctggtcacgccggtgccgcatcccgtcctgcgacggcctcatcccgctaggggtctcctttgcaacggatatgtttgctcaggaggctgcagcaacgagtgtagcaggtacttagggccaaggccgttgctgagctcctcctgctacatctgcttggctacacgactgagaatattgacgactccgatccgcaagcacaatatacatcatggtttaaacagttaatcagtatctgatgcttgtagctaaactagagtccctacttatctcaactctgaaaaatcagatgcttttgaggcgtcttttctctgtacggtgtggagctgctgtgctttgaatcatatatgctccatatatgacatttttttaaccctgaatttgaatcatatatggctccatatgtgacatgctctgtaatctgtatgattgtgaagttgctgtgctttgttgcatctttcgctccgtcgatgccatgcttttttaggctgaatttctatc

SEQ ID NO: 35758 - DNA, 1380 bp, Triticum aestivum
  unsure (1)..(1380): unsure at all n locations
  Clone ID: PAT_TA_35758
nntccgttatgttctgttggaatttgtcacatttcttttgtgaaagaatgtgccattgtctaatatatttgtcaaacaaaaaaatagttgcatatactagactggatggtttgagaaactacgggcactatcaagagtgtgttataggaaatttgtttaattacatatatcatatatgttctgctcttaagagattagtttagttacatgtatattctgctttgtggtgtcacccctacatctattcatgcataatgaatttggtggtgtcattctttatattgcaacaggttaaacaatcttgtgattgtaatatttttttggtgttgccataaaattagaaacatttattgaaattgttcggtaatgcagttttatgatatcgagtgccttagcctttggttggatatagagtttgaaaacaatatctaggttggagcacactatgctacatcaaaaaggacctacatagctaatcgtgtatgcttgctgagaggtgaacttagcaaaattgaggatgtcagcttttacattttgtcatgcttggcttagataagatgtatccatccttttttgtgtttgtacctgcccggccggccgctcggaggattttgcgcgagccttgcactgtcgttgccgcaggctgctttggctttgtttccttggtgctcgcggggcttgctcccccgggaccggcccgtccttcggccactgcgtctcgtcgaggcgggggggcgtcgaccgtcacgcacaaaattggagattgcgatgtcgaccttcctattgacgatcttataattcatctgctaactgacatattttagccatataatttctggtgactggaagtctaaaactgaagatagggcagattgttttgattatgattacttggagatctcgtggcttgctgtccatggatcagtcagacctacggcaacatcaactcattgattctagaggccatggttctcgaggtgaactctgaatctctgatgcaattgcagtggaggctagagcctgccaagtgatgcagaagatgaaaccatatagtgcaactgacttttcagattatttatttcctcctgtaaaacttctttctcatccatgtaatccctgcacatctcaaatccccgtccgccttaaccttgattttggcacatacgacttcaggatagttgtcatatttcttttaggggatctgcacctcaaggaaattagagaatgctgatttaaaaacaaagtatatgtaagctacgtggcagcctgggagagtcattgcccgcgtttgcgttgctctgcatggtctgcggctttgtccctttctgtctgccgcccctttattagtgggactggtgagtaatgtaaaatccccatttt

SEQ ID NO: 35759 - DNA, 855 bp, Triticum aestivum
  Clone ID: PAT_TA_35759
gccggccggtactggaccactctttttttgttctttctgtcgcggttgttcgtggtaatacaaacaagagctcttccttttttgagataattcaatccaagcccatttgagacgattatcgactcctagaagacatggccgacatcacagatcagcacgaccagacctctcccaccgagctcgatgagcagaacgttggcaatggtaacgccacagagtctcgcggtatcaagcgtcagcgtccttcagctggcgacgacgacgacgacgatgacgagaagggcagccgtgagcgtcgcaagattgaaatcaagttcatcagcgacaagtctcgccgacatatcacattctccaagcgcaaggctggaatcatgaagaaggcgtacgagctttctgtcctcacaggcactcaggtgctacttcttgtcgtgtccgaaactggtctcgtctatacctttaccacacctaagctccagcctcttgtgaccaagtctgaaggcaagaacttgattcaggcatgtctcaacgcacccgagcccaccccaggcaacgagaacggcgttgatggtggcgaccaagtcgagtctcccgaagagcctcctaaccaacatctccctcctcagggcaaccggcctggtatgccccagaaccctcacatgccacccaacaactatatgcccaacatgcccatggatccccagcaagctttggcttaccaaagctacgtacaacgaaatcaggcttacggctcaggtatacctcctcagccaggtatgcccgccaatagccatcaccagtcgtaatgacgcccgactctaaggtgggtctttggtcactgatacccggcgctcaatg

SEQ ID NO: 35760 - DNA, 843 bp, Triticum aestivum
  Clone ID: PAT_TA_35760
gccggccgggctgggaaattgcttctcttcatcctctctccgttcttgagtgttgtcagccatcgccgccgggaaacggggatcagtttgttgttgggacttgagacgggaaggatgtcttcatcgcctccggcgccgacggtggcggacgcggcggcggcgggcgcgccggcgtcgcagctggccatcagcaacggggtgctgctggcggcggtgatattcctcttcatggtcgtcgtcttcgtcttcctcctctacctctacgccaagcgcttcctgggggccaaccccatgctcaacggcgccggcgccacctcctcgcgcttcatcttcgtcggcgaccccccgttcccgcgccgcggcctgccggcctccgtgctccggaccctccccgtggccgtctacggcggcggcgcctcgcccaagacgcccggcggcagcgggaggaggaagaacggcgaggcgctcgagtgcgccgtgtgcctctcggaggtggccgacggcgagaaggtgcggacgctgcccaagtgcggccaccgcttccacgtcgactgcatcgacatgtggttccactcccacgacacctgcccgctctgccgcgcccccgtcggcgccgacgccgagcccgccgccgaggggctcccccgcgtgccgcgcgaggaccacgccacgccggagttccccatgttccccaccaacgtcctgttctggggcacccacgacgacgtcgccaacggcgggctcggggggatgccgccggcgccagccccggggcccacgatcgccgccgcctcaccagttcctcggcctcgggcgcaggaaggagacctggtgatcgacatc

SEQ ID NO: 35761 - DNA, 698 bp, Triticum aestivum
  Clone ID: PAT_TA_35761
aatacttttctcaccaaccaaaacacaaaatccaaacctcacacaacctctatcaaaatggccgccccttctgccgtcgtggacatcaagtccaaggctcagttcgacgagctcgtcaagaacaccccctacgtcgccctccaggctcacgcctcgtggtgcggtccttgcaaggccatctcccccatcttcaagaagcaggccgacgagcacacctcggaaaagttcgctttcgccaagttcgacaccgatgatgtccccgacctcgccttcgagcttggtatccgatccatccccgccttcttcttcttcgagaacggcgacaaggacagtgacctgatgggtgccgtccctcccaagctgaccaaggccatctccggctacgctgagaaggccaagggtggtgctgaggagaagcccgctgaggacaacacccttaagaccgacgaggccttctaaacgagcacttttctcacaaagaacaaaaatattacaaagcaacggctctagaagcgcaggttcgcaaggatacccctagaaacgaggcgcaccagacggacgacatacaccataattctacaaaccatcatgggttacaactacggcttaaagtacagattttgagtagggtggcccgcgccggttagctaagaatagatcaaattttacttcaaaaaaaaaaaaaaaaaaggccccta

SEQ ID NO: 35762 - DNA, 663 bp, Triticum aestivum
  Clone ID: PAT_TA_35762
gccggccgggctgggtgttcttctgccttgaccgactactacaagcgtggtcagtacatccctggtctcaaggtcaacggtatgggtgtcctcgccgtcaaggctgccgtcaagtacggtaaggagtacaccgctgccgacaagggtcctctcgtccttgagtacgtcacataccgatacggtggtcactccatgtccgaccccggtaccacctaccgaacccgtgaggagattcagcgcatgcgctccaccaacgaccctattgccggactcaagcagaagattctggactgggagatcacaactgaggaggagcttaagaagattgacaaggaagcccgcgcccacgtcaacgaggaggtcgctgctgctgaggccatggctgcgcctgaggccaagcccgagattctgttcgaggatatctacgtccgaggatccgagcccgagtacatccgtggacgtattcctgaggagaaccactacttccagtagaggggtcgagagcgaaatcgtatcaccataatgattctagcacttgttgcttgctgtaatatacatccatgatctatctagaaaaaaaaaaaaaaaaaaaggcccctagagaagggcgaggacccaggattgctttttttacgtgcaaaaaaaaaaaaaaaaaggccccta

SEQ ID NO: 35763 - DNA, 988 bp, Triticum aestivum
  unsure (1)..(988): unsure at all n locations
  Clone ID: PAT_TA_35763
gcacgcggcgccggccgcggcggcagattctcccttgcatgcaaacaatgcgacgcccctcttcgagctcgacaacacagcccatgactccacgaccatcccagacactgcggatggctctgtgcctcgtcctcccctacctggcgcaccaccagcgaccgcacgccgatgggccttgactagcatagtcggctgtggctctcgcactttcgttggatgctgggagcaccttaggggcgcgacggcgctgcaagccacctacctctcccctgtctctgctacaagaagccagcgactgaggacggcgacctccttgatcctgcttatctcgctgtccccaaacaatatgcgtgcctcgaacgtcatttcctatacgaggttccgacaccctgtggtgttgttaccgtcagatacattctctggtatttgatttaaattacagggtcttgcaattcatggtgtcgacgcagattttctaccctatgatgatgatggggactttgatgaggcaattgatcttgatgatgatgacgatgagccaaatcctgacgaattccagtctcatgatgcacttagtggctggtcttctcgtaccaagggtgttgcaagatatctcaagactttattcgatgaagagtctggtcgggggagaaagaatgttgtcattgatcatctggtaaatggaaagtctcggaaagaagcctcaaggatgttcttcgagaccttggtcctttcgacgaaggactacattcaggtggagcaaccaattccctttggtttaataaacgtgaagccagtatccaagctcctgaagacagatttctagaccaagaccaaggccgcctagcaaaagtggcatgatatacatacatcttacaatatctgtcacagcaccaacaacaacatacatattgtcttcttcatcttcgccatcgntgtcgtgacttgnccgctgntgnttntgcgctgctactgaagttcagcttga

SEQ ID NO: 35764 - DNA, 722 bp, Triticum aestivum
  Clone ID: PAT_TA_35764
gccggccgggtcgtcgcacagaacagacgaagcaaacccaacgaaacgagcgacgatgcggcgcgaggggcggcagcgagggtgggtgcgcgtctacgaccgcgccctggtggacccggagggcaagcgccgcgccgtgcacgttgtcgacggccccgtggtggccaacggcggctacatcagggcgtcccggaagccgaccaaccagtccaagtccggcggcctccgcgccctcggcagggacgccctcacgctagaggaggacgaggagccgcagccccttccgcccgaggacaagcgcttcggctactactactccaaggggtggcagtcgccgttcaagtacgaggccacctcagggcagtcgtggaactggaagtacgatgccgccgagcacgagcaggtgcacgctcgtcagccgctggcggcgcatctcggggggagatcggcgtgcaaggggagccgcaagttcaagcacgacgagatcaagacgtactatctcgacgcggccgacgtagtcgatgagcagctcgattctctctgctgtgatttcgattcatgagcgcacggaacggggcgcattgcggccatgaaaacaagaagatattttgtttccttttacttctgttttgcaaattttcggcaaagaggagttgtagtattactggatccatgggccgatgtgtatctttgtcacgttaattatgagtatatatatgtcc

SEQ ID NO: 35765 - DNA, 1221 bp, Triticum aestivum
  unsure (1)..(1221): unsure at all n locations
  Clone ID: PAT_TA_35765
cgctggctttgcccctgctgtgccgcccgctttgccgcggcggctccgaccgggggcgcccggcgggacgggcgtggggccgccggcgccagctccggctcgccccgggctccagctccagctcgaccccctccttcccggcccccgagctcaagcctagagcaaagcttacttatgtccgcacttggggccgcctatggagtctgccactgccgagccccgggagagccacctggcgtgcggcctggcctgtggctcagtcaagtgatcgcagtcaaaagaaaggggaatatccaatgtttccttacggtcctgtcgggcttctcttgccacaatatctggggcagatctggtttcaagaagaaagaaggactaggttccaatggttcaaaggcggaagccaccatctctcatggcccgacggtgccagatctcagtatacagctctatgcagaacgcatcttcaagtatgctgagtgcagtccatcctgctttgtgttggcacttgtctacatggagagatatctacagcagccaaatgtgtacatgacgcccttcagcgttcatcgcttgctgattacaagtgtggtggttgctgccaaattcacagatgacgcgtttttcaacaatgcattctacgctagagtgggaggaatccgcacaatcgagatgaatcggcttgaactggatttgttatttaatctggacttcaggctgaaagtgaacctagagacgtttgggagctactgcttgcaactggagaaacatgcaccggtgtcaccagagagactgccggttcaggttcatcgtgtcaatggatctaaagatttgagctatagcaacagcagcgccgacgagttttgccagagcaagcttgtaagctacagcagccaggcttctccaaggatgcagctgaccaatctatttatggcctaaagttttgcaaagcatgtgacctgcattactgataattcttttagatctgacatttgtgcattcagattgcattaagttgttctgtgggtgcttgtgttggaggcttgcgtctcggcttgtcttgtgcatcgctgggggtcttgcaaaccactttgtttaaaatgttcacaatctagttgggaaacaccaggtctgaatattattcagtcctgtgattccaatgccgcggttttaccggatctgctgccaagtaacctgtcggcaaganaatcgggcttttccaag

SEQ ID NO: 35766 - DNA, 789 bp, Triticum aestivum
  Clone ID: PAT_TA_35766
gcgaccggcaaaaaagggacttgtgcctcatcaagccaactgctcctgattcctgaagcggtaaaaagagcgagctttgggattggcagcaatggcgacgaaaccactagttggctctccgctctcggcctctcctgctgctcaaagcacccctgaccctggctttccaaccggtgttgctgctcaaggcacccccacccctggcccttccagtggtggtggtggtaccggtgctgctgctccagtccccgacggtggccctaaaagtggcagcgggaatccaattgggtcacctcccgtgtttcacggataagttcttgttctgcttcggatctccgaccttgtcttgtgcaagtttcaaactgtaatatgtttgttcccagttcggtcgagggttcgaccgccctcttgttcgttaagcatgtagtttgaatgtttgataaccacaaccttagttcttataactgatgttgttttaagtatggatatatggcttgaatagtgaatacacacatctgatcaatagtatctatgggtctaaagcagtgtaattcagatgccatcgatctgtgacattattcaagttgtatgtcgaggttaaacatgagatgcgtgtagcaagatcaaacacagaatatatgttgaggtgaagcagtgtaattcagatgccatcgatctgtgacattattcaagttgtatgtcgaggttaaacatgagatgcgtgtggcaaggtcaaacacagatatatgttgaggtgaaatgaagacctatgtgttgccaaaaaaaaaa

SEQ ID NO: 35767 - DNA, 754 bp, Triticum aestivum
  Clone ID: PAT_TA_35767
tcgttgattacctccgtgggcagatcggcacttattttgcggaaaagcttctcacaattgtgagcgatatacttctccatttcaaaggaaaaggcaagtctgaatcagtcggaccttcaaatagtgaacttgatgctcacttacataaaggcgatgctgcattggagttcattaaacatatatgtgctgttcttgctctcgatcagaatgttcagcatgatattctgagaatgcgaaagaacttgttaaagttggtccgtgtaaaggaatttgctcgagaagcaaagtcccaaaagccctgttcctcgttcattgcacggagggggatttgcagctagtgcaacgatagcggggctctggagcgtcgtcccgactcgacgcggcaacgccgcagttccttggcaagatgcgggtcttcctgaacgtcgcggtgagccagaagttcgagctgctccaggttgccgtccgtggggtcctggaggtcaggtgatgcctgccgtagttcttcagttgacacctagagtcgaacagtcaatacgtttcactaaccggttgttgcaagcagcccaaacgcagcccagatcgttgtcgcggtcccccaattgctggcgccacgcctgagaccgctatgggcctgtaggtcgctgtttgcctgcccctgcggctcatagtagttaacaacaacattcctctctctggtttccatgtatccgatgaccttatcggctgcatgattcaatgatcggacgcgtgg

SEQ ID NO: 35768 - DNA, 942 bp, Triticum aestivum
  Clone ID: PAT_TA_35768
ctgtgcggcgctcgataatttcagcccgccaaccacgtcccgtcgtcgaaaccgtcactcaccacccaagtcgccgagatggttcgatacgctgccaccgagatccagcccgcgaagtcggcccgcgcccgcggtgcctacctccgagtgtccttcaagaacacccgcgagaccgcccaggccatcaacggctggaagcttcagcgcgctgttaccttcctcgagaacgtcaaggagcacaaggaggccgtccccatgcgacgatacgccggcagcactggccgcaccgcccaaggcaagcagttcggtgtctccaaggctcgatggcccatcaagtccgccgagttcctcctcggtctcctcaagaacgctgaggccaacgctgatgccaagggcctcgacaccggtgccctcgttgtcaagcacatccaggtcaaccaggcccccaagcagcgacgaaggacataccgtgctcacggtcgtatcaacccttacatgtccaacccctgccacatcgagctcatcctgaccgaggctgaggaggttgtccagaagtccgatgctgttgccgagcgtgagcacctcagctcgcgccagcgtggtgctcgcctccgcaaggctatcacctctgcttaagccaatcaacaaccttcttctcaaatagacaaaatttaagcgctggttgaaaactgggtttacgtcgggcatcttctgtgttgtaactgtgactcttgacaagtctcttgaacaaagagacacaacaccaagattacaaacaaaactcgatcaattgttctagggtttctgcgagggtggttcgtggcttttcatctcctggtgtatggcaggctacggtaagcatggcattaaagggaaacgcatgcaaaaattcgcaaggttttcttgacgaaataaaatctttcaagtcctcctaaaaaaaaa

SEQ ID NO: 35769 - DNA, 655 bp, Triticum aestivum
  Clone ID: PAT_TA_35769
gccggccggttcgggtcacccggagtgcgtcgacgcctggctccgctcccagcccagctgcccgctctgccgcacgctcctcctccccgccgccgccgtcgccaagccggtcgacgttgtcaacggaggcgccccgccgccggtgtgactcgtgagccagaagacaacgtgctcgcacgccaactcaccgaagcatgacaaggaggccccacctgtaagccacttactgctatcttcaccgcaagaaagcccgtcctggtttaacaacagagccaaatgaccaatgtggctagctaactggccccggcccccggcgaggtgcgtcatcgccggccggaaaggcagggccagctgtgccatggcaccacgggagccgttctttcgcaggccggccggccggcgtggggtcgcgtcgtctctccggccacttttctaccttaaattttccgttcaagcccccaaagggaaggacagcggtgtaggctgtacattaaactatctatcgccaagagtattgtagcaccgtcactgcgtacgcggtggcagctcagtggtgcccgggctaatggcatctcgatgtgtacgtagtttaacagcactgatcgcctttattttaagtcccaggatccaaaaaaaaaaaaaaaaaaagccccta

SEQ ID NO: 35770 - DNA, 329 bp, Triticum aestivum
  Clone ID: PAT_TA_35770
gggttcccgcctttgatctatcagatgaagtcatccgtgcgccaatcggcatgcaatcggaggcctacgctcagtatacgcagtgtgtcggcttctagacaaacagtcaaacaacataggcctaccatattctactgcaagctttttgggacggagggagtgtcatatatccaacatagtaaatcgagtgtataataagataagtaatagacatgagatgtgtataagtgataatattgtgaacaatttttgtcagctgtgttttggcagcaactctttgaataaagctcgttgcacgtgagaaaaacacggatcataatcaaacaaat

SEQ ID NO: 35771 - DNA, 819 bp, Triticum aestivum
  Clone ID: PAT_TA_35771
gccggccgtaccgggattaaacccattcaccatggattcaattgatgtcagagaagactctttcccctctcgatcccgagagatctcaggacaagtgaacggagtcgccaccgaaatcacatccaccagctttacagacaagatcctaatcaccatctcccaagaaggccgcctctcacaatggatacaagtccctctgacaggatcctcatctggcgtggttgagatgaatctaccaagctcgaacaagggtcttctcccctcaacgcatctcacaccaacaacgttgttcggaggcgggggtgaggagcgcgagactttggggcagctttatgcggcacaaattgcaagtcaaatatgtctgaggtcgccggacgatcgacgcattcttgttctgggtcttggtcttgccaaaactgatcttgagcgtgaagctttctttgatctgttggaacttgttcagcaggtcctataagctctaaacgaaatcacgagcaccgttgcctccgcaaaaactattctgagaacaaaccactacattgtgacctgctttcaacactcttcagccgacccgcagcgacttgttaatgcacatcaacatactacgaaggcagggatgagggaggaacatcactgaggcgccggaaccacctccagtcgtcggtatatggatatcaagaccaaccttacggaagcaatagagaatccgtgctgaggaacattcatgtattcattaaagatgcacggtcaacacaaatcctagcgcgtatctgctctcagacagagtcctgaactttgtctgcatatctacttggcacc

SEQ ID NO: 35772 - DNA, 640 bp, Triticum aestivum
  unsure (1)..(640): unsure at all n locations
  Clone ID: PAT_TA_35772
cgcaggcagaggtagcgagaagcgtgccccctacaaaccacccaatggtctgcacaatggccgcttcccacctcaccatcctctccgtcctcgcgctcctggccgtggccgcggccgctcaggcgcccggagcggcccccgcggcagcgcccccggcaccccctccccccccggcggccccgccctctgcgatgaccgtcgcccccccgccctccgcgccccccccccctcccgcggaccctccgccggcccccccccccgcgcccacgcccgccatcacccccccggcgcccgccgactcccccatcccctgcactggggcccccactccgggcatcgcgtcctcgcccaccgccgagcccgccaccccgggcagcggcgcctgctggtccccagccccgccttcgtgctggctgccgccgcgccccgccatctacgctcttctacatgacccgccgccgtctcctttctttgtttctttgcacctcttgttccatttctccccctctttgccccctttccgtccgcacattggtgtaccctcatcttctgctgtaattacgagcattgatttaatttatgcatttcaccattaaaaaaaaaaaaaaaaacacgagcctcggggcaaaantcggggggg

SEQ ID NO: 35773 - DNA, 773 bp, Triticum aestivum
  Clone ID: PAT_TA_35773
attccccccagacatcgagtttctcttctcctacctttctcatacctaactctttcactcctactttcgcctattgcgccgttcaactcgcctacaaccccgtccccctacaaactcgatccagcaatcatgaagctgcattacatcggcgtcctccgcaacgagagccagccggctcatgagattgtcgctgagaaggagctcagcagctactcgcgattcacccgcaacaactatggcgaattcatgaccctattcgcaaagaccgtcgccgacagcatcctcaagatccagaaggagctcgacgagaccaagattgttctccacaagaccatcgagagtgtgctacagcgtggagagaagatcgacgatctggtggctaagagtgacggtctaagcgcccaaagcaagatgttttaccagcaagctaagaagcagaactcgtactgtattttgatgtaatggaccatttcatttttcctggcgttggacctggcttcttttcagcacataagggatgtcggcattgagattggttattcgtgcggcgcagatactttcaatcgtttatttctcccaccattcgttcgcagagccatgtctttacagcaacttagacttgtcgaaagggagggaagtagaggaatcttatcacgcgcactacagctggtgtttcaagttggaggaagatgaattgtcctcttttgatatatacagtccagaatgggacaatagtgaaattactcacttatcgccaaagctaacctagatat

SEQ ID NO: 35774 - DNA, 693 bp, Triticum aestivum
  Clone ID: PAT_TA_35774
gccggccgggtcgggaattatttcctcatcgattttcacaaaatggctcccaagaaacctgaagcagttattgacaatgtggtcgcctttggaagggtccgcaagaacctcaaaatgggatgcgttggtctccccaacgtgggaaagtccagcttgttcaaccttttgaccgagcagagcgctgcggcggagaattatcccttctgcacaatcgagcccaacgaagcgagatgcgctgttcccgatgctcgatatgatttcctatgcgatttgtggaagcctccgtctatgtacccagcttatcttcaggtcaccgatatcgctggcttgatcaagggcgcttctcagggagaaggtcttggtaacgctttcctgtcacatatccaagccgttgacggtatctttcacattgttcgagcatttgataacgatcaggtcctgcacgttgatgattcaatcgaccctgttcgtgacttgaacaccattcaaagcgagctttgcaagaaggacttggacattttggacaagcaaatcgtcgccgaggaaatgattgtgaagaacgctggtggcaagtacaagatgctgcctctcttttacgagaccacttccaagatccgagcggtgttggaagaaggaaagccagagcgagacggaagctggaccccagtcgagatcgcacttcatcacgaaaag

SEQ ID NO: 35775 - DNA, 654 bp, Triticum aestivum
  Clone ID: PAT_TA_35775
gccggcccgctgctccagccgcgcccccgatcccagttgcgtcctccgcggatctgcgcccccgatcccagctgcatcctgagcggattccattccattagattctcccgaggagcaaattgcctcccgagatcttcatctcgtttcggattcctctcgtctaattggttccggagccaggcaagaagcgaaagaggaggaaaatgtgcccgctgagggtgatactcatcttcctctccgccaccgtcgccggattcttcctcctccagggcctcaacgccgacaccgactgtttccgtgacggcgacgagggctcggaatctcccacggccgccgttcccctccattccaaggttggttcagctgtcaaaactgggttctggacaacggtggacatggccagcggtcggtacctttggcggacccttgttgcgccaccggtgaattctgaatctgacaaggcccggtgacggcgaactctatgttctctgtttgacatttgtgtaatggtggagacaagggacgaaattggcatgatgtgtgatacagcggcgattgtaaatatgggttttatatgttgaagtaaatgtgcaaattcttcaaaaaaaaaaaaaaaaaaggcccctagttatatgccaggactggattattttg

SEQ ID NO: 35776 - DNA, 637 bp, Triticum aestivum
  Clone ID: PAT_TA_35776
ccagggggcccggcggcggctcccggcagcaccgcggctgctgccaggcgtgtcctgccccgacagcagcctcgcgggctcggtcccgccgcccaccaccccgaccttggtgagtgcgccgccgcccggccgtgtcccgcctagttgggctggtgaccccctggacttctgccccggtaggtgtgggggtaatgtcgtcctcttccgtggtctgcttccagcgctgttgccgctcggcgcggggcggccgccatgcccacgctgccccctggccatggcctcctgtcgcttgacgcccgccgatttgctcttcagttttgagtgggcgctcccagaggggacgacaatacatgatgtgaacatggaggaagaaggaaggctcatcttgcaccgaaaggagccactcgtactcgttcccaccgcataccacctcgacctttaatagagtgccaccaccatgccatatgtgacctattaaagatggaaacatcctggactagtgtctcagcaaaatgccgtatgcacaagttggccaattttcttatttcgtgtaaaagtgggagtaaagtggaccttatgctttatcttataaaaactgaatttactcacagaaaaaaaaaaaaaaaaaaggccccta

SEQ ID NO: 35777 - DNA, 858 bp, Triticum aestivum
  Clone ID: PAT_TA_35777
gccggaccggtcgggtgaaatttctcgcgaaaaaaaaaaaagaaaaaaacggcagagctagcagtgcacagcacagagaagagagcgaagcgagctgagaacagagtaggaggactttggaaacgaaccgatcgggtagaattttaagatgagccgtgtgtgggtggcagcgacggtggccgccgtgcgggcgcagagggagagggcggcgggggcggggtcgcgggaccggcttgccgggctcgccccccaggccgccgcgctcggggcggcgcgggccgtcgccgacgacggccggaggcaggccggcgccgatgagtcgctccgcaaggccatgtacctcagctgctggggcccgaggctgatcacgacgccgcgccggccctcgcggggacgacggatggagcgacatgtggattttgtggggcctcgatgggcttgagcttgggccgggcgcacttgggtagcagcaatcatgtctcgtcacagtatgtttctggttggaagggggaacaaacatgtgcaaacctttggaaattgaggatggtggatgtactgtacatacaaatgctagtacttcctgtacatatttcatgcaattaattggaaaacgggatggtttcagcgtaaaaaaaaaaaaaaaaaaggcccctaccaaagaggtacagcgaaatctcgcgatttggacccgaattgctatcttagtcctaggtttattggtcctctaaatacgttctgacttattagtcgcctaaatacgtcccgatttattagtccttgtatttatgatcatattttaaccataattttgtataaataaaatataagttacatttaacaaaaaaaaaaaaaaaaaaa

SEQ ID NO: 35778 - DNA, 930 bp, Triticum aestivum
  unsure (1)..(930): unsure at all n locations
  Clone ID: PAT_TA_35778
gaaccgatggctctagcatgttacgatagaaaccctcaccacctccgctcggcctgtttgttcacctccctcccccacccgcaccgcagcacaatcctcgcagccgtccgccgcccctcgtgctctccgcctcagatccccagcccccgtccggcgccctcgccgcattcccatttccccgagtccatataaactacgatgggtgcatctgcagctaccggtatgcagatggtggcggcgcgcccttgcatcccagcttgccagcgaatgcttgggtcgagatctggagtttctgcattcggaagggcgctcagcaccagaactggctttgcaagctgtgttaaaactgcgtcatctggatcgctcatttctgtaagccgcaagaggtttgctgtcagggcgatgtctcagggagctgtccaaggactccccattgatctcagaggtaaaagagcatttattgctggaatcgctgatgataatggttatggctgggcaatagccaaggctcttgctgcagctggtgctgaaattcttgttggtacatgggtgcctgcactgaacatattcgagacaagcttgagacgtggaaagtttgacgaatcacggaagctgcctgatggatcccttatggagattactaaagtgtatccactggatgcagtttttgactccctggaggatgttcctgaagatgttaaagcaaataagaggtacgcaggctcctcaaaatggactgtgaaggaagttgctgaaactgtgaaagatgnatttcggcagcattgatatccttgtgcattctcttgccatggtcctgaggtaaccaagcccttgctggagacatcaagaagtggctatctttgctgcagtttcagcatctagttactcgttcatctctttactttacacttcctttccatcatgaatcca

SEQ ID NO: 35779 - DNA, 820 bp, Triticum aestivum
  Clone ID: PAT_TA_35779
ctctcccacctgctctccccgccgctccagaatcgcctccgccttgctgcgctcaccaacggaacgcgcatcccctgtgctcccccatcagatccccccctcacgcattccgccttctcccgaggctcgtagctgctagcacggacgatggccccttgtgcaactgccggcgcgcagatgctggccgcacgcccctgcgtctcggcctctcagagcatgctcgcctcgagggcggccgtctcacggatcgacctggcgctcggcgctagtagctttgcaagctgtcccagaatctcctgctccaggtctctcggttcttccaggagcagccctgtcgccgtaagagcggtgtcaggagaaggtagctcttctgggctgcccatcgatcttagagggaaaagggcatttattgctggggttgctgatgataacggctatggctgggcaattgcgaaggctcttgccgcagctggtgctgaaattcttgttggtacatgggtgcctgcacttaacatatttgagacaagcctgaggcgcggaaaatttgacgaatcacgaaagctgcctgatggatctcttatggagattgttaaagtttacccactggatgctgtctatgattccccggaggatgttcctgaagatgtcaaaacaaacaaaaggtatgcaggatcgtcaaattggactgtgaaggaagctgccgaattagttaagaaggaatatggcagcattgacattcttgtgcattctcttgctaatggtccctgaggttacaaacctttgctggaaaccctcagaagtgggtatcttgctgcaattt

SEQ ID NO: 35780 - DNA, 1234 bp, Triticum aestivum
  unsure (1)..(1234): unsure at all n locations
  Clone ID: PAT_TA_35780
ccccacgcgtccgcaaagtacttgcttttgaagctggacgcaaaggcaaaatccgagttaacaccatatctgcaggtcctctgggaagcagagcagccaaggcaattggattcattgagaagatgatcgagtactcttatgtcaatgcaccattgcagaaggagcttctggcagatgaagtcgggaacacagcagcattcctggtgtctcctttggcttccgccatcactggatcgactgtttacgttgacaacggactgaacaccatgggtcttgcggttgacagccccacagtatcttcgttgttgtgattctagtaggcggacctatttttcccgtttcaccgcggcttgattgttgaataaggagcttagttagatagcactgtaagaggctcttgctaagagctgagggcaggagaaaaaagagaagggggtggctgttgaaaatgaccttttaagcagtccagtacctcctctctggcccatttctaatgttatctcaaatgttgttgttgctgatactatgttcagtgtggctggttggtgcctcgacaaactgtgttatatatatacatcagaaattgtgttcaagaaataaagcaggtatagttggatggttgggatcgtactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaatattataaaaaaaaaaaaaaaaagggggggcccttttaagggaccccatttttccccccccgcccccccaactaatttttttttttttggggcccccaaaataaattcccgggcccgggttttacccccggggggggggaaaaaccccgggttccccccctttaatccctttggaaaaaaccccctttttccccggtggggtaaaaggaaaagggcccccccccaacccccttcccaatatttgcccccccctaaggggaaagggaccccccccttnatcccccctttaaccccggggggggggggggtttccccccggggtcccctttcttttggcgggcccctaagcccccccccttttgtttttttcccttttttttncccccgtggcgggggttttcccccggatgctttaatagggggcccccctttggggttcccttttggggttttccggccccccccccccaaaaactttt

SEQ ID NO: 35781 - DNA, 2198 bp, Triticum aestivum
  unsure (1)..(2198): unsure at all n locations
  Clone ID: PAT_TA_35781
aaacgaaaacccctccctcgatcccatcgaaaccctcaccacctccgctcggcctgtttgttcacctccctcccccacccccaccgcagcacaatcctcgcagccgcactccgcccctcgtgctctccgcctcagatccccagcccccgtccggcgccctcgccgcattcccatttccccgagtccatataaactacgatgggtgcatctgcagctaccggtatgcagatggtggcggcgcgcccttgcatcccagcttgccagcgaatgcttgggtcgagatctggagtttctgcattcggaagggcgctcagcaccagaactggctttgcaagctgtgttaaaactgcgtcatcggatcgctcatttctgtaagccgcaagaggtttgctgtcagggcgatgtctcagggagctgcccccctcccccccccctccctcttcctcccccaccccctccccgcgcccatcttggtcaccccccacccccctcccctccccagcagaacccgcacccccgctctccgccctccctcccgccttccgccttctcccggggcccgtagctcctcgtacccccgatggccccttgtggaatccccggcgcgcagatgttggcagcacgcaccggcggctcggctgcagcgagcatgctccacatggcggcggcgcgcccttggatcgaactttcgcacgtcgtgcgtgggttcgcgaatcgtgagataatcgccttctcaagggctctcggttctaccactggcggcgctggcgccgtaagagctgtgtcaggaggaggtagcatttctgggcggcccatggattttagagtgaagagggcgtttattgctggtgttgctgatgataacggctatgtctgggcaattgcaaaggctcttgccgcagttggtgctgaaattcttgttggtacatgggtgcctgcacttaacatatttgagacatgcttgaggcgtggaaaatttgaggaatcacggaagctgcctgatggatcccttatggagattgttaaagtctatccactggatgcagtctatgagtccccggaggatgttcctgaagatgtcaaaacaaacaaaaggtacgcaggatcgtcaaattggactgtgaaggaagttgctgaatcagttaaggatgattttggcagcattgacattcttgtgcattctcttgctaatggtcctgaggtaacaaaacccttgctggaaacctcaagaagtggctatcttgctgcagtttcagcatccagttactcgtttcatctctttacttaagcacttccttccctattatgaatccaggaggtgctagcatctcgctaacatatattgcatctgaaaggacaattcctggatatggtggtggcatgagttcagctaaagcagctcttgagagtgatacaagagtacttgcttttgaagctggacgcaaaggcaaaatcagagttaacaccatatctgcaggtcctctgggcagcagagctgccaaggcaattggattcatcgagaagatgatcgagtactcttatgtcaatgcaccattgcagaaggagcttctggcagatgaagtcgggaacacggcagcattcctggtgtctcctttggcttctgccatcactggctcgactgtttacgtcgacaacggacttaacaccatgggtcttgcggttgacagccccacagtatcttcattgttgtgattccggtaggcggacctatttttcctgattcaccgcggcttgattgttgaataaggagcttagttagttagtactgtaagaagctcttgctaagagctgagggcaggagaaaaaagagaagggggtggctgttgaaaatgactttttaagcagtccagtacctcctctttggcccatttctaatattatctcaaatgttgttgttgctgatactgtgttcagtgtggctggttggtgctgcgacaaactgtgttatatatatacatcagaaattgtgttcaagaaataaagcaggtaagattggatggttgggatcgtacttaaaaaaaaggggggccggtacccaattcgcctatagtgagcgatncgcgcgctactgcgcgttacaacgcgtactggaaacctggtacccacttangcttnagacatccctttgcactgcgtatacganaggccgacgatgcctccaangttggcntgatgga

SEQ ID NO: 35782 - DNA, 634 bp, Triticum aestivum
  Clone ID: PAT_TA_35782
attcggcgcccagcgaaaacaccaccacacctctccccgtcgacgcaagaagcagcagcggcatccatggcccccaaggcggagaagaagccggtggcggagaaggccgagaagacgacggcggcgaagaagaccaaggccgagaagcggccgccggcgtccaaggagggcggcgagaagaagggcaagaagaagtcgaagaagagcgtggagacgtacaagatctacatcttcaaggtgctgaagcaggtgcaccccgacatcggcatctcctccaaggccatgtccatcatgaactccttcatcaacgacatctttgagaagctcgccggcgagtccgccaagctcgcccgctacaacaagaagcccaccatcacgtccagggagatccagacctccgtccgcctcgtcctccccggcgagctcgccaagcacgccgtctctgagggcaccaaggctgtcaccaagttcacctccgcttagatagtatgttccctgttgtccaggtggatcgatgtttgctctgtaggtagctgttcgtaccatgtcatcttataagttgtgtgggaacacacatggtttcatcatctggagaaatagtaacagtgctgatttattctgtctaaaaaaaaaa

SEQ ID NO: 35783 - DNA, 827 bp, Triticum aestivum
  Clone ID: PAT_TA_35783
gccgcggccggacccggatcttcaatcacaaacaacaacacaactccatcaaattctttacaactacgccaaacaaaatgtctttctccaacgcaaacactggcgatgcccctgccgacccttacaagaaggccaacgctgaggacgttcctcttcagaccaagatcgaggacctcgtccacttcgtcaccaaggagaagtttggcatgatgaccacccgcggttctgaatccggcaaccttgcctcgcgttgcatggcgctggccgccaccgagactggaggcattgaccttcttttccacaccaacaccgagtctggcaagaccgacgacctcgatgctgaccctcatgtcaacatttccttcatcaacgcctctggagagtgggcttctatcgctggaaacgccagcatcagcacagaccgcagccttgttgctaagcactacagcccaaccctcaaggcttggcttggcgacctcggtgacggcgtccacgacggatctgagaaagatccccgaattggtatcatccgtgtcaaggccgtttcttccacctactcgctcgtttccaagaacttgcttagccgcgttgccgacattgcgtccagcaccgtcactggcaagcctgcctcgcccaacaccttgagggagatttcgggagggagatgtgcgctcgtggagggcttcgcgagagtaatggtcaggataatgcaaatctcgcttgtacgataggacttaatatcatggcgatacgaacttatgacagcattagtatacaatcaaagttgttttccgaaaaaaaaaaaaaaaaaaggcccctagggccgc

SEQ ID NO: 35784 - DNA, 709 bp, Triticum aestivum
  Clone ID: PAT_TA_35784
gccggccgggatcggaaacctgacccccaaaaaaaaccacgcgtccgcccaccggtccagcagaccaaggaaacgagccaagatgcggcgcgaggggaggcagcgagggtgggtgcgcgtgtacgaccgcgatctggtcgacccggatggcaagcgccgcgcggcgcacgtcgtggacgccgacgggcaggccgtggtggtggccaacggcgggtacgtccgggcgtcgcggaggccgaccaaccactccaagccgggcggcagccgcgcgctcgacgcgctctgcaggaaggccctccgcgcgctcgacgaggaggaggaggcgcctccgccgcagccggccgcgcggtacgggtactcgccgggatggtggccgtcgtcgccgtcgccgtccaggtacggggccgtcgcgcagaggcaggcgcaggctcagccggcgccggcgcgttcgggggccgggaaggcgtcgtccaaggggggcccgggccgcaacttcaagcacggcaagatcagcaagacgtacctcgacgaggacgagatcgattatctctacaactacgattcatgagcggacggaagcggggagctgctttgtggcttttttctccttatctttgttttggcgaagttcagcgagaggagttgtatgctggatcgtaatattaatgtgtactatcaagattagacttaatttctttttaagatcatt

SEQ ID NO: 35785 - DNA, 823 bp, Triticum aestivum
  Clone ID: PAT_TA_35785
gccggccgggtcgggttcccaggagtgccctcccgacttgcataatcgtctcgtagcatcagtcaacaatgctggcttccttgctcatcttgagaaagtacgagatgagccgctgcatcaacataccaaactatctattggcagtgtgacagaggtggacattggagatattccttacactaaagatgaggggaagactgggtcatggctcttggtttcctgtgacactgctgggggcaatttggaggaaattagtggaattgatgacgaaaattatgtgatggttaatgaagatgacatcgttgatgctattgctacctttgttgctaggtgcattcttgaagatccaaagtccaagtcattatcatcgaaagagctgcaaaaagctgttgcaacggcattgagcagcatgacagaccggaagaaatggataagtttctgggaggctggaaaggtgatctacatactggcaacttgggggatcacaatagcagggctgtacaggagtcgtgccgtcctgaagatggcagccaaaggagctgtcgtctccaccaaatttatcatgaaggcattgtgaggtgccaagtgcctcaatagtggcatcatgatcacacgcaagggtccgcaatttgtaaatacaaactcgtcgtgtcaactgtacatatgtgttgtgtgatatgatttatctgagaactattcgttggtcagttgtgctgtaacttctgaaatgataatgatttctctcatcgtgtatgaataatgggggcaactatctgcttaaaaaaaaaaaaaaaaaaaaaaaaaagacgcggccgcgaattcg

SEQ ID NO: 35786 - DNA, 530 bp, Triticum aestivum
  Clone ID: PAT_TA_35786
tgtgcggcgcgccggccggccggggatctcttctccttcccactgttgcattgcaagccggccggctgtctccttgatcctcctccgtttttcgccgtcgacgtggatcgggtgcggcatgggcgccgacaaggggagcacctcggtgcagtttgacgacttcctgccgtcgatggcgaggaagctcggcgcggaggggctgatccaggagctctgcaaggggttccagctgctcatggaccccagggccggcaggatcaccttccagagcctcaagaggaacgcggccaggctggggctcggcgagctccaggacgacgagctccaggagatgatgaggggggggggacatggacggggacggcgccctggatcagaccgagttctgcattctcatggtcaggctgagccctgagctcatggagcaagagtcgcataggatgtttgagtgttgatgtaacttgacttttgttacttgcatacaatagaacatactgattgccaaaaaaaaaaaaaaaaaaaggccccta

SEQ ID NO: 35787 - DNA, 682 bp, Triticum aestivum
  Clone ID: PAT_TA_35787
tttcgctacctcgtagcatacaagttgcctgcaccattgccaagacccagcgtccaagtcgtacacacttgttgcaaagaggaggagggttagaagaaagctaaggttgacgacatggccgtcgtgcggaggatgaggctcgctctgccggtgatcgtggcggcgctcgtgctgctggcggtgctcggcgaggcgcggccgctggggggcgcggactgggcggccgccggagggaccccgctgccggccgtggtccaggcgctccgccggctgtacatgcagcagctgggcgggccgggcccgtcgtgcggcaccaacagcccaaacgtccactgcccgccgtagatggccgaggccgagcgccgcagctcggccggcgtgcgtacgtcctctcgtgtttgaagttccaacgtgtttttggcgaccccggtggtagattctggtgatcgactgtaggattggattcgttgcttggtttgttggtgatttttgcccacgcgtacgtctacgctagttggcactttgtacatactacatacaaaaggaaatacacacatatattacgtaggattctgtctgaataaaactgtaaaacataggcaagctgcagaagcatcagcaatacatttgtatttacattacatatgtaaacctttgtttatgatttttctttttgagaacc

SEQ ID NO: 35788 - DNA, 738 bp, Triticum aestivum
  Clone ID: PAT_TA_35788
gcggccgctcccgacgccggccggagcgggatatagctacctcgtatagcgtacaaagttgcctacacacattgccaaaacccagcgtccaagtcgtacacacttgttgcaaagaggaagagggttagaagaaagctaaggttgacgacatggccgtcgtggggaggatgaggctcgatctgacggtgatcgtggcggcgctcgtgctgctggcggtgctcggcgaggcgcggccgctggggggcgccgactgggcggccgccggagggaccccgctgccggccgcgggcggcgcgtcgaacgtggtccaggcgctccggcggctgtacatgcagcagctgggcgggccgggcccctcgtgcggcaccaacagcccaaacgtccactgcccgtagatggccgaggccgagcgccgcagctcggccggcgtacgtcctctcgtgcttcaagttccaacgtgtttttggcggccccaggtggtaggctctggtgagcgaccgtaggattggattcgttgcttggtttgttggtgatttttgcccacgcgtacgtgtacgctggttggcactttgtacatacatacaggggaaaggatacacatatagtacgtaggattctgtttgaataaaacataggcaagctgcaggagcatcagcaatacatttgtatttaaattacatatgtaaacctttgtttatgattttttttaaaaaaaaaactttgtttatgaattgaaaa

SEQ ID NO: 35789 - DNA, 639 bp, Triticum aestivum
  Clone ID: PAT_TA_35789
tgtgcaatgatttatattccgctgctatactcttagaattgcatgtgtaggtttattgcttgacttgtgctaagttgttaaagactgtgacttaaagctgggaaaaggctagatttttatttggtcaagtagtctaatcaccccccccccctctagacctactttcgatcctacaagtggtatcagagttgtggtctctatttgccttgatttccatagctttggtgatcatagccttggtttcacaacttgtaagagtatcacccccagcgaggacatactccaccttttacaagtggtatcagagctttggtctctatttgcttggtctccatagcttttggtggtcatatccttggtttcaccctttaggagagtatggcgtctagcgagggaacttatcaccgtagaggtccttactttgatggtactaattttgctagttggaagcataaaatgaaaatgcatattcttggacataaccccgctgtttggactattgtgtgtgttggtttgcagggtgacttctttgatgggagagaaccaaaccgtgaagctaccgcggatgagttgaagatgttgcaatacaatgctcaagcttgtgatattctcttcaacgtattatgcccggtcggcccg

SEQ ID NO: 35790 - DNA, 419 bp, Triticum aestivum
  Clone ID: PAT_TA_35790
ttccctttacattcttgcaagttgcatgccttactttccgctgctcatatagtctttgcatgcttgcttgaattgtgttaagattgcttgacttgtccaaagttgcaaaagtctgccaagaactgaaattgggaaaaggataagtttttatttggtcaagtagtctaatcacccccccccctctagacatactttcgatcctacaagtggtatcagagctttggtctacatttgccttgattttcataccttttagaagtcatagccttggtttcacaacctaggagagtatggcgtctagcaagggaaattaccaccgtagaggtccttactttgatggtactaattttgctagttggaagcataatatgaaaatgcatattcttggacataaccccatcgtatgggctattgtgtgt

SEQ ID NO: 35791 - DNA, 674 bp, Triticum aestivum
  unsure (1)..(674): unsure at all n locations
  Clone ID: PAT_TA_35791
ggacccacaacaaaaacatccgtgtctcntattacatntgctttctcaaactcctcccctttaccttcatatgaaattgttttacattccactgctatactcttagaattgcatgtgtagattgattgcttgacttgtgctaagttgctaaaatatgccaagaactaaaatttggaaaaggctagatttttatttggtcaagtagtctaatcacccccctctagacatactttcgatcctaaagatggcctcctccatcaaggataaggacatcaagaagctccgggaggccgggtacctggccaaggagatcacccatcggcttccggccgagggacaaatcgtccccaccccggagccccaggagagggtagtgttcgtctctcacttcgtccgcgtactgggattttccctccacccgttcgtccgtggaccttatgttctactacgagcgggacttacacgatctggcccccaaccccatcctcaacatctcggcatttattgtcgtgtgcgaggccttcctctgcataccacctcactttggactatggctgaagaccttcaatgtgaagccaaaggtggtgagcggtcagcaaccagagtgcagaggcgccatggtgggcaagatgcccaatgtcacctggcccgaaggatcctttgtggagactgtc

SEQ ID NO: 35792 - DNA, 461 bp, Triticum aestivum
  Clone ID: PAT_TA_35792
aaaaacatccgtgtctccaattgtgtttgttccctcaaactcgtccctttaccttcatatgaaattgttttacattccgctgctatactcttagaattgcatgtgtaggttgattgcttgacttgtgctaagttgctaaaatctgccaagaactaaaattgggaaaaggctagatttttatttggtcaagtagtctaatcacccccctctagacatactttcgatcctacaagtggtatcagagccttggtctccatttgctttgatttccatagcttttgttggtcatagccttggtttcacaacctaggagagtatggcgtctagcgagggaaattaccaccgtagaggtccttactttgatggtacaaattttgctagttggaagcataagatgaaaatgcatattcttggacataaccccgccgtttgggctattgtgtgtattggcttgcaaggtg

SEQ ID NO: 35793 - DNA, 1646 bp, Triticum aestivum
  Clone ID: PAT_TA_35793
gcgttggcggtgtgtatgacttaacacaaaatgaagatctttggagaatggtttgccgtaatgcatggggtagtgagactactcgagctcttgagactgtgcctgctgcgaaaagattgggctggggtcggctggccagagaactaaccaccctggaagctgttgcctggaggaaattgactgttggaggtgcagtggagccatctcgatgcaacttcagtgcttgtgctgtagggaatcgtgtcgttctctttggcggggaaggtgttaacatgcaaccgatgaatgacacgtttgtgttggatttgaatgctagcaatccggagtggagacatgtcaatgtgagctcagctcctccgggccgctggggccatacactatcgtgcctaaatggatcttggttagttgtgttcgggggatgtgggttggcagggcctgcttcaggggctggcctcctcgcggcgtcgctgcggtaccccctgcttccgacgggagccatgccgtcgcgccgccgactccgcgttcccgggcgccccccccgctctgcggggggccacagttccggggtcgctggaggtccgaaagcgatagtgcttggaggacagtctggcgttgcgtcgtggcgcacgcatggacatacctgtatggagggaagtacctgcatcttgggcaccctctttaagggtctttcacccaaggttcctttaaaacaaatggagacctttcatgtggcgttaagcttcgattgtcttcaccacccggggccggggcactgaatgtttggcgccaggaatggatgtatttgctccggaagtgagatatggttgggtctgtagaatgccttgggcgggaaatccggctggagctggtccacctcctcgtcttgatcatgttgctgtgagtttgccagggggaagagtgttgatatttggtggatcagtggcaggcctctacttagcgtaacagctttatctcttggatccgactgaagagaaacctacgtggaggatactcaatgttcccgggcgacctccacggtttgcgtggggccacagtacctgtgtcgttggaggtacaaaagcgatagtgcttggaggacaaactggagaagagtggatgctcaccgaagtacatgagctctctctggctagtagtaactctgtttgaagtctatataaaggtctttcaaccaaagcttccatgaaaacaaattagacctttcaagtggcgttaagcttgattgtcttcaccaccgggccagagcactgaatggatgtatttgcttggaagtgagatatggttgggtctcgagtaaagattaaaccccttaaaccggggttgctcgctttatttagctaatgcgtagtgatatgttttctctcttgttgctgtttgtttggtcttttaccagataagtataattcataagctactctcctcgagtgattagcgtggtcgcggccgaggtgacgattctgacatccattctgttaggttaagaaaaggactactctgtacagatgaaccctctcttgtattgaaaccgtgatagttatgagatgtatggatggtcttggatcaatcctctttttttgttaaaaaaaaaaaaaaaaaaaaaaaaaaaacctgcccgggcggccgctcga

SEQ ID NO: 35794 - DNA, 951 bp, Triticum aestivum
  unsure (1)..(951): unsure at all n locations
  Clone ID: PAT_TA_35794
gtgcggcgctcgaggcggccgttatgggctggagcaccgctccaaacacacagaaacacacacagcttcttgcgttctcaaacactgatatcgacttgcagcttcagtgtcgtccaccgccggcaagaaggcatggcgggcgcgtcctcgtggtcgtcgtcctgctcgtgcacgtcgtcgctcggctccttggatgacgacgatgtgttctgcgtcgtgaagccgggttcccccggggcagctgcagagggcagcgtcaagttcctgtgcagctacgggggcatgatccttccacgccaccccgacggcgcgctccgctacgtcggcggcaacaaccgcgtcctctccgtcgaccgctcccttcaatttcacggtacatgcctattaccaacgacgcctcctgctgtccattgatcgtttccggcactccagccagttcagctgtttgactgtggatcgatcgatcgcttcagagctgcaacggaagctgacggacatgtgcggatgggaggcgttgagcctgcggtgccagctgccgacggaggacctggacgcgctcgtctccgtcacgaccaacgacgacctcggccacctgctggaggagtacgacgccgccagcagggaccggctccagccgctcaagataagggcgttcctgttcccaagggccaaaacgccgccgctctcgccgtccaccccgtcgtccaaggccaacgccggcgtacgtccgccaccaccaccagcaccacacggtcgcccccctccggtcgtgggcattccggcaccggcgcccgcacactcctctcctccaaaacgcatttggtgtcaataacagcgggattaacaacagctgctggtgtatcaacttggcatcctgaattgtccatgggccttgccgctgtcctcaagcggttgtaancccgcttgctgttcaacttatctcctcgatat

SEQ ID NO: 35795 - DNA, 537 bp, Triticum aestivum
  Clone ID: PAT_TA_35795
gaccgaggactaaccggtacgggcgagcggagcaccgagcacgcgcgcagcacatcatctgtcacaccggcggcggcggcggcatggggatgggcggtcgaggtgtggttggcgacaggtggtcgcagcgcgtcctctggatgtgcgccatcggcagcgccgtgagcctgtacttcgtggcggtggagaggcaggcgcagaaccgcgcgcgggcggtgtccgagggctttaagggcctggacggcgcagacggaggtggcagccgtggcggggaggacgtgtgactttggcggcgccgaggtgaaagggcgtgtaggcatgtgcctttctgctcgaagcctgagacaagttagagtttgcttatctgctgcttgttcacaagattcacagaatcgttgcaataagaatgtactgctaattgctccctgtgttgctgtatgtcaatgtttgggggcaagaattgttatctgacgacatgatgcttttttgtgagaaaaaaaagttggaaaattcagattaaaaaaaaaaaaaaaaaaa

SEQ ID NO: 35796 - DNA, 726 bp, Triticum aestivum
  Clone ID: PAT_TA_35796
gccggccggcctcgggacaagcaccaaaccccacgcccgcacccaagaaagcagagcattccccatccccactccgctttccccttcctcgccatggcagccaaggcccccgccctcgcggcgctcctcctcctcgccgccgcttccctcctgctcgcccgcggcgccgaggccggggccggggaggtgccgctgagctgggagctgggcgtggaggacgtcgccgacgacgggtacggcctcaccggcggcgacgcggtggcgcggcgcgtgctgcagagcggcaacggctacatcagctacggcgcgctgcggcgggacaacgtgccctgctccgtgcgcggctcctcctactacaactgccgccccggcggccaggccaacccctactcccgcggctgctccgccatcacgcgctgccgcggctgattgagccacccgccgatccgcccccgtccccgtccaggttggttgattgagatgccgctccgtgtcctccgctcgctccgctgaagatgcagagtacatttctttcatgctgctgttttagtacccgattccaagaggtcgcgtctgttgatgtaaatcgaaatccaaggcgtatttgttataaactgatggatgattgattgagtcccgaaaaaaaaaaaaaaaaaaaggccctgcttgtcgagtttccagaaaaaaccaaaacttaaatcgtattacgcagaaatcaaggcccta

SEQ ID NO: 35797 - DNA, 464 bp, Triticum aestivum
  Clone ID: PAT_TA_35797
gggcggtaccccgtgaaggtggacagggacggcggcgtcgggccactgccgggccacgagtgcttcccggacgtcggcggcaaggtcctcggcgcgcagtcatctctgcccgatgctctgaccacgtaattaagctaaccaattgttaggatttgcagaacactagatcttgtacaatgcaaggtgctttagaaaaggtgcttgaagaaatcacgtggacttttcttaagcaccggtgctaatcaggcgtctctccgtgtgaaatatgaaccggtgcttcagaaaacccagtttatttatttaagcacctctctgagcaactagcaaaattggaggcctaacgagacagtactcaaaagaaaaatctgctattagaactgtaataacgtagatggctagttttttgggtgaaagaaaaaaaaatttggccccttattagtgatgctgttttttcaaaaaaaaaa

SEQ ID NO: 35798 - DNA, 964 bp, Triticum aestivum
  Clone ID: PAT_TA_35798
gggcaacagaccttctacggtcctggatctggcttcaacgttgataccactaagaaggtcaccgtcgtcactcagttccacaagggcagcaacggacgtctctctgagatcacccgtctctatgtccagaatggcaaggtcattgccaactctgagtccaagattgctggagttcccggaaactctcttaccgctgacttctgcaccaagcagaagaaggtctttaacgaccccgatgacttcacgaagaagggtgcttggagcggtatgagcgatgctcttgaggctcccatggttcttgttatgtctctctggcacgaccaccactccaacatgctctggctcgactctacctaccccactgactctaccaagctcggctctcagcgcggatcttgctctacatcctctggcgtgcctgccgaccttgagaagaacgtccccaactccaaggttgccttctccaacatcaagttcggtcccatcggcagcacctacaagagcgacggcaccactcccaccaaccccaccaacccttctgagcccagcaacactgccaaccccaaccccggcaccgttgaccagtggggccagtgcggtggcagcaactacagcggtcctaccgcctgcaagtctggcttcacctgcaagaagatcaacgacttctactcccagtgccagtaaattcgcggctagcctacgctatctgaggactcagaagaaaagatttgacgaggagatgattgtgatgaagttgtcttggggagggacgaagttggttggttgatgtggaaaggggttagttttccagtttgtcgattggcttatgctctttcttgcccttcttttgtatcgcgcagtaaaaagcgacttttgcccctattgtatatactttggtagaagaatagcaatacctgtcgttaccaactacatctgagaaaaaaaaaaaaaaaaaaggccccta

SEQ ID NO: 35799 - DNA, 431 bp, Triticum aestivum
  unsure (1)..(431): unsure at all n locations
  Clone ID: PAT_TA_35799
cgggtccacttagacttcgtgaagtgtaagtcgaatgacatcacctataactgattttgcccgttttgcctccctggttagtgggttctaatttctcccgctctgggcctttctttatctgtttttttatgtctgagttgtttgtttgtttgtatttttaccaaaagggaaaagaaactacacatgaagcccatctgtaccaaataaaatgacgagaaatcctttcgttccttgtttcttctacattcttcttctttttgtcaaaaggagcctcattaaaaaaattgcacgcacaagtcggcttggtctatgtgtgtgcgcattttggttagagttgggttcaattggtgaaacaatcagctccgttcatcagttataacanaaacataggttctcggaacccgacggcggctacttaanaaaccgatcac

SEQ ID NO: 35800 - DNA, 808 bp, Triticum aestivum
  Clone ID: PAT_TA_35800
gccggccggtccggaccatcagcattcacttcactctcatctcactcactcatcaacactcaaacaacaaccacttaatctcttcaccaaccgccatcatgcaattcaagactctcttcactgcttccctcctcagcggcctcactgtcgccgcccccgagcccaagacctttggtctcgtcgctctccgctcaggtagccctttccacctctccagcgtcagtgcctctgagagcggcttctcgcttctcctccccaagggcaagcagggtgccaagtgcgccgacaacaagaaggaggactttgctactttccgcatcagcaaggacaagaagctcgtcctctaccacaagggcaaggagcagcagattgcctacactgaccgatccggcatgggccaaggtgttctccagtacactggccagaagaactaccctcgcaacgccgagactgagggctggaaggtcgacaaggacggcaacctcgtctttggcagcaacaacgctggcttcatggcctgccctggtctcaagtccactgacccctggagcatctgggtcgccaccggtaccgaccaccccggtaacagcgagaaggagtgctacagcttcagcgcccgcgtcgctgagaccaagaagcctgttagctgcatctactcccagtacagcaactaagcgatagagtttgcactgtacataagacttgttttagacatgatttattattttagattttagttctcttgtatatacattgattaactaaatcaaaaaaaaaaaagaaacctaagggccctaagggcctcgag

SEQ ID NO: 35801 - DNA, 845 bp, Triticum aestivum
  unsure (1)..(845): unsure at all n locations
  Clone ID: PAT_TA_35801
ccgctcgaggngccggccgggcccgggatccttcttctcagacactctcccctcaatctcagagccctccctccctccacatcatcacaatggcttctcgcaacctctccaaggccctccgtggccctgcccgccagctggcttcggctccccgtgttcagcagcgaacttttgtatctgctgctcgcgctgctgtccgtgccggtgctgttgcccgacccgttgcttctggtcctatccagcagcagatccgtggtgtcaagaccatggactttgccggccacaaggaggacgtctatgagcgtgccgactggccccaagagaagctccttgagtacttcaagaacgacactctggccctcattggttacggctctcagggtcacggccagggtcttaacctccgtgacaacggcctcaacgttattgttggtgtccgaaagaacggaaagtcctggaaggacgctgagcaggatggctgggttgccggcaagaacctgttcgatgtcgacgaggccatcggccgtggtaccattgtcatgaaccttctctccgatgctgcccagtctgagacctggcccgccatcaagccccagctcgtcaagggcaagaccctttacttctcccacggtttctcccccgtcttcaaggacctcaccaaggtcgaggttcccaccgacatcgacgtcatcctctgtgcccccaagggctctggccgaaccgtccgatccctcttccgtgagggccgtggtatcaactcctctttcgccgtctaccaggacgtcactggcaaggctgaggagaaggcatcgctcttggtgtcgccatcggctccggctacctct

SEQ ID NO: 35802 - DNA, 655 bp, Triticum aestivum
  Clone ID: PAT_TA_35802
tgtccaaagatctctgattttggactggccaagctgtgcctcaataaagaaagtgtcatttccattggtggtgcaagaggaacaatcggctatcttgccccggcggtttattcgaagcgatatggagcagtaagtagcaagtctgatgtgtacagttatggaatgatggttcttgagatggttggtgcaagggataagaatatcagtccaaatactgaatctagcagccaatatttccctcaatggatttatgaacatctagatgaatattgtgttagtgcttctgagattaatggagaaatcacggaggttgtgaggaagatgatagtggttgggctgtggtgcattcagttacgttctacagatcgtccaacaatgactagagtcgtcgagatgcttgaagggagcacaactggcctcgaattgccaccaaaagtgctcttgagttgataggtttatattgttctcgcacacttactccagtgttgcataatctgtaaaacaacttgaaattttcaatattcccgctgcgattgggacaaacagagcagcttccatatgtccgctggtctcctgattattccatgcacaggagataacacgacaatcctgtcatttgcagcatccctattctttatcctaaaaaaccacacca

SEQ ID NO: 35803 - DNA, 890 bp, Triticum aestivum
  Clone ID: PAT_TA_35803
gccggccgggctgggaccaaatcagcccatcctcgcaatccctcgacaacaccctctacctcgcatccccgagtcatcctcattgccaggcgcaaacccgatccgataagaaaaacaacaatgtttctgcaacgctccgccatcaccgcggctcgccgcgtcgccgcccgacctgctgtcgctcgcacctttgtcacctccgtcgctcgccttgatgccagccgccctgccacccccagcgagcaggccgctgctcttgctggcaccgccgagaagaaggttggatcctacaaggtcctgaaggagatccgaactgaggaggatctcttcggtcctggtgccgcccccggtaccgtccctaccgatctcgagcagtccaccggtcttgagcgtctggagattctcggtaagatggagggtgtcgacatcttcgacatgcgccctctcgatgccacccgcctcggaacgatgaaggaccccattatggtccgatctgctggtgaggagcagttcgctggttgcactggtttccccgccgactctcacagtgttacctggctcggcattacccgcgagcgccctatcgagcgatgccccgagtgcggcagcgtttacaagatggactacgttggtcctgaggacgatcaccaccaccaccaccctcctgagtttgaggagcccaagacctttgccgattacatcaagcctgagtaccgatacaaataaatgcattgcgccgagagacattgaggagattgggctgcagcatcaagcgaaaactagacgggtgtgatgctgccccgggaagaggatccattttgtgtagattagggtgccttgttccctgtgtcatttactaagtagcttgctaaaaaaaaaaaaaaggccct

SEQ ID NO: 35804 - DNA, 831 bp, Triticum aestivum
  Clone ID: PAT_TA_35804
gccggccgggtcggattcctccatcaaaatcatcctcgtatcacaacactaaatcactatcaacaccttccaacctacgcacaaaccaaacacaacaaacaccttcaacatatctggccagccccaaccttccactctcaagtctgtcgtcgactccaccactggtgctgtccagaacgttatcggcaacctgactggcaacacaagcgaccaggctgctggcgacctcaagaagcagaaggccgaggccgagcacgatgcttctcacgctaccgctaagctccccggtgccaccatctccggctctggtgctgctgccaaggatgaccccaaccgcactgagggttcttggaaccagactgctggatccgccaaggagaccattggaggcctcattggcaacgagtccttgaagcagcaaggccgtgagcagaacctcgagggacgtaaccaagaggccaagggtcagctcagcgaccttggatcaggtatcggcgaccgtgttcagggtactgttggaggcgccatctccaacctcgctggcgacaaggagaaggaggctcactacgacgagctccgtgccgagggcaagacccgccagcgtggcgtcgagcacgatgtccagaagcaggctgaggctgagcaccgtggttaaagtatgctgcgttgctacgatgagcatcaggctaggacgagcatgagagacgatgaaacatgatacccagagttgagttgaatggatctaggagatcctactgatagcagtcctaataaacactatgaatatttaccctttctgtcccaaaaaaaaaaaaaaaaaaggcccctagg

SEQ ID NO: 35805 - DNA, 867 bp, Triticum aestivum
  unsure (1)..(867): unsure at all n locations
  Clone ID: PAT_TA_35805
gccggccggcccgggtatgcagagaaaaacgaacttcaagcctccagcgatctcgaccgccagagcccccggagcccacacacccgccgccgtgtcgccgccttcgtcgatcaagagcaacaccgacgtggcgccgccggagttggagcagcgcgtcaaggtgtcgccaccgccgccgttcgcgtcggacaggtgggccgcgggcggcgcctcgtcctccgacgaggaggaggacaccaagaagaccaagaacaagaaggccgcgaccggcaagacggtgccggcaaggaagagcggcaaggccaagggcaaggacaggtacctcgttgcgccaaaggcagaagctgaccaggagttcatgcccgcaggggtccccgacccgttcgccgacaacgacgcgcccccgccctcctcgttcgacccgttcgccgatgacgctgccggggggggcgctggggtcgacgaagcctacgtgcacctccgcgtgcagcagcgcaatggcaagaagacgctgaccacggtgcaggggctcagcgccagctacaactacgccaaggtgctgcgggacctcaagcgggagctctgctgcaacggcaccgtcgtcgaggacaaggagctcggcaacgtcatccagctgcagggcgaccaccgcaagcgcgtcgccggcttcctcgccaaggccggcctagccaagacggagtgcatcaaggtccacggcttctaagccgatctccatagagtttgtttatcgggtttgctgtttggtgatttgatttctgtgtgagtctggncataatggcttgcggtcgtcgggttaaatcgtgtaaggggtcactttttgctatatncataataatgcagactttt

SEQ ID NO: 35806 - DNA, 582 bp, Triticum aestivum
  Clone ID: PAT_TA_35806
gccggccgggccgggaaaaccactgaaccccttccattcaactccaaaccaacacgcaaaaccaacaccaaaatcgcccatcatgcctctcgtcgttcctggtgtcaactcaacttctggcgacaaggccgaggagtggcagaacaagctcatcggcaagaagctttctgatgacgaggcttccaccgagacggtgtttgccaagcgagatcttccccaggagacgcgcattatcgagcccggaatgatggttacaaaggactttaaggaagacagactcaatgtccacctcaaggatgacggaactgtctcacatgtcgtcaagggttaacgctgctggtgtcaagacaacccctccattcttgacttgatgatggggtaataattaatgtacgataacgactacctacgaatgggaacagggtccgcccgtagtaataaaggcgcaagagaataacagaaatatgagatttaaactgccaaaataaataccatcataaactgtcatttctattgcgtcgtgctgtttgtagaggaatgtcatcgtcgaacagacaaaaaaaaaaaaaaaaaaggccccta

SEQ ID NO: 35807 - DNA, 690 bp, Triticum aestivum
  Clone ID: PAT_TA_35807
gccggccgttccgaatcacatcatcaaccatcaacagtttcaacagagcaataacaacctctctccactccatctaaatcaccactcaatttttcgagtataatactcttattaattccttgacttgatccaactcaactaccactttctacaaaaaaaaaaatcaacccaatcaatcaacatgtctcccatcgttgctcgatctgccgcccgcgcttttcagactcgccagttctctcttcttactgcgatgcgaaatgccggccgagccatggagtctcatccctttgagcgtcttcccatcactcagaagcctgcttctcctgattacgccaagatgttcaagcgagttggcagccaggctctcttcttcttccccggcttcgctgtcatccttggctggccttgggctgcccagtatgcctttgacggtaaactgtaaaggataaaccaacaacattctctgatcttttggatcaacttcgaacgagcaagacctgacggtatcgcttctcgataacggcatttatacatggctatttgaatattgggaccgattgggacaatatacagtcacttgtatatagcattggaaggcgttggggtgcattttgaataggagggtgtctagagcattcgacctacgactacatatgatacatttcttagacataccataattccatatgt

SEQ ID NO: 35808 - DNA, 708 bp, Triticum aestivum
  Clone ID: PAT_TA_35808
gccggcctgtcccggaaatcaagatcatcctctcagccctctagacatccaacctacctcaaaatggcgactcgaagcgcagctctcaagcttgactggaccaaggtcaccagctccctcggtctccgtggccagactgttgcctccctgcaggccttcaagaagcgcaacgaggacgtccgccgcaaggtccagcagctccaggagcagcccaccaccgtcgacttctcccagtatcgatccgtcctcaagaaccaggccatcatcgacgagatcgagaagcgattcaacgccttcaagcccgttacctacgatgtcagccgacagctgaaggccatcgatgccttcgaggctgaggccgtcaagaacgccgaggccaccaagcaggccgtcgacctcgagctcaaggacctcgccgctaccctgaagaacatcgaggaggcccgaccattcgaggacctcactgtcgacgaggttgccgctgccgagaagtctatcgacgagaagaccgaccagctcgtttccaagggccgatggatggtgccaggctacaaggagaagtttggcgacttggctatggtttagacgaattgcgacgttccctttccgccttcgcgttgtgtactctagcattgtagataagagagaactgggggctgaacccaggttttcctcatacccaaaaaaaaaaaaaaattttccaatgtg

SEQ ID NO: 35809 - DNA, 1983 bp, Triticum aestivum
  Clone ID: PAT_TA_35809
atctttttttttcgaagtttccaacttccaacaggaactcagatgttgcgtataaagttttctagtaatgccaatgcaagctgctgcgataatggttttactgtccgccgggctgacccctcgcataaagagtaaacagccacaactggataacacaaagttttaaccagggttgcactgccgcaatcttggccagcaaaaaactgtcgttatgcgcagcttcagcaaagagaaagcagggaaaatcccccggaaaaatggtgttgcattgtcgctgcgctgccactagcttacacggtcaagagcttgatgaccgatgcattccccgatgcggtgaagggccacaatggactcaccagcgttgcaaaggcccatctccttggcgttcttcatggcaaacctcagtgcctcttccgtggcttcgctgtcaaacgccttggcagtgccagcactgagcatagggatcacgcccctcacgatgaggctttgcctggcaggcccctcgtcgctgcagatccagtcaaactcgaccgtcttgagctcaggaaccacgacagacagtatcggcatggatggcctgtacttggctacaagccttgcagttgttcctcccctggtcagtaccaagataagcgtcgccttggctgagttcgctgtgcggacagctgatgaggcaaggctctccaatgggctcatgggaatcggggctgatgacatgattgatttaaaaacagcagaatagtccacacatgactcggcctgcaagcagatcttggccatagtttgcactgccagttctggataagctccagccgctgtctcacccactgagcatgacacagtcagtgccatcaagaactgcattggcatcatccgttgcttcaactttcagtagggcgaggagactttatcatagactccaacatctgagttgcggtcataactggcttgccctgaatgttgcacttgaaaatcatcacctactgtgcataaaagaacttctctacaggaatttccatgtctaaatcaccactttacaccgtaaaagcattagactgtgacaggatatcgtcaaagttatctactccttcctggttctcaacctttgacatcagcattattgacttggcatgctccccaagtaccttcctgacctccacaagatctgaacctttgcggacaaacgacaaagcaatcatgtcaatcttgttcgggacaccccattgaaggatatcctccttgtccttttcagtgagtgttgggagatcaacaacgacccctggaagattgacattcttcctctcaccaagcatagcagtgttctcacaacagcagcgaacaagaccttgctctttgtcacaatgaagcacagtaagagtgatggtaccatcagcgcataatatgacactgcctggcttcagatcaactgctagcttcttatagctcatcgatatcatcttgtcgtccccctttatgctataatctgtggagatcacaatttcttggccctttctcaactggataggcttcccatctttcaaaaatccagtacggatctctggacccttggtgtcgagcatgacggcgcagaggatcccggtgcgctccatggcggcgtgcaggttgtcgagcgtctcctggtggtagtcgtgggagccgtgggagaagttgaagcgggcgacgcacatgccggcgcgcagcagcttctcgatcatgtcgacggagcgcgaggccggaccgagcgtgcagacgatcttggtcttgggccggcggcgcatcacggcgaggccgtactcccccgcctgcggctgcgacagctccccgttggacaccatggcttgtcggtcgccggatctgtctgcggccggggaggggaggggagggggtcggcgggggtggggattctttgggcgaggcgaggccgccgcggatgcgcccaagggatgggacggctcggttaaataaacggaacagtcggcaaga

SEQ ID NO: 35810 - DNA, 862 bp, Triticum aestivum
  Clone ID: PAT_TA_35810
gccggccgggtcgggaagcttcgcacctcaactctttgtcttcaaccgcaaagcaagtcatcatgtccattcgttcaatttccagccagctccttgtctcgactttggctttgagtagcctctgtcttggccaaaagaccggaaagttcaactttcttacctacaacgtagcaggtcttccagaaatcatcaatggcaatgatgttcctggtgacaagaagaccaactccaacctgatcggtactgcttttgccactcaaggattcgacattgtgcacatgcaggaagatttcaactaccacgcctacatctacgcaactgacaaccaccctcagcgaactcccacttctggcggtgtgccgttcggagatggtctcaacactgtggccaactacccatggtccaccttcagccgcaagaagtggaacaaatgcaacctgaactctggagactgcctcactcccaaaggcttcagcttcatgcgcatggctattggcggagtcgaagttgatctctacaaccttcatgccgatgctggatctgaccaaggcgatgttgatgctcgatcggctggtattgaccaggtccttgcctacatcaactccaactccaatggtcgggctgtgatcattggtggcgacacaaacgacagatggaccaacgctggacgaagccttaacaagctgacagacgctggtttcagcgatgcttgggtccagctcatccaaggtggtaagtatcccactgctggggctgccgcagacccatgcaaggttcctgccgcagacacaagtgcgagatcgtcgacaaggtttctaccgatctggcagctctgtcaagctcaatgctacttctttcacta

SEQ ID NO: 35811 - DNA, 441 bp, Triticum aestivum
  Clone ID: PAT_TA_35811
tccacaactaccgcgcaagtggtgcctgtaagcacgacgacacgcaggcgctggccagggcgtggaacgcggcgtgttcctcgtcccggccggccgtgctgctcgtccccaagggcaagacctacctgctcaagtccatcaccctctctggcccgtgcagatccagcatcgtcttcaaggtgaagggcacgctcatcgctcctccgagcatgtcggcgtggaccgacaacgataggaggcgctggatcttcctccagcgcatcaccggcctcaccgtcaatggtggcggcaccatcagcggcaacggtgagatctggtggaacaactcgtgcaagaccaacaaggctctgccgtgcaagggggctcccacggccctcacgtttcacctctgcaacaatctaaaggtggagaacctgaaacttggtaacagccaacaaatcc

SEQ ID NO: 35812 - DNA, 1332 bp, Triticum aestivum
  unsure (1)..(1332): unsure at all n locations
  Clone ID: PAT_TA_35812
aaagagctgctgcngagagagttcagcaagaagcaaggaagagagctgagcgagctgcggtggaaagagctgctgctgaggctcgacaaaggcaggcagcagcagctgcggcggcggcaaaagaaaaacacagcacaccaaatgatgttgagtccttctttcgtatggatgctcgagatactagtgcagcaaagcagagggccccaacaccaacagcggactctatgtttgattctcaaccacaagatagaggaacagttaatggatcacagagaacagcctctacctcggcctctaccagaaaaacaaacccaccatcagccacaaatatttttggcaatggtctatctgacttatttgaatttgaaagtacccgatcatcatctgacgcatttcaagatgttgagggggagagtgaagaaagaagacgtgctaggttagaacgtcatcagaggacccgtgagcgagcggcaaaagctttggctgagaagaatgaacgagatatgcaggttcagagggaacaagcagaaagagatagaattggtgcctcattagactttgaaattaagaggtgggctgctggaaaagagggcaacttgcgtgctttactatcaactctgcaatatatactttggccagagtgtggatggcaagctgtatccttgactgatttgattactggtgctgctgttaaaaagcagtacagaaaggcaacgttatgcatccatcctgataaggtgcaacagaagggtgcgactcttcaacagaaatatattgctgagaaggtctttgacatgctcaaggaggcatggaacaaattcaattctgaagagctgttttaagccatccctgtgaatgtacagccagcttttaactaagtgtacccacgtgaagccctggagcattaagatgcagccgatcttctttttggtgcagctccatcaaagttatcagtgtataataggttctgttcaaatgcagacttctgttctttgaggattactggccgtttgctttgggatgatacttttttatattatataccttggagggccaaagattacatgtatttcttcaacaccatttgtctatagtcagaccatagaaagtcgaaaccacagtttatgctttacttaagatcttacaagaaacagatgtacaattatgctttgccctttgattattctctcttgtactccacagtgtgcagttaaactataaattctcaactcgatcttcacttttgggcctcgcctgccccggggcgggccgctccgaaatcgaantccccgccggccgccaatgggcgggccngggaacaatngccaacgg

SEQ ID NO: 35813 - DNA, 2407 bp, Triticum aestivum
  Clone ID: PAT_TA_35813
acgagggcgagcaggattagcacaatctctctttgagcgccttgttatccttggagtcaagccattcaggctacaggtccaatatagaatgcacccttgtctttcagaatttccatccaactgtttttatgaaggcacactgcaaaatggggtaaccgcaaatgagagacagtcatctggaattgactttccttggcctgttccaaatcgaccgatgttcttctatgtgcagatgggagtagaagagataagtgctagtgggacatcttacctcaataggactgaagctgcaaatgtagagaaaattgtaactacattcttaagaagtggtgttgtgccaagccagatcggagttatcacaccttatgaagggcagagggcgtatatagtaaattatatgtcaaggaatggctctcttcgccaacagctttacaaggaaattgaggtggcaagtgtcgcctccttccagggaagaaagaaagattacattattctgtcttgtgttagaagcaatgaacaccagggtatcggctttcttaatgatccacgcaggttaaatgttgcattaactcgtgctaggtatggtatagtcgttcttgggaatcctaaagttctaagcaagcagcctctttggaatagtttgttgacacattacaaggagcatgagtgcttggtagaaggacctttgaacaatttgaagcagagtatggtgcaatttcaaaaaccaaaaaagatctacaatgatcggagactgttcctgggtggtggtcaaggtgttatgcagggatctgcctttggcactgtaggctcaggagataagagaagtggtaggggaaaaggacacccatttgttccatttgggccaccaaatggggctcacaaacctggtgtgcacccatcaggctatcctttagctcgcatgccttatcctccatttcctgggtctccacattctcaaccctacgcaattccaacccggggatccctgcatggacccattggagctgttccggcggtgcctcaacctgttaataggaactttggtgctcctcgtgcaaataccggtggccctattggtggtcaccttgctgcccatcagcagaactctcagcaagctatgggaagtgtggggccaacttataactttgctggtgatccgagcagtcagccttctggtggaggcctgatgtcccaatctggactgatggcacagatgcctgtcgaaggtctaagtcaaacaatccgtgatgggtttcctgttggtgggatgtctcaggacttctttggagatgatttcaagagccaaggatctcacgtagcatacaacattgcagatttttctactcaggcttctcaaggaggttatgctgttgaatatacacaagggccccaatctggatatcctgggaattatttgaaccaaagtgcacatccaggatacccccatatgggtgcaacaaatgacattgtatctcaggatcacatggcccatggttcacatggaatgtttacgcaagcgggatacaacgaccaatcacaagatgaatcttctcagatgcattatggactgggtgctcctggccatcttcagtcacagagcatgatgaatcctatgtactctcagtcatatgctcactataacactcaacctcagtctcttcagcctccaccgcagtgatcaagaaagcttgtcacataaggctgaagccgcattaagttttggaagtttcatgaatcacatccccttggcctgtggcatcttggttatgccttgctacagtattacgcagaagtgtttggtgctagacatcggttgcaagcaaagaggacaagcatattttgacacattggatgtttattgggtcaggcttgtacaagattggctgtggctatcgctggacaccgttgctaaggagcacaaggactgagatgtatctctccttacttaccgtggcaattttgcaatgggcttgacaacaacaggtcgtcacttgtgcattaagagaaagggtgtcgatgctacacccacatcccttcacctgtgtagaaggcaaatggggcttgtagtggtacaatgtgaatatgtgctgccatccgagtaagggtgggcagctattgcctgcctccatggtatcatgaagacgcctgttgattggccttgtatagaggtggtgtggctaacctcagatctcgcacatggatacttgccttaagaactatgtatgctttctatatagttttgatgttattattacagaaatgatgtaggtaatgttgcttggcaatagcttgtggttcttggtggaaagtgaggttttattgggctgttaaatcatatggtgtaactatggcttgattcagctatttaaggctgattggtgtgcggttgatttttaaaaaaaaaaaa

SEQ ID NO: 35814 - DNA, 848 bp, Triticum aestivum
  Clone ID: PAT_TA_35814
gccggccgggtcgggaatccgttcttcattgctcgactaactttccagcgtcgtcctcgccaaaccaccgccacaatgaccaagatcaacccctccgtcgcttcttctcgccgcaagagccgtgctgctcacttcaaggctccctctgaccagcgccgtgttatcatgagcgctcccctctccaaggagctccgtgagcagtacaacgtccgctctatccccatccgaaaggacgacgaggtcaccattgtccgtggttccaacaagggccgtgagggcaagatcacctccgtgtaccgtctcaagtacgttgtccatgtcgagcgtgtcacccgcgacaaggccaacggccagtccgttcccctgggcatccacccctccaactgtgtcatcaccaagctcaagcttgacaaggaccgtgaggacattctgcgccgctccaaggttggccgtgagctcgctgccaacaacaaggtcaccgcttaagcggatgattttgtcgagcaacaccaacaaaaaaccaacatttggaactttcaagacgacatgatcaaaccttccctcccaggcgaggacaaatcttttcttttttcaccactcacaatcacggcaccaatgtgagcaacatcaagggcaaaagttgatgaggaaatgggcataatactccggcgttttacgatacctgcgtgctttccttcggacggcgcggtacccggtctacagcagggtagatgaattgagaatttttagggttctcaatggccatttcactcactggtgaaatgctccatggggaggtttatccccgaagtcttgaaaaaaaaaaaaaaaaaaaaccctagggccgc

SEQ ID NO: 35815 - DNA, 607 bp, Triticum aestivum
  Clone ID: PAT_TA_35815
gagggcctacgtggggtggaagggacgccgtcgccgctgggcgcgtggacgccgtaccgggcgccggagcggagctgaacaaggcccgtctgcgcgtgcaatgcagagcacgcacgtgtaaaccgtgtggccgtgggagagagcctacgctgtagatacgcgtacgtgcaacgtagtaaaagagaatcatacgcacaccgtatctaggtatacgtatacggtgtggcgcatgctgatttgttatttgtttatttgttcgtttgtccattttggtgtcccctgaaatggacggctgcgatgtggactcatgagtgccgtgtggtggtgatttggtcggtggagactgagaggtcgatttgtacaatctcgactaataagcaaaggaattgctcgacttttgaaaaaaaaaaaaaaaaaaggcccctagtggacgccgtaccgggcgccggagcggcgctgaagcgcccgtctgcgcgtgcaatgtagagcacgcacgtgtaaaccgtgtggctgtgcgagagcctacgctgtagatacgcgtacgtgcatcgtagaatcatgcatacaccgtatgtaggtacgtatacggtgttgcgtatgctgattt

SEQ ID NO: 35816 - DNA, 948 bp, Triticum aestivum
  Clone ID: PAT_TA_35816
gaattcactaagtgattagcgtggtcgcggccgaggtagtgtcgagagttttttttttttttttattatctgtcaatgaatattctaatgggaatggaatttcataatactgaaagagaagagctagcaattcggaacgcaaattgcgttttaatacgtctcactattctaattttttagaagaaatggcctttattatttcttttttatggggttaataaatattaaccaaatttaatttaagaaatgagagaattcagaatagctacgagaaagactagtccaatccataatgatgtaccagaaaatacaacatttttattatttgaccaaccatcaggagaagcaaatacaaggggtacactaattactaagactgaggaagtcgcaattaatgcaaaaacagctaattggaaagcaatagtcatatttctaatcctccaagctaccatcaaataaagttgactacatatttgatccctcacttaaccaaaattgtaaaaaaatacaagaagtaggaggggtttaatcatgaatccattgattcttctctttaattcaaatttattacttaaaccgcttttttatttggatatgggggtgagaagagattatttactctttatttcacaagcgggtatagcggatcctgtatccgtgtatacagtatacagagatatatcgaaaaggaacttgtatctgatatctttctagaggctaataaatctttttattttttatatggctatgttctatttgtaggagtaaaataaggattaggctgtggagagatggctgagtggttgatagctccggtcttgaaaaccggtatagttctaggaactatcgagggttcgaatccctctctctccttttgcttattgaatacgtttgtttctttcatttttttacctgcccgggcggccgctcgaaatcactagtgaattc

SEQ ID NO: 35817 - DNA, 674 bp, Triticum aestivum
  Clone ID: PAT_TA_35817
gtgcgtgccgcgcgccggccttccactccatcccatttctgcatcttacccgcaacactgtcacgaaacttcaagttttcctaaagagacattatcttaaatttaccctacgccgccacttaaacgaccaccaagactctcaaatcaaccctcaatctcaacaattgtctcacttattccgtcatcatgaaggctacgtttttcatctctattatcgccgccactgttactctagtcaatgcagaccccgttggtatctcattgcccgaacctgaatgcccagccggccccacatcttgcgcagatatcatagggatgagtaatgaatgttacaatctcaatggcggagatgttgagtgctctgaaaaggccatctgcgaatgtccagaaggctgtcacttagtcgaagctccggacccagtgacataccctggtggagcctgtgtggtcatcgagtagacttgcacctgatgcaaattgcagcaaggtgcatatgagatgcaaggattttagtgcattaccaggaggaatataaatctagcaaacagagatatacgttaccctgtattaaattcacatgccaatcttccaaaaaaaaaaaaaaaaaaaaaaagggatgaaatgtcaggacggtacatgccgtagatcattgaatataaaatcttgggcgctac

SEQ ID NO: 35818 - DNA, 699 bp, Triticum aestivum
  unsure (1)..(699): unsure at all n locations
  Clone ID: PAT_TA_35818
tttacacctcgttgaagaatacatctcgacgacattgccaaaacccagcgtcgtgcagcccccctacaagcttgttgcaaagggagaagagagagacagaagaagaagaaagccaaggttgacgagatcgatggccgtcttgaggaggacgatgaagctcgctctgccgatgatcgtggcggcgttcctacttctggcggtgctcggcgaggcgcggccgctgggcggcgccgactgggcggccgcaggagggaccccgctgccgggcgcgtcgacgaccatggcccaggcgctccggcggctgtacacgcagcggctgaccgggcctggcgcctcgtgcaccaccaacagcccgaacgtcccctgcccgccgtagaggccgggcggccggcggcgcgactcggccgtcctccacgaccaccccttcctctctcgggtttttgacggaccagcccgggcggtggtggcgggctcacagtgttcgcatgttctttttccctagctaggacatggttggattgattgaattcgttggttggtttcttggagatctttttgttgcccgcgcgtgctcttcgccgggtgttgatttgtacagaagaaaagatactcgtatacttggtaggatctgttcatttgaataanacataggcaaggtgcaaaagtgcgccagcaacacatgtatattcctttctctat

SEQ ID NO: 35819 - DNA, 831 bp, Triticum aestivum
  Clone ID: PAT_TA_35819
cggccgctcgggcgggccggccgctaccacctcgtcgaagattacatctcgacgacattgccaaaacccagcgtcgtgcagcccccctacaagcttgttctaaagggagaagaaggaagccaaggttgacgaggtcgatggccgtcgcgaggaggacgatgaggctcgccgtgccggtgctcgtggcggcgctgctgcttctggcggtcctcggcgaggcggcgcggccgctgggcggcgccgactgggcggccgccggagggaccccgctgccgggcgcgtcggaccatggcccaggcgctccggcggctgttcacgcagcggctgggcgggccgggcgcctcctgcaccaccaacagcccgaacaacccctgcccgccgtagaggtcgacgccggcggcgcgactcggccgtcctccacgaccaacccctgctctctcgggttcaaacttgtttttcacggaccaacccgggcggcggtggcgggctcacagtgttcgcatgttctttttccctagctaggtaggccggccgactagccgccggcgaccgacaaggttggattgattgaattcgttggttggtttcttggagatttttttgttgcccgcgcgtgcttttcgccgggtgttgatttgtacagaagaaaagatactcgtatactactcctggtaggatctgttcgtttgaataaacataggcaacctgcgaaagtgtaccagcaacacatgtatatacctttctcagtaaagtgttatattttgtgatccaaaaacaaatcaaaaggcccctaagttatgcactctaactcaaaagaaaaagcagttttat

SEQ ID NO: 35820 - DNA, 706 bp, Triticum aestivum
  Clone ID: PAT_TA_35820
gacgcacccaacgcaggcgggcgcgcgaagcccggactcgcagctcttccagctcctcgccgaatctctgtagcggggggggttcacgatggcgggggaggggatgccggactcgcagctctttcagctcctcgccgacgttctgcaggaggtggagtcaatgagcaaccaggaagaggtagaattgagagcaaagattgaagcgctgggcctagaagtcactaaggttccagagaaggcacctaagcaacttgatgagttagagatagccgcagagctggacaggttgtcggcaaggctcgataatgtcgacaagatgatatcatctgccatgacatctgacccagaggtgaaatcgcttctgagcagcaccgccgatgtctggatgcccgtcatcaccgcgtctgctgatgaaaggcgagggtttgcggaaacaagcggtgacaaggaagagcaagagaaatctaagtaaatagcttggactgaagcccttgtactcctttgtgccagccttgttcagcattttccttgcacgagtatatgttcatagctatgtatcaaatgttcttttgggcaataacagaaaataaaaacacatgctgttcatgtacttctattctaatttgtgtgatggttgaggtaataaaagtctgccaagcattgtgtcaaaaaaaaaaaaaaaaaataaaaaaaaaaaaagcggccg

SEQ ID NO: 35821 - DNA, 759 bp, Triticum aestivum
  Clone ID: PAT_TA_35821
atcgcattcggccgaccgtcatatggctagtgatgcgcccgaaaagactgcagagcagacccctcctgcgccagaggttccttctgaggaagcgcctccagcaccgacagtccccgaatcgcgattgccgacccgcaaggatgtctccctacgagagttcttgaacaagatggacgactatgcacctattatccctgatgcagtcaccaattactacatgaccaaagctggtcttccaccacctccacagactgatcctcgtctcgcgcgactgctcgccctcgcgacgcagaagttcatcgcagacatcgccgcagacgcctaccagtacagccggatccgcgcatcgtcaaacaccaataatcctatgggctctcttggtgcggctgctggattccccattcctggacaaccaacgggtcagcctggaagtaaggaccagaccaaaggcgcgccccttggtatccagcgaccgggttacggcggtggtggccagggtggcagccagaacagaaccgtccttacgatggaggatctgggtatggctgtcggagagtacggcgttaacgtcaagcgaagcgagttctatcgctaggttatgtttcttaactacgtgggtgcttgattgcaaggcgttacggtatggcgttcacggaaggacctgggtccataaatgatatcaggatcaccaccagcagaatcagaactggttgcaatagatcgcctttcaatgtgtatcgatcgatccctttgttgaaa

SEQ ID NO: 35822 - DNA, 1194 bp, Triticum aestivum
  Clone ID: PAT_TA_35822
gtttctgagatctttgacgcaacaccacaatcctcttcgccgtcactctcccaagccatcccttcgtcaatccagacaagagaacaaatccgtcaagatggctccctccaacctgccctccgtcatgaacgccaccagccaggacatcgagaccctgctggccgctcagtgccacctcggctccaagaacctccaggttcacatggagaactacctctggaagacccgtcaggatggtgtcaacgtcatcaacgtcggcaagacctgggagaagattgtcctggccgcccgtgtcatcgctgccattgacaaccccgccgacatctgtgtcatctctgcccgtccctacggtcagcgtgctgtcctcaagttcgccgcccacactggtgccactgccattgctggtcgcttcacccccggttctttcaccaactacatcacccgatctttcaaggagccccgtctgatcatcgtcaccgacccccgaaccgacgcccaggccatcaaggaagcttcttacgtcaacatccccgtcattgccctcgccgacactgactctcccaccgagtacgtcgatgttgccatccccaccaacaacaagggtcgccacgctatcggtgccgtctggtggatgctcgcccgtgaggtcctccgcctccgcggtaccatctacaaccgcgagaccccctgggacgtcatggtcgatctttacttctaccgtgaccccgaggctgaggccgaggacaaggtcgaggaggagaaggtccccggcgctgacgaggagggccctgccgccatcgagtccggcttccaggcctccgctggtgctgactgggaggctcccgcctctggcttcgccggtgcttctggcgctgctggcgctcctggctgggacggcgctgccggtgaggagtggggtgctgcccccgctaacaccgagtgggctgcttccgccgagccccccaaggagtctcagtggtagggtactgaggcccaagagggttccggcgctcaagttcctgaggcgattgaatggtaaagaaatcaaaaaagaggataccaaaaaaattcaaacgagtgaatttgacacaaggtcctggaatgggagagcagaaaaagcattgaaggatgtgtggatgttgtggttcaatcaaactattcgacaaacaaaaaaaaaaaaaaaaaaggccccta

SEQ ID NO: 35823 - DNA, 1855 bp, Triticum aestivum
  Clone ID: PAT_TA_35823
cgtccgcccgcgcgtcagaaatctcatcactgctccccagtcccttccgccatggcgatctgcaaggtctggatctcgctgctgctcgcgctcgccgtcgtcctgtccgccccggcggccagggcggaggaggctgccgccgccgaggaggccgccgcggcccccgaggcagtgctcaccctgcacgccgacaacttcgacgacgccatcgccaagcaccccttcatcctcgtcgagttctacgccccatggtgtggacactgcaagagcttggcacctgagtatgagaaggcggcccaactgttgagcaagcacgacccagcgattgttctcgctaaagttgatgccaacgatgagaagaacaagccgcttgcgggcaagtacgaggtccagggcttccctaccctcaagatcttcaggaacggaggaaagaacattcaggaatacaagggccccagggaggctgagggaattgttgagtacttgaagaagcaggttggccctgcttccaaggagatcaaggcgcctgaagatgccacttacctcgaagacggcaagatccacattgttggtgtcttcacggaattcagcggcactgaatttacaaacttccttgagcttgctgagaagctgcggtctgattatgactttggccacaccgtgcatgccaaccatctcccacgtggtgatgcagcagtggagaggccattggttaggctattcaagccatttgatgagctcgttgttgacagcaaggattttgatgtttctgctttggagaaattcattgatgctagcagcaccccgaaagttgttacttttgacaagaaccctgacaaccatccttacctcttgaaatactttcagagcaatgctcccaaggccatgctctttttgaacttctccactggaccgtttgagtccttcaaatcagcctactatggtgctgtagaggagttcagtggcaaggatgtgaagttccttattggtgacattgaagcgagccaaggcgccttccagtactttggcctgaaagaggatcaggcaccacttatcctcattcaagacagtgactcgaagaagtttttgaaggaacaggttgaggctggccaaattgttgcttggttgaaggattactttgatggcaaattgacaccattcaggaagtccgagcctattcctgaggccaacaatgagcctgtgaaggtagttgtggctgacaacattcacgacgtggtcttcaaatctggcaaaaatgttcttatcgagttctatgcaccctggtgcggacactgcaagaagctagcacccatcctcgacgaggcagctgccacccttcaaagcgaagaggacgttgtgattgccaagatagacgctaccgcgaatgacgttcccggcgagtttgatgtccagggttaccccaccctctacttcgtcactcctagcgggaagaaggtctcgtatgagggcggcaggacggccgacgagattgtcgactacatcaagaagaacaaggagactgccgggcaggcggcagcggcggcgaccgagaaggcagctgaaccggctgccaccgagcctctgaaggacgagctctgagcatcagtcttgctagcagcagacaggtagaggagggggaaacatgttttggcaaggcagcttccaacgccagattttgcgagggggggacgagagttggttgttggttgtgttggccccggttttgcctgatactgtttcccgttgcgagaaatactgtaacaaatccatcagtggtgtacctagttaaattatcgagaagtgacattagaaatggtctgtggagagctttggtaaaaaaaaaaaaaaaaaaaaa

SEQ ID NO: 35824 - DNA, 2417 bp, Triticum aestivum
  unsure (1)..(2417): unsure at all n locations
  Clone ID: PAT_TA_35824
gaacacccgtccaccttgaagaccttgagaaatctcatcactgctccccagtcccttccgccatggcgatctccaaggtctggatctcgctgctgctcgcgctcgccgtcgtcctgtccgcccaaacggcatcactgctccccactcccttccgccatggcgccctccaaggcctggatctcgctgctgctcgcgctcgcgcgtcgccctgtcggcgccgtcggccagggcccaggaggccgcggcgagcgcggagccggctgcggcggacgcggccgtggccacccagcacgccgacaacttgcacgccgacatctccaagcaccccttcatcctcgtcgagttctacgccctatggtgtggacactgaaagagcctggcacctgagtatgaggaaggcggcccaactgttgagcaagcacgacccagcagattctccttgctaaaggttgatcccaacgattgatgaagaacaaggccgcttagcaggcaacgtacgagggtccagggcttccctaaccctcaacgtatcttccaaggaactgggggagaaagaaacatcccatgcgaatacaacgggccccagggaggctgaggggaattgtcgagtacttgaagaagcaggttggccctgcttccaaggagatcaaggcacctgaagatgccacttaccttgaagacggcaagatccacattgttggtgttttcactgaattcagcggcactgagtttacaaacttccttgaggttgctgagaagctgaggtctgattatgactttggccacaccgtgcatgccaaccatctcccacgtggtgatgcagcagtggagaggccattggttaggctattcaagccatttgatgagctcgttgttgacagcaaggattttgatgtttctgctttggagaaattcattgatgctagcagcaccccgaaagttgttacttttgacaagaaccctgacaaccatccttacctcctgaaattcttccagaccaatgctcccaaggccatgctctttttgaacttctccactggaccgtttgagtccttcaaatcagcctactatggtgctgtagaggagttcagtggcaaggatgtgaagttccttattggtgacattgaagcgagccaaggcgctttccagtacttcgggctgaaagaggatcaggcaccactgatcctcattcaaggccaagtgactcgaagaagtttttgaaggaacaggttgagagctggccaaattgttgcttggttgaaggattacgttaggtaggcaaatatcgacaccattcaggaagtctgagcctattccttcaggccaacaatgagcctgttaaggtagttgagactgacaacgttcacgacgtcgtcttcaaagctggcaaaaatgtacttgtttacgttctctgcaccctggggcggacactgccagaaagctagcacccatctcgacgaggcagctgccacccttcaaagtgaagaggacgttgtgatcgcgaagatggacgcgaccgcgaatcgacgtgcccggtggagttcgatggtccagggttaccgccaccctctacttcgtaactctcccagcgggaaagaaggtatccgcacgagggcggcaggacggccgacgagatcgtagactacatcaagaagaacaaggagactgctgggcaggcggctgcggcggacaccgagaaggcggcggaaccggctgccaccgagcctctgaaggacgagctctgagcatcggtctgtctagcagcagacaggtagaggagggggaaacatgttttggcaaggcagcttccaacgccagattttgcgagggggggacgagagttggtcgttggatgtgttggccccggttttgcctgattctgtatcccgttgcgagaaatactgtaacaaatccgtcagtggtgtacctagttaaattatcttcaagtgacagtagaaatggttcgtggagagctttggtaataaatggcgcttctgtgcttggtagaataaaaaaaaaaaaaaaaaaaaaaaaaaaaaaaaaaaaaaaacctgccagggcgcccgctcgaaatcactagtgaattcctggctcccggccctaaacccaacttctcttggaccaagacagtttttagacccaaagacaacttctcttagatcaagacacatagtaatttacgcacattaattctttcattttattcataatgcactctctcactgcatgcagccaaagataacttctcttagncgnntcgcccccccccccccccccctccnttcgatttcgattggaatcggagccagctccgctgcctgattagccggccggccccggccccgtctccgtccccatggcgtccaggcggatcctcaaggagctcaaggacctgcagagggatccccccacctcct

SEQ ID NO: 35825 - DNA, 1256 bp, Triticum aestivum
  unsure (1)..(1256): unsure at all n locations
  Clone ID: PAT_TA_35825
agttaactctatttaagtaatcacatccaaaatgaagctgcaatctcttgttactcttgccgcctccggccttgttgccgctcagagccgtcccaacctgaccgcggccattgagtctgagaactctaccctctcctcgcttggtggcttatcgccggtcagcccagccttcttcgagaccttggccgtcttcgaaatgtcaccatcttggccccaagcaatgatgccctcgaggagctcctcaaggacaccagcattgctcgcatggtcgacaacaaccccagctatgtcgccaatcttttgtcttaccacatcctgaacggcacctactatgccagcaacatcacggacatggacatggctgcttttattcctacccacttgaccaactcgacatacaccaatgtcacaagcggacagcgcgtggaggccatggccatgaacgacactgtcagcttctacagtggtttccgcgctcagtccaatgtcaccaaggctgatctcaacttcactggaggtgtcatccacatcatcaaccgtgttcttagtgtccctcagaacctctccgacacggccatcgccgccaacctctccgccgctgctggcgcccttacagaagccaaggttgttactaaccttaccgctgagaagaacgtcactgtctttgttcccaacaacagtgcgttcgccaagattggctctgttctcgccaatgccagcgagtctgacgtcgccgatattcttgcctaccatgttgtcaacggcactgttggctacagcagcgacctcaagaacggtaccctcactgcttccgatggcacaaagctcaacattgctatctacaacggcactgtctttgtcaacgaggccaaggtcattgtccctgatgtcctcatcgccaacggtgttgtccacgttatcgatggtgttctcaaccctgacaagccctctgctactgccaaccctactgctagcacacaagaggctgccttctctggcgccagctctgttagcgacgttcccttcacctccggtgtccccgagggtactgctcaggccactggtctgtctccctccacttcaactgaaggtgctactcaggctactgctgccattgcgctcggtgcgctgtttggtggtgctgctctcatcatgaacgcttaagctgtagttagntgtaattaagttaattggctagggattaatggtcgttgatagtaatggtgcattaaatgaataaacatgatttgaatcct

SEQ ID NO: 35826 - DNA, 876 bp, Triticum aestivum
  Clone ID: PAT_TA_35826
actacaatcaacgacgccaacgaaacgtaacgacgactctttttctcttctgcacaatacacaccaccacttctttttactacaattaatactcactcacatttaatacgtcgttatcatgtggatcgtgaactggttctacgatgtgctgtcctccttgggcctgctcaacaagcacgccaagttgcttttcctcggtctcgacaacgccggaaagactactcttcttcacatgctgaagaacgaccgtgttgccattctccagcccactcttcaccccacatccgaggagcttgctattggtaacgttcgcttcaccactttcgatctgggtggccatcaacaagctcgacgtatctggcgcgactacttccccgaggtcaacggtgtcgtcttccttatcgacgccaaggaccacgagcgattcggcgaggccaaggccgagctcgacgccctcctctccatggaagagctgtctaaggttccctttgttatcctcggcaacaagatcgaccaccccgatgccgtctccgaggacgagatgcgacaccagcttggcctctaccagacaaccggcaagggcaaggttcagctcgagggcatccgacctattgagctcttcatgtgctcagtagttatgcgccaaggttacggtgacggtatacgctggttgtcacagtacgtttaagggaggctgaaggggatgcgggtggctagagactacatcttacgttacgttacgtcctggtcgatggaagaaagaagacatgtgactattcaatgtttttgagattcagaaattctccgttgggcgaacaaaggctgtgcaattcaactacaacattttgctaaaaaaaaaaaaaaaaaaggccccta

SEQ ID NO: 35827 - DNA, 534 bp, Triticum aestivum
  Clone ID: PAT_TA_35827
cggcctccagttctgaaagacggcagctgggtcgacgtgcccgtgctgggcgacggccgacaccagctgctggtcgtggtcggcgacgagatggagatcatgagcaacgcggcgttcagggcgccggtacaccgggtgatggcgccgggggaggaggcggagcgggtgtccctcgcgccgttttaccagccggagccggacaaggtgctcgagccgtcgcccgagctgatcgacggggaccggccggcgatgtacaaaaagctccaggccaaggtcttcgccgacggcttctgggacgcgttcgcgctcggggaacgcaccatcgacttcctcaaggtcaaggtcgacgccgtcgatccgccggcggcggccgtttccggcgcttgatttacctgttgtccatgtatcgatcgttcccagttccatgggggcggcatcaatactatcaataataaatcaatcaatgagtgttgattttatttgtgtaatttactcaatgaaaaaaatagcgtgctacaccaaaaaaaaaaaaaa

SEQ ID NO: 35828 - DNA, 754 bp, Triticum aestivum
  Clone ID: PAT_TA_35828
ctgtgcggcgctcgagaggcaccaccgctcctcaacctcctccgtccgctcgcagctcgaaccaaggagagaccgtcagccatgtccggccgcggcaagggaggcaaggggctcggcaagggcggcgccaagcgccaccggaaggtgcttccccaccgctcctcgacccccatcctctcgcggctcgaaccaagaagagatcttcagccatgtcggggcgcggcaagggaggcaaggggctcggcaagggcggcgccaagcgccacaggaaggtgctgcgcgacaacatccagggcatcaccaagcccgccatccggcgcctggcgaggaggggcggcgtgaagcgcatctccggcctcatctacgaggagacccgcggcgtgctcaagatcttcctcgagaacgtcatccgcgacgccgtcacctacaccgagcacgcccgccgcaagactgtcaccgccatggacgtcgtctacgccctcaagcgccagggtcgcaccctctacggcttcggcggctaggctcttccttgcccccttgcagatcccaaaagtttgatgataccgcgacttgtgtagttctctacttcctctgtagttcgctatttcctctgtatttcgaactgaatcgtggagcaaacctattcgcagtttgttagaattcaaacttgtctaagtgagataccgtgcctctgattttgtcctgctgcatctctgttaatgtgaaagtgttctgtattaaaaaaaaaaaccta

SEQ ID NO: 35829 - DNA, 623 bp, Triticum aestivum
  Clone ID: PAT_TA_35829
gccggccgggttccgcgaccccaacgccgccaagctcaaggctggtatggtcgctcacgtcaagaagtgggtctcccagggcatccccattgacggtatcggttctcagacccatctcgaccccggtgccgccaacggtgtccaggctgctctccagcagatggcttccactggtgtcaaggaggttgccatcactgagcttgacatccgctctgcccctgctgccgactacgctaccgttaccaaggcttgccttaacgttcccaagtgtgtcggtattactgtctggggtgtctctgacaaggactcttggcgcaaggagaaggacagccttctcttcaacgctcagtaccaggctaagcccgcttacaccgctgttgtcaacgctctccgttaagcgtagagtgacatagagggggtatccttcagaaaagatctcattgcgggtcttgaggttgttggaagcacagggggcctcatagccacatttttggcttcattgcacatatcttatctcttacatacttattttgcttttgtataaatattgagatggtagctgtctggtacatggttatttgttagtatagctggatcaacggttaaatacatatttaccatcg

SEQ ID NO: 35830 - DNA, 396 bp, Triticum aestivum
  Clone ID: PAT_TA_35830
catttcatcgaaaaaatgatatgtcgagaaagatgatagaggtgaggaggagtggggcgtggtggtgactggtggtcggactgggcggaggcatggggatggacggcgccggcagcggccaccatgccagattgttccagagacttccttttgtaattgctcagcaatgaggttgtgggagataaggatgaacgaggcaaggccttatctgtaaatgtggagagaggagcgggtatcttttgtaaatttgtcatagtttgctttctatccgtcagatatagatcggacaatctatattataagatggcaggcgcaccatcatcaccaactcggttttttctctactcctactcctataaaagactcagttggtgatgatggtgtgtctgccatccg

SEQ ID NO: 35831 - DNA, 460 bp, Triticum aestivum
  Clone ID: PAT_TA_35831
cgggtccacaagttacagctgatgtgaatgatgccgaaatagtttcagtatgccatgcaggcaaagaaaaccaagtcaattcattgcaaaacatgttggctgcaccatcgtcgagttttccagtcaatggccattcttctaatggcagtactgaaaaaactgatatgacatgcctctttggtcccaaaacaaaaactgaaagactcgagtatttaaccccagtgtcaaagcacagaagcttacccagctgtagcaatgatcggaccagtcagcacagcttttctttctcgaaaggacatggtttagagagaaagaaaatcaagccgctatggacttcaacaaaaccaactgcagctgatgtcagtgacaaatttcggactaaaataattgcgagataatccacgaaagagaagccatgcgagcagaatacggttgcatcaaactcttgtaacactgacag

SEQ ID NO: 35832 - DNA, 432 bp, Triticum aestivum
  Clone ID: PAT_TA_35832
ccgaaaacaaataataaacttcaacataacaaactttgggggccacattcatttgcaggaattttgcaggcaaggaaaatgggaaaaattcctacaaaacagagggccaatatgtcacttactcggcacatgatgagaaatttctgtgcacttcaaactactccctccgtctcaaaatataaaaacatttttgacactttgcaagtgtaaaaaacgttcttatattttgagacggagggagtacaatacaaatagtttggatttatctttccatgctttgttgccaacttcattaagaaaaagtactccccaattaaaaatgggtaagtaacgtttccttttgattttgtagggtattttctcctgtagttgaattccttttcttctctcgatacatactccatatgcaagatcgggagaaaactgcaccgc

SEQ ID NO: 35833 - DNA, 751 bp, Triticum aestivum
  unsure (1)..(751): unsure at all n locations
  Clone ID: PAT_TA_35833
gttatttaattcnatnaaaaanggttcttnttntttnggcccctgcnaaaaaaaaaaaaaaaaaaaaactngagnntnagntcttgcaagagtttagatggtnacatgcactgggccccccgtgccaaaaagtcatcttaaatgcgatagccccttcgcttaaaacagtggatgtttgaggttgttgggaagggtcaattcaaagatgaattttgtgacagctggaggtgttccacttttcagagatatcgcttagcaccatggaaagcaagaagcagcccaatctgttctttgcaggagaggtacttaacgtcgacggggtcacgggcggattcaattttcagaatgcatggactggtgggtatatagctgggacaagcattggcacattggcatcaaacagcattctcaaagaagagcaagcctgtttgcaactacaaggatcttaaggacatgtatgaaatcatgacaaggagggattcaaggattcttagttcttactggctgagtaactttgtaaaaacttgagagtgtagcttagctgctagtccacagtattgtagctaaaaaacaagcaaagataaccaagattcacatcgagtaactgtatcgtcgtcttgtagcgacaattttgtaatggagtaagatcctagttgagcaacttgtgaatccttgtaaacttggcagtaagaatcagaagatcaatatacccagtgcattcattgctaaaaaaaactcgagacctcgtgcc

SEQ ID NO: 35834 - DNA, 1054 bp, Triticum aestivum
  Clone ID: PAT_TA_35834
gcctcgtgccgattcggcacgagggtcgtcttcccaaaggctccaaccctagccacctttcctcggcatcctccccccaagccggcggcggccccggcggccgtaccgcctgtgaagatgtcgggaggcttcttccgggggacgtcggccgaccaggacaccagattctccaacaagcatgccaagctgctcaagacgcagaagttcgcgtccgagcttgaccatcaggtggacatgtcaaaggtgaagatggacgtgatgaagccgtggattgccacacgggtcaccgagcttcttgggttcgaggacgaagtgcttatcaacttcatctatggcctgctcgatgcgaaggaggtggacgggaggtactcgccgcgccggctgacagggttcatggagaagaacacaataaagttcatgagggagctgtggagcctccttctcagtgcgcagcagaatgctagtggtgtgccccagcaatttttggatgcaaaggaggctgagattcagcagagaaaggcggaagaggctagaattgcccaggaaatccagaagaagcgagagaaagatggaagggacacggaactagataaacgcaaaatgatggccggggatactggtaattcaagatttcatggtgattcacttggctctgctttaaacaatcccactgtttatgctgacaaagaataggaactggacttgaagcatagctcgagaacaaagagccgggaacatcgaacacctaggagcacatctttggcgccccctcgtgggctccggtcgactccgccgaccacgcgctctccgtcccctgccagaccatgctccttgccacgctcagcttctccttgtcggtctgctcccccccgttggctttccccatgtattgctccctcagtggctcggcgggggtcaccggctgccagccgtcctccccccccaccctgatcgccttctcctcggccgagtggccccattaggagaagatctccaccacctgggcgacgtagatcaccatctccttatcgtcgtcggtccccagctcgcgcac

SEQ ID NO: 35835 - DNA, 214 bp, Triticum aestivum
  Clone ID: PAT_TA_35835
aggttggcggggtcactgttgttggcgggatatcggactgagtcaccggcgaggtgttgtgcgttgttgggcatcggggaggagagagagagggtttagggaaacttgcccacaggtactcaaatttgagcaggttcgaatggtttgaaaagtttcttctcaaatttttgaggtctaaagggaaaaacataaattcaatcataaaaagtaaaaa

SEQ ID NO: 35836 - DNA, 423 bp, Triticum aestivum
  Clone ID: PAT_TA_35836
cactagaaaataatcaaagtgcccgtactgcaacaatggagaaggttagtgatgggtcatggacaaagaacaaccccggcaagtatttctacaagtgcaagcatcactggactaggaggtgtaaattctgttaatgggaagcggtgtacatcaagaagtgctttgtgcaaggtggcctaagctgttcatccatgccgacaacttgcccaagaataataaggcgcctctcaatgtcccctcctcatcgttgggattctcagcccagccgttgttctgtacccctgcatcaggctacatggaatatgctaatttagggatctgtgaagctaatcccctagatgttccctaactatctatccaggaagtttagtacctgccatatatgtgtgttaccagggatttcctttaccaagaatctgccgg

SEQ ID NO: 35837 - DNA, 1305 bp, Triticum aestivum
  unsure (1)..(1305): unsure at all n locations
  Clone ID: PAT_TA_35837
tcggccccgactccgtcctcctccgcggcgccggcgagggcgccgctgcccaggggatcgacggcatcatgggcaaactcagtatggaaagcggcagcgatgcctcttccattaaccgcgtgctctccagctccggcatagacccctacatcagaaacctcatggtgctcggactcgggttccggcgctcccggtccaacatcaagcaggcgctcaagcggcatgacgatgacagcgaatggtggatgtgccctgccattccattgaaggacattatgccggcgcctcccccatcgatggaaccaccaccgccggtggagaagaagaagaagaagactaagaagaaggcgttgaaggacattgccgctgggccgtgcattacatgtgttaaggaggaaattcctgaccctgcttatggggatgatggaatttttggaccgaaggcgcccaagacaggattgggcctgagcctcaacactgaggaggtgctgaaggcgtggtatgacagaggctccgtgttcgctgacggcaacatacctgatgcatcatccactgatgggctggctaaactttcagacattgaactgtttctagagaatggtgctgctggtgctatcagggaaggcagcatacagaaattgaagcacaagcagaagcagtgcactcccctcctctcaaataagactcggtaccaagcacggaaggtgcacgccgagtctcgtcctcgggtcaaggggaggtttgtcagccaggcggctcttctgcagaaagccgcggagaaagagacctaggggaggacgttcttgctcccatgaacattctgtcttgggatttcatttcattccccctagaagtgaagcagatgagggcttcttttcttttctgcacttatgtgatcatgtagagagggtagagattgcctgtagagtggcttctttgtcaggggatagctgctggttagtttcccagctcagatgctgccggggcaaagaaggccgtaagccaaaaacttcgtaacaatggtacagtgctgtggcaatgaccaaagtgcttctgtactttgcttcagtcttatgctctgaactctctgaaggaactgcaccgggtgctagttttgtacaaaactgaacctgcaaaatttgttaaacttcagggagcatttgattcgcaagaattctaaagcatgtgaatagaaagaaagaaaaagtaggattagaatgtcatgtatgaatnccttggtnctgcaatactcggaggaaaaagcaaggcaagatgtttgagaagtaggcattggnaatgttatgt

SEQ ID NO: 35838 - DNA, 1103 bp, Triticum aestivum
  Clone ID: PAT_TA_35838
ctgaaaccatggcttcatatcagtgagcaagtgcatgaggtgaatcgtatgaatatcctcgacctaatgagcatggatcctgattccccattcttcgcatcagataatttcaaggctggtgtacttctgtctgtggctgaatgtttgaggggctttgtaattatacatgaagggctctgctcttttccagaaatcttcatgccagtttcttctctgctgcaacaaattatggaaaaatccgagttgcctgccctgttacaagaaattttccaagatgtcatcgacttgattaagaagaaaagtgacgaacaccatgcttcaagagagccgctccaaatgcgaaagcagaagcctgaaccaatcaagcagctggctccccaatttgaggagaattacgtaaagggtcttgattacgatcctgaccgagaaagggcacgcctgaagaagctggcgaaacaagtgaagagcgagaagagaggtgcgatgtccgagcttcgcaaagatagttatttcatggctgctgtgaaacagaaggagagggcgagacacgagcaagagaggtctgaaaagtatggcaaagcaatggcttttcttcaagaacaagaaagcgcttttaaatgcgggcagatgggaaaaggcaaaaaaaggaggaggtgatgatatgctgatcatgttgctatcacagtccagtttgcgctgggtattggagatagaaaattaggcatgcacctggtgaccctggcatgccccgctttaactgcctttgccacttccatgtcgaagacacgccggaaagagtaatcatgtcgcaaacgctgatgtggatggacgcgttatgtttcttgcacttgagaatgagttgctccggagtgctgtactcgtgcaatagtagtaatctgatgtagcgcaggagcgattttgttcgctttttttgtcctgatttcttgtatgcagtgttactcttcagacgtatccgaaccaacagtcctgttcatcttgtcgcttttcccaaattaatgggaagacatcctacactgcaatttaatcattggtgacatactggtcaatgtcactttgggtgcccaaaaaaaaaaaaaaaaaaa

SEQ ID NO: 35839 - DNA, 850 bp, Triticum aestivum
  Clone ID: PAT_TA_35839
cgaactcgtcacgcgtggccaccccgcggagccaccgctccctctcgccggcgccgacacatgggccaggccctgcgccgcgcctcggggcgcctgaggcctccgcccccggcgaggcccccacccgctcaccctcccccgcctccaccacgggccgcaccggcggccgctgctggcagcggcggaagtcctccccaggacctgctcgacgtgtcacaggatgctgttacaccatcaacaaaagaggcccatggtgtacttgtagaacgtgatccaagttatgatgacatgcttaagcacatggttgggagaatcaccactaagcctggaggaaagcccgaaatgggtgaagcttccgtcgtagagcgatacaacaggccgcttcctaaggtgagaacatccgaacccgaacccgggcagagcaggcagctacctccaggaaccctgaacgtcgggcacatccaggagatcatccagctgtaccaaggaaagtccggtagccagcacggcccgatgagcgtggaccagatcgcctcgaggttcagagtcgaagcctccgtggtccatggaatcgtgcagtttgtctcgttgccgcaggatgaaggcaccgaaaagaaagacgaacggcgggacctttgagcggttctgtcatcatggtggagattgttcatgctcccaaaatgagttgcgtagaggacaactggacagacaagtttcttcgtagtgttttcgtaggtatctttcttcttgttgttgctgctgctgagctgaaagcctgagatggtgatggaaactggaaaccgtacattgccgtgttgcctaaataaagatgatcgctgagttttacgtg

SEQ ID NO: 35840 - DNA, 429 bp, Triticum aestivum
  unsure (1)..(429): unsure at all n locations
  Clone ID: PAT_TA_35840
ggnctgcaggnaattcggcacgaggcggacgacgacttctacagcggcggggaggctgggcttgccgccagcgatgacggcgacgccgactacgacttcgccgaccacgactccgacgactctcccgagctcctctctcaccggcagcagcaaaattactgcatattgagtgaagctggtataaagcagcggcaagaggatgacataaatagggtttcaactgttctctcaatttcaaagtcggaagcatgtgctcttcttcgcagctataactggagtgttagtaaggtgcatgatgaatggttcgttgatgaagaacgtgttcgcaaggttgttggttttccggagaagcgcattgaaatgccaaatgacagagaactggcatgcggaatttgtttcgaaaattgcccctatgcatcaatgagtgct

SEQ ID NO: 35841 - DNA, 712 bp, Triticum aestivum
  unsure (1)..(712): unsure at all n locations
  Clone ID: PAT_TA_35841
tgtgggtaagacaggatttgacttcgccatacgaactccttgtacaccatctagatgggaggaataccaggaagaaatgaccgcagcttgggaggccatttgcgaggcgtattgtagcgacccaaaccctacgcgtgactccaatgcacttgatgctgtgaaggcggcaatattacgcatgacatattactggtacaacttcatgccactctcgagaggatcatcggttgtaggttatgtggtgctgctcggcttgttcctggcagcaagcatggatgtgacagcaagcatcccgccaggcgttcaggtcgactgggaggcgatcctgtccccagatcctgggcacatttgtggacgccgttaagccctggctgtacccatctgtaaaaatgagcaagagcctgaaagattatgcggatgtcagcgttgctttccggcacgacaggatcggtcgtagcggccttgacttctgccgacacataagttatgaatgggttcacaaatgatacaggttgctttggttgtttcaattatttcctttgtttcaccttgcataaatcctagcagtgcagtttgcttccgacttgcagtttaaattatatgctgcaatgttgtaacttgaacaataacctttttttccttccgttgggtccttgaantntacaaaaagntnganattctaccaagggggttatatccattntncaaaaaa

SEQ ID NO: 35842 - DNA, 403 bp, Triticum aestivum
  Clone ID: PAT_TA_35842
gacgacagaagggacacacaacaggagacaaaaggggaacgccggagggcataggagcgccggattgcgaaacggacaacggggaaaatgctcggatgcatgagacgaacacgtatgcaatgcaatgcacatgatgacatgataaaatgcaacacacaagcaaatgacatggcaatggcagcgaataactggcggacacctggcgcgtcggatccggggcgttacaacactcctccactaacaagagatcttgtcccgagatcttaggaccgagacgaaagagaaaaggggaagaggtgaaacaagaactcaagagaagaagcaaagaatcgagagaactcaagaagaagagaggaacgatgagaatgacgagaatcgaaagctcatggaatcagatagacta

SEQ ID NO: 35843 - DNA, 745 bp, Triticum aestivum
  Clone ID: PAT_TA_35843
gcacgcgcgaggggtctggactccgaacggacaacggagagaaccgggagaacccgaacggatgcaagttttgaaaaacatgcggatgaaaagcagatgatgacatggcaaaatgcaacacgcaagaaaatgacatggcaacaacgacgaataaccggcagacacccggcgcatcggatccggggcgttacaacactcctccactaacaagagatctcgtcccgagatcttaggaccgagacggaaggggaaaaggaagaggtgaaacaagaaatcaagagaagaagcaaagaatcgagagcactcaagaagaagagaggaacgacgagaatcttaaagtcacggaaacagatagactatgaaacaactccggtttgaacgaggtaagaaacgaataagactgaaaggatttaggcagcactccggctgaagatggaaggaatagaacacgagcttcacccaatgagatggcacttgacgagatgaataatgcaatgcctccggaagaattgaaagaattgaataaaaagaacttagaaggaaggattgaatggagttgttgagaaaatcaacaacgaaagaataagcttgttgtggtcttataggtaacatctcaagatcataaggtgataaccggccacaaacggaaatgattggatagctgagaggaacgaagaaatgcaaaactccacttcaaaacaatactaagaattaattacacttcgagacgccagaagaaaagata

SEQ ID NO: 35844 - DNA, 2570 bp, Triticum aestivum
  unsure (1)..(2570): unsure at all n locations
  Clone ID: PAT_TA_35844
ggtttttttcttttgaaggtcgacgaaatcttctttattgtaaaatcatgagaaatacaggatccgtcaaaaacgtctggcgacgccaatacaagctcagagcatgaacctcgaccagctcatcgtactgaagaacaacaggggccatgccaggtgcgggaacgcctactgcattccttccagctaataaataaaactggcgtgaatgattttttagaccctggctgctgatttataaagcttgcttgtctgatgtttcaacgagggcgctgatttatacagttttttcatagtatgctgcaacaacaaaaccagaatctatcggatgagagcacgcgatgtacagcggggtagatgttcgccctggatctctacgtcggcacgacgacgtcgggaagcgcggcggccggtccgtcgtcatcgggcacctcggcgttcttggcgggctctgtggtcttgccatcttcgtcctggaacccctgcttgaagaggtcgtagtttgttagctcggctgccttgaaggggcggtctcctagtaccctggtcagatcgtcctggtggaggacctccttctcgagcagcaactcagcgatgagagccacttgttccttcttctccgtcaacagttcaactgtccttttgtaggccttggcgacccattccctcacctcagtatcgatgatggatgcggtttggttgctgtaaggcttgttcatttcaaagccatcctcccgctgagggaaggatagaagaccaaccttatcgctgaaaccatacacagcaacttgcgcatatgtcatctttgtaactttctccagatcattctgggcaccagtcgagattcttccaatcaaaacctcctccgcagctcggccacctaacgtcatgcatgtcatatcaaagagctgctcctttgtcatcaaaagattctcatttggtacatactgtgcaaagcctaaagcagctgttccacggggaacaattgtaactttcagaagaggctctgcatgttctaaaaaccatccggcaacagcatgcccagcttcatggtaagcaacagtacgtcgctccagtttgctaattaccttgtttttcttctctaaaccaccaataatcctatcaattgcagactcaaaatgctgcattgtaatctgagtttcatcggttcttgcagcaatcaaagcagcttcattacaaacattcgcaatgtcagctccagcaaacccaggtgtcaaagcagctagcctttgcgaaaaatatgttgggtcattgtccagtttaagttttgtaagatatatgcggaatatctgatcacggccctttatatctggtttgtcaattgttatctggcgatcaaatcttccaggccttagcagtgccttgtcaaggatgtcaggtctatttgtaccagcaagaacaacaacaccagcagttgtaccaaatccatccatctctacaagcagctggttcaaagtactttctcgctcatcatttgaaccagaaaaacctccacggcctctcgcgcgaccgattgcatcgatctcatcaataaatacaatactgggtgcacactgccgagcttcttggaataagtttcttaccctggatggtccaacacctacgaacatttccatgaaatcggaaccagaaatggacataaagggcacaccagattctcctgctgtagctttagcaagtagagtctttccagttccaggaggacctacaagcagggcacctttgggtatcttagctcccaactcttcatacttcttgggatttttaaggaaatgcacaaactccattatttcttgtttagcttcatcacagcctgctacatccttaaaaaacaccttatttttagaatttttgtccatctttgttactgttgcttttccaatgttaaagataccacggctacccttcccaggaccacctccaatattaaatccactctgcatccttttccccataaaatatagtagtccaacaaggaacgctgttggggcaaatctcatcacttcttggaaccaatttacttcagcaacataagttactggaacataatcatgtgaatctatacccagattttcctgggcttcctctaacttttcttcaaacgactcaacacttccaatattgaagaaatacttgtatttgctgggagcctgtctgcctggaacatcaacggtcgtaatctgtgtatcagtattttggctttggccgttcgtctgtggtgtagtcctgacatagacctttgccactgatttatttgaaacaacaatacgatcaaccaggccaggttccagtaacttgttcttgaattcttggaagcttatctccttctggtctgatgagcttgaagacaaggatgagaacatgaggcctaaaagcaatagaggtcccaagaagttctgcagctgcttgaaagtaccatcctggaaattccattgaccatctgtatcggattcctgcttggaatccttgttgctcccatcccctttgggcgcctccttcttccccttggggtagtaattctcgtaattcttncttagagccgctgcagaagc

SEQ ID NO: 35845 - DNA, 617 bp, Triticum aestivum
  Clone ID: PAT_TA_35845
aagttcaccacgcatcatgtagtggacacccacgtgagggggaaggccctctcggtggtgtacacgaacgatccggtctcggtggagagctccatccaaactatggggcagttccttgccgatgacaagtaccgagtggtcggcttcgacctcgagtacaccatcggtcgtgcctggcacgatcagaaggttgtcgtcgcccagttgtgcgtgcgacatgacgtcctcgtctaccactaccacttggccacaaggccttgcgagcatttctccaggtttatcaacaactccaactacagtttcattatagtggacaccaccaacgatctaaaagcgctcaaggtttcgggcttgaaatgcccgaatcttgtcaacatccagcactactacaaggtctaggggagagacaacaacaaactgaactccctggttgacctcacctcggccatcgccgacccctactatacgaagatgaagtaagagagcaagaagtacaagaacgcctagcacagtgtttggcatgagagactcgatgaagaacacgtcaagtacatggccaaggatgcgtacacaagctacgagatgtacaggcggattgttgacatgaggaactgtct

SEQ ID NO: 35846 - DNA, 1299 bp, Triticum aestivum
  Clone ID: PAT_TA_35846
ttctttgtttgattgtatggggctccatggccttaacactgccccaattacgggcctcatgtccgctcctctgtggccccacccccgcggccacatcgcccccgcacacatccacccccctcgtctcccgctccggccgccgcctccgctgtcccccctcccgccttcccccggacgaacccgccgtcggcctaacgcgtcgaacgaagcaaaccttgttccatcatatgatccacccacctaactacttacacgccttaatttttcacagcaaaggaatctccactctgttctcactaagctagtactcacagatgctgctgctggtaggcatcgtcagacagcgcctcgagtgatgaggcggccgccttgtccagaaaccacaccagcttcccgtccgttggctggaccatcctggcaggcagcggggcggcggcgtctaggccgtcgctgctgtcagacacggctgaatgcaccgcgtttgccttgtcgacgcccgtcgcgaggatcgcgatgtttgacgccgagtttatcacagggagggtgaaggtgattctctcgggtggaggctgcggggagtccgtgatgtaggtgacccagtcgtccttcagctcgagggcttggtggttagggaacaatgaggccacatgtccgtcggagcccatgctgaggaggatgagatcaaacttggggcagtcgttgctctctgagactcctatagtgcggatcttgaccagctgcctgatgacaaattcgtagtccgttgctgcgtcctccaccgtggcgccgtcatttatggagtagacatggccactcagaataggtacctttgatagaaattcttcttttgttaacttatagttactgtctgcatggttctttgctacagcacgttcgtcagaccagaaaatgtaccatttagaccaatccagggtcttgttgtatggcacttcacaaagtttcctcaaaaaactgacaaggggccctccagatagggcaatagcgaagtatcccctttctttaacagagatttctgaaacttgggagatatactcagctagatctgttactatctcatctgaactctcaaaaatccttatttcactgtttagttttggctcatatgaggcagccatttccctctccattgtttgcttcagcctagaactctaccgagttattaccacaccaaataatcctttgctttgatctgaattctctgcggtcgtgcttccttcccctccggcgtctccctccctcctcgctcttctttcctttccttctgctcctccgctctgc

SEQ ID NO: 35847 - DNA, 229 bp, Triticum aestivum
  Clone ID: PAT_TA_35847
aggctgcgggcgatggggaagccggtgggggtgagggagttcgaggggcagcagcacggcttcttcaccatcgacccatggtccgccgcgtctgcggagctcatgcgcgcgctcaagcgcttcatcgacaccgacgggcgcttcgactagatccgttccatcgcctccgactcctcagtctatgtctttctgctgctttaccaagtctacagatggcattgcaatatcg

SEQ ID NO: 35848 - DNA, 572 bp, Triticum aestivum
  unsure (1)..(572): unsure at all n locations
  Clone ID: PAT_TA_35848
tgctgctacgcgacactacgatcagagacccttcgagaaactgtgtgcgatgcaatgatcgcaaacggtggtgtaggaaaactgtcagaaatgtataaaacgtttgcaatgaccgatgcatcaaacacagttcaggttttagttgtgtgtgtgattcagggcatacggtttagttaaattaaccgttttcgatgaggaggaacaaaagaaacgggcagccagatgaaggtgtgtgcgatgtacaacatatggttcactcggatgaactgtttgtgattaggcaacacaaaagaaacggtaagccagatgaaggtgtttgtgatatacggcatgaggttcactcggacgaactgtttgcgttgacacaagagaacagaaacggttcaacttaacaagacatgtgtgttgtgcgatgggattgcatacagaacaacaacatacacacacacacacacacacacacttataaggacatgcttgcataaccaaattaaacatccacttagataggtggctactacaaccatggcatttgcacacaccanagtanactattacatgcataattacat

SEQ ID NO: 35849 - DNA, 665 bp, Triticum aestivum
  unsure (1)..(665): unsure at all n locations
  Clone ID: PAT_TA_35849
ctacgacctgaagtcccacctcgccaccatccaccgctgggaggtgatcaacttccgctacggcgagagcttccaggcccctgcctttgactctgccatcttccgctgcgaggactacggcgagctcttccacatcagcagctcccgcgagggcttgggcaccgcgctctccatgatctgcatccgccctgacaacgccttcgaggaggagttcacctacgagctgaagatgccggcgggtggacggcgccacaggctgcagattcagtcgaccgtgtggaacacttcgctgcggtacgggatcggtgaggggagcgacgtcttcctgctggtccctgacaagctgcccggcgtcgagaatggctgtgccgtggaggtgtgcattcgcaaggtggtggctggtaactagctcaagctgtgcgccgatctggaccgtcattgtcgttctggttgcagcattgcctgcgagagttctgctcatagccgagtaatcttgaacggcatccgtattggtgaattcgttagtcgttgatgggtcttctggtaggtgagatggaagcataggcatcccgcgcatcgctgatgcagcaaactgtctggatatcgtcttttctgaggagggtgaatttggatctggatattgtnctttnctgaggnagggtgag

SEQ ID NO: 35850 - DNA, 818 bp, Triticum aestivum
  unsure (1)..(818): unsure at all n locations
  Clone ID: PAT_TA_35850
cacagctgggacctcaacttcagtcgaatccgtgacactttttggttgcggggcttcttcagtgaaaggttcctattgaactgatggtgtgtggatatgctccaaaaacgcattactgggaatggcttctctcttggaacctatttttgccaaatcatcatccgcttgatttttcagtcggggtatatgatggagctctaacccctcgaatttcttctctagctttctcactgcattgcagtaaccagtcatggctggaattctgacgtcccactccttcatcacctgattaaccaccaaatctgagtcgccataaaccacggggcgacggacgccgagtgaaatggccatacgcaacccatacaaaagtgcttcatattctgcttcgttattggaggaatcaaagtgaatctggagtacatatctgagcttgtctcctcggggggatactagtactaccccggcaccagaaccattcagcatcttggaaccgtcgaagaacatggttcagtgctccgactgaacttgagtcggcagttgctgctcgatccactcggcgaggaaatctgctattgcttgggacttgatagctttctttgcctcaaacttgatatctaagggaaggagttcaatcgcccattttgccactcgaccagttgcatctctgttgtgcaaaatctctgacaatggagcatcgctgacgactgtaatagagtggtcagagaaatagtgtgcaaccttcttcgtggtcatgtaaatcccataaacaagcttctgatagtgtggatatnctttgttttgacggagtcagaacttcc

SEQ ID NO: 35851 - DNA, 387 bp, Triticum aestivum
  Clone ID: PAT_TA_35851
agctgagggagctcaagacagacgacaacctcctgctgttcaagtgcgagctcggcgccgggcacttctccaagtcggggaggtttgagaagttgcgagaagacgccttcacctacgcattcatcctcaaggcgctgggcatgactactccaacaacggcttcttcgctgtgacgtgcgcacatattcatcatcgcggccagtaactgcatggatttaattttttagacacttattctggtttgcccaaaaaggtgggttagaaagaaagccatgtgaattagttgtggcctgtgactgtgagggagtggattagcaactgaacctttgacactgttgtttggcaagaatgggaggagcgatcctttgtttcggtaaaaaaaaaaaa

SEQ ID NO: 35852 - DNA, 376 bp, Triticum aestivum
  unsure (1)..(376): unsure at all n locations
  Clone ID: PAT_TA_35852
ttttttttttttagagaaaagcaccnagtttcactgcagctaagaaaatgatggatcactggatgtgacctcttacaaggatttgtagttttgtcctcgaaaatgttttttgactagttttgcagtatcaacagcggcaggcgcataaattgaatcacataagccaatcttacaaaccaccaatagtacaaattaaagaaactagcgagatgaaagaagtttaaataaacagagagaaagaaggggaagggaacccgggcatagcattctcatcttcaactagcttgtcgtccgtccgtccctagaaacgacgcacggtctcactctcacaacagacagccaaggacggcgcctgcagcccgggggatccactagt

SEQ ID NO: 35853 - DNA, 1543 bp, Triticum aestivum
  unsure (1)..(1543): unsure at all n locations
  Clone ID: PAT_TA_35853
ctcacccaccccaatcccacctcccggacagggccgcaacaaaagcagcctccagcgctggcattcttgttttgccgctgcggtttcgctatctccccaccgcttcccggccacctcagaccccgagccgccccctccccccaccccatatggcgccgccttcccgccccgtagccgtcctcgcatggggttcgggggaagacgggcagctgggcatgggccgatgcgacgagaaggactgggcccgctgcatcggcgctctggatgcgtacgccgtctccgccgtcgtagccggcagccgcaactccctcgccatatgcaacgacggcagcctcttcacttgggggtggaatcagcggggaacgctcgggcacccgccggagaccaagacagagagctccccggcgcatgtcgacgccctcatcggggtcaagatcgtgcaggcagcgatcggcgggtggcattgcctcgcggtggacgacaaggggcgggcttacgcttgggggggcaacgaatatgggcagtgcggggaggagcctgagaggaaggaagatggcacaagggcactcaggagggacatccccatcccacagcgatgcgctctcaagctcaaagttcggcaagtagctgcgggggggactcactcagtggttttgacacaagaaggccatgtctggacatggggacaaccgtggcctccgggtgatatcaaaaaaatatctacgccagtacgtgtgcaagggcttgaacaagtgagcatgattgctgtaggggcattccataatttggcactgtcagtagatggaatcttgtgggcatggggtaataatgaatatggccagctggggattggagatacccaaccgagatcacaaccgatccgtgttgaagggctatctaacctctcattggttgacattgctgctggaggttggcattcagccgcattaactaaagaaggagaggtatatgcttggggaagaggagaacatgggaggctcggctttggggatgataagagcagtcacatggtgccgctaaaggttcagcttctagcaggagaggatattgttcaggtatcatgtggagggacccattcagttgtgctaaccagtgatggccgaatattctcttatgggaggggcgatcatggccgtctaggcgacggtagggaggtgactacgggtcacccaatggaagtgcccataaacttgccgccaccgaagaccagcaccagctccgaagggctatggcaagcgaactacgttgcctgtggcggacgacacacactcgccatcgtgacatggactgatatgtaacaaggcatgatcacttgagtgtatgaattgaaattgtggtaacggtaatggagaataagaactagaagctgtgcactttaggcttcaattgaatgttccgattaacaaattttgtgccgacttaccaatgttgttttctcctttgcatgtcaacgcagctatncttgagtcggttcgaattgcaaagattctataatgctaaatgttatctagctataacacgg

SEQ ID NO: 35854 - DNA, 441 bp, Triticum aestivum
  Clone ID: PAT_TA_35854
cgcttgcccgtaccggtcctagattcacgggtccactcgtgatagctccagatctcatcgtccttggtagatctcgcagccgaagcttgcggtctctgtcggctaggaaatgcaggagggaacaaggagaacgtgtctggactccaggcttgatgttctaaagaggaagccttgttttagtgttgggtggatgatagtgatgggtgggatcggactggaggcgacggtggaaccgaactgaactgaggttgggtgttggtgcaggctcgcccacctggcgccgaaatgaaacgcggtcgctctcatctccaccagatcgaccagaagaccatctcatcaatcaaaaaggaaaaagatcggccggaagatactacacactctgaatctgaatagagaaaattcaactttcgcttaggcgtggtggcctgtggaccggtgaat

SEQ ID NO: 35855 - DNA, 859 bp, Triticum aestivum
  Clone ID: PAT_TA_35855
atactcgcacgcccgcgatcgcgggggccctcctggttgtcatgaagcaggttcgggaggcgggggcgcggaggcgggcgcgggccgccaagaagagatcgaaggaggtgcaggcagagaagctcaaggagagggccaaggagaagaaggagagcattgagtcggtcaagaagtggaggaagcagaggcaacaggggggattttccaaggggaaggaggacgggcccggcctcgacttggaagttgcagagcccacgcggcggattttccaagggcaaggaggacggcccggtcctgaacttggaagttgtggagggcctcgagcaccacaagaagccgaggcctggcggttctcctggtgtcaggtctggtggtcttgctaagcgaggtaaacaaggaaagaaccataggtcaaaggattccaagtttggtcatggcggtcgcaaagggatgaagaagcaaaacactgctgagacgacgaatgacttcagaggatttaacaaccaggaagggcgagtccaggaaacaagaagaggaagatgttttgatacggtgttgtaagagtctgtccctgcttccttgtgatgctattatattcttgtctttatgttattctgctgcagtactctctatcactagatgcaaaagttagcttgaggtatggaatttggggaggcagctcaaacacaagacttttatctttagctgtgctattctccataagatgcggtgccgtttgcatttaacctttgatcgtcctcgccctgccctcccgttgtttgcacttggttctggagcgtgttccgccacctgcccccttgcggcagggtaaggggtttcacctcgcctacaaattttt

SEQ ID NO: 35856 - DNA, 767 bp, Triticum aestivum
  unsure (1)..(767): unsure at all n locations
  Clone ID: PAT_TA_35856
caattgnagcaagagtcccgtacccagcaaacgaatgcgggagaaacaanagtaacaagtacggagtaatagatcgtataaatgtatggtggtgatcagtcatggtccaagaacgacaggggaaattaaaactaagcaccacatgcctgtataatagcagaactagagcaagagaagaatgttggctagcaggtcgacaacgacgcctgctaagggagcatccacacgtgcatccttttgccactgccgaagccccctatcctcgagcttgacaggctcgtgtgccatcctggacgacgtcctcgccatggccccaagcctcgcaaccacgtcgccagctgccgccaagctgagcatgttggcagaccaggatgaggacaacccataccgcacccaaggtttttagtagatgaaggagaaagtccgcgccaagaagaccattatgatggattcaagagaatcaagagtgaagcatcaagatacgataaatatgtcgatgacaaatatgcctaccgacacacgagtggtttcagatatctttggttgattaggatttgctcacatagagaaaggatgcccacatatatatggtagtcactccccatgtcccaaatgtgttctttcagtgggtattgcacaatcacgttgaagtttcaccacacacacattttcagtgttgctgtcatgtcatatatctccacagtgtttgatcacaatttacacaattgatctgatgttgctcaaaaaaaacaaacccagcccgcccg

SEQ ID NO: 35857 - DNA, 742 bp, Triticum aestivum
  Clone ID: PAT_TA_35857
gccagccaggagccctctcggactgggactccgataatagcatccagccctacctccactaggacgccaactcctaaccggagcgtagaatttggtgttggtacaattgattccagcaagatgggcatgtctgaggaggagctacagttgaataccaggaaggaaatcatggatctaggcgaacggctaggcaagacgaccatagcggcctgggcgagcgacgctgtctgggctgccccatttgtcgctgtgctccctgctgattaggctcttgattgcgcctgcgccccccgtgcggcagtgtgcctcgagcctctgtatgcatgcgatcctgctaggtttcagagggaagaggtaaagatccaagcttgggaaaatcaccagagagcaaaaattgaagctgaaatgaagagcatagaggcgtagctggagaggttgcctgctcgcggggacgggtggctgcgcgagaagacgacagaagcgacgggcagagcagaggcgaagagggaggccgcggaggcgaggaggagccaagaagcggagcgaacggatgagcaggcggcgcagatccgtaagaccgggcacataccttcctcaatctcctgctggtgctggtgcctatgataaatcccatgcctctgagcatcgtagaaatgtttctcctgaaaacgaccattgtaaaaatgctactggctcatcttttaccagcaaggaatgcaaagtgtgtcgccgttttcgtcgg

SEQ ID NO: 35858 - DNA, 753 bp, Triticum aestivum
  Clone ID: PAT_TA_35858
aatgatgagccggcaaaaggcaacaacaacaaacggagaaaatccggggaagccaagttaacaaggcaacaaaaattccaagaaaccaaaacaaggggaataacaaggtaaattcaaagtatagttgatggcgaatatcctgcaaacaaaatgtcttatgaggacaattattttgatgaccccttagcagtgagtagtgagaacatacctaatgaagaagctattcagttcacggagcagcatggtagcagaagaaagtcaacctcaaaggatggaacaaaccatgtgcccacaagaatatcagagaaaggtgccaaacccaccttgaaaaggtttccgggtgatgagaatgctattacaaagccagaaagtgccaaaaaggccaaggttgactttgcctattcaggagctacaggttctttatcagcacagagacagaacttgcctcctgacaaacatatcaatgagaggtcaagcaaggagacagggaatgttggatgggacacacatactgagctacaggtacaagatattagtcctaaggaaggaaggcctgtgactcctggagatctacaaaagataaatcagagccaaaatctgcccatcccaactcactctgaaggaaaacaagaaaagatcatgaaaacaagctctaagaagaaactagataaggtgcagaaacctttgaatagtatggatggcagccctgggaatgtcaattttgacaacactgatgattctgctgcaagaaaa

SEQ ID NO: 35859 - DNA, 150 bp, Triticum aestivum
  Clone ID: PAT_TA_35859
aggtgaagattgatatattggacgaagggtattgcagtccggaattgtttcaggggtaccgggtgatgatcatgtttcctaccgggtgatgatcatggtataggtgatgatcatggtcgggacacctctagacatggccgctaccaggcc

SEQ ID NO: 35860 - DNA, 1144 bp, Triticum aestivum
  Clone ID: PAT_TA_35860
gccggccggtttccgggtcatcccacgctcgcacaaagactgggggaaaaagaggactctctctctctctctctactccgctctgcgcttgccatttccccaaatctgtcagagagagagagagagagagagagagagagctaggttttccctgcgcccgagcgatccagcaggagcggccatgaacatcttcaagaagaaggtcgaccccaaagaggctctcaggacaagcaagcgcgagatgtcagtcgccacaagaggagttgagcgagagattggctccctgcaaatggaggagaagaagctggttgctgagatcaagaacactgccaagactggaaatgaggctgcaaccaaaattctagcccggcaactagtcaggcttaggcaacaaatcgtcaatttacaaggtacacgggcgcagatacgtggagtagctactcacacacaggcaatgtatgctggaacttcaatatctgctggaatgaaaggcgcaagcaaagcgatggcagcaatgaataagcaattggaaccaacgaagcagatgaagcagatgagagaattccagaagcaatcatctcaattggacatgacgcttgagatgatgtctgatgccattgatgaaacactagataaggatgaagctgaagaggaaacagaagagctcacgaaccaggttctggatgagattggtgttgatgtggcttcgcagctgtcttctgcacctaaaggccgtattggagccagtaacaagaaagccgagaacaaccaagcacggaatgcggctccagcgaaaaatgtggcgcctgaacctaatgccgctgaagttgatgatctggagaggagactggcatctctccgccgcatctgagttgctgctgcaagaaagtttatatagccttatatatgtaaatctgtttactggtgccttgtttccaaattctggtagcttaatattgtaaccaggaaacaagctagtacatgtgacttaatagaacctgagttttactgtttggcaagccataacctgtgctttggcaaatcgaagtggctgaaaaaaaatatggtggagcacaaaaaaagttgccaatctcgtgtcgcggtctcgcaatatggtggagcataaattatttatgaagtgaac

SEQ ID NO: 35861 - DNA, 409 bp, Triticum aestivum
  Clone ID: PAT_TA_35861
gagtttatccaggttcgggccgcaagtgatgcgtaataccctactcttactggtttgtgtttatctggtgttcttggactagctacaaagtgtgccgggtccaaaaagttcgaatcctcctccagtacgcctcgggcctccttttaaagccaaaggggtcgccacagtggcacacaggaggtggaaagtttgtactgtatacaagtctatcgcctggcaccgtaggacaaaacacatttaatgcgctgccgacgtgccctcttactttactggggacgacaaggaagctcgtcccatccgccgccgcttcgtctcgctctgacgcgcgtccaggctgactaggcatgcagcgccatgctggttggttgctgagttggcgcggtggcagagtcttcatggagatctgcat

SEQ ID NO: 35862 - DNA, 1101 bp, Triticum aestivum
  unsure (1)..(1101): unsure at all n locations
  Clone ID: PAT_TA_35862
tccccgcggcgcccgacccgcgtccggggagcaatctagcgaaccgtggcagactcctccccacaccacagcacagcgccgacgaggcctcacgccacagcgcggcgaagccctagcctccggccagcgccgccgcagcgatggtgtacttcgactcatgggacgagttcgtcgaccggtccgtgcagctcttccgcgccgatcccatcaccactcgctactgtatgaagtaccgccactgcgacgggaagctcgtgctcaaggtcaccgacgaccgcgagtgcttgaagtttaagacggatcaagctcaggacgcaaagaagatggagaagctcaacaacatctttttcgctctcatgactcgtgggcctgatgctgatataagcgaggtttcagggaaggaacaggcggagcagcagcaatcgaagaagggacggggcaggaggcagtagtatcatgttctggatttctttcagaaagatcacaactgggagtggtgggtggatattttgatggactcctgttagtcatgttacaactgtgagtggtgggtggtctaagagtggcaaatagttttcagacaatgtgcgccatcttcggatccttttcctggcacagaaccgcgaagtacaactacccacacaatcatggttgatgagacaactcaaatctttgaccgtctgcgtgttttgttgatgaatcatgcaaggttgatcagacaatcaaatcattgcccgcctgcgtgctttggtgatgatttttcatttaggaacatggcaaaatgttttcttgaatccatccacacttatgcgttgcacactgttgtgggagcacaaggtacaacgctgcggacctcgcagtgacggtggggttgattttgatgatgcagtgatagctggtttgttcctaaaaaaaaaaaaaaaaaaaaaaaaaaaaaaaaaaaaaaaaaaaaaaaaaaaaanaaaaaaaaaaaaaanaaaaaaaaaaaaaaaaaanaaaaaaaaaaaaaaaaaaaaaaaaaaaaangggggggggcccgctttaaaggacccaagtttacttccccgggcttgcaacggaatagtttttttttgggggccc

SEQ ID NO: 35863 - DNA, 423 bp, Triticum aestivum
  Clone ID: PAT_TA_35863
tcagggcaacacactaggggtttgttgcaccaacaggagccctcgggcctggactgatcgtgtttccgagcgtagtcgcggtaggcccttccaagtacacaggcgaggaggctgccataagtcgtcccttgaggtcttctttgcttcttcataatctgagcttggatcagtttctggtcttcccgtgcatcacgcaacgccaattgtagtggggccatatttgtaatggcccatgaacgactttaacgcatgggggagtaactgccaattcactcttcccaccacgttcttctcccctaccacgtatgttgcatgcattgagtggggtaagtaaaggaggcgcgtggtgcgggagagtgtcaacgcaagggcctggccttctcgcattggttgagaaggacggccgtcacccatcgagggatt

SEQ ID NO: 35864 - DNA, 421 bp, Triticum aestivum
  Clone ID: PAT_TA_35864
gtagctaacgtaggacaaatttgctgagacgaaacaaaccgctatccattggcaatcaacgtcgggtggtcaatcagtgggagccaaactgttcatttgtgctgatgcatgtatagcgtggtctgctattgctgatgagcccggcctgtgtttctttctttcgctgtctgtgcgtcgttggctttgctctggagtggttaccagaggatgtcagatgatgatggatgcaccataaagttctgcccaatcaaatactaggcaccttgtcactgcttcatcttgcacaaaaacttatcccgttaccttgtgtcaatattttttcaccctaccaaaactactttttgcaacttgtagtgttttttctaaagaagatagtacaatcgtggataaataatgagccaacatgctgagctggcatttt

SEQ ID NO: 35865 - DNA, 430 bp, Triticum aestivum
  Clone ID: PAT_TA_35865
accaacatagacaaaacatacacttaagtaaagcacttacaaaacagctactcaaacccgcacaaggaaaagccaattccaacacagcgggagacatagtcaggccaatgtcgattagaaccagacacacctacgaatccatatatggcccatccacaacaccaaaacaacttcgcaatccccacatggaccaaacatccaaccaacagaccaccggcaccctctccctgcacaaagtccaaccccccttcccccaaaaaatcacatccaccgcccccccaagcacacaatattattacagaaataatggaataatcaacatagaaaggaactaaaagaggaagagaagaaattgctaccttcccgcagcagatccacaacaccaaaacagcctcgcaatgcccacatggaccaaacactggacatgatg

SEQ ID NO: 35866 - DNA, 380 bp, Triticum aestivum
  unsure (1)..(380): unsure at all n locations
  Clone ID: PAT_TA_35866
tgaacaccatgaaagagatggtgggactatcanaggatctgctctcatgggctcgacgacatgacctcgtctgaagatttgcaggaggccttcgacgtcatgggggcgctgccagacgtgttctccagtgggtacacgaaatgcgatgattttgtccgggcagccatacaggctgggaggaggagctgatcagccacaactcctctccactgtttgtgttgatataaggcacgaccctttttgttttgtatgatgagatatgcagcttatgtgtgtaaacagtctagcacttggacatcagctggttgaacttgtataatattatgtcgtggaattgccggccttcattaaaaaaatgctatgcccctgctgcaataaaa

SEQ ID NO: 35867 - DNA, 1692 bp, Triticum aestivum
  Clone ID: PAT_TA_35867
ggacggcagggaattagggaacgagccgctgatccattcgacgacggcatgccggcgcttcgacagggtccggtcgacgctggggtacactgggttggtcgagcagctgcagcaattcttcaaggagggcacgtgatctgggactagcaactaaagccagaaagacgaagcacacaccgaatgggtgtcctcggggagagaaaggaggtgctgctgcacggaagtctcgtaacaaggaatgggatggtgcgtatgctgagaaaaaatgagccattgtgaagttgtatcgttccgcttagacgtcaagctgttccacatgggcagtacaaccgatgtgtagatcagtattgggaccaactgaattctcaaggacgggcagatggaagtcgtctccggttgttgacatacgacattgttctgatgctggccaggtttgccacaggcgcttctttcagcaccgactgcaagggtggggggaaggagagcaattcacggtttcttcctttcatgatccagatggcttctcatcttgtagatggaagtgccaaccagcaacgccattcgatggccaaggccatctctacttacctgtccagttctctctcaacttcagaatctcccagtcgggtttcagcttctccccctggagctcggggtagtccagggtctccggaggaaactgtgcagtttatgatggtcaactctctgctgtctgagtcttacgagagctggacacagcaccgccctgctttcctgcagaggggcatctaccatgcttacatgcaacacaagcatgggcgatccgccctcaagctttccgccgagtcgtcttcctccgcggcccggtcagacgaaggttcgtccgctgatccaaacgacgacggcaagaggctctttgccattgtccagtcgatgctggtgtacactgggttggtcgagcagctgcagcaattcttcaagaagggcaaatcatctgggactagcaagtcaagccagaaagacgaagcaagcagcaagtgggaatccacgatgaaagaaaggctcagcaacatgaaggagatggggggtctatcaacggacctgctctcatggcgtgactacatcagctggtcccaaacgacgacggcagccgtcgccgtcccgtgggcccgtcggtgctggtgtacactggcttggtcgagcaacggcagcattccgtccaagaaacggcaaagcatcatgggaactaccaagtctacccagaaagacgaagcaagcagcaagtgggagtcgacgatgaaagaaaggctgagcaacatgaaggagatggtgggactatcaaaggacctgctctcatggctcgacgacatgacctcgtctgaagatttgcaggaggccttcgacgtcatgggggcgctgccagacgtgttctccagtgggtacacgaaatgtgatgattttgtccgggctgccatacaggctgggaggagctgagcggccacagctccactccactccactgtttgtgttgatataaggcacggccctttttgttttgtatgatgatgttgagataggcagcttgtttgtagcagctgtaaacagtctagcacttggagatcagctggttgaacttgtataatattatgtcgtggcgttgacggccttcattctcaacatgcttcgctcctgctgttatctgttacagttgcc

SEQ ID NO: 35868 - DNA, 409 bp, Triticum aestivum
  Clone ID: PAT_TA_35868
tacaactatattcaaattacttggaattattaatatccggaatacctcattgtgaaattacaaatgtgatttcaacacccattgcaacgcacgaggccttttgctaataataataaatatgataataataataatataatactcttcccattcctaaatataagtctttttagagatttcaacacagaatacatacgaagcaaaatgagtgaatctacacactaaaatatgtccatatacatccgttatgtgactataaattaagaaatatctaaaaagacttatatttagaaacatagggagtataaagcaaaagcttgctgattgttaggttcatataggttggctagtattactacaaatgcctcacgcaactgcctcctccccaaaagtccagggtttctttgtg

SEQ ID NO: 35869 - DNA, 410 bp, Triticum aestivum
  Clone ID: PAT_TA_35869
gcagtcgctgccaggatgctgattgtgatgagcattaagctgaagctcgctcttctcggcgttcgcaagagacggcgtgacctgtgaatacatcgagtgcggcatgtaacataggcaaatagcctgcctgaagagtgagggagagaaaacctgcatagattttgttctggcgtttttgtgtgtgtttctagtgattgtttgggtttattttccgcgcttatggatgtacattacaggtatataagacagcatagtgatgatgtcttcttcatggttatggaagtgaaagtaatgttatggaagtgaaagtaatggtatgaatgctgtcttcatggttataagacagcatagtgaaaatgttttagatacgggaaaaataaaaaaaaaaaaaaaaaaaaagcggccgctct

SEQ ID NO: 35870 - DNA, 900 bp, Triticum aestivum
  Clone ID: PAT_TA_35870
gagggtccttcgtcgcagaccatatctcgggtctactctgcttctggcaccccgcactctctgaacacccaaagaccatacaggaactcatcagccatgagcatgagcagaagtagcgcagaccttgcaaacatgtcttcgccctacttccgcacctcactcctccgtggaggctccacacactccctggtcggcaaccacctgtctccaccagtcaacataagttatggttatgccccaccgcagatgtacaattctggctatgcgtcgcccagcccgcacgccggttcttcatacatctccaattcgggatatggatcatcgtcgggctactacctgggctcgtccagccagcatcggtcttcggcgtacctgaggcactgatggggagtcggggccgagcctgtccaccatggcccctcagtcaccacagcagcagcagtcccactcgcggctgcgccacggcggcgactcagacgcgagcctgaacctggcgggcgcgtcgtcggcccagtccttccgtcagtcctacctgaggcactgcggcgactcggacgcgagcctgtccgccatggcgtcatcggggcagtcgctgccgggatgctgatggtggcgcgccctgacccgcaccgtgctcttctccgcgggacctgtgaatacagcgagtgcggcatgtaacttaggcacgtggcctgcctgaagagtgagggagagaaaacctgcatagattattttgttgtggcatttttgtgtgtgtttctagtgattgtgtgggtttattttccgcgcttagggatgtacattacaggtatataagacagcatagtgataatgttttttggctttgtcttcatggttatggaagagaaaactaatgataaagttggctctagatgcatc

SEQ ID NO: 35871 - DNA, 407 bp, Triticum aestivum
  Clone ID: PAT_TA_35871
cactgagagagcttccgaagaaggctggccaacagttagtaatattatctcaggtcctaatggatgatattaatgttggttatgaaaggctggctgaactccaggtaaagaaggtgaatggtgttgaggttgagaatttgaagcatttgtgcagtatcgtggagaactgcactgaagaaaacttgagaattgatttggacgatgagcgggagatcgtcctgaaatttcagaacgcgaggcttgccacgtctcggatcctcaagcggcacaggattccatcagccatgtcgagtgaccttgtcgatgaacaagcgagcaaaggtgagactgaggcgtcatgcacaaactgacacattttcgtaggcgtagctacacagtttctgtggaagcaccgatgttaactcggt

SEQ ID NO: 35872 - DNA, 696 bp, Triticum aestivum
  unsure (1)..(696): unsure at all n locations
  Clone ID: PAT_TA_35872
cctttgnttttccggccantgtgnntatttntttaagntgttacncaggaggcttttgtgcggttgcgtgggcatctgcactggtggaaccccgaggattcttggggtcgtggggcggccggtcggcctgtaatttcagaacgcgaggcttgccacgtctcggatcctcaagcggcacaggattccatcagccatgtcgagcgaccttgtcgatggaccagcgagcaaaggtgagactgaggcatcatgcacaaactgacacatttttcgtagggcgtagctacacagtttctgcggaagcaccgatgttagctcggttgtctttccagagacagatgaggtaggccgaggactgctggagtcacccatgagcccatcggttgcggcgggctccagtttggctgattcagttttgacagaaggtagaggaggtcttcagcaaataagaagaacccaagttcttcaccccgagttgtaacaccatcattctttgctcccctcccgacgatttatcattctttctttcgccactgtacgggttttggcacccttatgttaaattcggattatgtatcatcaccaaagcagaacataggagatacgaatttcaagaaccaagacacttcgttccaaaccgtacaagttctgctgacatgttattctttggatgctgcgganaatttatagaaaaaaaaa

SEQ ID NO: 35873 - DNA, 398 bp, Triticum aestivum
  Clone ID: PAT_TA_35873
atccggcaacaacttgctcacaagggtgcaaccactgaatttgtaacgacacaatgatttgaaaaacaatcaaaagatatgtaaagaacacagacagtaaaggtagaagatcatttccgggtagataggagagctattaaaatccacaaacatgaatcagagtttcgactgggttctccagatttaaccaaaagaagacttttctacaaataagagaatttctcatttttttgtttataccgagccaaaacatataatttccattgaacaacgaagtaaggatgctagccggagaatcaagagatacatacttcccagtccgattcttttttagttcccaagatagaatttctttgtttttggcaagagccgtggggtgacaacgtgcaagactagat

SEQ ID NO: 35874 - DNA, 303 bp, Triticum aestivum
  Clone ID: PAT_TA_35874
gtatccttttgattcttcattttgagccaaaaaaattcaccgtttgtcaaaaaaaatatctttcttgcggaaaaaggggatgcacccaaatcaaaacacatggatgggctcctagcctagtggcaagagcgcggtgatgtctctcggccgactcgggtttgaactgcctaggcaagcacttggtaaagttacgttacctgatctctgagtgtgggcactccatgatggacaacatattgtgcgtccacgatgccaaattgctcttcagggtcctgccagtccataaaaaatgaacataagtgt

SEQ ID NO: 35875 - DNA, 549 bp, Triticum aestivum
  unsure (1)..(549): unsure at all n locations
  Clone ID: PAT_TA_35875
gaccaagcaggcaggcaggcgcaccaggctagcgttgcctgatcagcagctgcacatatagtcagtcgagtcgagtcgaatcgaggcagtatagtttagctggagcttgagagggtcagatcatggagctcgtcgggagttggaggaaggtgatgccttacatggccatggtcttcctgcagttcggctacgccgggctcttcctcctctccgtcgcgtcgctgcgccagggcatgagccactacgtcctcgtcgtctaccggaacgccatcgccgccgctgccatggctcccttcgcgctatggtttgagaggaaaacaaggcgcaaaatgaccctctccctgttctacaagatcgttgttctggcactactcgagccagtccttgaccagaacttcttccacataaggagcccgttacacgacggggagcttctcttcggnaatcaacaacgtaatgcccggcgtaacaatttgttaattgccaancctgatnaaggnttnaagaagaataaacaatcaaaggggcnggngggacccaaggcgaaaa

SEQ ID NO: 35876 - DNA, 821 bp, Triticum aestivum
  unsure (1)..(821): unsure at all n locations
  Clone ID: PAT_TA_35876
tgaacttcctcatctcctgtgaacattctcatcgacttttggacttactattttctgtactctcaaaataaacctcgactgctccntaccaccntatcaaacaaatctaggcatgnttctccgttcaggtattaccccaattcagagatgcccctttacccaagattcccaccaaggttcagttggctcttaccaataaattaagtacttcctcaaatgcctcgggagctcactattgatcagataagggtaatgatggagagaactctgaaatggcttgttccgatgccatcaataccacctgtgcccgaggcttcttgcggtttagtgaatgggcaaatcagggaccgagcgagttggaagaggacctggtcgaccggacgtgatcgagacgctctaccacgctgagaaggcaaagacagaggcttacatactcgagttggtcgtgcggcttcaccaccttgttagccagagcaaccggccggcaaatgttaaaaaagcccagtccatgtaaccatcatcaggtcatggggtgatgacaagcgcattacacacaagtcatggcctgacaagagcagacagaaagccattacgatctgtttcgttttcattgttgctaggttgtatagaagggggaactgtgtctgttcttaccaggaaggacttgaaacctgatattaggtagggaaataacaagagcttctcctttcatcttttggtttctttgaggggttgggttctaatttcatctcatgtatgcggtgttgacattgtttaacacctcaaaacatcatggcaaatatcaacttaatactgcaaaa

SEQ ID NO: 35877 - DNA, 370 bp, Triticum aestivum
  Clone ID: PAT_TA_35877
aagcgaccaaggacgatagacaaggtgtcgtactctcctcgctaaactccactgaagcttgctgatctccacaaccttacacgggtcaacaaaacagaccttcccacagtgccaatcaattcaccaccaacgagggcttcatctgtgctgaatgcttcttacaagggcttcctccacaatggtcttccacaacaatgaaaccgatgttcacaccttccatctggatggttaatcaatccttgtagtctggatggactacagtgagtggacaccaaacactacgggttcatacaactactgcgatgcgatctctcgcagtactagacaagtcttcacacgatggtggactgcagttctggtctcgctcgac

SEQ ID NO: 35878 - DNA, 720 bp, Triticum aestivum
  Clone ID: PAT_TA_35878
ccatgagcttctgttgtttttgcggtgacctgctcttcctccgccccgcccccccgtgccgtccggggagtggtctggtgagctggccgcggccatccgcctttttttttcttcacgaggcagccgctgccgctgcgaggaaacaaaacaatcccctgaggcaaggacggttgtgaagcaaaggggtgacaaagccttctgcagcatggagtgcagggagaacttcatggaagatgagatggaaggtgaaccttcgataggtcactctgatcccagctgcccatcctttgacaatcgtcgcattttccaactgatccagtgaccagcgagcatcagtaaacacttgatgtggtcgtatctgaagcgctgtctgaggttaataagctgcagccatggatgtgatcatgctgatcaagtttttgcctgaagattttgtctgctgcggcactgatgaatttaccccccttaatgatttctttattttcgttacctggatcctcaaatttttggaggagcctgaacgatgactgtgcttccggtcatattattattttgatcggaaaagggtgtgtgcgtgtgtttgcctgagccccaatttcaattggacgtcattttgtcgacgcctattgagtattgtgtcatgtatctgaacctaagcttctacatgtatttgcatgtggtacacaataatatttgagtatactatcttgttcacctttc

SEQ ID NO: 35879 - DNA, 1145 bp, Triticum aestivum
  unsure (1)..(1145): unsure at all n locations
  Clone ID: PAT_TA_35879
tcggcacgaggctcaaagcttgcatgttgctgaaaggaatgcctattgacgatgctgcactggaatgcaagtacactccagagcttgccttggattacctgagtgatggagccttcggctggtgtttcgacttggacccctgtttacccgcgtcctttagcgactatcagcggctggtcccttgtaatgaagggggtgatgagtatgaaagttggagtgaataccgagagttttatagcacccctgaaactgatagagattatctgctgtactgggaaacgattgtgaaggatcttaagtggattgaagaacatgtgcttaaagccttttctgagtggcatgaattgcatgaaaaagcttcgtgccaagcagttaggattgctgctaggttcacaagcattcatccgaggctagcgtactatggtttcctggagtataaacagagcacacgcttttatctcaagttcgtgaaagatctcgactctgtgttttttgagatttggaagctggtcaatctccagatgtcttttagagatgctatggagcatgtttatgaggagaacccgttttcattacgcaagcgtgatttggagcgcgagctgagtcgccctggctcattgagattggaggaacaatttcgacggtgcacagagggcatcagtaaggaagttccagagtggatagcgcgtgagttaatttcgcaggaagttagattcaagtgtgctgtgccaaagacgtatgcgcagtacgccaggaagaagctcaagattgcagaagtcataggattgattcccgaggccaagataccaacctagtgtgttcgttgctggtgtgggtactgttgtcttttgggatcagttccagaaacaaaactgtaatatctatcccgacccaaggtggctactcccatgtatggttaaatgcctatgtatctggatgtatgcgcatgtgattcatttgcgcatccttggagcaaattgatcatatttttacccaactaaaactgtgtccctaattcctggccttggatagctagggtcaatttggtttgtaccatgaatttttggcatgttgtttgacaagaaaataaggggaatggtatttttcaaatncgggtagggacattttattaattggaggacttc

SEQ ID NO: 35880 - DNA, 1147 bp, Triticum aestivum
  Clone ID: PAT_TA_35880
ctcagccatgactttcgtcgcatttagcgagtctgcagtccatttttcagatataaacgaggcctactctacggtttcacgcacacctccactgcatcagggtgtattcaggcacaatatggcatttgcttgcatgttgatctatgccttggtggctttgtattgcctttcgcccataagcttgggtacccaattcctccttttgatttttctgtcaaaggtgttacgtccatctcaacagatgttcataagtatgggctagccccaaaaggcaccaggtactgtcctatacaggaatcatgaaattagaaagcaccaatttgttgctgtgactgaatggaactggttgggctctatatttcccctactatggctggtaagcaggccaggtgggactagtcgcaagagcttgggctgcgatgatgtctcttggatttgaatggttatttggaaagtactgggaaaatcatggaagtctcaaagaagatacaaaaaggaattgatgacatcacaggtttatttgtgattgggaagccagacatgaccgtcgtggcctttgggtcggacgcagtcgacatatttgaggtgaatgacataatgtcatcgaaaggatggcacctcaatgctcttcagagacccaacagtctgcacatctgcgtgacgcttcaacacacggctatctatgaggaattcctcaaggacctcgaggattccgtgaacacagtgaaagcgaatccagggcctatcagtggggggatggctcccatctatggcgccgctgggaagatgccggacagaggcacggtcaaggagttgcttgtggagttcatggacagctcttgctcaaccattgattggttatctctctgtaacatgtatacgtacaagccgcagtgacagtgttgtgtgatcttctatatttggtttggctgcaaaactgaaggcacacaaggcctccaatatagacatgtatctatgtatcagttacattggttgcaataaagttacattttcagccataatcaataattgggtttggctcaaaactgaaggcacacaacacaatgcctccaatatagacatgtatctatgtatcagttacattggtcccaataaagttacattttcagcctaaaaaaaaaaaaaa

SEQ ID NO: 35881 - DNA, 900 bp, Triticum aestivum
  Clone ID: PAT_TA_35881
cgtcgtcggcggcgccgtgccgtcccgcgctcgccgtggcggggtcgcgccgccccgcgacgccgccggggggtcgccgttccgaaggcgtcgtccacatcaagaggaggccacgacgtgatgctgtggcgacaaggagactgcggtgcgatgccgcgaggaggaggcggcggtgtgatggccgcctcccgtcggcgacgcggcgcggcttctcggtgcggcagcggcaggatgccgttggggcgctagcaacggcagtgtgatgctgccacgagaaagacgatggtgagatgccgttccaagaagacggcagtgagatgctgctgagaagatgtacggcggcgcgaggtcgtcatgaggatcagcgcaaagctagtcgacggtggtgtgatgccatcgtcgtcatgaagttatcctcggtggtgtgatgccgtccccaagatgagtcgctgtgacgccggcggcaagacatacatgaccaggtgcgttgccggtgcaagtggagatccatgccgcggtgacaggcgctgtgacggcgtcatccacagcgagatgccctgtgtggtcttggtgctgcgaaggcaaagttcatggcaagaggtttgcaggtgatctgcatcaagattagaggagttgacatgacaagattagggaggtgaatgttaggattaatcttgtctagccgagctgagagagtcagttagtttgttagctgcgtgagggtcgtgtgcctagagtgattctaggaggaagaagtggtcaagataagattagatgggtgcatgtgaagtggcgtgagtgggtcagtttgttagagattagtctgtacgtgatgttagtggccgagagtggccgctgggcaatacgtgtgtgagtctatttaagcagtgtaatcccgtt

SEQ ID NO: 35882 - DNA, 425 bp, Triticum aestivum
  Clone ID: PAT_TA_35882
tctcgggtaagtcaaatatctcgagacaaagggaatggaatacgggatggtttcaatccacgagattgtggtttaaaccgatgaagatctttgtcgaatatgggagagtcattatggtcatccaggtccggctagtgattattgattggaaaggtgtctcgatcttggccgcatgttctcgaacccgtagggtcacacacttaatgttcggtaacgttagggtcgtaatggggtattcataatggtgaggccgaatatagttcagagtctcgtatggggtccgaaatatcacgaggatctttagaatggtccggagatgaagattcatataaggaaagtggttttcagggttccagaaaatgtttgggatttttcagtactgtacagggaaggcttcagaaggttccgaaataggggcacctgca

SEQ ID NO: 35883 - DNA, 915 bp, Triticum aestivum
  unsure (1)..(915): unsure at all n locations
  Clone ID: PAT_TA_35883
ggtaaacattgagnatcacggaggttgccccggcgtctacggcacaaaaagacctggcagacaacacaacaacgacggtggccaaggagacaagtgccgacgcggaggcagagcaagggtcgccgccgccggcgaagtcgacggcgccgtcggtgacgcacatcgcgttgatggcagggaagaaggttctcaagattccgaatacctatgccagcttccttggcctcatctgggccctgatcgcattcaagtgcggaatcaagatgccaaaaataatcgacgactcactgttcaccatccagacgacggcggtggggctcagcatgttcgcgtcggggacgttcatagcgcggcagtcgcggttcgtcccgtgcggctacgcgatcgcgtcggtgtcgatggtgctcaagttcctcatcggcccggtggtgatgctgctcgcgtcgctcgccatcggcatgcacggcaccctgctgcacattgctgttgtacaggcggcccttcccctagccgtgacttcatttgtgtacgctgaagaatacaaggtccatgcagacatcatgagcacaggggtaattcttgggatatttatctcgctccccgtcaccattgtatactacattctattaggtctatgatcgagctaccaagatcgatgtccgaggcctgaaaagcgcatgtcagatgtagaagatgtgccacacaacagttgaagagagcagctcgattgcagcttgaagaagccaattactgggactccaacatgataatccaaattaaaggaatcaagagaatcataatgatattgtttgaatgtggtcaatcaatagaaattcatcttttcactcaaatatgatgtaaagttagtcaaactcacgttggncaaaaagtacactcctttcaatttaaaaaaaa

SEQ ID NO: 35884 - DNA, 778 bp, Triticum aestivum
  Clone ID: PAT_TA_35884
ggcacttcagactgcgccactgatacactatcagccgatggctccctcttctaacccacactatagggcatctgggaaggctaaagatgtcaatccgggcccgtttcatgtcgctgctgggggtaatcgccagatgggcggccttaactatcgatccatatgcctccggcctttgcaccagtcatagtccgcatttccagaaatgctgcatattgcggtgtcagataaccaagcgggtcgcgcacgtgacaaagaagaaaaagcgcgtgatgttccaattggcccagtcgtcgatgcaagaggttagctttcctaaccaacaagacaaagatgttggccaggatacggcaccagacaccgatgacatacctggtgatcagtaactatatttgacctaccgtccagtccagtgatagtttataatgttatttataccgagaagaaggcccggtggatgtgacctgtaactgtaagtaacttagtccaaatctgatgtgattggctgcctcaaagaaggatgagtaagagcccttgtggtgtatacactgttggcttctttatgtatatctgtgaaatggccgatatagggcacccttatttatacccagaagaagggccggtggacctgacctgtatgtaactgtaagtaacttagtccaaatctgatatgaaggatgactaagagaccttgtggtgtatactctcttggcttctgtatgtatatctgtgaaacggccaatatagggcacctacgagacatgtcggttacaaaaaaaaa

SEQ ID NO: 35885 - DNA, 1420 bp, Triticum aestivum
  unsure (1)..(1420): unsure at all n locations
  Clone ID: PAT_TA_35885
anngnttttttnnttttttttttnccaaanccatnnnggttnttttnaggggggtttccnggggncnggntcctttaannaaatggaggnnccgggtttnaaccnaagttgncccntnnggggtttttttnnggggnggnnantttntngggttaatcggnnggtttaaaaaacaagtttttgaaatttgggnttcctggnnccaagccctttaatgggcctagggccttttgtcccgccggggccgtaatgtttcatcatcccgcccaatggttggctccgggcgctttccatattccggcacgcccccgatctctaacccttgtgcctcgcctccagcttctccgtcgccaccatctcccggggttcttgcgtcgccgtggccggcccatgcccccggtggttgtccggaggccatccttcatttcctcccccgggccccccttggaaaactgcgttgtttgcccatcaccttaccaccgatagccgtccatgaacccgcgcaaaagcaggtggtcccgcacctgccgggattccgggtccgcattaaggctcttcagcttgcatcttcgacacggacatcttatctctgtctcgttcttttgaagcatctcggcttcgcggacctcaaaaacctattcacgatgccttcggtcatcgtgcggaccatggtcgcctggcagaggtccctctcaatgagtgtgcgtccagcgccctcacattgtatctgtatacctgtgatgttcggtgatgtagggcacggccttgcgccgctcctcgctgcaagaaacgatgttcaggacaggtgaagcatacaaacaatcagaaaaatatagaccctcgcactgtacctatatgcctgtgatgctcggtgatgtagggcacggccttgcgccgctcctcgctgcaagaaacgatgttcaggacaggtgaagcatacaaacgatcaggaaatacagaaatgaacagaaaaattcagaaaacgaacagaatgtaaatatctgtgatgttccgcgatgtagggaacgattgacacggccttgccggtcctcgctgaccgcagaccaccccctgaccctagagttccgcgatggcggcggcgcctgccgcccgcggcctccccctcccccagggcccccccccccccggtcgtcctcctgcttttggtcccctgagtgcggcgggttggccggctcgtcctcagcatctgagtcatgctgtgggatccgcaagctacatctgttgtgttggtgacatcatcgtcgaagagaagtacctaatcctcaccataagagcaaccaggaaacatccattgactcgatcaacaatattcgagagcctcaacaacgtcaagctacccacagtacagagcctaaggtgagcattccatgagactgagaatccatagacgggcatagcc

SEQ ID NO: 35886 - DNA, 534 bp, Triticum aestivum
  Clone ID: PAT_TA_35886
aatcgggccgtcttcgaggtgctgggctactgtgtctgcatcgccaagggcgccgctgagacgaccaagctgaacatggccctcatactcctcccggtgtgccgaaacacgctgacagcactccgatcgactgcactcagcaccgtcataccatttgacgacaacataaacttccacaaggttatcgcggttggaattgcaattggagcgggtatgcatacggttgttcacctgacctgcgacttcccaaggctggtctcctgcccaagtgacaagttccaggagaagctggggcccttcttcaactatgttcaaccaacatggggaactctgttcgcgagcactccagggtggactggtatcctcctggtcctcataatgtcattctcctttacactggcgacaacctccttcaggaggagcgtcgtgaagctgccatcgccactgcaccacctggctggcttcaattccttctggtatgcccaccacctgctggtgtttgcatatatccttctggtgatgcactcctactac

SEQ ID NO: 35887 - DNA, 1269 bp, Triticum aestivum
  Clone ID: PAT_TA_35887
ctcgcgggtcgacctaccaccctatgttttacactacggatactacctggcatacttctggatgaacaacaggatgactagagatgctctcgggatcaaggggggaacagttggcgagtgggtgagatgcaaaaaagaactcccctacacacaggacatgccaagcagcataccgtaccatcttaatctcaccacgagaggttaccgtgcactcgtatacagcggagaccatgatctccaggtgcctcagctcagcacgcaggcgtggatcagatctttgaacttctccatcggcgatgactggagggcatggcatctcgatggccaggccgcactaatctcaaggctaactgatagatacccccctagcttctccggacgcccgctgccaggcgacgcctccactggcctgtgcggcatcgcatagccgccctcctgctttagcagctctctcggccgccctccacgtcggcgacaacggtggtcaccaacctgccaggtttcgatggccctctcccctgctacatcgaaaccggagacgtgggcgcggtggaggagaccggggcggagctcttctacgacttcgccaagtcggagcggagccccggcaccgaccccgtcatcctgtggctcaccggcgggcctcgctgctcgggcttcggcggcttcgccttcgaagttggccccgtaaagtatgtgcgggcgccgtacactggagttttgccgcggctggtacagaacccgctgtcatggaccaagatggcgagcatcatcttcctggattcgcccgtctgctcgggcttctcgtatgctcgtgaccccaaaggctgcgatgtcggagactactcgtcctctctgcaagtccaaagattcctgaataagtggttcactcatcacccgcagtacctttcaaatcctttctaccttggaggagattcatacgctggaaaggtgattccacttattgcaacatacatgtcacaagatttaccatcacatatgcaaataacttgacctttgcaacagtaaagggtggaggtcatactgctccagagtaccagcctgaagaatgctttgccatggcccaaaggtggcttgacaacaagccactctgatactttgacaacacaaaaatttctctcttaacacaaatccttatatatttaatttgcttctctcaagctgtaaagatgcagtcaatagtgatgtaaaaaaataggaatgtgatatcaaacggaatttttttctctccaaaaaaaaaaaaaaaaa

SEQ ID NO: 35888 - DNA, 699 bp, Triticum aestivum
  Clone ID: PAT_TA_35888
cacgccggcaaccaggtccccgccggggagcgcggggaggtgtgcatccgcgggccgaacgtgacggccgggtacaagaccgccgaccccggcgcgaacgaggcgccgtgcccgcacgggtggtgccgcacgggcgacatccgcgtgaggggcggcgaggggcgtacggcagcctcgtggggcggatcaaggagctcatcaaccggggcggcgtgccgcgggagggaaccagcgtggcgctgggggaggaggaggtgctggccgtcgcgcagaaggtcttggtggccgtccccgtccacaagtacggcgaggagatccactgcgcggtcatccccggggagggcgaggcgctgggcgacaaggaggtggaggccttctgccggaagaacctggcggcgttcaaggagcccaagaaggtgtacatcgccgccgacctgcccaagacggccaccggcaagatccagcgccgcatcgtcgcgcagcacttcttcgtcgtgcccgccgccgccgccagggcctagaagagctcgtcggtccgtcgatcgatcacgtcgccgtcttttgtcccttttttttacgtgccagacagaacaggggattgataatgaaattgcgcgccacatgacattggagagcggtaaaagttgtggttgatttgattgatgaagattacaaatacacttcccaccgcaaacaaaa

SEQ ID NO: 35889 - DNA, 480 bp, Triticum aestivum
  Clone ID: PAT_TA_35889
tccggcctggccacagccggttcatgggatcgcacgccagctccgagtatgacaccagccagtacaacgaggacctgaagaagttcaggaagatggcgctcggcaccagcagcttccagagcagccagctaacaccgtccagcggcgagcacgagcaggagcaccagaacccgtccgtcccgagcagcgacggccatcagcagacgcaggaggtggagttggggactagtacgaagcgagacgacggcgacgtcgagagccaggcttccatgagatgaccactttccctttccttggagagagttaacctcaggacatcatttgtaaatccacagcatagctgaattcacataagctgccagctgacttggttgcaacgaacaaaaatgatattttgttcttgagatatatatatatagttcttttgttagacacaaaaaaaaaaaaaaaaaaaaaaaaaaaaaaaaaaaaaaaaaaaaa

SEQ ID NO: 35890 - DNA, 1174 bp, Triticum aestivum
  Clone ID: PAT_TA_35890
cagagcatgcatttggatcggatgaaacgaagcaagatcttgctattgttcctcctaacacaactgtttattatgacgttgaactcgtgtcctttgataaggagaaggaatcatgggagttaaaggctaatgctgagaagattgaagcggctgctaagaagaaggatgaagggaacgtctggtttaagatgggcaagtatgccagggcttctaagagatatggaaaggctttggatttcatagagtacgaaagctccttcaatgaagaagaaaaacagttgtccaaaccactcaaggtgagctgcaagctcaacaaggcagcgtgcaaactgaaacttaaagactacaaggaagcgaagaatctgtgtaccgaggtcctggaaattgacagcacaaacgtgaaggccttgtacagaagggcgcaggcacacatgcatcttgttgattttgatttggcagaggtggatatcaagagagcactggaaatagatccagagaacagggatgtaaagatgggttatcggaggttaaaggagaaggtgaaggagtacgagagaagggatgccaaattctacggcaacatgatcaacaagctgagcaagctggaagacgatgagggctgcgggagtagccaggggccaagcaagaagccgcgcagcctgtggcctctagcgcctttcttcacgaccgatggcagcaagctctggctcgttctaaggctactgatccccgtgatgatcttggtcgcgctttgtgttgcttactatgtgcagagcggagttcatgaaatcgactgcgtcaactgctgacgacgcgttggtcgacatgcccaggtcgtgcagtgttaatgttgtggtgggtcaaccgctcatggtaaatatgtttgtgacattgttctctttacagtgtctcatggactatcgtttttcctggtggaagtctattgctcattttatttcgctgtgacttggtgagtccgcacatggtgttactgtgcatcgcagtccagttcacgacacatgtactacaccacacatcatagtctatggtagcacaggtcgcgtagtgtcatgtcgtggtgtgtctcattgttctcggggtacccttgttctcatgggtaaatatgaatatgtttttcacattcttctcttggccgtgtttcaaaaaaaaaaaa

SEQ ID NO: 35891 - DNA, 720 bp, Triticum aestivum
  unsure (1)..(720): unsure at all n locations
  Clone ID: PAT_TA_35891
tcatcataaggacatggtctatcaacctggcgaaaaggcttatcttcgcgttacaccaatgaagggtgctcaccgcttcgggatcaagggcaaactagctcctcgctatattggccctttcactattctggaaaggcgtggaaaagtggcttatcagctggagcttccgccgaacctttctcaggttcacgatgtgttccacgtgtcacaactccgacgctgcttcaaggacccaatccgagcagtggaccatgaagtgctcgaattgcaacaggacctctcctataaagagcatccggtccgcattctcgaccaagctgaacgccgcacacgtcagaaggcgatcaagttcctcaaagtccagtggtcgaatcactctgaagacgaagccacctgggaacgcgaggatcgtctgtgcgaagaatatcccgcactttttccttctacctcctaaatctcgggacgagatttcttgtagtgggaggagatttgtgacgccgggataattaagctacagtaatcccacgctaatgatgccacgtcaacacagttactgtggtaacctcgcgatgattcgaaacgtttcaaaatttaaantcaaattaaggccataataaaagtttcaaaattttaacaaaaatgttcgggggtgcaaatattgcactataatatggggagaaantatttngaaatgcaactatttaaatgtgtaaanaaaaa

SEQ ID NO: 35892 - DNA, 613 bp, Triticum aestivum
  unsure (1)..(613): unsure at all n locations
  Clone ID: PAT_TA_35892
gccggccggttctcgnaagccccggacgtcaagtcgatgtagatccaccacgaggcgcgccaccccaagctccccttcgacccggacaagatcaacaacctgcacggctccaccgccgccgcgcccgccgcggcggccgtcgcgtccacctccaagcccaagcccggcatccgcggcagcctcaagaagacgggcgatgaacagaaatgaggcctccacagcttcaagcgcctcttctaagtctctgtttgccgtcgcaatggattgttatgactactgtctcgtttggtcggtcgttttaagatatttggttgtcttgtaatcggatatattatgcgctccagaacatctgggatgtactaaactgagcctaaataactggttgctgtcaatttgcttggtacctagaagggtggcaactgatgttgtgggataaacaccttaactaatcgctgccctttataacaaaaaaaaaaaaaaaaaactagtctggttttgtcgatgcacttttgttattgcattgccccactgaacaggcattgcaatgatgtgatattatgatatgcttgacacaaaacaaatcaattcaaataaaaaaaaaaagcggccgctc

SEQ ID NO: 35893 - DNA, 821 bp, Triticum aestivum
  Clone ID: PAT_TA_35893
cccacgcgtccgcccacgcgtccggtcaaacgcaaagaagacaagcgcagcaagtagggttaggagagccggcggcggcggcggcggcggaaagcgagagctccagcgggccgtcgggagggaaccaccctcgtcgtcggagatgacgggcaaggcgaagccgaagaagcacacggccaaggagatcgcggctaagatcgacgcggcgacgaccaaccgcggcgggggcaaggccgggcagaaggaccggctcgggcaggagaagggcggccacgccaagatggagtgcccgctctgcaaggtgacggcccccgacgtcaagtcgatgcagatccaccacgaggcgcgccaccccaagctccccttcgaccccgagaagatcaacaacctgcacggctccaccgccgcggctcgcgcgtcgcctccacctccaagcccaagccggcgtccgcggcagcctcaagaagacgtaatctaaaccccccataccctaccttgcatccaaacccctctattggtcggtcgtccgctccgatctaatggtcgtcgcctgcatctgctgtcttaagtttactatatgctgccgctgatgctgctgctgctctaaaatattgatgctgttgctgctgctgatgcgttcgtctacgtctcgccatatccacctggtcgctctgctgttccccgacctccccaccgtgtgcgagtcgcctcccatcctgcaatacatcttcgaacctttctcctgtgccagcccctctttcctcccctagtaaccccatctcctctgcattgctcgcttctgccgcgcttacatccacggc

SEQ ID NO: 35894 - DNA, 1034 bp, Triticum aestivum
  Clone ID: PAT_TA_35894
ctccagccgcattcaacacaaggcccccaagagcgaaaagaaaagaagcgcaggcggaaggggtaggagggggggaggaggaggcggcggcggcgggggagagcgccaagcgggggtccgggaggggaacccccctcggtcgcggagatgacgggcaaggcgaagccgaagaagcacacggccaaggagatcgcggcgaagatcgacgcggcgacgaccaagcccggccggggcgaggggcgggccggacggccggatcgggtaggagaagggcgaggagcggccagcgggagtgtccgctgtgcaagctgacagcccggcgcgccacgtcgatgccgctccaccacccggcgcgccaccccaacctccccttcgccccggacaagatccccaacctgcacggctccaccgccgcccgcgcccgccgcggccgccgtcgcgtccaccgccaagcccaagcccggcatccgcggcagcctcaagaagcccggggtaatctaaacccccctaccctaccttgcatccaaaccccccttatggtcgtccgatctgcggtggtcgtcgtcctgcatctgctgtcttagtttactactgccgctgatgctgccgttgctgctgctcataaattattgccgctgttgctgctgccgatgcgtgtggtgtgtcgtgtgatagatgcgtgatttcttttccctgtatacttgaggccgtgtggcctcgtcgccatgtttaattacctgtcgctactctaagatgctggcaaattgtttgctgatattaatgtctagtggcgctcgagcgatctgaaaagatctgctgtcgagccagttcctccaaaaaaaagctaaagtgcatgaatcggggatttgcgcttttgttccgggatttgcgcttgagtttcttatcccgccgtaagaagtattttacctcgtcgattctcggctattgatgaagctgtccctttttagcaagggagcaacatcgtttccatacacaactccatgctttaaaatgctcaactctcctttttcttc

SEQ ID NO: 35895 - DNA, 1337 bp, Triticum aestivum
  Clone ID: PAT_TA_35895
gtccgacccctcgggcagtccgcagcagccggcgtaggaggacagacgacaggcacacgcacaggtgctgttccttgcggcatgccagctgcattgtccataccggcagacaagcctgagctggggggcacgcgggaggatgctgaacctggagcctctggtaggcctgctccgcgtggtggggctggtcgtctgcggcccgatggtcgtcgccggcccacaaagcgttgcggagctacaaggcaatctggggatgctggcgattctgcttcagccgctagcacctcggcagctgctcggaggggacagcaggctctgcaagcgcttgtttctcggcgagctcttgtgtccagaggcggtgttgcggcctccgccgctccttctgcttctccagcgcctgctgctggtccgccggcgggtacaccgggggctctggggcgaccggaccgtggcgggaagctatacagcggcctcatgatctcgaggtttcgcaatctcccgtcatttggcactccgctgtcaggtgtggctgctcaagctggtgtgaggaacaccatggaagacttgacactgaaccgtgcggtgatggacaccttgagcagtatggtgcaaaatgtggatgcgccacaaaggggccaaggtggttttgacttggccagtatgatgcagcagatgatgcctgttgtgtcacaagttcttggtggagcttcacctcgtcgtgctggtacagatgtgcagcctccacggaatgacagggaagtaagcggcgctgcaggtggcagaagctctcagatggatcttcaagaagcatgtcaacgcatcgagcaacatgatgcccctgaggatatctttggtgctgtccttgagaccgctgctcaggcttatggcgacgacgagagcatcgaggtcatgcttgaagagcttgccagtgacccagagcttgctgatgagtacatgaagcttctgctggagcaagtcggcgagagggtggagtccgaatcggaggccaagacgcagtcgtgaagcgtggcccgggagtcggtcggtcgtcaagtgggtggtacatttcaggcggcgtggttgacaatgtggtgaaaacatatatacagaactcatgacttgtggatgtaattgtgtctcctgacttgtggatgtagttgttgtctgttgttaccgaattttgctagcgacatgcacatagctagctttctggaagcgtgttcctggatcagtctgttctgtggtaccgacgacatttaattgctgggcattgcgatttaagatgaacccagagcactcctgccggcctgctttcacatgtagctttcattaaaaaa

SEQ ID NO: 35896 - DNA, 449 bp, Triticum aestivum
  Clone ID: PAT_TA_35896
gggtccacctgctggtggaggtgctggcggttgcacgtagctttggttttgatcaacctcatcctcataatcgcccgcatactcattatcctcctgggtaccagcagcagcagtagcaggagccaaagaagcatcaacaacagggatagcagcaccagaagtttggccaccctcaagaggaacacgcttcgctcgtccatactgattcgaaaggggcgttgttgttgttgttgcagcaatgcgataggtgcagccggcggtggttgtggaaaatgcgcgagcaattcattgaacttgctatcaagctatgtttcgaacgtcttctcaatgccatctatcttctccatggcctcgtcaaatctatttagcacatcttgcacctgtccactcatcatttgctaaaatttatcatgtagttgtttgttcgtcaggttctcccaatcaatctc

SEQ ID NO: 35897 - DNA, 670 bp, Triticum aestivum
  Clone ID: PAT_TA_35897
tgtgcttaatgaggacgcggtgtggcggagggaaagatgagagatcgcagtcgctcgccgcaaatacaatacaacacgatacaccaccagttcatcttgtagcacatcgatcggagtaaagtgcgtgaaaatcaaggataatggacgcgaccaacaaggcgaccgggcacggcggcgccaccggccccgcggggaaccacggcggggctcctgccggtgctggtgccgggggcgtgcagcagctccaggcgacgagggacgaccgcaagaccgacggtggcctgggccgttccggcgggcccacggggaaccacggcggtgctcctgccgtcggcgcggccgccgccggtgagaagaagggcgtcgtggaaaatatcaaggagaagcttcccggcgccggcgggcagcagtgagagcgtcgagtcactgagctacatgtaccacacagcctctggcactacgtgtaaaaagctcagccacgcttttacaaataaataacgagctgtgtatgtatgcatgcatgtaccgatgtacttgtcttccatcggaataaaaatacttgtgttttgtaagaatttgaacgggaaatatattttcattggcgtacaaaaaaaaaaaaaaaaaaaaaaaaaaaaaaaaaaaaagcgggtcgacccgggagtctaggacc

SEQ ID NO: 35898 - DNA, 1044 bp, Triticum aestivum
  Clone ID: PAT_TA_35898
cgccgccccgccctccgccgcccgctgcccgcggagccccccgccccctccgccggcctgggcgcccccgtgcccgtcccccgccgctgcgcgccgcccggcttcgcccacgccgcggggctcgtggccctgcacgccccctgccgctcgcggttctcgggccgcgccttcctccggccggcccaggccatccgccgcctcgccgtgtgccgctcgctcgcgcccgtcccgggccgcctcgcgggcctgggcctcgcggtcgggggcggcgcgaccgtgcgcggcaccccgtcgagctactgcgtgcgcctgctccgcgacgccggcgcccgcgaggtgcacatgcgcatctccagccccccggtggtcggccggtgccactacggcatcgacacgcccgacgggaaggagctgatatccaccaggctggacgtcggagggcgtgcgcgagatgatcggctgcgactcgcttcgggcttcctgacgcttggacaagctccacagcatctacggcgacgaggcggacgagctctgcgacgcctgcttctcgcggaactacccggtgcctatgccggagaaggtgccggcgatggcatccgccgatgatgaagactgaccagaatgtgcgactagggaagggcagtggctctgtactccgcatgcttctataggattttgggcgtggcgaatctgtgtcgtggcaattgcattcatcgtttgaatttttgcaggtcttaagtttgtgtccctgagcggctagcgttccttggcctctcaaactgaggttgcgaaacctttttcttgagtcaatttatatactgtataagaaaggttgacaagtcaggcatctaatattgtttcgtcgccgacgtgaactgctagtgaattgcatttttcaagctcctgtgattcgggagcatttctattagttacatctgcaaagccaagcaaaaaaaaaaaaaaaaaaaaaaaaaaaaaaaaaaaaaaaaaaaaaaaaagaaaaaaaaaaaaaaaaaaaaaaaaaaaaaaaaaaaagcgggcgcc

SEQ ID NO: 35899 - DNA, 2455 bp, Triticum aestivum
  Clone ID: PAT_TA_35899
gggccgctaacccaaccctgcttccatactccaccttcctaccgccatcaccctagtcctcgtcacccagccgccgtgcccgacgacccctaaccatccaagcgctggtacgccgactcgccggcgtcgctccgcacggggggcaccctcgacccgctccccgccacgccgccgcttactgaggggcaaagatccaattcacaagggacatggatgttcaacccggctgacagacaggttgggtcgatctttcgggcactcctgaccagataaacagtgatgagcagtggataatagatgttcttgcagaggctgatgctggatcatctggcactatctctaatcggaagtacaacgcacctcaacctgggtggtgagcaattccaaatccaaattgctaagactaaggtgggtctggttattggtaagcgtcttgagcctttaaattccatgaagcactaatatcaagctcctctacatgtggttccgttgcattagcctcatggctgatacttcgactgaaaggaacactgtatattgagggtactgcaggagcaaatttgaatagcaaagcagggttcgagagacgccatcagtgacaatcatgcaagaaatccaatgtcaggttgctattcgcagcgggccgtctggatacattgagcaaggctaaactgcaccgccgccttaccctggtgaacacaccactatggatatggttaaatgccgcctggacctaatcctggtgccttacgacagtatgggcaacgggcttatggcagcttccctcaagcaagtgacggtacttgctgcgggtgggatcaaacttccagccggcacttgccccataccccccctggcgccggctcctcgctcctagccaacagcagcgccccccaaacttctcctgagccactcggccttgctcctcgcctgaggtgaatatgtaatattggttccgttgtcctgcttgttatacttaacaagcttatggtgattctacctactcacagtagagtggtgggtagcaagcttatgactactctggttaccagacccaagggcagcagcagtcttactcgcagcagcctggatatgatcagcagagctatggggcatctggctatggatcagctgctaactcaactcaggatggtactgcacctagctatggtggtccaggtggtgctggtcaagcatctccagggcagcaagcttccactccatcctctggaggccaaccgggttatcctagccaaccacctactagtgctgttgcatcaagctacccagtgcaaggttctgcccctccatctggatatgttgctccacatacacagcctggttatggtacgcagccaccaccacagggcgcatacggtcagggtggttatgggcagcctccgcaggctcagaagccgccttcatctgctcctacttatggacagccaccgcatgctcaggctggttatgggcagtatggatacagtcagcaaggctatggtgcaccgccgccttaccctggtgcacctactgctagccagccaggccatcgccagcagcagtcatacggtgatccttatgctactggtagctatgggcagcctacagcgtattctactgaagctacagcacctgctgcgtcccaggatcaatctgctgctgcacctgcgcctaccacagcaactgccgctcctgctcctgccaacagtggtgccccccaaacttctccgagttgagctgcctgctcctgcctcagctgcatttgcaatctggtttccttggctctgctgctggaagtataatactcagtttatccatgttatcttgttatagcttgcttgtcaacttcatatccaccgcctgctcaggctggttatgtgcagtatggatacagtcagcaaggctatggtgcaccgccgccttaccctggtgcacccactgctagccagccaggctatggccagcagcagtcatacggtgatccttatgctactggtagctatgggcagcctacagcgtattctactgaagctactgctgcgtccctggatcaatccgccgtggcacctgcgcctaccacagcaactgccgctcctgctcctgctcctgccaacagtggcgccccccaaacttcgccgagttgagctacctgctcctgcctctgctgcatctgcaatctggtttcattggctctgctgcttgaagtataatcctcagtttatccatgctatcttgttattgctagcttgtgaactttatatattgctatattatatcctggttttgctgcttgcgtatggcatgtactgctgtgcttgtgatcgctggtgcatattgtgacctatacttggtttgggcactgaaatgcaactgtattcaattttgcaaaaaaaaaaaaaaaaaaggcccctaggatgaaatatgtatttgacatcaatttctagcagcacttcag

SEQ ID NO: 35900 - DNA, 433 bp, Triticum aestivum
  Clone ID: PAT_TA_35900
atgtcaaaatgggaatgcaggctgtgccgctgacctctgccgcactaactgcggaggtgaatgcactaaagcagagcctcgaacggtccgagaatgagctcggccttgccaagaagtagctcgaggataaggaaggtaagtaataccttatgaaagtagtaccttatagaaaaggatttggttgcaaaaaatgacaagaataacgtgggtattgcaggggccacgaatgaggtggcgaccctgaaggaggcggtgtccaaggtcgaaagcagtgcggccttggagcgcaccgagcgagagaagcaggaggcgcgggtggcggaggtgcggcaagagctccaggctctcgtggaaaaacatgagagtttggaaggtgactcgagggcccgagagtccgagcttgcctcggctcttgagagtggcaaagccgcta

SEQ ID NO: 35901 - DNA, 770 bp, Triticum aestivum
  Clone ID: PAT_TA_35901
ggggggttgcccgggactcgaacccggaactagtcggatggagtagataattcttccttgttacaatagagaaaaatccctccccaaatcgtgcttgcatttttcattgcacacgactttccctatgtagaaatagccaatttctattccaaagaggaagttctactaattttttctagtctcgcgttttttttttttttttttattataataaaaagaacatttcagaatgaaaaatagaaaagttttttcttgatcatttatcaaccctttcctgtttcttaatttcgtctaatgattaattaagagggttgaccaggtcattgatacgtataatatccaaataccaaatacgctcagtgtgtgatccacagaaagaaaaaaagagttgttttggtgaacatcaaagaaaaaacttgctcttcttccataaaaaattcttctaaaaatgccgaacccaaccgttgcataaaagttcgtaccgtgcttttatgtttacgagctaaagttctagcgcatgaaagtcgaagtatatactttagtcgatacaaagtccgttttttcgaagatccactataataatgaaaaagatttctacatatccgaccaaatcgatcaagaatatcccaatctgataaatctgtccaaatgggtttactaataggatgccccgacaaagtacaaaattgagcttttgataagtatcctatgaggagagtagcggggactatggtatcgaatttttttcattcgagtatctattagaaatg

SEQ ID NO: 35902 - DNA, 1915 bp, Triticum aestivum
  Clone ID: PAT_TA_35902
gcagacccccatactgtataacaaaaacaaatcagtgcgggcattatgttgtgtgttcagggtcgactcaccacgccaaggtgaaacgaactcaagccccggccacactaaagagagtatgtcgtcgaacttcgaccataggggtcttctacaccatcgtgaggttcaggacctgcgcgcgcccctcccgcaggcgtccagaaaatccagtcagtccagacgttcacaggattttgagcactagactccagtgacccctccacctcaccgtcttcgtctctccaccgacttaattcatgaaccttcaattgtatctggatattgacattcacatacagagacaataaatcttcaaagcgactgaaaggcacaacaaggtatagtcacaaactcacaattccatggcggcaaaaatcttctttaatcttggtgtagtcacaagagggaagtgtcaccttcctttgctagagtcctcctctcttcttttttcttggatgcacttacctcgcattccaaataccgtcatcaatggtaccctggccttttttacacttttcctagcagtaattgcattttcacactttgtcgaccagactcagtctgttctgcactggatgcccgctgcttatgtccaaggcgtggctggccctctggtctccgagattgtaaccaagcagagaaagaaccccaagcccctgcaatactgcacgtatctcagccacagcaaatacaacacacccatatacaccaacctgccccgtccgtccgctgcactcctttttctgggggtctccccgtccccgaaatcttcctgccatgccgtcccagacgcatggtgccgtaggtcgggtggtggcttaggcgctgccgccgctcggggcatatcacagccgcccctacaggagcgcccggcggcccagcacatactaacctaagtaaagcaaaccctgaaatcctgggtgctgtaataaagctagtggtcaataactgccagtagcatgcgagtctcgcatgctcatgcctgccccacgctcgctctgcaaccctcatccaaatctacaattgcaacgcacaggggcttgggctaagctgaatgggaacctgagctggcatttgcttaagcgaccttgacatctgatctagtgtcaccaaacttgcaacaggagtctcccgcaaattgaatccgctgaagaataaactctgaatccgctgctaatgcagaagctaattaaacagcagtggcaaactgcgtttgaaaagcagtgcatgattgagggggagggtagcttcgctgcgatagccactccctccttattactgtatgccccctcggtagtttgattcatggcgtgcacctcttggttagcacctaatggccatctgagagggtgagggatgacaaaagcacactcgtcatgaagcatatcggcatggtgcatatttggttttctctgtagcttgcatatacaccaatggaaggtagctggcaatctccatgtacctcatcctttgtggccaatcgcagattaccaagaagccatcgctgctctttgtggcctcctttgaaggataatctgcgcacccccgtacggtagtgcagcgccgccccccgcgtcccgcgaaggccgccgaacttgaaccgccaccccatcctgctccatcagcctatttctttgtcggtcgcacgccttcctccgacgatgagggatttcggcaaccaccgcatccaccacttctgtccatctaatccagcagaaccagacctaggccgacgaggaggaagacctggcaggtcagggcgctgtcagggaaggatgtcctcttcctctcgtctccttatccataccacagcggtctcagccggtgacgtctaggtcgacggcggcggcggcgacaacgacgactgaggtaggag

SEQ ID NO: 35903 - DNA, 615 bp, Triticum aestivum
  Clone ID: PAT_TA_35903
gacacttgaagcatgattgatagatgaatatgaaatgagttcacttgtcacaaaacaaagtgttgagtttacataataagttcacagctcaaaaatatatatgagctcacagccgagagaaattggagaaattgagttatagaagatcggtggcacgcggcgtcaaggaaatcggcggcgtcatgacgtccaggagacgtgggtggcgtccagcgattgacccaagaagtccaggcaatcagggaatgttccagcaaagaaggcaatgacttttccatatcacccatatcatgaattttttgacttcaaactgtatgatatcatggactctgcataagttgataagacatgataattaaccgcaaaaagcatgggtatggataacacattgaaagtaataccagagagcaaatttaacgcttacaataaagcatgggcacagataacttattggttcatctgccactgcttattatctaccaagaaactacaaatgaaatgtataactaaattaggaataagaactccataaaacattggctttggtctgcaaaccattaatctgattggagatggaaactaaaccaagatcgggtaaagtttgaacataagata

SEQ ID NO: 35904 - DNA, 1231 bp, Triticum aestivum
  unsure (1)..(1231): unsure at all n locations
  Clone ID: PAT_TA_35904
aggaaaccctaaggaaggtgcccgcgtccattgggcggtatttccatgaaaggtatcattgagaaggtggggtccgtcctcgcatccccaacccgcgtcgcttgagcgacgcggcggtagaagggctgtctatgtcagttgaggcccttgtgggcatccgagttgttgataggtcatggcctgatcattgtccggggttggttgtttgcagtaccaacactgtctaagaagggaaaggtggtgctgcttgattttcaagagggagagttgcctacctagtcagatggtgtggttgagctcgcaagccgtgttgttgctgttgattacccagagggaaaacttgctgtttctgtggaggcctctgcggggtcgattttcttgcccgaggtacaggtcagacctttgggatgaaagtgccaaggggaagatttactcgcacgtgtgatctggttttctgcaaaatgctagttacagttgcttggtcccttgtttcttgctatcgggtttaaaatccaagcttatctgtttggccatccttacccgtggtttgcccaggtaagccttttgaactatttatgtatctatattgtcatgccttggtacctccctacctgttgtacttgattcatccataccgtttgctcccgagtgtggtattacttagtctgcgtcccgtaatgagcatattagttgttgctactaaactttcacacaccgctgtaatgttatttattgtcaaaagggagtttgaggattatgggttatgttgcagatacttttatatccatgaaaggtatcatttagaagatgggatccgttttcgcatccccagcaagcgctgcatgcttgagtttgctttggcagtgctgcctatgtcagttgaggccattgtgggcatccgagttgttgatgggtcatggcctgatcattgtccggggttggttgtttgcagtaccaacagtgtaaaagaagggaaagtggtgctgcttgattttcaaaatggagagttgcctaccaagtcagatggtgtggttgagcttgcaaggcgtgttggttctgttgattacccanagggaaaacttactgtttctgtggaggcctcgcggggtcgattttttgcacgaggtacaggcgactttgggatgaaagtggccagggggaagtaatcctcgcccgggggaatccggtttcttggaaaaggtaattaccagtggctgggccccttggttct

SEQ ID NO: 35905 - DNA, 426 bp, Triticum aestivum
  Clone ID: PAT_TA_35905
gcaggggagagaaagagatgggatttggcgaaaactgctaagtcctaatgcccttttagtcccggttggtccaacgaaccgggaccaaagagcggcattggtaccggttggttccgtgtaactacttttttattttctgcagctatttttttgttgattcttcctgcagctgtttttttagtcccacctcgccaagcgagaggcagtcgcagttgtttataagccctgagtgcagagatgatgacgaagaggctcaatgctcctgcatattggttagcttcaagccttgaggaatacggtagactgcacagagctatgtgcagtgcagttgacactattccgaaaggcttgaagcaaatttaacaagcattgcgcctcttttttatttttaatgacttattacaactgagaaataaaaaaaaaaaa

SEQ ID NO: 35906 - DNA, 473 bp, Triticum aestivum
  Clone ID: PAT_TA_35906
ttgaacaatatgcaaagcaaactgcttaatgcgccattgcctggctgtactggaagtgtccgcgagatccaaatagatacgacgacgggaaggaggctcgtgaagaaggagaagattcaggtctcaggtgggtgagatcgatggggaagatggctcgcaacacaattatatctgggaatttagaattgtatagtttaccgtgctgctttcttttcttttttgtgggtagatctgatgtctctacgtataatagataccgagtgtatgctggtggttctttccattcttttgggttcgtgggtgccatgtaaatgttggtggatcgattccttatgtttttgcctcctgcggtaaataaaagctaatgcagattcgtgatcaaaaaaaactacaaaatattatagccaaaaaaaaaaaaaaaaaaaactcgagactagttctctctaacaaaaaaaaaaagcggccgccccaaa

SEQ ID NO: 35907 - DNA, 713 bp, Triticum aestivum
  Clone ID: PAT_TA_35907
gcacgcggcccgcgccgcacgggacaagtgaactgaacagcgaccagatgcacatggacccaggcactgccgaagatctgaatgaagatcccttgggctttgagttatatgatgaccagactgattctgcaccaaaagaataccttttcactggaggcggattctgtgcggaggaggatgaacaagatacagcggttgatcgatctggcggggaaacagtgggtggaacaagtgacgcatgtgaggatatcgcgggggtttctgacggcggtaaaagtataggcttgtcgacgccgactgaagagtgtgcagaggatactagtacggacgcccggggtgcatcttcatcgaagcgacacaatgctggcagtggtctgcccaagattgccaaacgtaggagaaaataactggcttcctcatagtgcatcatgcctgtctgtcattataggttcgagtttatgtgtagcccacgtttcgacattttgcttggcaaccctgtagtgcatcacttgctactgctttgctgtagctctgttctcgtgcatagtctgaaatgctggtaaaataactgtaaagcatgaagtttttggttgctccttctgttcgagattatgtgtagctcacgtttcgacattttgcttggctgcccgctggttcagcgcttgctactactttgctgtagctctgttctcgtgtatagtctaaaatcggca

SEQ ID NO: 35908 - DNA, 678 bp, Triticum aestivum
  unsure (1)..(678): unsure at all n locations
  Clone ID: PAT_TA_35908
ctaggaagactgaggcaattgcctgtgtgagctcagagaggaaagagcggggtcagattgagacatctctgaggtcggaagagaatttcctgcacctcaaagctgagaacgacatgcagagatacaagagcgagatccgtgccctggagcagcagatctcgcagctgaagatatccctggacgcttcanagacggctgctcccaagtggggaacggacgacaagacccgtgccctgcgtctctccgaggggagaaagaacggcggcaacgcacaggtcctggccaatgttgcgggggcggcggccctggacctcgacttcgacgacatccagcgcgaccgcgagtgcgtcatgtgcctgagcgaggagatgtcggtggtgttcctcccctgtgcccaccaggtggtctgcgccaagtgcaacgacctccacgacaagcaggggatgaaggagtgcccgtcgtgccggaccctcatccagcgcagggtctgcgcccgcaccgtgggctgctgagtgagaagagagagattttgcgttcgcgtcgccgtcgctataccgtttttccttttctttttgatgattgcccagcttgaatttgatggagattggaaaaaagaataacgagtgtcggtcggacgaataacgcttggtcgagacatcgtacaccccccaagcacaa

SEQ ID NO: 35909 - DNA, 1292 bp, Triticum aestivum
  Clone ID: PAT_TA_35909
agccccttcctctcctcactctgtcacccccgctcctccctttataacccgcctgcactccaccacctcacagcccacagctcacaacacacccaccgccgctgcctcaacttccccttcccggagcagcagccagagaggaagcgagagagagagagagagagggcgatggaggggaaggaggaggacgtgcggctgggcgccaacaggtactcggagcggcagcccatcgggacggcggcgcagggcggcggcgacgacaaggactacaaggagccgccccccgcgccgctgttcgagcccggggagctcaagtcctgggccttctaccgcgccggcatcgccgagttcatcgccaccttcctcttactctacgtcaccgtgctcaccgtcatgggcgtctccaagtccccctccaagtgcgccaccgtcggcatccagggcatcgcatgggccttcggcggcatgatcttcgcgctcgtctactgcaccgccggcatctcaggaggacacatcaacccagcggagacctttgggctgttcttggccaggaagctgtccctgaccagggccgttctacataattatgcaatgcctaggggccatctgtggagctggagtggtgaagggcttccagcagggtctgtacacgggcaacggtggcggcgccaatgtagtcgccagtggctacaccaagggcgatggccttggcgctgagatcattggcaccttcgtcttggtctacaccgttttctctgctactgatgccaagaggaatgccagagactcccatgttcctatcctggcccctctgccgattgggttcgcggtcttcctggtccacctggccaccatcccatcactggcaccggcatcaacccagcgaggagccttggcgctgccatcatctacaacaaggaccatgcctggaatgaccattggatcttctgggtgggccccttcgtgggcgctgccctggcggccgtgtaccaccaggtgatcatcagagcgattcccttcaacaagagcaggtcctaagccgcctcgcctccgctaccaaaagctgatccgaaataacgagcttctttgtgatgtcttgtttcgagcgcctagtaccgcatccgccgtcgattctcctgaagatgttctctcctgactgaatccagacttgcgtgtgttaagactccagtgtgagtgtgtgacagttgtgtgtgctctcattgtggaagatttaataagttataatttgttgatgtagcttcccataaaaaaaaaaaaaaaaaaggccccta

SEQ ID NO: 35910 - DNA, 1348 bp, Triticum aestivum
  Clone ID: PAT_TA_35910
gccccccttgcccgcgccccctcccccccctcgctctctccccaccccacaccccccgctgccgcacccgcctctactccaccacctcacagcccgccgcccagaacacacccaccgccgccgctgcctcagcttccccttcccggagcagccaaccagcgagcaagggagggacagaacaatggaggggaaggaggaggacgtgcggctgggcgccaacaggtactcggagcggcagcccatcgggacggcggcgcagggcggcggcgacgacaaggactacaaggagccgccccccgcgccgctcttcgagcccggggagctcaagtcctggtccttctaccgcgccggcatcgccgagttcatcgccaccttcctcttcctctacgtcaccgttctcaccgtcatgggagtctccaagtccccctccaagtgcgccaccgtcggcgtccagggcatcgcctggtccttcggcggcatgatcttcgcgctcgtctactgcaccgccggcatctcaggagggcacatcaacccagcggtgacttttgggctgttcttggccaggaagctgtccctgaccagggccatcttctacataattatgcaatgcctaggggccatctgtggagctggagtggtgaagggcttccagcagggtctgtatatgggcaacggtggcggcgccaatgtagtcgccagtggctacaccaagggcgacggccttggtgctgagatcattggcaccttcgtcctggtctacaccgtcttctcggccaccgatgccaagaggaatgccagagactcccatgttcctatcgtggccccctcttgaccgattggggttcgctggtgctgcctggttcaacctcggggaccaatccccgatcagtggcaccggccttaacggagggaggagccctggggctcctctcatgtacaacaggctccaaccctggaacgaccataggatctcccggctgggcccctcagtgggcgctgccctggcggtccgtctaccaccagggtgttgatcaaagcgagttccgttgaacaaggcttcatttctcctaagccaggtcccggcctctgctgtcagaaagccgatcgggattaacgagcttctttgtgatatcctgttttgagcgcctagtatcgcatccgccgtcgattatccatctcgatctcctgaagatgttatctcctgcctgaatccagactcgcgtgtattaagactccagtgtgacagttgggtgtgctcttattgtcgtggaagatttaagttataacctgtttgttgctgtgctttccatttagctactcccgttgttgcatttggaatgttgccacc

SEQ ID NO: 35911 - DNA, 470 bp, Triticum aestivum
  unsure (1)..(470): unsure at all n locations
  Clone ID: PAT_TA_35911
acgggagcgcaccgatnagataaatttgaggcgcaggtcggcgaggcgcagcaagagttcaggctctcatgaaaacatgagatttggagctcgactcgaagacgcgagcgtccgagctttctgtggcccttaaaactgccatatccgccaaggccgaagcccagaaggccctccaggaattggatgcggtgaaaaagacagcggcgagtaaggcattctctatggaaagcagacatataaaagtaaactacttgttacttacccgaatccggagctctccaggggcattcgcagatcttccccgcagcgtatccgatgccgccgcattctaccgagccacggaaggcaccttgacggagaaggtgttctggtctcagtacgctgaggccggacaccctgtgcccttgagcgaccagctgaagcagctggtcgagctccacaaggcggccaaacaggccctgaagggtttc

SEQ ID NO: 35912 - DNA, 762 bp, Triticum aestivum
  unsure (1)..(762): unsure at all n locations
  Clone ID: PAT_TA_35912
atcaaactgtttacctttttngatatatgtcatgatttagttcgatcattttttctatgttcacatccactttcttgctcaaaaaatataaaagctgcatgccgaagctggaaaaggcagttcgaggttgccttgaagtatgtcctgtgcactcttgctgctgacaatttgatatatgctcgcgagattattaaatccgttgctcgaaagcatgggttgatagcaacgtttcttccaaaacctgacctgaatgatattggatcgggttcccatgtgcatctgagtttatggaagaatgatcagaatgtttttatgggatcaaatgaatacagccactatggaatgtcaaacgttggagaacagttccttgctggagtataccatcatcttccatcaatcttggcatttactgctcctcaccctaacagaatcaaatcctgcagattatgctaccaaacttaaaaggctaccacaggaccttctggaatctgtagaatcacttgctgcagacaaaactttgcatcagctaatcggcgataagcttattacagccattatcgctgtacgcaaggctgagattgatcactactcgaagaaccctggggcatttggcgatctcattcaccgttactaagacagaatacttgtctcaagaccactttctcgttaagccgacaaataatgttgcccacgaattactgattctcatcactgaatttgcagtcgttggtgtttcttcagttaataataaagtgcttttag

SEQ ID NO: 35913 - DNA, 1717 bp, Triticum aestivum
  Clone ID: PAT_TA_35913
cgtccgcccacgcgtccggatggatatgcttttccggagacatactatctaggatccaggagggcacgtgatgttgtttaccgtgtcctatcagctgcatctgaagatggtgatcttagcattcaggaagctatagatgcagttgaggacatctttagaagaaatgcatcggatctgtacaagttgaacgttgccaatgggtcaattcaccagaaaacgatagctgacaataggatagcatcatcttgtgttgagcaagatgtgctttttgttcgcatcgtctggaatgatgcttcaggccaacatagatgccgcgttgtcccagccggaaggttttatgagattgcaaggaataagggtgtcggcctgacttttgcatcaatgggaatgacttccttctgtgacggcccagctgatggaacaaaccttactggtgtaggcgagatcaggcttatgccagatatgtcgacacttttgagactcccatggtcaacacgtgaggaaatggtgatagctgacatgcaaattaggcctggagaagcctgggaatactgtcctagatatgccttaagaaaagtcacaaaagttctgctggatgaattcaatgtgacaatgaaggcaggttttgagaatgaattttatctccgcagaaaattagtaagtgagggacatgagcgttgggttccatatgataatagcagttactgctcaacctcatcatttgatggtgcctcatctatactacaagaagtgtattcttctcttaaagtggcaaatattgtggttgagcagctgcatgccgaagctggaaaagggcagttcgaggttgccttgaagtatgtcctgtgcactcttgctgctgacaatttgatatatgctcgcgagattattaaatccgttgctcgaaagcacgggttgatagcaacgtttcttccaaaacctgacctgaatgatattggatcgggctcccatgtgcatctgagtttatggaagaatgatcagaatgtttttatgggatcaaatgaatacagccactatggaatgtcaaacgttggagaacagttccttgctggagtataccatcatcttccatcaatcttggcatttactgctcctcaccctaacagctacgatcgaattcagccaaatacatggagtggagcttacctatgctgggggaaagaaaaccgggaggctccattgagaaccgcatgcccacctggtgtgcctctcgacatggtcagcaacttcgaaattaaatcatttgatgggtgcgcaaatccacacttggggcttgctgctattgtcgctgctgggattgatggacttaggaaaggccttaagttgcctgaaccaattgaatcaaatcctgcagattatgctaccaaacttaaaaggctaccacaggaccttctggaatctgtagaatcacttgctgcagacaaaactttgcatgagctaatcggcgataagcttattacagccattatcgctgtgcgcaaggctgagattgatcactactcgaagaaccctggggcatttggcgatctcattcaccgttactaagacagaatacttgtctcaagaccactttctcgttaagccgacaaataatgttgcccatgaattactgattctcatcactggatttgcagtcgttggtgtttttttaattaataataaagtgcttttagaataaaaaaaaaaaaaaaaaaaa

SEQ ID NO: 35914 - DNA, 974 bp, Triticum aestivum
  unsure (1)..(974): unsure at all n locations
  Clone ID: PAT_TA_35914
acgagcctacgttccgacatatgttgccaaactttaatgagtgctggtgggatagtatcatcttggacatcttgatctgcaattggtttggtatttgggcgggaatgcacacggtccggtacttcgatggtaaaacatatgaatgggttggactgagccgacagcccagcatcatgggtaaggtgaaaagatcgttgagccagttcactccggcacagtgggacaaggatcaatggcagccgttcatgggtccgttgcggttcatccaagtgttgttcctctgcgtcgttttcatgatggtggaactcaacacatttttccttaaattctgcctctggatccctccgaggaatcccttggttgtgtacagattgatcctctggtggctgatcgcgatcccgaccatccgcgagtacaactcgtacctgcaggacagcaaaccggtgaggaaggtcggcgccttctgttggctctctgtagccatatgcatagtggagcttcttatctgcatgaagtttgggcatgggctttttcatgatccgatgcctacctggctgatcatcttttggaggtcggcgggggtagcgttcgtgatcttcttgctcgcgtggtcgtggaggaaccaccagaaattccgcagaaagaatctctgatagtttggtgggaagagtgatttctactgaatcacttcaaagttactttttctatacataggctgtacatatatgatgtaactgaaaaacctcaggggagccaattccatgtggctcctgacagtgacacgaacctggtctgtcacagtagcccattgttgccagcttcataagattgacaattatagatcaatcaacaataatgcatcaaggcatgatgtaacgagctaataaatcgagattctacatttggggtctgtctcaagatgccccggacaatctttgtgcacaaangtaaataaatctggggctgtttttctg

SEQ ID NO: 35915 - DNA, 410 bp, Triticum aestivum
  Clone ID: PAT_TA_35915
gctgcgtctacaacaactcatcggcaacaactccagtcaacagcgtccgcctcgtcatttgcgtccacgacactcccgctgtggctgcgggagggaatagaggagaaggcaggaaggcaccagaaggggacgcagtcaccgccctaggtgccgacccatcagagacgcagttgatgatggtgcggcggagaagacgacgaaagcacaagagttcaaattcagtcgtcatcgtccgcttcactcccgctacgactgagggggaatgttagaagtataattatgtttaagttagagataggattggtttaaaccacatgtaacttgtcttgtactccaagtctctatccctcatgatgtactctatatatacccctatgagggtcagatcaatagaacaataatattcagcc

SEQ ID NO: 35916 - DNA, 542 bp, Triticum aestivum
  Clone ID: PAT_TA_35916
cccacgcgtccgggccaggccactctcccccctcccgaatctccctccttcctctccccccctcgttcgttccttcgctcgctcgcaccccgatctccgtcgcagcccgggcgtggcttccggcggggcgggcggaggaatcgaggcgataccggcgaggtacaagatggctctcaccagaattggtcttgctggcctcgccgtcatggggcagaaccttgccctcaacattgcggagaaaggcttccccatctccgtctacaacaggaccacctccaaggtcgatgagaccgttcagcgcgccaagctagaaggaaaccttcctctctacggtttccatgaccctgcatccttcgtcaactccattcagaagccacgtgtcgtcatcatgcttgtcaaggccggcgctccggttgaccagactatcgccacgctcgcagcacacctggagcagggtgactgcatcgttgatggaggaaacgagtggtacgagaacacggaaaggagggagaaggcgatggaggagcgtggactcctctacc

SEQ ID NO: 35917 - DNA, 750 bp, Triticum aestivum
  Clone ID: PAT_TA_35917
cgtccgcggacgcgtgggctcgcattccaatcgcatccgcaaaaccacactcgtcttccttgctcctcgacccacgcagatctcatccaaggcaggcgcaggtacaagatggctctcaccagaattggtcttgccggcctcgccgtcatggggcagaaccttgccctcaacattgcagagaaagggttccccatctctgtctacaacaggaccacctccaaggtcgatgagactgttcagcgcgccaagctagaaggaaaccttcctctctacggtttccatgaccctgcatccttcgtcaactccattcagaaaccacgtgtcgtcatcatgcttgtcaaggccggtgctcctgttgaccagaccatcgcaacgctcgcagcacacctggagcagggcgactgcatcgttgatggaggaaacgagtggtacgagaacacggaaaggagggagaaggcgatggaggagcgtggactcctctacctcgggatgggtgtttccggaggagaggagggtgcccgccatggcccctccatgatgcctggaggctcactggaggcgtaccagtacattgaagacattcttctcaaggtgtctgctcaggtccctgacagtggcccgtgtgtcacatacattgggaagggtggatctggaaactttgtcaagatgggtcacaatggtattgagtacggtgacatgcaactgatcgctgaggcgtatgacgttttcaagtcggtttggaagctcaca

SEQ ID NO: 35918 - DNA, 578 bp, Triticum aestivum
  Clone ID: PAT_TA_35918
gacccgagtttgcgcaggagatcatggacaggcaggccgcatggaggagggtcgtgtgcctcgccatcaacaacggcgtgagcacccccggcatgtcggcgagcctggcctactttgactcgtacaggagggagaggcttcccgcgaacctcgtgcaggcccagagggattactttggggcgcacacctacgagagggtcgacatgccgggatccttccacaccgagtggtacaagatcgccaactcgaagatctaagctgctgctgctgctgctgctgctgctgctgctgctgctgctgctgagagacggcccatcaggtttcgtcttgtcggtaggtatatcttttgttgttgagtcctttttcctgtaggggaggaactgcctgccgtttaatttttattactcgagtaatgagtctgtctgtggtgtatttattttctacaaggaggtccagccggtattctctccactagttccatgtgattgatcaaccctggagggaaaccaccactgttatttgtcggatttcgccatcctgaattttatatagcatgaagaaataaaatacgttttcac

SEQ ID NO: 35919 - DNA, 780 bp, Triticum aestivum
  unsure (1)..(780): unsure at all n locations
  Clone ID: PAT_TA_35919
cagggtgactactccagtggtgaaactgtcgacaaggcacagctgatcgaggatgtgaggaaagccctctacgcctccaagatctgcagctacgcncagggcatgaacatcatcaaggccaagagcacggagaagggatggggcctcaacctcggcgagctggccaggatctggaagggcgggtgcatcatccgcgccagcttcctcgaccgcatcaagaaggcctatgacaggaacggtgagctcgccaacctcctcatcgaccccgagttcgcgcaggagatcatggacaggcaagccgcatggaggagggtcgtctgcctcgccatcaacaacggcgtcagcacccctggcatgtccgcgagtctggcctactttgactcctaccggagggacaggcttcctgcaaaccttgtccaggcccagagggactacttcggggcgcacacctacgagagggttgacatgcccggctccttccacaccgagtggtacaagatcgccaactcgaagatctaagatgctgctgctgctctaccaagagacggcccatcacgtttcgtcttcttggtatcctttgttgctgccagtcatgagtccttttcctgtaggggaggaaccgctgtttaatttttatcatttgagtaacgagtcctgtatttattttctacaaggagatcacatattctctccagtctccactacttccatgtgattgatgaaccctggtgggaagacattgccattctgaattagtttgaataaaatgtgtttttacct

SEQ ID NO: 35920 - DNA, 2287 bp, Triticum aestivum
  unsure (1)..(2287): unsure at all n locations
  Clone ID: PAT_TA_35920
acgcgtccgcgcacgcgtgcgccctatctatatatccctacttgctatcccctcctaagttagctcacttcgctctgatcgcaccacgatctccgtcgcagccaggacgtggcttaacgccggagacgggcgggtaggaatctgagacagataccggaccgtccgcgcaaacccaacacttgcctccctcctcgacccacgcgcagcgcaggcagattgggggggtacaagatggctcggggccggcccccggtcgcacccgcatcgcccctactcctctcccctcgcacagcccatcctcgtcccgcgcatgtacgcaacgaagggacgccatcccgaacacgagtactggtcttgccggccgtggcgtcatgcggcacaacctaggcctcaacattgcggtgaacgggttccccatctctgtctacaacaggaccacctccaaggtcgatgagacggtccatcgcgccaagctagcaggcaaccttcgcctctaaggttcctatgaccctgcttccttcgtcaactacattcagatgccacgtgtcttcatcatgcttgtcacgtccgctgccccggttgcccagaccctcgcagcgctcccagcacacctggagcagggcgactgcatctgtgatggaaggaatggagcgttatgacagcaaggaaaggagggagaagaggacggagcagggtggcctcgtcgtcctggaggtgggtgttcccggaggaggagagggtggccggcatggcccgtccaggatgcccgggggcttgctggaggccataccagtacattgaagacattcttctcaaggcggccggtcacgtggccgcccacggccccccgtcacgcctccatcatggggggggggatcgagccacaaagtttggcaagttggttcagaacggggacgagcggtgatacgcgaatcctgtggaggggccgaaggccgttctccagtgcgaggggggggaggcgaacagggcgttggcgcggagtatggcggctgggagcgtggggtggaatcgtcggactcttcactgatgttttctgcagcaagggatgaccacgggtgaaggctacttggtcgacaaggtcctggacaagaccgggatgaagggaaccgggaagtggacagtgcagcaggctgctgagctctctgtggctgctcctaccattgaggcgtccttggattccaggttcctcagcgggctgaaggatgagcgtgtcgcggcttccaagatcttccagggtcgactactccagcggctgagaactgtcgacaaggcacaggcctgatcgagggaatgtgaggaaagccctctacgcctccaagatctgcagctacgcccaagggcatgaacatcatcaaggccaagagcacggagaacgggatggggcctcaacctcggcgagctggccaggcatctggaagggcgggtgcatcatccgcgccagcttcctggaccgcatcaagaatgcctatgacaggaacggtgagctcaccaaccacctcaacaaccccgagctcgccacccgagatcatggacagggaatccgcgtgggggagggtggactgccacgccatcgacaagcggcgccagcaccccgggcatcagcgccagtctcgcctcctctgaccccgaccgcagggactggcttcatcctcaccttctccacccggagggagtacgttccccggggcgcccacctaccagggcgcagacatgcccggctccttgcacacccagtggcacgagatcgccaacgccaagatctaagctgcagctgctggttccaagatgagacggcccctcatgctttaacatcctgctgctgctctattcgtcgacggcccatcaggtttcgtcttctcggtattcattgttgctgccagtcatgagtctttttcctgtaggggaggattctccgtttaatttttattatttgagttccctatattctgtatttattttctacaaggagatcacagattctctccagtcttccactacttccatgtgattgatcaacccccagtatggaaaacattgccattatgacttagtggaaaacaaacttgtatttaccagatttcgccattctgaattttataaagtatgaagaaataaaatgtgtttttacctaaaaaaaaaaaaaaaaaaaaaaaaaaaaaaaaaaaaaaaaaaaaaaaaaaacaaaaaaaaaaaaacgctaaaaacaagtgaattccggccgctanggcggccggaagcatgcnantttnccccnaattccgcccta

SEQ ID NO: 35921 - DNA, 807 bp, Triticum aestivum
  Clone ID: PAT_TA_35921
tttccccagaattataatgcatgacgaatacctgtgtaaatgaatatcctgttgatgctgttatatgtccaattgaaacacattccgagaaattttacatttgtgatgataagcagatttaacacactttaaaaagggaaagaaaacaaaacaccatacgggctaacaaatggggccgcagatactttttcttgatacaactgcatatttgaattctttgtgccgccttgctggctttgtagtcactgcagacccctgccaacaatcccataactcggaaatatccattatttgcctgtttccttaacatcatctgaatctgagtcactagcattgtaccctggtcgtttattgcaaactttccagactgtagaccgatatcttgatgctttctccatccaaattctagacttgtgctcgttcttgttgacgccgtagccgctgcggtacatctgaccgacgaggacctgcatggcggcgtcgccggcgcgcgcctccttgagcgtgtcctggaaccaccgcttcgtgcagtccaaaaccacctccgcgagcggcacccggtcgtcctcctgcatcccgcatgccgccgccacatcccgcacctcggcccgtccagagctagccccggcggcggcgccgggaccggcgttcctgggagtatccagcggagcggtcgggggcttcgctgccttgctagcggcgggggagaagcgggcgtaggggcggacagcggcggctagggcggcggctgggaagcgcctgcccatgcaaagctggggtttcaggggaggaggggggagggtagat

SEQ ID NO: 35922 - DNA, 822 bp, Triticum aestivum
  Clone ID: PAT_TA_35922
gtggagggcgcggggggtggcgggtagccaaccgcaccagggatcgccggcggagatggcgcagagggagaaatcctccgtcgcggtcgcctccctgtcgtcctccgcgccaaccgccgtgccctcgggcgagcggtggggcgccgcgatcggcaacctgggagagctaggcgccaacgtcgagtcgctgcagaagctgctcgcccggaaggccgtcttcgtcgacgacgacgtcttctccaaggcctccctcgcctccgaacaggcccgctccatcaagattcttgaccagagggtgcagtctctggaacgtgaactggacgctgccatttctgcagctgctcgagcccgtacggaaaaacgccaggctgaagctgctcaacgagctgcagagctgcgtgcacaggaagtcacgaaggagctggagaacaccgcaagagttttccagctgcacatggaagagctgcgggcaaaacaagaggagatcgccaagagagatagtgatatcaaggtgttggaagcaataatacgaaccctgagtagcaaagatgatggcggatccagcgagtaataaccatacactgggagcatttgggcattctcattgatgctttcgtgttcaagcatcccgacacatatttatcgactccatgtaagcacttcaatactcagatgattgtatattgttttcacaagatcgaacactcagatagtcacttgcaatggtatgctgtcatcctgttactttacatgttgataattggccatgaatatcaagcagaaactgttggcactaaaaaaaaaaaaaaaaaaactcgagac

SEQ ID NO: 35923 - DNA, 436 bp, Triticum aestivum
  Clone ID: PAT_TA_35923
cattcaaattagaagacggcgaaccttgtggaattaagcaaactgcctgtttcactgaagtccaagggatcaataagttaacaagcaagcaagatgatcatgaacataacaggtgatatacattgatgtgagtgtgtagtgtaggcaaatttcatctcccttgctagttgattttactcttctccgaatcataacttgtgatgtgtgcaagtacagttaacaaagaacagcaacataaaagtgtgcaatagtttggatccttctgtgttgaatgatgaaatcatactttagatccttctgtgttgaaagatgaaatcttactttaaaaaaggtaaaaccttaaaatacagttaaagaaaaatgaaaagcccaacaaaaggtgcacaaatttcaattcaaggggcatctgttaaaaaaatccgtaactgggaaaacc

SEQ ID NO: 35924 - DNA, 687 bp, Triticum aestivum
  unsure (1)..(687): unsure at all n locations
  Clone ID: PAT_TA_35924
taggggattaagattctctgacactcttagttatgatggcacaaattttgatgtttgggtaattcccatgcttaatccctttagggtcatggacccaaatttagagcgaattgtagatatgggtttttctcctccaaatgatccccaaagattatctctagaggatgataaaaactcttatctcaatgcccaacttctaatgtgctttttgatgctttgagcaatgtagttatatttcaactcatgccgtttctgggatgctcatgagttgtggacaaagcttcaagataaatatggtgtgtccagagatttgtgggagatgattgttctccttccacctccggtcgtatagtattctcaacttccttctacttcaacctacatgtggtttgccacaaggtaatgatatgggtgagtagtggtgttcattgcaatggattatagtgagcttaatatggatgatccntcatcactttattaatgcaatgcttcaccttttggaccttaacacttcgagcaccctaaaggttcacatccgggtgttatccggctggctgtcctggtgctgccgctcccagananagcttcnagtctgtgcaagataaagtacaatcctcangggggccgtaccaatccctaangagcttacccccacggcgtctttaaactctacngaaacctgngtac

SEQ ID NO: 35925 - DNA, 931 bp, Triticum aestivum
  Clone ID: PAT_TA_35925
attcggcacgagcatccttctcctaccttcctccttccccttctgcaagataggactccatgaatccttgtactggttgtaatagccattgctactgaagtacttagtaatcttgatcgagagctacgccttccatcgctactcttacacctcccccgtgcaaataagcagccgccgccgagtctgccttgccaatactctctggagatgcaaagcctcccatgggcgattatccgaagcgtcagcagagtcggctctgctgcgcctcgctggtggcttccagctcttgcccgacgagatgcccctccactcatggagtcagcaccgtcttatccaaatcaacatctctataaaattttccgtgagaagcatagcaagctggatttgccgtgcctctccttctgttctgctactacacgaggcatggataaagcagagaggatgaaggcagcagaggagagcaatcccatggtagagacaagtgcaatacaagatgtgtattaccagccaatcatcccgggtagcagccaccgtgatggtactatatacaagaaaaggcttgaatgggaaagtgaatactgtgtagatgttgacgaccgcacagaaactcagctggagccagcatcttgggacgatatgacatgtgaaatgatgcagattttctccttaaagttagctaaatctcctatcaacagtggctcaatgcagttatatggatacatcgcggcacgagatgaatatgatttaaggcttaattatcttttcaatcgtagcagagaagatcccatcgtcgtgcaacagggttctctcattcaaatgaccggacctaagagaggcattgcatttcactgtgatgttctacttgagtttgacatgagaatcaagaacggagaaaacaaaggagatgacacacagttgattgatggaatgt

SEQ ID NO: 35926 - DNA, 729 bp, Triticum aestivum
  unsure (1)..(729): unsure at all n locations
  Clone ID: PAT_TA_35926
tggagaaggaaattagtgcaaacaaatctcacattagttccgttaaccgaccatgcacgccgatcagctattaccggcggtcgtcgccgcggtggccatggcttgcctgctcatcgccggccgggccgacggcctcgaggagtacgccccttctgccgcggtgagcctggagattgagccgctgtccatgaaccagaaccccggggagttcctcccgcgaccggaggtgatgtcgctgccgaccgatctgctctcaaggccagacgtgggtggcgacggtgaggggtacgtcccgcaggtggaggttgtgccagaggtggtgctgcagcccggagaccccctcgccgaggctctcggcggtggctcgtatgcagaggagccatcgacagagccggtcacgctcatgggcgagcagggcgacatctaccgcaccggtgcgacaccgagcccagcacagccgccggcgaagccgtcttcccctggccagaagaaggctggttaagaatactaatccaaagggacgctagcctatgatcccgttgctcttcccttagcaagtttgtttcctgttgcagaaaaataaggggccatgcatgcaacgtgtgcatgtgcacgtcttggccgagagattgttttacttaccttagtggtnntatttggatgtcaagaatcagacgtgagttttaagaaaaggaattaagaaccggcgaacgttctaccgaattgccc

SEQ ID NO: 35927 - DNA, 1938 bp, Triticum aestivum
  Clone ID: PAT_TA_35927
ccacgggggagatcgccccaccgagagaactacttccctttttctccgctgcgcagaaggaccctccctcaccgccctacgccgccgacgccgcctccgccaaacgcagcgcatccggagcactcccgtcaagctcgtcctgtgagaagttcgccgcgccgcggtcgcacgagaataagctccactacaacgtattacgagcggaggagggcggcgactcagagctcgtccgccaggcggagcgcaaccgattggcccctttcccgttctttgacgaggtcatcgacctcgaaaagaggtggcgccagcggcagttcgagctcgacaagatccggcaggagctcaacaagaccagaaaggagatcggcaagctcaagaccaaaaagcaggatgcgacgcaggtgatacagagcacagaggagattaagaagaggctggccgccaaggagacggaggtgtaggaggcaaagaccaccctcgatgccaagctagtgacaattggcaacctcgtgcatgaatctgtgcccatcagcagcgacgaggcaaacaatgctattgtccggacatggggagagaagagactggaggagaaattgaagaatcatgtggatctttgcataatgcttgacatcgtatctttggataagggtgctgatgtagctggtggaagaggtttctttttgaagggtgacggtgttctcctgaaccaggcgttgataaattttgggctatcattcctgggaaaacgagaatttacaccaatgcaaactccttttttcatgagaaaggaaatcatggcaaaatgtgcccagttggcccaatttgatgaggagctctacaaagtaacaggtgacggagaggataagtatctcatagcaacatcggagcaaccgctatgtgcttatcatctaggtgatcgaatttatcctgcagatttgcctatcagatatgctgggttctccacgtgcttccggaaagaagctggttcacacgggagggacacagctggcatcttcagagtccaccagtttgaaaagatcgagcagttctgcgccacaggtccaaatgacaatgtatcctgggaaatgcatgaggagatgattaaaaatgcagaagatttttatcaggcgattgggctaccatatcaactagtttcaattgtctctggtgctcttaatgatgctgcagctaagaagtatgatttggaagcatggttccctgcatcaaaaaccttccgagaattagtgtcctgttcaaattgcacagattatcaggcaaggagacttggaataggctatggccagaaaaagaatgatgagcaatcgaagcagtttgttcatatgttgaattccacgctgactgcaactgagaggaccctttgctgtattctggagaactaccagagggagggtggtgttaaagtgccagaggtgttgcggccattcatgcttgggatagatttccttcctttcaagcggcctcttgttgatagcaaacaagctgctgccgactccaaacccaacaagtctaaaccaaagggaaatgcaggttgagctgtaagggtagcgaaatgaaaattgtttccaggcagataatggtgcacccttccttttattaatttcaaggtctgtagcatgatgatgatttggtgtcccattttggttgttttggttacaaaatattacaatccaggacacagtttaccacaaagtatattagtgcttttcatcactatgacatccgttgccctaattaggtccttacagagtttgaagtagtgataacttaatttattttggtattgcaagctgacgtgtaaatcgctggttgcctgattagcagtggtacttgtgggacagagatgaaaatgctaagatttttaccccaaaaaaaaaaaaaaaaaaaaaaaaaaaaaaaaaactcgagactagacctcgg

SEQ ID NO: 35928 - DNA, 958 bp, Triticum aestivum
  Clone ID: PAT_TA_35928
ctcaaggacctcaagttgagatcctgcagactggttgaccgacactctgcgctcaagatcgacacgccgcatgccgggcttgagaatctttggttcatcagctttcgttgcgcactgatcgagcttatctccgtccctaagctcaggatattctggtgttggagccgcaagaaccctcctgtgcgctgcggctatgttcctgagctttacaaagtagaactcggttctcgggccaaggcatcgcaagtgccatttgcactgagcgagtgcttttcaaggagtgccacaaacctgtctaaactgtatctcaattttggctctcaaatgatttggattaagccagaacacccgaaggagctcacttctatattcaacaacctgactagtttggcgctttttaatatcttttctgagtgtaacctgagctggaccttgtttcccctggatggtccgcctgccctgccggtatccggatcaccccgttcccaacgcccaggcgcccgagtgtccaaggtcggtcccgcgaggtcgacgctcgcgcgggaaccatccaaggatttgaagcacctaaacctgaagttatttataatgtttgggttcgaggatgaagacaaggtgacaaactatataaggcttgtcatggaacgtgccgtgggcttgaaaagaatcgagttgcatggtagaagcccatgcaatgggtgcgatgccatcgaccttgagtccctgagaagatcccaggcggatgaagctagcaggcatcggattaaggagcaactcagacatggatcttcctcgtccgtggagatagtaatctgctgatggatatggtgaaggaatgataaatttcataaagctgctcgagcgatgactgtacgaggtgcaggcagtcgtaattttaagttcagttattgatagtctggatgaatgttttgtttttgtccaatttacggagtaatta

SEQ ID NO: 35929 - DNA, 699 bp, Triticum aestivum
  unsure (1)..(699): unsure at all n locations
  Clone ID: PAT_TA_35929
ttactattnttaattgccttttcttgttcttgcttatcttcgaagattttcggaattcagatacctctgcctccaatttctcaaccgtagcactcagcgtacgtctattgtcttgcgtgaccatctccattaaagcagtttctaactcctcggccctgagttcagctgatcttttctcctcaagcagtttgcacagctcaacctttagccatgttacctgatcttgaagatcaatgccctcatccaactcattttctaatgctgaaccagtaaggtagcttccccagggttgttgacccagagtccccattcacttgcaaaccatctgccccttccttggaatcaacttgtgggcacacagatgaggggtcatgtttaaagctatataatttagttgctaaccccttcttatctttccaggatttacggtcttttgatctttcctccatagccgctataatctctggcctgtgcttttctcttagctctcgcaatcccatttctttgactgactgaaaacccatacaagctgtcaatacaagttggctgctgtcaaaggtagagccagcaagagactgcagtaacgtaattgcatctccagcatcctttgtggtcaccaaggcaggcccatataagtccagcaaagcaagggttgtccggaacaacattgtacgatttccttcaaagaggatcacatcc

SEQ ID NO: 35930 - DNA, 831 bp, Triticum aestivum
  Clone ID: PAT_TA_35930
ttttggctcgcatgcagctagcaaagaagaataacttcagccttgatcagcagaaaccaaatgatgaagctactgtcgacatcaatgtagctacggtatcagaggcactgagaagggcactcggatacttctccgccatacaagcgcatgatgggcactggccaggagattttccggggccactctttaccacagcaaccatgatgagagttttgtatgtcaccgagtcattaggtactacgctgtcatcggagcatcgcaaggagatctgtcgttacttgtacaaccgtcagaatatagatggaggctggggactacacgcggaaggcgagagctccatgctcagctcagctctcaactacgctgctctaagactacttggtgagggcgctgatgatggaccggatatgtccatgccgaaagctcggaaatggatacatgaccatggtggtgcaacaatgataccaatcttgggaaaagtgtggctctcggtacttggggtttctgaatggtcaggtgtaaaccctatgcccccagaattgttccttctgccatccttcgttcctatccaaccaggacggttgtggagtcacttcagaatggctttcatccccatgtcctatttatatggcaagaagtttgttggcccaataacaaaactggttttatcattaagggaagagctgcatattcacccctacaaaaagattaactggaagcaagcgcgcaaattatgcgcaaaggaagatgcgtatcatccacatacctggctccaagaatgcttgtccgattgcctttacagtttcggtgaaccttttctggcatgttggc

SEQ ID NO: 35931 - DNA, 1722 bp, Triticum aestivum
  Clone ID: PAT_TA_35931
ggctcagggtccaagggcctcctccggtacatcctgtgtgtggggctgggccctgcggcgtcgcggcggccagcgtagaggttcagtcccctcaccactcggtgctattgcttgggctccccttcactcgtggtggtggctttccgcccccctgggctgcggtggtgcgtgtccgtggcttctggagtgtcttccccgcgtgggggcctggctgatggtgtaggtctccttgggtcgtcgggcagtgtgtcgtggagaggggttggcgggccgcggtggcctttcttttaacagagggtcccgagaacccagtagctgatattatatatgacaacaagttagaacatactagctaatacaggtatccctactacgaaaaacattcactcccttctttggtagacaagatctgaaaagaaccaggattggaactggtttgctggtgggaatgggatatggattgaaaaataaccttcatctttctctcctctcgtagggcccttcgtcctcgtcccgtcgcctgaacattctgagataaaggctggggacagtggtgtcatggtggacaagatagaagtaccttcacctgaacattctgagataaaggttggggacatcttcgctcggcttcatcccatccctgcctccagcgctgctgactctccctggcagcgcgcctcccgctgccctgctccccgcggtcgcctgtgctgcgcccttgccccgtcgtggcttcgcggagcggccgcctcgctctgccccccacctgatcgatcgccgccgtcgcgtctccccctcgtggtgtccgttactggccgccacctgggagtgcttctcctcttcgcccttgtgggactgcctccctggcccccgagcggcggtctgccgctgaacatcgggccatgatggcatgatctgaaagaaaggggaaaggggtaggctcggtattggtgagggtcgggcttctggtgtgcgcgggggctgccccctctcttttgcaagcacgttctgacgggacatcgccgggcaaggcagccccggcttcactgatcgccagtaggcctcatctggtcaccaccaggaactggtaatttgtgcgatgttgtttaacaacacacatgttttttttgttagtttggtggtatactgcttgatacgtgtggtcagcatatgctagagaggcagaaattgggcctaccggagaacgacaaccagatgtcaacagtgataagcctaaagttcgacgtgaaaacacagagaggtcgcaaatcggaaaagacaaccagaacaatcaacgtcgacaaatttactcctagtggaaagctaaacaggtggccacttgggagagcttatcttcttcgccgtattgagaatggtatcctgtacaccgaagagcgatatggctaacagcgaaactctttgtttcatccatttgagtagaattaatacgtatcatgctagtgtaattagaaagagttcgagttcatgtggttgattggagacgacttaattttagcaagcattttctgcggggacaacttcggccaagtgaaccactgctagaatgaactacattgggtttaagctaaatccaatccaataacccttttggggggtaaattataaggtttgcaaaagaaccatgcttgcaaaaatgtatctcgattggatgattgtatcctcgactcatagtggttaaccaacctagtgtggttttagtcc

SEQ ID NO: 35932 - DNA, 404 bp, Triticum aestivum
  Clone ID: PAT_TA_35932
tcctattattgttgtgcctcacgaaaataatgaagatgatgcacttgatgatgatctcgttatgcctattgcttgttgtgatgattatgattgggaagataatgatacttcttatgatcttgaaaatctttttggcacttgcttggaatatgataattgctatactattggtgctatccatactactaatgatgagagtgattatgcttatgatatgaaaaggcccaagcttggggatgctatgtttgaagaatatgatatttttgagaatatatttgctgcaattaatgtttgtcccaagcttggggatgctacgtttaatgaagatgatatttttagcccccccccccaaagttttgatatgcaaagttgttatgatgatagaatgcctcctacttatgatg

SEQ ID NO: 35933 - DNA, 867 bp, Triticum aestivum
  Clone ID: PAT_TA_35933
aaggtctcctcaccgccgacgccgcccgatccctcgtcggctccgtcgacgccttcctcttcgattgcgatggggtgatttggaaaggggacgagctcatccaaggggtccccgagacgctggagttgctgcgaaaattggtatgccgcaccggacgttctggtagcaagagtaccgctctaatcacgaagtggcgaacgatttgcgcccccggccccctctcatctcttccttagttgggcaagaaattagtttttgtaacaaacaattctaggaagtcgagaaggcagtattcaaagaaattcaaaacacttggccttgaagttactgaggaagagatcttcacgtcatcatttgcagcagccatgttcttgaagttaaataatttttctccagaaaaagaagtttatgttgttggtgaggatggcattttggacgagctcaagttagctggctttgaatgttttggtggtccggaggatggcaagaaaaacataatgttggaggcaaacttctactttgaccacgacaaaagtgttggagctgtcgttgttggacttgatcagtacttcaactattacaaaatgcagtatgcaagcttgtgtattcgtgagaatccaggctgccttttcatcgcgaccaaccgtgatcctactggacatatgacatccgtccaagaatggccaggagctggaactatggttgctgcagtaattgctcggtgcagaaagagcccattgttgttggaaaaccttcaagctttttgatggacttcctattgaaaagcttcaatttggaaacgtcgagaatgtgcatggttggtgacagactagacacagacatactatttggccagaatactggttg

SEQ ID NO: 35934 - DNA, 1644 bp, Triticum aestivum
  Clone ID: PAT_TA_35934
ctcgtgccgaattcggcacgagataacgttcacttagccccaccgcgtccgcgcacgcggccgccgcgaagaagaaaagccatggccgaaggtctcctcaccgccgacgctgcccgatccctcgtcggctccgtcgacgccttcctcttcgattgcgatggggtaatttggaaaggggacgagctcatccaaggggtccccgagacgctggagttgctgcgaaaattgggcaagaaattagtttttgtaacaaacaattctaggaagtcgagaaggcagtattcaaagaaattcaaaacacttggccttgaagttcccgaggaagagatcttcacgtcatcatttgcagcagccatgttcttgaagttaaataatttttctccagaaaagaaggtttatgttgttggtgaggatggcattttggacgagctcaagttagctggctttgaatgttttggtggtccggaggatggcaaagaaaaacataatgttggaggcaaacttctactttgaccacgacaaaagtaatgtgttggagctgtcgttgttggacttgatcagtacttctaactattacaaaatgcagtatgcaagcttagtgtatatccgcagaatccaggctgtcttttcattgcgaccaaccgtgatcctactggacatatgacatccgccccagaagggccaggagctggtactatggttgctgcagtcttccgctcggagcgcatcgatctcgtaacggcgggaaagcctttgggtggtgtgagagtcgacccagtcaaactatttggccagaatactggttgcaagaccctccttgttctgtcaggtgagactaccttaccagacctccaggatgccgcaaataccatccatccagatctttacacaatctctgtgcacgcagtagtccagtagctccagcaatccacttgtacatagtaattcgtactacagatgcagcacgtggcctgactactgcaccagcaataatctccgggacactttgtatgtcacctaacaaaattttacgtgaacagcgtatttgactctgttcggtgatattatctattctttgggtagcttcttcgtagctaccctggcttttattttttgaccacttcaactcaatctaagtactgccatttacaagtcacacagcagcatatatttatcatggcattgttaaaacttccagttgggacaatggaatcacatgtcagtcttgaaatgtatggaactgaacagttttgtttcataagtttattcaactgtggcaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaggggccccaagggccccaaggggccgcccaacggaaaccaccccccaaataaattttttgggggccggggggccgaaaagccctaaatggaaccccaaaggggaccccccattttaaactttgaggggaaaacccgggaaacgggggaaaaaaggagggaaaaaaagcaaagggggggggccttagggccttggaaagggaaggggcccccttgcgggaaacccccacccccgccgggttaaagggccc

SEQ ID NO: 35935 - DNA, 396 bp, Triticum aestivum
  Clone ID: PAT_TA_35935
aagtacaacaacttcggcgatggaagtcaagattatggggagattattaggataatcatgactttgatgcatggataagctagctacatgcgtgcgtgagttggttagtctatgcatggcgtgagttagctggttaagttgttagctacgtgcatgcatcgcatggatatgggtgcatgtggttgagatattctaggaggtgagtgtccgtgtgtgtacatggatagagtttgttagactccaaaaaaaaaaaaaaaaaaaaaaaaaaaaaaaaaaaaaaaaaaaaaaaaaaaaaaaaaaaaaaacaaaaaaaaaaaaaaaaaaaaaaaacaaaaggaaaaaaaatacaacaaaggaaaaaaaaaggcaagaacaaaaaaaaaaaaaggggccgcc

SEQ ID NO: 35936 - DNA, 677 bp, Triticum aestivum
  unsure (1)..(677): unsure at all n locations
  Clone ID: PAT_TA_35936
tctcaaagatgtttcaaagaaaatcttccttgcaatcttacaacttcatgctattaagatagcactagcttaacaatcattccaagattgagtaaatgcgccgctcatatgactgcaacactttgttgtgcatatccactgtgatgatccagtcctcaccaaaactgtcacactcttgcaatatgaagtataaaccatgattatcatgtgtgttcacaatagggaattgtggcacccatcgtggaagggaagactctcggaagtttgcaagagcccataaatcatcgacttggaacatgcttgtctgatgccattccaactccggcattttcaaagtccaaactgtgactgtgaaaccagatttcttcatgcttccaaaaaagccattatcgatgtcaacaaagttaacaatacctttgcatacaccaacagttctatatgcctcagggtatacacgaccataagagagatcatcgagctcagtccaaatttctatccctggaagctggatgaaacggagctctagattttcaccagcagaaagcacgttgcaggacaataagccgcggtggtaatccacccagtatattgtaccatctggataggagaatacctgatctgtctcccataggcacggcttgagggcctcgccatcgtanggcattgttggactcttc

SEQ ID NO: 35937 - DNA, 870 bp, Triticum aestivum
  unsure (1)..(870): unsure at all n locations
  Clone ID: PAT_TA_35937
gtnaggttcaagnactctgatggatgagagcgtggtagctgagagcccaaggaacatggtattgaacacaataaggaagatgaagccacatgtgttcattcatggggtcactaatggatcctataatgcaccattcttcgtctcacgcttccgggaggcattgttccagttctctgctcacttcgacatgttggaggctaacattcccagggataatgaggagaggctgctcattgagtcgactattttcagtcgggaggcaattaatgtaatatcttgtgagggaatggagaggatggagaggccagagacctacaagcagtggcaggtgcggaatcagagagctcggttcaagcagctcccgctggaccaggaaatcatgaagcgtgcacgggagaaagtgaagtgctaccacaagaatttcatcatcgacgaggacaacgggtggttactacaaggatggaaggggcgtatcctgtacgcgctctcaacatggaaggcgaacccccaattctagcttctgtaaatggtgacctgttcatatttttggactctagagctgattggtcctggccaacaacccattagtaggtaaaaaaatgctatttgaaccggcgccaaaggaacaaaaacatttgttcaccagtgacatggttcatttgtttgttgatgcagatgatgaacctgattactctcctgtagcatctgcctgttgtatgtgctgcccatgcacggttagttttcacaggaacagttagcatttttggtggagcaggctacttatgttagatgtagcatataggttcttcttgcattgtcagtcttgtattatattcgttcctccacagtacctcgcccgcgtccacgcta

SEQ ID NO: 35938 - DNA, 965 bp, Triticum aestivum
  Clone ID: PAT_TA_35938
cgacccacgcgtccggctgaggacactgcaaggtgtgcatgagtcgagagtcggatcactggcatggaacaagagcatcctgaccgctggtggtatggacggcaagatcgtgaacaatgatgtgaggattagggaccatgcagttcagacataccgcgggcactcgcaggaggtgtgtggactcaagtggtccggatcagggcggcagctagcgagcggtggtaacgacaacctcctccacatatgggatgtgtccatggcatcctctacacaatctgcaggccgcacccaatggctacacaggatggaagaccactcggctgcggtgaaggcgctcgcatggtgccccttccagagcaacctgctggcgtcgggtggcggcgcaaatgaccggtgcatcaggttctggaacacacacacgggcgcatgcctcaactcagtcgacactgggtcacaagtctgtgcgctgctatggaacaagaatgacagagagctgctgagctcgcatgggttcactcagaaccagctcacactgtggaagtacccgtcgatggtcaagatggccgagctcaatggccatacttcccgtgtcctcttcatggctcagagccgtgatggttgcacggtggcatccgctgcagcagacgagaccctgcgcttttggaatgtgtttcctgatgctccgaagtctgcagtgaaagagaagacttcacagagcagattgttcaacagttacaatcacctacgctagggagggagcagattccggcaacggccgcaactctgacaagaagtagctgattttacttggaaattctttgtgtgcattgaagtatttgtgggtacttcagtatggtggtaactctagttgttgttctacattgatccagatgaacatcaagaccagtttgatgtgttattcatacatatgttggtgatatataatttttttatcaaccaaatgc

SEQ ID NO: 35939 - DNA, 410 bp, Triticum aestivum
  Clone ID: PAT_TA_35939
gctgacgacggggatgtcggactggagcgagtgcccggagctggggccgatcggggacctgcttgtgtccaaggacttccagaccaaggcgtccgtgctggtggtgcagtcctatgggagggcggcggcggcggcggccgcgtcgacgtcttctgaatttgctgttggcgaggccgtcttgccggcgccagaggccatcatgccggcgacctccatggggcacccgccaaggcgcccacgacaacattcacattctgaccttatgctttgatagtagtatagtttggtaaagcttgctagcacattgattaattaattaattaattagggagcgcctaatttttgcaggggaattaggaagtgtctgatgatcagtcgagtgatgttaatttgggtgacagtcaaacatt

SEQ ID NO: 35940 - DNA, 301 bp, Triticum aestivum
  Clone ID: PAT_TA_35940
agcaggagaaaccacacaaaattttcttcgacacctacctgtaactgaagtaattctgtaagggctcatttgccttgcatgattctaaaaacatagggataggtcatggaaaaacacctgaatatgataggaatgcacatgggaaacaaagcatttgtgaacacaggatttctgtcaacttgggtgtttgcttcacaggaattggaggagcagaggaatgcaaagaagcatggccaaaataaagtgaaaccatatgaaagcgtgtatagggaaaaaaatcagcggtcattcacacgaaaca

SEQ ID NO: 35941 - DNA, 1017 bp, Triticum aestivum
  Clone ID: PAT_TA_35941
gcccctttggcaatcggcaaacacttcaaatcccccgaccgttggactcgcaacgttcttctccaacccacagcccaccaggctcctccccctcgatccagccgatccccttcccttcttctccccgcctccaatcaaaaccacacatcacacaccaccacatcccgagagagagaaccctagctcgcgcgctcctaaccctagaattctgcccgtccatggcggcggagaccaaaccctcctccgggacggaggcggcggcggcgacggccgtgcagttccaggtggacgaggcgtacgagtaccgcgcgcccaagtacttcgacttcgtcctcgacgagacggaggccgacatccgcgccgccgagcgctggttcgaggccggcgccagccacgcgccctcgcccttcgccccgaggatcaaggagtcgagagcggaggtcaagatcgacgcactctgcgacttcgcggacgcggaggacccggctccatctccaaacaaccaagcaacggaggaggcagcagtcaacgccccaaatccggcaggggatatcgatggcacgtctgcttgtcctgacaccatgtcagagtcgccgccaacagaagagaaggaggagtcacccaagtctttcgagttccccctgtccaaagatttggctgcaaaatcagatgttgggtctagcacgcccaagattcagaggccgcctccacctgcggaagttaccactgctgcgaccactcgtgccaagtcaacagtgaaggctgaagcgtgcactcccaaggtgcaggggagctcatccactcgctcaaagaccgtgcaaccgtctaatctgaagcagtcctcgctggcattaaagaagaagagtgcgataaagggggctcgtgatgcggtggccggaaatgcagctgctgctgcaaatgatatcaggcaagaaaatcaggctgtgaagaggcaaaaactagatgatggaagtacaagacagatattgaacgtcaagtcccgggtgctgcttcaca

SEQ ID NO: 35942 - DNA, 1167 bp, Triticum aestivum
  unsure (1)..(1167): unsure at all n locations
  Clone ID: PAT_TA_35942
gtctccactcccgctgccgactccggcgaccaccatggncactcgccggagccccgccaccacccaccaccgcctcctcctactcctcctccccttgctgctaatcggctcgttcctcctccccctctcgtccgcctaccgccccggcgacatcatccccatgctccgctccggccagtaccacggctcgaggtcggtgtggttcgacgtcatcggccgccactgcccggtcttcgcggtcaaccgggaggtgctggtgccgatccccaagcccacagggttcaccggtgcggatccgtataagataacatttcagattggacacgaaaagttccatgttccttggctttatgttattaatcgcaaaagctctgaagttccactgattgatttccatttaaaatacactggaaacgatttgcttggtgttacggctaaagtagtggacatgcctcaccattttgtggaacttcatcctgacataaagaagaatttctgggatccacagaattggccaaaatatgtacttgttagttatacatgggaggaacaatcagagatagatgttactgcaggattctatgtgttatttggatctggccttgttctttccttcatccttgcaatctatgtattgcaatcatctcaagataagttaacaaggtttgtgcgagaagcggtttctgatagcagtctacctgaaggaggggttgcaaaggttgagtgatgtttccgcgaggggctgttggattatcaacaaatgtccacttatggaaacaccgacaaagacattgtgaactcgagctttcttgggagcgtggacaatagcatgcatctgaagaaccggtgaaccattgcgtgtgcatgcagtgttcagttctggctttttcctcgcggtaacggaacatttagcaaactgaagtatgtgcagttgctagctcattacagttttgatatatgacctgtgtgatttcaatgttgcaagaatttgtcttctacatctacattttgtagaatgtgtaagtaaaaacaggcaccgtgtacacctctacagatcacaagattggtgcaaatgtttcattgcttcatccggtggaaacaccaatcctcccttgaaactgtactgtttgtgttggttacatgggaaatgaacctgggttaaaaaaa

SEQ ID NO: 35943 - DNA, 1103 bp, Triticum aestivum
  Clone ID: PAT_TA_35943
gcacgagggatacacacgagatttgatttgaaagggcatggtcaccgcacgccacaccgcccacccgtagaacaaagaaaaaagaaaaggggaaaaaatcgcatcaaacccccttcccctcccttcctcccggttcgtgaggggatctccggcggcggcggcggcggcgatggcccgaaagagaaagacggacgccgcgccgcggttggacgaggccgaccgcacgctctactccagcttctgcggcgccgccaattccctctcccagctatactcccaggccatggcccagcagaagctctccttccaggctggcgagcggcacgccctcgaaaagctccaccaatggatcttgaggaagcatgatgaggagtcgaggcttactgttgcggacataatgtcacacatccagcatgagattgactatggaggtactgatgcacatgtatccccaagggtacatcagcatcccatgagtgtgaatccgtttacaagtatccaaccctcagctgggtcgtacgcacaagcaacatccgggcatgctcccagacccagcctcagtgaccagtcaaagaatacaatattctcaaatgcattatcaagcccggtccgcaggagcctccagacgtatcacttaacccaaggtgctggtaatggaggacggaacactgaagcaaactcagccgggcaaaaccgagaggccaactctgcaagctccaatgacacctccatggacatggtttcagacagcgcaggaaatgggtactactaagtcagtttgtggaaacatgttgcatgcacaaccaggaagcgtcgagtgccagtattttctctggtttttgtatgttatgtatttttcctaaagctcatgcactgtgtggctttatagttgcacacctggcaattcacttaaaagttattggatttgttttgttttgttcaagcctgtttggagagaaatctatatgtaagcctggttcatgtcttttaaaaaaaaaaacatgttcgggcgttgccatggagattctgaatgtaaatgaaaattgctatgatatagcaaagagtttatgtgcttaatacaatgagagggttaaattaaaaaa

SEQ ID NO: 35944 - DNA, 698 bp, Triticum aestivum
  Clone ID: PAT_TA_35944
gggagaatggaagcacgggagcgtccccctccccggcgctccttcttctcctccgcggctcaccaccgccgtggcgcctcatgccggcgccccactcacgacacgggagcgactctgccgcgcagagcgctcacctccttatcttgtgtgccgaggcttgctcgtctattttcctttttacccaggcccaatagaaagtaacggcccaagcgttaacggaagaacgtagaccaagcccgtgagcgaaagaacgttgtaataaggaattttgacaaaaatctttagtgcgtaccccaaattagtaccacctcgtttatattacgattttatctatataaattgtaaaagcgtattatgacatgagaagaaagcgtattgtgacggtgaacccgacaaagtcaatccgtgctttattattagggagagatatagggatgcagttcgtgtgttacaacgggagaaaaagagacttaacatcataagtaagcataactcgaggccccttaccagacttgcacatactaaatatgcaatacttggcagggaggtaacgttgacaattccctactaacgctgatagtaaactataatatatgaatcctagaggtcaaggaaatgagcagttatttttcccttgtttatgtgctctgaccgtggtactgccgttgttgaaggcatacatgtgggccccgctgtcg

SEQ ID NO: 35945 - DNA, 681 bp, Triticum aestivum
  Clone ID: PAT_TA_35945
gcacgagggaggacgagttcctcatcctcgccagcgacggcctgtgggacgtggtgagcaacgaggtggcttgccacgtggtgcgatcgtgcgtgcgcagcttcgcggcgcgccgcccccggcgcccgtgcccggcctccaacctggcccccgggcgcagcggtgcgcgccgcagcggcagcaccagcggcgacgaagcccagaacgacggcggcggttgtgccgacgcacgctccgagagcgacgaggagagcggcgaggaggtggacgaggcatgcgccgaggcggccatcctgctgaccaagctggcgatagcgcggcagagcccggacaacgtcagcgtcgtcgtcgtcaacctcaggaggcgccgcccgagattctgaccgccgctggatccatggatccaccatactatcgtccgtgatccctgactcagcggcgaacgtggcatccatagcggaattcatgaaatacacaacgaaattgtttcgtttattttccgggggtggcaaaggtgttgaggccagacagacccacgccgcccccgccattttcctttcgaaagccggcgatggtttccggcgtgtcaagaagctttctttctcgagcgtcatgagaaactgtactataatccggtggaaacgaacaaagcttccaatcttccaaaaaaaaaaaaaaaaa

SEQ ID NO: 35946 - DNA, 681 bp, Triticum aestivum
  unsure (1)..(681): unsure at all n locations
  Clone ID: PAT_TA_35946
tntttccctggaaggtttttcagntantggtaccngtttccgtaganttaaagagcnttgggggtangacnntttggnaattgtncggcccccttgtccgnattgttgagacccggccnttgcgaggacgcccgggacgccgcaggttttangcgttccttgttgggctgcgctntccttnccgaggcgccgcccgtttgttgctcggctgcccgccgcttaaggacgcggagggaatgcacgcggggctatgcggcccccggggacgacgtgtgcgccggcggcgatcatgtcggtggagggcatcatcaaggtctccgtcccactacgacatctcctacttcgcgccggcccaagcaccatgaggaagtggagatggacgggagggtggtcgaccggaaagggaggatgacggcggtgaccacggaggtccggaagaaggagtccggcgcgctggtggcgatcggccggcagtggatgaccacctccagaccaaagggatatcaagggagcaagctatgatacagcaacgatgagaacactatctgtccaaattcattgattaactgacaatgttaaatgcttatttgaggagctcttttacggtaccgggtaatgaatacgggccctccattccgaaagagccaacggcccaaagagataaaaaaaaaaaaaaaaaac

SEQ ID NO: 35947 - DNA, 504 bp, Triticum aestivum
  unsure (1)..(504): unsure at all n locations
  Clone ID: PAT_TA_35947
ttacccccttgtgggatgttctattttgcagctgcttgtatgacatgggagctggctgagtcgggagtacattttatcactacagtcatcaatggagctgatttggtgccaacattttcggcagcggcagtagatgatcttcgttcagaggtgacggcatctgcctggctgaatgatctccgtcaccaaatcgagcaaactagaatcctgagcactttctatcgatctgcatctgccttgggatcgcgacttccttctatggcaaatgctaaagctagagtagctggtgctggtgccatcctaagacctgtatctaatgggacacaggttgtaatgaggagagctcacagtgtagcacaagcagcgtggacaagaccggggctacaacaatcctcaanggncttgtattgggccaaaggcaacggaatnctaacccaattgtcacatccngaagaatacacttccaactaccaacgggggtcccgaaccacttcacnatggacg

SEQ ID NO: 35948 - DNA, 390 bp, Triticum aestivum
  Clone ID: PAT_TA_35948
agttcattaaactaccttaggtggtggttttgttttctttcactaagcggggcttataaggatttcctgttgagttttgtgttgtgaagtttacatgttttgggttaagctttgaaggactacggaatacagtggcgagagcctaagcgtggggatgcccatggcaccccaagagattctacgagtagcaaaagcctaagcttggggatgccccaagaacagcatcccctctttcgtcttcgttcatggtgaactttacttgaagctatatttttacacgccacatgataagtgtttttcttggagcgtcacgtactacatcaatcttatctttttaatataccacaatcatcctttctgtacacaccttttgagataagcccacatgat

SEQ ID NO: 35949 - DNA, 1449 bp, Triticum aestivum
  Clone ID: PAT_TA_35949
gtcgagggccgaggatacagtgtaaagggggtagtaacacaatcccaaatggaattttcaaacctaaggaacttaaggatggtacggttgcttggttggctgcttgtttggctgctgctgttgcggatccatcttctgagcctcgctcatatcaggctgccccgcgcattccacattggcgagaggctatggagcaagagtttcatgctctccttcgtaacaagacatggactctcattcctcccccaccacgggtaaatattattgactcaaaatgggtattcaaagtgaagaagcattcggatggatctattgagcgttacaaagcgcgacttgttgctcgcggttttcggcagcgtcatggtcttgactatgaggacaccttcagtcctgtcgtcaagcctaccactattcggcttcttctctccattgctgtttctcgtggttggtcacttcgtcaacttgatgtgcagaatgcttttctacatggatttttggaggaagaggtttatatgaaacagccgcctggtttctctgatcctgatcgtcctgactatatttgtcgtctttccaaagcactatatggtttgaagcaagctcctcgtgcctggcatgcccgccttgcctctgcccttcgtgctcatgggtttgtgccgtccactgctgacacttcattatttcttctacagaagccagaagtcactatgtaccttttggtatatgtcgatgatattatccttgtcagctcttctcagtatgctgctaatgctcttgtctgctctcttggtgctgattttgcggtcaaagatcttgggaagcttcactactttcttggagttgaggtcacttctcgtgctactggtcttgtccttacgcagaagaagtactccttggagttgttacaaagagctggcatgctgaagtgcaaaccgaccaccacacccatgacgtctaccgacaagataacagctgttgatggtgagcttttgtctcctgcggatgccacagagtacaggagcattgttggtggacttcagtacttgacgatcacgagatcagatatctcttatgctgttaacagggtttgtcagtatcttcaggctcccagagatactcattgggctgctgttaaacgcattcttcgttatgttcagttcaccctgacatttggaatgcatattcggccgacttcctctcgggtcctttcggccttctctgatgcagattgggctggtagtccagatgacaggcgatccacggggggttatgcagtattctttgtctctaatttgatcgcctggagtgctcggaaacaggctactgtgtcacgtagcagtactgaagctgagtacaaggctgtggctaatgctacagcagagattatttgggtgcagtctttgcttcaggagttgggtttgtctcaaccacaacctcctattctttggtgtc

SEQ ID NO: 35950 - DNA, 606 bp, Triticum aestivum
  unsure (1)..(606): unsure at all n locations
  Clone ID: PAT_TA_35950
gcggcgtcccacgtattggttggcattttccatagcgtgtcaagctcctctttcagcagccccagatacagattgatgtcgttccctggttgttttggcccttcaattagcatactcatgtgaatgtacttcctcttcatgcacaaccaggggggaaggttgtacatccacacaaacacaggccaggtgctatgtgtgcttctctggctgccaaatggattgactccatcggtgctcgcgcccagcacgatgttccttggatcgttcccaaattctgggtattcgaagttcaacgcttgccactggctcgcatccttagggtgactcagcatcttgtcttttttatctatctccggatcatttgcgtcatcttctcgcttcttctcctccctatccacgtgccaacgcaagagctttgctaccttaaggtccgcgaaatacgctgcagacnaggataatcgggaagtacacacacttttcgaggagcttctcctctctggatcaatgacacgcataccggacatatggtaaatccgcgtgctctcccgataatgatcaatggtcatgacanaggaatcacgntggnaatcaaaggnnacatttttc

SEQ ID NO: 35951 - DNA, 550 bp, Triticum aestivum
  Clone ID: PAT_TA_35951
cccagttctgcacatagtgcgcctgcaactgcaatggacaaaattaaggctgagaaagcaaggcaggacgatgcatttgcagacttgagtaacatgttgggaaacctgaaggatatggcactggatatgggtacagaaatcgataggcaaaacaaatcactggatactttcagcgacgacgttgatgagctgaacttcagagtcaaaggtgcgaaccaacggggacgccggttgcttgggaagtgatatcagagtaggagtcaggctgtgtggaaccactgtgctgcccatgcctttgacagttaattttgactatgctgtggagcctatagtgtgtttctgctgctatattcctatttcataactgttgtttttttggcaaatagtcatattcttgtattgtattgtactgtattgtattcgggcctattgtattagtatgttgatgtttcctgatttttcttgggttgtatgacaactaggtcagttacttggtgttactccacatatagccactcttttggacaaaaaaaaaaaaagcaactgtaat

SEQ ID NO: 35952 - DNA, 812 bp, Triticum aestivum
  unsure (1)..(812): unsure at all n locations
  Clone ID: PAT_TA_35952
gggctgaaagaggttttatatcaccctttctgggaacaactgatgcatcagccagatataacctggacaaaaaggctttcttctcttcagcactttctttgcgcgtgccagtatctgaggatttcttgagtaactgaagtactgattgcagtgtctcaatcttttcaggatttatccctggggagcaacgatgtttccagaagtcaacttccctgtcacggtgccatgcacttcgtctccttcctgtggatgatgcatacaacttcttggtcagattctcacgtatcttgcccttttgaagcagcgacttccttgcgagtgaaaggttgggttttttggctggtccatccatggacttcccaattgctgaacggaatgcggtcaaaagtttttcgtcaaaagcgttatccttctcgagtatactaataccattatctctaactacttcccttatctcttgttgtagcttctgaactacagcagttgattcttttccgtccttgtgtaaaatcttcttcattctaagaccaggcttatctcctgctcttctgcctacaggcttcgccagctccctgccaggatccctcatgtagctctctccttcaactatactcattatatcagggacatatttattctgtgtggcaattttgatgtatcactggcaataacttcggctgcaatcgaagtagcatggcagtctgatgaagaaacacctgagtttgcaatgagatccatttcctgatccggcactcccagttttgctttcttcgcaggatgactaatttcacctccngattccatgtcactgg

SEQ ID NO: 35953 - DNA, 1294 bp, Triticum aestivum
  Clone ID: PAT_TA_35953
ggccggcccccagatccagtccgcgaaccttcgcaccaagctactagttacgcctcagtacggagaccgcaagctgaagctccaccacccccgcgttccccgcctccccgcagcataaaaccctagcgcatgcaccttgccggtccggccccgagacgcattccggaaacctccggaacgccgcaatggtttggtttcagtgcgaagactgcggcgagaacctcaagaagcccaagcttgccggccacttccgctcatgctccgcctacaagctttcctgcatcgactgcggcgcagtcttcggccaggacaccgtccagacgcacacccagtgcatctccgaggccgagaagtatggtcccaagggactgaacaagccatccagcaatgcacagggtaagccagacaagccaaagccaaatgccgatgttgatatcaatgttgggttgtcgacacgccctccttggttctgcagcctatgcaatacaactaccaccagcaagcaaactctcttggggcatgctgatggcaggaaacatagggcaaaagcaaaagcctttcatgcttctcagaagcaagaaaatggagctgaacaaactccaagcgacaaggaaactggtggagcaccaacaacagcatctacagaactaaatgacgggaagggtgctgacagtgaaagagatgctgacgaggatgttgtgaagagaaagagaacagatagcacaacctcggaggagccagataatgcaaaaagacaaaatttatcgaacttgaagactggagaggcgacacaatctgaaaatggagaagcggaactcaaaacaaagagcaaaagtgctgcagaagaactggtcaatgatgccaatcatcaagatattaagaagcagaaaatcaagtggaagaaaattattacgaagatactagagatgaattcggatggagctatgaagttaaagaagctacaaaagctagttatcagggaagttttagaatgtggtctgttgaaagataaggaacagctgcatgctctgttgatggacaagatagcttcgagctccaggttttctgtggacgggaagaacattagattggtggccaagaatgaagaatcatagtccctgacattttcttgtgctctatttaagatgttactaaaatttgagggaaaatgataccggcaatattatttttttagctgtcaattttggatttgttgtgcctctatcatttccagagaactgttccaagatacagaaactttgtgcttgatttttttttttggaacagtgggacc

SEQ ID NO: 35954 - DNA, 1124 bp, Triticum aestivum
  unsure (1)..(1124): unsure at all n locations
  Clone ID: PAT_TA_35954
gccggttcgaaccacagccccacgacacatcctcgaatcacaacctcacacctcctcccctgagtcgaccgaccaccccgcagctagcttcgcgcagccagcaccgaccgatcgcacgctagctgctgctgctgaggcgaccgaccggctatccatggcggtgaaggactgcggcgggcacaagggcgggggctgcgagtgccaccgccgccggctctaccgcaagtgctgcggcgcgctgctggccctcgtcatcctcgccctcttcatcatcctcatcgtctacctggtgctccgcccccacaagccccgcttctacctgcaggacctggcggtgctctgcctcaacgtcacgccgcccacctccgcctacctcttcaccaccatgcaggccacggtcgcggcgcgcaaccccaacgaccgcgtcggcgtctactacgacgaggcggacatgtacgcggagtacaagggcgtgcccatcaccgtccccacccgcctccccgtcgcctaccagggccaccgggaccagtccgtctggtcgccctacctccggtccatggacagcgtcgtgctcccgccgcagctcgccatcgcgctggcgcaggacgagacggccgggtacgtgctggtggacgtgaaggtggacggtcaggtgcgctaggaagatcggcacggtggatctccggccactaccacctccgggtcaactgacgcggcgctcatcagggtgaacgagggcaagggcagctacgttgcgcacccagcagggcggccccccgactccgtccgcttctggtcaactgccgcatgctcatctggacgtctgatcacacatcatcgtatcgacctccaccgatccatgcccgtgtccaaattcaaattcagggggatcgcttgtttgcctttctctctctatcttccttcttccttctttctagtctctttctgacttgttgttcaattggttaaaaatatgaatgtaaacaaaagtttgaagctttaaagtgcttctttttagtctcttttctacatgttgatcgattggttaaagaaatcgatgaaagaattggtcaacactacttgagtgaaggaattanatgataactcaggaaaaaccctttncg

SEQ ID NO: 35955 - DNA, 504 bp, Triticum aestivum
  unsure (1)..(504): unsure at all n locations
  Clone ID: PAT_TA_35955
ctcgcacagaggccaggatatattcgagcatggttggttgatcgatatcattcattacatgttgggctgccgttttccgcccttctccggaataaacgtgtactttatcagagataaaaaaaataagagtacagacgctccaccatgcggttctagtagtagtactactcgtactaccgcgcttggctctttgcctcttcgtgaagtcgaacaatgatggtactccgcatgttgggtactacagtgtatgcctctgacaatctgacaccgaatggactgatgcatgtccaccgagggtaggttgcattagtcaaaaggcgtaagcgagcttcaccttgtcctgcaagcttctcctcgttctgcgagtcgactggacacaggtcgagattggattagcgttttccagctcctccgcttgtaaaactgacgcttgtaaatnaaagcagtggtctcgggcgaaggcgcttggntggncgtttcgnctngtaaanatcngaagtnttc

SEQ ID NO: 35956 - DNA, 1734 bp, Triticum aestivum
  Clone ID: PAT_TA_35956
cgtccggcggtcctccgcatcatgtttttgctgcaaggctgcagggagtccatgctcgtcgttgttcgccaggtgacgccgcagccgcaggtcgagcttgaccaccacggtggcgaactgcaaaaggcatttggatccttccactgcagataagcaagaataaaaggcatcaagacagaccggctgctctggaggtgtgggatcggctggatgaatttgtgcgggtcgtacgtgtctctctggcttaatgacgcggtgctgctgctgctacaagacgctaccaaaattttaaattaagaatttgttggtggagattcattttaattttattggcacgttgcatcttgcaacaagctaatgtttggtatgacaaaactacagggaacggcacatcctcatattacaaagatagaacctataaggtcttactcttttgtccattgaatatgttttcttctgctgataaccttgattttatctggaaaagcatcacctcagccaaaagcagaactaccagttcccaggttgcttcgcctcctcagccagcaaaatctcctgctaaagttgatgtgacacccccaaaagttcatcagccatcggttgcaccccctcctaaagttgactatgccattgacctctttaacatgttatcaatggacggaacaactgagaaagaatcagagtcatcttccaacgacgatagtgcttgggatggcttccagtctgcagaaccagcacctaactccgagaaaaagggtactgctaagccagtagaaagtaaggtccagtctacatcgggaatcgaagacttatttaaagactcgccagctgtggcagcgtcttcagctccagttgcttccaaatcaaacccacagacggatatcatgagtctgtttgagaagtcgaatatggtatcaccatttgctatccatcagcagcagcttgcttttatgacccagcaacaagctttactgatggctgctcttaaatctggaaatgcaccccaaatggctccggggaatgcaccccaaatggttcccgggaatgccagtgtgctaaatgctaatggttctaatgcccctaatggaagcttgccttcccatagctggcctaatctaggttatcagaaccctgcatctattccagcagcagcaccacaaaatggtgtcgccaaggctgggaacaacaatcaggacttcttttctgggaacttcggttttggttcgcccggcatgccagcaaatgggtccacaaccgcaggtgctaacaagagcgcatccacccctacctcttctaccctgccctctcaatcaggcaaagagtatgatttttcctcattaacgcaaggaatgttctcgaagcgatgaatggcttgaaatacttggagatggatgaggcctccattgggcgcagatttagggagaacgttggggggcgcttgtacactgttttaccgaggcagctttgccaattgtggatacatagttacatcaccttgtgggccaacaagtgcggatatggcagaaaactgctcatgttgtttcctacagctgaatagtctcattgttacagtgatgccaaagaacttaaaacagaggattcccttgtgggcctgttgaacttttctcttgttcagggtgtagttgcaataccacatatcgattactttgtattgtatgccaataattttattctgttgtgttaaaaaaaaaaagaggggagggggggggggag

SEQ ID NO: 35957 - DNA, 3176 bp, Triticum aestivum
  Clone ID: PAT_TA_35957
gcccgatgtaatccctcccactcctctgcacatctctcctccccccctcccccacgacgcggcaaaaacagggcaggagagagggcgagccgagggagcccgagcacgaatccctgcgatccccccctcccggtcggagcatccgccgatcagccatgaacgagaaggcctccgtctccaaggagctcaacgccaggcacaagaaagatattggaaggcctactgcggttgacggagaacagagaatgtgcagactgcaagtgaaagggtcctcgatgggcaagtgtcaatcttgggatacttcgtatgcatgcaatgttctggaaattcatagaagccttggggtacacatatctaaaggtaaggtctgctactcgtggaatacatggttgccaagagcaagttgcatattattcagatcaatgggaaatgaaaaggcaacatggctattgggcaagcagagatgccccctaattatgacagggttggggatagagaacttcatccgggcaaaatacgaggacaagaggttggataccgaggaatggaaacatccaaaaactgaccacgtaggtgctccgtagatcgagaatgagctctggactctcaacaccaagtcattataacaagggtttgtcatcacgctcaaaaaccttctatttagagtaacctcgggtttactaccaaaccggcagatgagaagaattgtaccgaactggcttcgaaggttgcacacccgggaatcctgttgtaactatccccaaatcataagtccccggtcccaagggatgctcaaccatccctcccctcctccatatgacagcctaggctgtggaggatgagctcgctgcactgcaagctcgaaacggctttgtgatcaggctcacagtgaatcaagcgatgaaatttattaatgatggtctcgatggtccgaactagcaggcaagtctgagtacacatatacttggacgtgagtgtatagtacgggggatgggcagacgtttgaccaacgaagtaggaaaagatgctccagtccaggcgtctatttcaacctaattgtttcgaatgaaagacccgtagaccggtataaaaatttttggcagcggacagctccattccatcacgtttgcactactcattaccctcagacagtttttatgattcagccagaaaactctactgaggtctcaccataagttatccaatacacgcaacttggctttgggaactggaacccaactgttctgatgacaggtctttgttctggaaacaaacgaatcccaacccacccccgcagccaatcccaccggacgccagacaccaaacccctatctcgactcctccgtcgcctcaatccggttccgagtccatatttgaggtgccaccatgttcaacaggttatttgggaagcccaaggagcaggccaacgccggcgcgttggccactttggataagttaaacgagactcttgatatgctggagaagaaagagaaagtgttagagaaaaaagcaggcgctgagcttgagagggccaaggaattctcaaaagcaaagaataaaagagcggctatccaatcattgaagaggaaaaaactttatgagcagcaaattgagcagcttgggaatttccagttgagaatccatgatcagatgatcatgttagaagctgctaaagctacaacagagactgttgatgcattgaggactggagctaaagctatgaaagcgatgcaaaaagcaacaaatatcgatgatgtcgacaagactatggacgaaattaatgaacagacagaaaacatgaaacaaatacaagatgctctgtcagctcctcttggagcttctgctgattttgacgaggatgaactggaagcggagctggaagagttggagggagcagagttggaatcccaactactggagcctgttgtaactattcctattcatacgacgcccgtcccaggcaaggcgcaaccaactcgccctgctccacagaaagcatcggctgaggaggatgagcttgctgcactgcaagctgaaatggcattgtgatcaggcccccagtgaatgaagaggtgaaatgtacaaatgattggctggacggtacgctgtcgcaggcgagtcctggctacacatatatttgcccgtgtgtataatctttggtgggagacatttggcgaacagaggcaggaaaggctgctccagtccagtgtttatctagttgtttgattgaaggtctgtttcccggacataatttttggcacggtcagctccattccaggtcgtgtgcaatgctcattgttgtggcacactatttactgttgacccgtattatctcttgccatgtaaaccaagttatctcattccagtgtttgctaatttggtgtgttgacgggacagttctttcctttcaattctatatatacaactcactagtactattgagtttggtatttatgatatcaaattcttgtggtagccaaaaaaaaaaaaaacaaatgcccctaatggacgcttgccttcccatagctggccaaatctaggttatcaaatcagaaccctgcatctattccagcagcagcaccacaaaatggtgtcgccaaggctgggaacaacaatcaggacttcttttctgggaacttcggttttggttcgccgggcaagccagcaaatggggccacaaccgcaggtgctaacaagagcgcatccacccctacctcttctaccctgccctctcaatcaggcaaagagtacgatttttcctcattaacgcaaggaatgttctcgaagcgatgagtggcttgcaatacttggaaatggatgaggcctccattgggcgcagatttagggagaagttggggggaagcttgtacactgttttaccgaggcagctttgccaattgtggatacatagttacatcaccttgtgggccaacaagtgcggatatggcagaaaactgctcatgttgtttcctacagctgaatagtcgcattgttacagtgatgccaaagaacttcaaacagaggattccccttttctcttgttcagggtgtagttgcaataccatatgtcgattactttgtattgtacgccaataattttattccgttgtgttccatatatgtgattgtattgttgtgacttgccctttaaatgcactgaacgcttgtttattggt

SEQ ID NO: 35958 - DNA, 628 bp, Triticum aestivum
  Clone ID: PAT_TA_35958
tcaacccgagcaagcaagcaaagccaattgattgagttgaagcaaagttacagagcgtgcccgcaagaaagcatcggccaccggagcatccccgtctccaaccaatcaagcatggacaaggtgttagccttctccatcctgagcgcgtcgccggccgacatcgcggccggcgccggcgccggggccagctgggctcggttctcctggcaggggaggaagctgcaggacgacggccaggccagagcagggcaagaggggaagcagggcggtccaccgtcggaggcggagcagcagccggacaaggggagatcgccgacgttgcggccgcggttcgcgccggagttcgacgggatcgactgcttcgagaccatcgtgtgccactgatcagcgagtgaatcacgagctgctctgctcgtggtccagccgcgcgtgtgtgcgagactaattatttcttcgtctgatcaccgtatgatcggcgtgttcatttgttgttcacttgtgcttctgactgaagccgcgtgttgtacagaatacagagctatgaagaaacccatttcgccgcgattatttggataaaaaaaaaacaaaaaaagaaacgcaagaggcgcaaagcgcaagcagacgcggg

SEQ ID NO: 35959 - DNA, 650 bp, Triticum aestivum
  unsure (1)..(650): unsure at all n locations
  Clone ID: PAT_TA_35959
gcgagcccatcaacaaacaacccaagcaaagccaccaattgattgaagcaaagtcacagagcctgcgtgcaagaaagcctcggccaccggagctgctgcaggtctcctatcgagtatggacaaggtgctggccttctccatcctgagcgcctcgccggccgacatcgcccccggcgccggcaaaggcggcagctgggcccggctctcctggcgggggaggaagctgcaggagggcgaccgggcacggagcagagcaccaagggaagcagggaggcctgccgcgggcaggcagagcaacagccgggcaaagggaaatcgcagtcgccgtcaacgttgccgccgcggtttgcgccggagtttgatgggatcgactgcttcgagaccatcgtgtgccattgatcgctgatgaatcgcgatctgctcgtggtccagccgggcgtgtggctacgtactgattctttcttcttttgtcggccttacggtcggcgtgttcattcgtttcttaatttgttcttctaactgaagcctgatgctgtatagaatacagagtaaacagctactgtataaagaaacaaattaaaaagaaataaacatcgccccaaggggnnnnnnnnnnnnnnnnnnnnnnnnnnnnnnnnnnnnnnnnnnnn

SEQ ID NO: 35960 - DNA, 636 bp, Triticum aestivum
  Clone ID: PAT_TA_35960
acgcctcggcgcagtacgtgctcctgggcgcggcggacgtgttcgccatggtcggcatgcaggagttcttctacgaccagatgcccgtggagctcaagagccgcgggctcgcgctctacctgagcgtccttggcgtcggcagcttcatcagcagcttcctcatctcggtcatcgacggggcgacgaggaggggcggcgggacgaagctggttcgccgacaacctcaacaggggccatcttgattacttctacatgctccttgctgctctcagcgcgctggagcttcttgctttcctctacttctcggcggcttacatttacaagagaaagcctgtcaatgttcactgagcgagactgatacatccgtctatgtacattggatctgtggtcaggtatacagtacaattgcaagcacgcatcagtaaagttatagtagacgagtacgctgaccaccgccctaactttagagaggggaagtcaaggtgctacagtgctcgtctattgtaaaatgaagaagggatgttacaagactattagcaaagttatttaattttgggaattattgtatatataaactctctcgggacggaatcggggcggagcccgagccgaattcgggggcgccggtaccaattc

SEQ ID NO: 35961 - DNA, 553 bp, Triticum aestivum
  Clone ID: PAT_TA_35961
ctgcataaaaaaggtccctatcacaagtggcaatataaagtgacgttccctcgcattaagattttgtgcatccaactataaaagcgcatggcaacctctgcttccctctgcgaaggggctatcttttattcttgtcttttaccttatgcaagagttatggtgatcttcaccttttcctttttacatttatcctttggcaagcacattgtgttggaaagattctgatatatatatatatatccaattggatgtaaggcatcatgagctattattgttgacattacccttgaggtaaaaggttgggaggtgaatctataagcccctatctttctctgtgtctgattaaaactttgaacccataaatatcacgtgagtgttagcaattgtgaaagactaaatgatagttgagtatgtgaagtttgctgaatcaaagctctgacatagacccttcctgaaaatacgatgaattgtaattgtttgatgactactaacacggtttgttagttttcaagaaagtttatgatctatactttaacatgtgaatagcttgtta

SEQ ID NO: 35962 - DNA, 835 bp, Triticum aestivum
  Clone ID: PAT_TA_35962
gttcgaacagcggccagtcctggcttacttccaaggagccattcacaaggaaaagatgggtggaaaaggttcgtcagaaagctgttacagcttctcaaggacgagaaagacgtgcacttcacctacgggagcgtccggcagaacgggatcaggcgcgccaccaaaggcatggcatcgtccaagttttgcctgaacatcgccggcgacacgccctcctcgaaccgcctcttcgacgccatcgtcagccactgcgtccccgtcataatcagcgacgagatcgagctccctttcgaggacgtcctcgactactcggagttctgcgtgttcgtccgtgcgtcggatgctgtgaggcagggctccctgctgcgcattctccgaggcgtgaccagggaccagtggactaccatgtggagaaggctgaaggaggtggctcatcactttgagtaccagtacccttcgaagcccgatgatgctgttcagatgatatggggagccgtggctcgcaagatgcattctctgaagctgcacctccacaagactggcaggtatcagagaacacattcagattcatgaaaggtctagctatttggagctagcttgcagttttgatcccaagtgagagtttctaaggtcaccatcagataaactagatgatccgatttaaaccgacatttattttgcttattaaggcctacatttggtagtaatttttttgccattgaatttctatggcaggaatagttttctttttgtaatggtgattgatgctgtaaataagactaacatatgttggtatgagcgcatatatgctctccacctgaaaaaaaaaaaaaaa

SEQ ID NO: 35963 - DNA, 761 bp, Triticum aestivum
  Clone ID: PAT_TA_35963
tcatctaaacgatgaactcaaagtggacaggccattgtcctgcctgctataccttcgtctgagtgactgcagggtaactacgatagaactcaacgcccccaagctccaaacctttatattccaagggaggctggtgcctattcaccttggcgaatcttcagaactgcacaatattgttattcattcttatacactaacactagagcaagctatttgttcatttgctgatgcgtatccactagtgcaacgcctgactctgtgtcacacttgtgcactaccgaagttcccctggcgattggacaatacttctagcttttctcatttgagatatttacaactgttgttgaatatcttctctgaacatgccaacgacattctctctattgcatattttctagaggctgctccattccttcaggagtttgatttggagtttagatcatcatgcatggatgttgttccggggcctttaaggatcttcccatatgggcaagacaagtacaagtatctaacgatctttagagtttttgaatttagaggcgaaaagagcaaagttgaacttatagttcacgttgtgcaaaatgccccttcacttgagaatctaactatagacccaagaaggcagcatgttttagatgattcacctgctagtgaagctgaagaaaaacgtctctctgagatccgtcatatcgccaaaagtttaatcggtataaaactttcacccaagacgaggctctgtgttggaattgctgttatgccat

SEQ ID NO: 35964 - DNA, 787 bp, Triticum aestivum
  Clone ID: PAT_TA_35964
aagcagcaaagttgagcatgcggtgtcgcgcttgtgatgcacagtgcttggctccggtacatcacagaggccggcagcaaggaacacagcttcctgcccttgcctctgtaaatcatcaaggaggaaaaatgtgcaagatgcttgaagtttccccttgaaacgaaggtcttgggcctttgtttgtacatatattcccttgatttgtactgactctccaattaattattcagagagctatggccatacaaggaaatcaaaagtttcagttgcatgtagcaaggaaggtcaatttgacacggcggtgctgccatttgcccctcccttctccctcgaaaatgtggttgacgctccccagatcttcaggttgcatgacaagatttttttcctgtggaacatattgtgtatcttccatcggtcatgagaacatggcgatcaaaaattgctctgtactaatgattgtcttgagggattatttcattcatactgctctgaattaatcatattctcctgctacctcattacgttagtatggtacaactttgctgaaaaaaccattgtccgtatttgtagtacagactgtaggatccactaacatctatttactgctctggattaatttttagcttcttattacctgtgggagtcccagtattacaatatatagctcatagtggctcacaaatcataatatggtccatacgtacaatatatggctcataatgaacatctaaagatatcttttcaaacaatatagcaaagttgactccttagaattattattttggta

SEQ ID NO: 35965 - DNA, 420 bp, Triticum aestivum
  Clone ID: PAT_TA_35965
tgcataccattcaggtatagagctgatgaaacttctggtgatgaacagaaaaaagttgttgaagttctcatgataaactcccaaagcggaccaggtttattattccccaaggtacttattctttgaattgtcataccaagttgttttggaacattgcgctgctggcaacacagattggtatcccagttagctccaacgtgttccttttcccggcatttatatatttatgaatcctctgagacaaattgagatgcacgcaggaatagtgtgtatggttgatgcataaatcacccctacctaaattttggagagcccaagtttggccaaggattaaagggaatggccaaatgaccatggtcatgcaacaaagttgtcaatcatccaaagaaagcccaatagtttggtgttacctaattagtc

SEQ ID NO: 35966 - DNA, 1002 bp, Triticum aestivum
  Clone ID: PAT_TA_35966
aaaccggggggcgccgccccctcggttgaacaagcagctgctcgagcaagctactcccgatccccgccctcgaggagatattccgccttcccccgccccccaccccctcccctcccccgccccattgctccccgggcacccccgggccccgcgcgccccgccagccttcgcgccgcacgtgaaggaagagctggcctcatggcccgagcagagcacccgccggaggacctggctgacggtccccgaagccacatcaccatgtcggtaccagtggacgccagacgccttgccgccgggtgcataccagtcacgtatagagctgatgaaacttctggtgatgaacagaaaaaagttgttgaagttctcatgataaactcccaaagcggaccaggtttattattccccaagggaggatgggagaacgatgaaacggttgaacaagcagctgctcgagaagctatagaagaagctggagttcgaggagatatagtgcaatttctaggtttctacgatttcaagagcaagacgcatcaggacgcgtgctgccccgagggcatgtgcagagcggcagtgtttgcgctgcacgtgaaggaggagctggcctcatggcccgagcagagcacccgccggaggacctggctgacggtccccgaagccacgtcacaatgtcggtaccagtggatgcaagaggccttgctgacgggcttctccgagtggcatgacaactggagcaaaggcggcagtgcaggtggcgacccaatctaaacgcaagaaggcgtcgtcctctgtcgtctctcgctttcctttgccttctctgttctcctctctaggccccaaccttgcacgcaaattgcaataatacagtgtggtgcttttacttgatgatgcctagtaggtcattgacccttggttcctgggattgaagtcttagcgtagtggtatatctcatcgaagacgagaattatcacaaattttaagtgtcaaaaaaaaaaaaaaaaaaaa

SEQ ID NO: 35967 - DNA, 1008 bp, Triticum aestivum
  Clone ID: PAT_TA_35967
gcgcatctccgccccccggccccccgctcctccctctccgcccgcgcgctttcttcgggtggcctgcgccatatttcgtcatggacgcactgcccagtgagaaagacgtggacgcgtgtatttaggtcaccttccaccatgcatcggccactgtcaagatcttggcgcatgacagagttaccgtgtggtgtggccggggcttcttccactatgacccctcctgccctatctctcgtctgcctgaatccttttgtccatccaaaggatctgcgccgacgagcacagggcgaggtcctggtgcaccagatccgtcgcccccactactggaggagccatggcatcccgttcgccgtgcgttctgcccttctccaagaatggatctacgccgacgaccccatactgcccaaggtccattctcccaccatgcttccgccactatcaagatcttggcacacgacaagagttaccgtgtggtgtgaccggggcttcttccactatgacccctcctgccctgcctcttcggtggccccgattcttcttccactctgggatagctcgtggatatggtacatcatcatcacctatgaagaggagaaggggtttatcgtgtcaggaaaggtgtgtggtggcaggcttggtctccggcctcggcatctttcgttggccccggtgccgtgcggctgaggcgatgttgtttggcattagctacaaaatagccatgatgttcctctttaagccctggatgggaaatctgttgcaagtgctcaaggggtgttaagagcatatgcttcccaaggccaacattgtgatgcatgtgttgttagtttagaagtgttttggtatagcaacacgagctgacatgtagtttggtctgtagttcattgtacatgcaagttgaattgtcctgaccattttatgaaacttaatttagctttttattggattgcagggtggtatgaatatgtcgtatgatgaataattttgaattatggttggtataaatccaaa

SEQ ID NO: 35968 - DNA, 777 bp, Triticum aestivum
  unsure (1)..(777): unsure at all n locations
  Clone ID: PAT_TA_35968
ctacgtaccaaacatacatacgtatacagaggactagctagacgcgctagctacctagtacgcagacaggatatcggcatgaacaaatatgcatacagagagaagtgatatcgaccacctctccttctccgagagattggtcgaacagacaagttctcgtatatctatcggagactaccggctatatataatcattatctctatcaaatattaccatacggacgcgtggtccacatagtattctccgtcttcagcgatcacgtggtcaataaagaatgccgccaattcctcttgaattgctcgcatgcgatctggtgctaggagttcatcccgcatccgaaacatctaattttaagaagggggtcaatacatagtatatatatatgaatgaatgaaactcaacacaaatgatggtaataaaataaaattgtgaatactgttatttatgcacttcatattgttccgtcaagagtagccccgctcacaggtcgtgtggcggatgggactcgcanacgtaagtatccaacangaaacattcccttggtcctgccacaaccactttcaangaaatagaggcaatcaaaactggatnagcaaagaatgccaaatnnggtattgcntnnactaatngcttgatcaatanggatgnttggacatgctacaatatacttacttcggggtgtctaaatgcaantcctcgggagtcccggactttttggggatttcaaacctgccancaagaaanattcttgnnttnaggaatganagttctgaatg

SEQ ID NO: 35969 - DNA, 1355 bp, Triticum aestivum
  Clone ID: PAT_TA_35969
gttcactcagtgctcccaaacttagcaccacaaagtagccatcttatcaacatggaatcatcgccttggtttactctttggagtacctgtgcggcaaaagaaacttttttgtctgtacacgtgacactgagggaccaaacacggtgggctaaagctggtcatgtcttggcttcagcgcaactcagtttacctcagacaaagggctttgttcctcatgtgatagcattgtccaagagccctctgacctctgagcaggttggtgatggtgtaatcattagcaagaaccacgaatggcaaatcaaaataaacagtcagttgggaacaattgacagttggaagatcaacaacgtcgagcttatgagcaagggaatatttccttgcttttggcgcgcaccaaccgacaacgacaatggaggcttctacaccaagtcctatgccacaacatggagggaagccttccttgacaacgtctccttctacagcagccagttttcagtgaaggagctgccagaccacaccgtcgaggtttctaccacatattacggccttcccgggcacctgccaaaaccggatgatgccgctctttcagaagcttctgagtccgtgcttttccgggtccatatgcgctgccggatctacgagtccggcgacgtgatcctcgactacgaggtaaaccccaagagcgacctcccccctctcccgcgggtgggcatcgtgttcaatgcagagaaatccctgaaccatgtcacatggtacgggaggggcccgttcgagtgctaccccgaccgcaaggccgcggcgcacgtcggcgtgtacgagagcagcgtggaggacctccatgtgccctacatcgtcccgggcgagtgtggcggccgcgcggacgtctggtgggtggcgcttaagaacgccgacgggttcggcctcttcgcctcgacccacggcgagtccccgccgatgcaggtgagcgcgagctactacggcgccgcggagctcgaccgggccacccatcagcacaagctggtcaagggagacgacatcgaggtgcatcttgatcacatgcacatgggggtgggcggggacgacagctggacgccgtgcgtgcacgaggagtacctgctgtcgccggcggcgagctacaggttctcgctgcggctgcgccccctgtcgccgtcgtcatcgtgccacgacatctacagctcccggctacctaattgatcgtcccatctgtctgatgtggccgtcagaggtgcgtctgagagagaaagaacattcgagagactgaaacaatactgtccgagtcgctctcgctcgtgtaaacgtaagaagactgtaactggacaggtacctgtcaataa

SEQ ID NO: 35970 - DNA, 379 bp, Triticum aestivum
  Clone ID: PAT_TA_35970
taggtcaaaccagacctgtgggacccatatgtcagcgtcacaggttaaacaggggggtttagtttagtttaattaaaaattagggcactacggcccacatgtcagtgtcagcaggggggtaattaaattaaaataaactaaactaattaacaggggggctggccccacctgtcatcgacccaaggggggtcaaacccctggtcagcagggcctatcctgccggccgcttgacgccaccgaggccgaaaccgcggaggccttcgcacgtcttgctctggcggtcagaaaggtgcatgagggagtttcttcgaagctgggactgcctccctcacatctgtgcaaacgtcaagggctgccatgaccgtggcccagaggagcc

SEQ ID NO: 35971 - DNA, 696 bp, Triticum aestivum
  Clone ID: PAT_TA_35971
cggacgcgtgggtgcccgcgcacggtgtcgtgctccgacatcctgtcgttcgcggcgcgcgacgcggcggtggcggcggggctcccgagctacgaggtgccggccgggcggcgcgacggcacgcactcccggatggccgacctgccgggcaacttcccggtccccgggcacacggtgccgcggctgacggagctgttcgcgagccggggcctgtcgcaggaggacctggtgacgctctccggcgcgcactccatcgggggcgcgcactgcttcatgttctccaaccgcatctacggcttctccaagacgggggacagccagaagtcgcgggacccggcgttcgcgcagcggctgcggaagatgtgcccgcggcccaagccggacgacaacccgcagcaggcgcccaaggtgaacttcgacgagcgcaccggggagaagctggacaacgcctactaccaggagctgctggcgcggcggggcctgctgacctcggacaacacgctggccctggacccgcagacgaggccgctggtggagcagtacgccaaggacgacgcgctgttccatcagaggttcggggaggcgatgcagaaggtgagcaagctggacgtgatcatcaagaagaacaacgggcagatcaggcgggactgccggatggtgaacaaagccatcgaggtacgctggatgcccatccac

SEQ ID NO: 35972 - DNA, 1014 bp, Triticum aestivum
  Clone ID: PAT_TA_35972
cccacgcgtccgcccacgcgtccggtatacagtacacagccgctagctcttcccccgcggcgcccgatctcgtacttggagccttggaggagactcgaaccctaatcccctcccgcctcgatctctcccgccgaaggagagatcccgttcagcctcggctccaatccgcgactcgactcgactcgaagctccagctccgccgccgccccccgccgccgccgatggatccgaagctggtggaggtgacgcagctgttcgaccgcttcaaggcggccttcaaggccagcaatttcgacgtctgctcgaccctcctctcgcagctcaaggtcctcctcaccaagttccccagccttcccccgcgggtcgagcagacgcccaacgatgcttacatcagcacggagctcgagtctatgaggctaccgcgtgagcgccgacaaaccgcgccgcatgaaacctacatatacttcatggacctcgtcaaaacggttgacgagtgctgggtgcagcgagaagggatatgattacctgtcaataaacgacgcgaagcagatgtttaagttcagctccgacaaggaactgcaacagtacatcgcagaggagcaccccgagtgggatgtcaaggacggccgggtcttgttccagaaggcgaaggagtcccagccctgcaaggagatcccggcggcgccggtcatcaaccagaccctcggctacgcgagggaattggagaggattgtgtgatttgtttgcctcttttttcttcatctttggactgagtttcccatgaagaggtggattattggattgccctgtgactcggctgtactattttgttaaatcgtttgtttcacctactgtttccaaagatacacaagtgtgaaatgtcggcttaaaatggcaaaagaaacaatgcctgttatgttaatcaaaaaaaaaaaaaaaaaaaaaaaaaaaaaaaaaaaaaaaaaaaaaaaaaaaaaaaaaaaaaagaaaaaaaaaaaaaaaaaaaggccccta

SEQ ID NO: 35973 - DNA, 1351 bp, Triticum aestivum
  Clone ID: PAT_TA_35973
gcggagtgtacacagccgctagctcttcccggccgcccccggcggcggccgatggagcctggagggaggccgaacccaaatcctctcgcgcctctctctccccccccgccgcgggcgtccttctccgcctccgcgccagtcatccccgacacaaccctcgaggacactcgaaccctcctcttccgcctcgcatctctcccgccgcaggcgggaggatcccactcgcgcctcggctgcaatccgcgactcgactcgaagctccaggctccgccgccgccccccgcctccgatggatccgaagctggtggaggtgacgcagctgttcgaccgcttcaaggcggccttcaaggcccacgccaatttcgacgtctgctcgaccctccgtctcgcagctcaagggtcctcctcaccaagttccccagccatacccccgcctgttccaggcagacgcccaacgccgtggaaatgaggctcaatgcttgcgaaggggaaatttatcacgcacggcagttattttgatgtgggagaatggaatgaaccaatgatgcatttgaaagggaccttgtggcagctcaagcccgtattacagtggaccaacaattgctggcagtaagttcctccagtcatcggaatgcagttagcccaatcattgggggcgccagccttctgaggctgttagtccacaatagaaattgtgggagtgccacattgagctggagcttcttcccgccaaagcgctgggtaaggctgacatcaagcacggggttgagctcgagcagtccctttatggagggcgcatacaaccgcgtgctgagcgctcgacaaaccgcgccccatgaaacctacatatacttcatggaccttcacgtcaaaacggttagaaacgacagagctgggtgcagcgagaagggataggattacctgtcaataaaaggagcgacgcggagcggttaaggttagccccgcacaaggaactggagcaggacatgggaagaggagcacccttagtgggatttcattggttgccgggtcttattccaggaggtgaaggagtcgcggccatgcaagttgattcctggcgccgccggtcatcaatcagaacttcggctacgcgagggagctggagaggattgtgtgatttgtttgcaacttttttctaatctgttggactgaatttcccatgaagaggtggattattgattttgttaaatcgtttgtttcacccactgtttcaaaagatacacaagtgtgaaatgtcggcttaaaaggcaaaagaaacaacgtttgttatgttagtcaatagattgggtcggagcaagtccaacagaggggcatgtgcttttttctccaa

SEQ ID NO: 35974 - DNA, 990 bp, Triticum aestivum
  Clone ID: PAT_TA_35974
tcggcacgagggcatgtttgtgctggagaagctgaccttccaactgatgatattgttattgttgattgtggggaactgccagaaggttcaactgaaggagttgcaaatttcttcaaagatggtgacatgtatcctgattggcccattgacctcgatgaaaagcctgcagacgttttgtggtggattaatgccgttgattctgcaaagtctttcggaaatgaaaattttaagaaacatgattacaaggctgcactcagaaagtacagaaaagctatgcggtatttagatatttgctgggagaaagaagagatagatcaagagaacagctcagcactgcggaaaacaaagtcaattatactcacaaatagttctgcatgcaaactgaagctgggagatgtggagggtgctttgttagatgcagactttgcactgcgtgaaacagagggcaacgcaaaagcttttttccgtcaaggacaggcacgcatgacactcaagaatattgatgctgcagttgagagcttccagcgtgcgttggagttggagccaaacgatggaggaatcaaacgggagctggctgctgcaaagaagaaggttactgacagacgcaatctggagcggaaggcattttccaagatgttcgagacgtcaggaagttcagagaaaagtgaagaagtattggctgcaacttcaagagaaaagtggcgaagataaaaactgatgcccaagtgagcctttccattgtttcctctgtcacacatgctgggagctgccctgtgaaaacttcagttatactgatggagtttggacgggagaaataactcccagtggacggctgaaaacaatgggggcacctgaaccttttgtgttagtatagaagtggtagcaatgctgtcgaaagaaatgtctttcgttgacttcgaactcttggatatctcgacaacttcttttggcaaaacacattttgcgagagttgatgaaacattgtcgaca

SEQ ID NO: 35975 - DNA, 1172 bp, Triticum aestivum
  Clone ID: PAT_TA_35975
actatagctggtcttgattcggatcacaatcaaacacgatggcgtccaaagtccttgtcgcaatcctcctgctcgccgcggcgacgccagcgtcgctggctgccatcgatgtggtgcagctgctcgccggacaaccccaggacgcggccttcctgaggctcctgcgggagacaaaggtcgccgatgacgtgagccgccgcaactcggcttccgtgctggtcctcaccgcgaagaccgtgaagccactcctggcggggccggccgcccaagagtgggctcaacgtccttctcgcaatcctcctcctcgccgtggcgacgccagcgtcgctggctgccatcgatgtggcgcagatgctcgctgacaagccccagtacgcgaccttcttgaggctcctgaaggagacaaaggtcgccgatgacgtgagccgcctcaagtcggcttccgtgctggtcgtccccgagaaggccgtaaagccactcttggcggtgccggccgcaaagcagcggaccatcctccagcatcatgtgctcatcaagtatttcgaccccatccagctgggcgagatgaagaccaacgtcgccaagctggagaccatgctctccaacacggataaggacatgggcaccatcgactactccaaggacaaggacggccagatgtacctacgctccccaggcgccgatagtgtcgccaagctcgtcaaggtcgtcgccgcgcgccccttcaccgtctccatcatggagatcagcgcgccgctcttgtgtcccaagctactcggccctggcgccgctggcgctgccgctggcaggcccaaggggaagggcaagggcaagatcaaaaccatgtcggctgatgaaggggccgccgccgctgctccaactgcgtgatctgagaattgagtaaggtggccctgcaggacgcccccgttgaaccatgcgtgcacaactttggattttatcttcatgccaaggcttcatacatcttcttttttttctcttctgctgtactaattttgtgtttccagtatcctatgatttttattagtgaagtgaatcgagtacaactagaggttggttggggcgcgcctcctgtgcagtgtgcgcgtttttttctttttcttttcttttttgggtgcaaaggcaatcgatcgaggaaaaaatgtaacaactgc

SEQ ID NO: 35976 - DNA, 1239 bp, Triticum aestivum
  unsure (1)..(1239): unsure at all n locations
  Clone ID: PAT_TA_35976
ccacggctctcctgtcaaagggactagagaattggggggatcatcaggctgctgcaagtgcatgcatggttggaaccaaggaggacggctccatgcctcagtctgtcgccggaggcgcttcttcttacaacttctatgggagccatgttgctggtgacggacatgtgatccagcccaagtcccagctgagccagatgctcctggcctcctctcctaggtcatgcgtcaccacaagcctgggcagcagcatgctcgacttctcaaacagcatggcgccgcccccaccggagctgaggagccaccaccactccgacaactcatccgagtgcaacagcaccgcgacaggttcagctctcaagaaggctanggttcangcctcgtcctcaagcacaatctactctaaaggtgangaaggagangctaaggggacagaataactgcacttcaccaaatagtttccccatttggcaagactgacacagcgtctgtactgcaagagaccattggctatgtcagattcctcctgggtcaaattgaggctctaagctacccatacatgggccacggcagcaacggggcatccattcaaaatggaccaactagagaaagcaaccctggcctcttcccggagtaccccggacagttgctaaaccataataacaacactggaggagtacagcagcaggctccaggccaaccagagcagcagggtgctgtgaatgaagaggcgagcaagaaggacctgaggagccggggcttgtgcctcgtcccagtctcgtgcacgtcccactttggcggagacaacgctgctgactactgggccccggcgccgcttggcgggatgatcctccagtagaagagacgactggtcttgcagcaagtatatgtgttgtgcatggggtggtgcaggagtacgtaacagcgcgcgtaagtacgtacataccatcatgagcagtcactctactaaggctgattgctcttgatgctatgctatgcgagtgtagtgtaatcatatcatgggggtgaaagcgattaagccttctgtatctgcattgttctctgcgaagaggcttttcatgaaggaagctgtgcatggccggtctatttcttctctagctggtcgtcctccttcagtccttgcaaaatttatgggtttgttgtatatgtaaatctagcaagttatatagtgaactttaattattatttttctgtcaaaaaaaaaaaaaaaaaaaaaactcg

SEQ ID NO: 35977 - DNA, 699 bp, Triticum aestivum
  unsure (1)..(699): unsure at all n locations
  Clone ID: PAT_TA_35977
acaaggaactcngaangcatgtgaagttggagaaccntcttgtgcagccaagggaagtggatcctgccgtggaacagaagtggagatcgctcgagtttgaaagagagagggaaaacgaactcagaacggtaacttcatnaatggggagggnagtggtttggggtgactatgtgttggacctggaggatggagcgnacttggaggacgaanacagcgacgacgacgaccgtggcaatgaccgggaggcggataacgctcggaggttgataatattcatgatgcgtcaagttgctcagcgacaccgaacacaaaggctccagagtccaagtggcatgcctggagatgccgaggaaggttatgcggttagcagcggtggcgccaatggaaccaccccgtaccctttcaccttggagggcgacgacgaggatgacatggctctggccggaggggaaggggcgggtatgcttagatcagacaggcgtcgccggcgacgccgtaggaaccgtggaagactgtttttagattctaattgagaaggcaggggctctgtcaccagagtacatgcacagctgattccctggtgcctggcattcatcaattccaaccaaaatttacttgttcatgatcattgtaccaaagtagtttgtcttaacctcagctcatcattgctttccatcaaccatgtttcattttcacatt

SEQ ID NO: 35978 - DNA, 1860 bp, Triticum aestivum
  unsure (1)..(1860): unsure at all n locations
  Clone ID: PAT_TA_35978
ggcgctttagctcctcacgcgccattccgtttccgtcccctggccctccttcccctccttgggattcttcctcccatgtgctgatgcgcgagnaagggaaaagccccgaagctccgatcagtttgaggccgggccggcggtagtggaggcagcatcttggctgaaccatttgtaaaggctacatggcaaacggcagaggaagggatgtctctattgatgctttgacttcaaagcttgaatccaagatatactaccatagggatgccgctgtcgagtacctggatatcaagactatggttgataaagttgtagaagaaaagaataagctcttggctgagaacaccgaattcctgaatactattgataaggtcgtggaagaaaaggaaaaactccagcatgatcatgaagtgattaatgagctggtggcaccaatggagaagcagcttgaaatggtaaagaaggagcttgaagaagtaaaatatgagcatgtggcagcaaaggaggagcttgctgtggcaaaagagcaacttgctcagaagaacaaagagctgaaggttctaaggaagaagcttcaggagagtgaagccatgcacactcaacatgagcaacaaattggaagtgcttctgagcctgctcgttccaaaatggtaacaagattatcacatacacgggctatcctgctccaaggatcatcggacaatgacatagacagacatcgctgtaaaaaacagaggtcctatccgcaggtgccaaataacccaactgctggccagcattcaggcagagatgacgacccaggaggtggtcagacaaaagctgatcaagcggttctctgaaattgatgctggacagtcaattgggataaagaaaatggggaaattaaatgagaagccattccgggatgcttgtgctgtcaagctggctcctaaatatgctggtgcgaaatcttctgaactgtacgcactgtggcaggaactactcgatagtccaaactgggaacccttcaagtctgtaatagttgatggcaatcatcaggaggaggtcatagatgttgatgatgataagttgcaaggactgaagctgtcatggggagaaggcccctacaatgctgtcattagtgcattggttgagaggaaagagtacaacactgatggaacaggtgatgccttcgatctatggaactataaggaagggaggaaggccactcttggggagtgtgtcgactgtatcttggacaatgtaaagaaactcaagcgggtccatctgacatacaggtcgaggagaacaatgtgtgctgccactgcgagcatgcatgacccagtcaaagatctgtcggcagcaagtaatgaatgaagtcatcagatgtccaacactagcaagcatggaaggaagccatgatcttagcaggcttttattttgcgtctgattaaaactctggtgtatcaatatgctgctgctttggtgttaccttggtttcaacttctgacaagaactctgatgcatgaatatgttactgactttggtgccattttcatttcatgcttcttcttcaatgttctagtgttctccttcttggagtggcttttctttctgtttgatacctggtgagtgaagaataatagcttggtctcagaatgctagtgcgcccttggtttatttgactacggcggtaacattgctgtctagattgtggagtgtatctgaaggacctcttcttctgtagtctttagacacaccgagtggttactgctgaatttcgtctgtgtgtgcgtgtgtgtgaaattaatatagaagcctctctttattgaaaaatattatcatcatgcattgtactagtaggcaataagtttttctanatca

SEQ ID NO: 35979 - DNA, 1221 bp, Triticum aestivum
  Clone ID: PAT_TA_35979
tgtttttttcagatcagctctgaacatcgacaagtctgaagcagatctcaccaatggaaccatgacagttagcaggaaaagtttagatacctcctctggcttcttgtcatgcattggcaatgttcttgggtataaggacgatggaattgaagtacaatgggctagtggtgtgatatccaaggcgcagcattttgaaataattggattagaaagacttctagatagttcactaggatctgtgaatgaggtgcatacttctgtcgacaacgaggttgagcaggaaacaattcgtaatgagagtgaggacaatgccctggcacagtctggtgaagactgcgctggttcattgcgcacttctttctactattccaaaacagcttttatttttctgacaaatgtggctgctcgtttcttctttgcccatgactatacatcctgtagctcaatcactacaggaaccctgtattaaatggggaaggcaacaacaatactttggtctacactggcagggagaagaactgcatcacgtacaacgagaatgctttcttgctgtcttgcaagtccatgatgtacattttgcacaaaccaccaaagcattttgaaaatttcgtcaaggagcacttcactcgcctcgcgccgcacatcctgggagcctgcaacgcatacctcggcggcgatctcgtcggtcatgctggcgacagcacgtacatatcagatgatggctgcaagagctgctcgaccggattcaagatcatgctcggcaagctactgccgaagctcgtcgccgccttctccgaagccgggatcgcccgtggccagtgacttcagagcgggcacacctcctgcatggcgatggcggtgacggcacgcccactgcgacaccggtattgtataggttttgcaataaaaatgctgcctggcacatgatccttttgttgtgtaatggcatcttgtaagatgggaaaacttgtgcatgattgacgcgatgaactgaaagggtgccagatgagagacagaagcagctggtgtgtagtttggtttgtgaaattgtgcctcgctgtagagtgtgatggaagtatgtaaatttgtgtgtgggtgttgagatagcaagtaccctgtctgtatagttggcagaggagctatctgatgtgcctgcaataataccacagtgtgaaacacacatattgctaaattactactactacccgtactttacttggt

SEQ ID NO: 35980 - DNA, 886 bp, Triticum aestivum
  Clone ID: PAT_TA_35980
cgacgtacttcgcccgggcgccgggcacgtgaacccgaagaaaccatggacccggggctcgtgtacaacctgtcggcgtcggactacgtcccgtacctgtgcgggctcaactacacggaccagcaggtgaactcgatcatccacccggagccggcggtggactgcaacaagataacaaagatcgccgagaaggacctcaactacccgtcgatcaccatcatcgtcgacaaggcggacaccgccgtgagcgccacccgcgcggtgaccaacgtcggtgtggcaagctcgacgtacgagatggaggttgaggtgccgaaatcggtgacggtggaagtaacgccgacgaagctggagttcaaggagctggacgaggtcttgaactacacggtctccgtcaaggcggcggccgtgccggaaggcgccatcgaagggcagctcaagtgggtctccagcaagcacatcgtgcgaagcccgatcctcatattgcccggcgacggggaggaggaggccacgtcgggagctgaggggccttcagctcatgttagttctttgctcgagtgacagattgttttgttttgttttgttttctttgctcgtgttgaaatacaggtgttgatgatcgtgacaactgtttttcttcatttaggggcaaatgtatgtgtggctgcagtccccctctatattgacatgcgatctattgtatttatttgggtacgaggtgtatttaaggatcactttgccctcaaaaaaaaaaaagcaaaaagggaaaaaaaaaaaaaacaaaaaaaaaaaaaaaaaaaaaaataaaaaccaaaacaaaaaaaaaaaaaaaaaaaaaaaaaggggccgcccaaaaggttcaaaccttacttacccttgaatgcaa

SEQ ID NO: 35981 - DNA, 1670 bp, Triticum aestivum
  Clone ID: PAT_TA_35981
cttgcgccctccctactcacacaggcgaggccaggcgtccaacggatggaagcaaacgcaaaaggggagggacgccggttcccgtctctccgtagagcccgctcctcgccgtggccggccgcggcaccgccaccatggccatgtccgagacgcagccgggcgaccccgcgcgcggcctcgaccgcgtcggcccgggcctctccgcctgcctcttcgcccccctccccgcgcccggcgcccgcgcccggcccaggccgctccccggcccccgccgcacttcccgccgagggcggcggcctccccaagaccgccgtccatgcacgagcatgcgaacctcgccgtgctgaccgaccgggctggagagccccagggtctacgggagctcgcggggctgcaggtgcggccggagctgccgccccccgcccatggcccccaggccatggacgcggctgctgatgcgcccgcgccccgggcgtggggccaccaccccgtcgcctagacacgctcttcgtcgccggcaccgccgccgctcgcaccaagaccatgggagaccccgctcgtatccgcttgtgcactacagcaaccatcgactcctacctggaccagccggcggcctacaacgacccgtactcggacaggtcctgcacccacagggtcgcctccgatgtctccgtcctccgatgagatcaggatacagccctacaaagcattctttcagattggacatcctatatacccttcaaagatggtgcggttccggtatgggctattgcaaactctctcgtccatcagagtcatttatcacagatgatgatgataaccaagcagtaattgctgatgaaatctaccgctcgactctcgccgcgcctgagttccttatgttacaggaaaataaactgcagacgtttaaactcccgcgcccagccctgtgcattggtggcgtagtaaagattgagctgctgggaagagtgcagaaacaagcaacagatgataggtattacatatgtgtctgccatgctcaagtggtcgggcgttcgctctcaccagtgttcatggtcgacatcaacgactcggctggctactccatcctcaagcacctgccagaggccaagaacctcagcgtggaggaagtgatgcaggacagcgctagtgactcgcaggagtggaaggacgctctggccagctacagggagacgagtcatctggccaccgccctcatgaacgtgctccacgagggggccgcgcaccccgcgcaggaccagcaaggggacgcgccgcacttcccgcatggcgcggcgcttctgcaagagatccaagcaatgcagggagatgcgaacctcatgcagcagctgcaggtggacgcgcagctcctgtatttgctgcaagacggtgtgctgcaactgcaggacgatgaagatggtctacaggccatggacgaagatgatgatgcggacggcggcggcgtgtcggacaacgaccccttcgcctaggctggtgatgcagagagagtgagtgagagagaccgttcgtttgttgttgtgaactagtggacttgtgaaccaacccttgtatgaactagccgggggtgtatagttgagagtatacagacagcttgttgtgaacttgttgtggtcgtccagacagggtttaaaagagtttaaaagtcaggt

SEQ ID NO: 35982 - DNA, 649 bp, Triticum aestivum
  unsure (1)..(649): unsure at all n locations
  Clone ID: PAT_TA_35982
gatccccgcaaatctgaatttagagactttcttgctagtatcactgtgggagaatctagggacgtagcacaagctaccatagggagcattcattttcctgctatacattactttgctctcttcattggtagatgcattaacggtaaggacgaagcatgtcacttgtgtgcccctgacctttgtgtccccaagagtgttgtgtctggttacagaggttacaacttgggggccgattgttgcacgtaggttgcataataatggtatatatgggagatttctttgggaggaattttatgcgacccgtgtggctaatttcccgggtttttctccaccgcaagggggtgggtttggactccccggccacttttgttgatgttcgacgctgtgcgccatgccccggtgtccttggcttcccgcctgtaccgtcctcccgggatcgaccaaccctcccctgtcacccccgccccctactttcccccctgctccgtcctgttttgattccagggcgagcccaatgttatggggtcgccgggcccccagatccctcccacggcgggccccgggccatctcccctttccccaaggtacgcggctgcgggctacactagcaaaccaactgggataaatttccantantcagtnnacatcg

SEQ ID NO: 35983 - DNA, 1451 bp, Triticum aestivum
  unsure (1)..(1451): unsure at all n locations
  Clone ID: PAT_TA_35983
ccntgaaggtttnnggntaatgaccggttcctcgnttaagacccttggggtatgnccttggganttgtcggcccctggaaaggncttggaagggcgcggagggatgaangccatggccgcttttntagggnttctaagcggcgggatcagggccttgnttgttntccnaagcaccctggttttngggtnaccttaagttaagaccttccganttgcggnttaaaacggttaatngaagtgagtcacggcggtnncccggatccnggaggtgagtcacgcnggttattgccttcatacaattgtaaccgggagttttcttgtcgaaggattgaagttgacatgaccggctcnaaatcatcttgggccttaatgtttgaggtatagaccttagagtcacccgctaggagggccgggttactcatatggtcattgcccagtcccccccggccccggctcttaggccgcccgcccagagatgggctgagacccggatatggtttaaagcctgtagttgtaatcattgttatggtagaacttgtagtgtaagacaagtatagttgagagtccgagccggacactcttatgagccggccgggactctgagagctgctgggcgtcagcctccctatataaagggacgacccggcagcggtttagaggcgagaacaatctcatcgagagctgggatagcaagtttagttccctggtgatcgtaaccctaatcaataccatctcaactggatgcaggcttttaccttcaccgtaaggggccgaaccagtataaaccctcgtgttccttgtcccatttaaccccttcaagcttcctagcggctatggctccacgactaagtcctaggtggctcatgtctgtcttgacatttctacgtcaaatcccgaccacagagggaatatcataacacatagccaaaaatggcaagagttggagttacaaatatggaaagttacatccggggtgttacagttacgcctcatggtagtcttccagcaaaaataattgatactacataaacatgatagaaccaagtactattcatgccataaacatttcaagcttaggaacccaatattaatcataccacgggtcgaggttttacatcttgaatgctatggaaatgacggtagcaaaatcaggaggattgaggacgatacatgctccagaattgttgtaactgtccttggaagtctctatgagcagcagtgagttgacgatgatccttcaggagaagaagcaggcgctaagcctctgccgccgctggtagcccgccggagtatcccctcttcgccgccccgcaggccctcgcccgccaatcccatcttcctcccttgctgtgccgcagtggaagagccaggtgcagatcgagggaagggagccggcggcgtagatcgagagagggagagacaaggaagattcattcacgaccccacgccnc

SEQ ID NO: 35984 - DNA, 362 bp, Triticum aestivum
  Clone ID: PAT_TA_35984
cgcgctttgagcaccgccgcctggatctgccgctcgtgctccttgagcatctcgtccatgttccctcccggcggcaccagcgggccggagtagttcatcctccggttccgccctccgtaaccaggcacagctgaaggggcgtccctcgtgggcatggcggtgtctttgttggcagggacgggcctgtcaagcgcattggcgggctcggcgacgtcgaggcggttgtacttggagttggtgttcctggccgccgacgagctcgggtgcaggtcggtgccccgggacgtggcgtaggacctctgcgacgtcaggtgcgcggcgtggttcgacaccctgacggagctggtcgttcgctggacccc

SEQ ID NO: 35985 - DNA, 718 bp, Triticum aestivum
  unsure (1)..(718): unsure at all n locations
  Clone ID: PAT_TA_35985
ggcacgaggctggctctggtggacacgttttctgttctcgaggcatgcgcacgtcttgcgggtgacagttgggtgcctngtgaatatcttaatgttgccgctgtcggagacaatgccgactttgtgttcttgggatcatccatcaagcggtgttatcttttatgttcatctcagtagcagggtggttaagatggtgtatcagaggacggcagatgaacatgnntgtagaagtgtggctgtacgcatctctcctgttatgacaatctggccgcctatattcccagcactgaacataggacatgatcaagaggggattgttagggctgtcagatctctcgacagaagatgacccgagtgttcgaaggcagctgaccagggccatcgagaggctcgaggtggtcctgcagcagctgattctggcctgcaactctataaggtgagactgagctcgaagcgaaacccgaggacgcggttagtaagatcaagagggatgtgcagtgcccgccagcgccatgtatgctatctgctctgctcttgttcttggcctttgactgatttaccttcacatgggcggagctttttagcttgtacaacaactaaaaatctaggtaaattgattagtgttggactgttggtccaaggataagcaacttgtactctgtactcattttcccccctgtacacagaaatttatagttgtatgtgaaattcagatttg

SEQ ID NO: 35986 - DNA, 549 bp, Triticum aestivum
  Clone ID: PAT_TA_35986
cccccccttggaggatttataacaggaggtaaatcacatatataaaagtaaagttaaatacttattacctccaatcccaaatagcgggaagtaacaaccaaggttgtggattcccatcaacacccaacggaccaaagttgagtgtagaaatcgtaaccctaacgtagcacttactcatcgtaagaatcctgcaacatgagacgttgcagccatgtaggtcagtatattgaatgtactggcaatttcacgctgtagagcaatgctaaataatggctatcactacatgcatatttggttggtggaggctctaagtttaatttttgcataaagccaattttttcctacaacaaaggaatatattttatttaactataaagtttgttgaaaacattgagaaggttcctccaactcaatcccaaattaacatcaataacctaacaaattatttaaataacgtgatgagatcaacatgataattcaagaaccagatacccaagatgtccacaaccagggatacggctagtcatgactagtttgtacactctgctg

SEQ ID NO: 35987 - DNA, 1663 bp, Triticum aestivum
  unsure (1)..(1663): unsure at all n locations
  Clone ID: PAT_TA_35987
agctcggcccccctctctcccccctcccccttccgggtcggttgctccgctcgcggccgtgtctcgccccccggggctccgcctccgcccaccacactgcacacccctgtgccagggtctgctatgaggcccggacgggggtctcgcgcaccctccaccgaccgctccggcccgaacccaccccagcggaacaagacgacggggcggagacgagacgcgtcccgtccgcgcacgctactcgattgattgcttccttccgcccgctgctgctgctgccgctgccgctgccgccagagctcccctctcccccctccccctcctcgaatcccccggtgccctagccagcccgccgcccccgacgacgaccggcggcgagcgagagggcggatcgtgccccacgcgccgctccttcccctcccggagggagaccctgccgaggatcgagaccggccggccgcggaatgggcggccgcgatgactagcgggggtcgcgcggcggcgttgttggcggaggcagcggagcgcataccatggtgcagtgtctcgacggcgtgaagcacctcctcgcggtcctcttcaagtgctgcgacctcgagctcaagcagccgcgggggctcgaggacccccaggtcctcgcgcgggagaccgtctttagcgtgagcgaggtcgaggcgctgtacgagctcttcaagaagataagcagcgccgtgatcgatgacgggctgattaacaaggaggagttccaattagcgctcttcaagacgagcaagaaggagagcctcttcgctgatcgtgtattcgatttgttcgacacaaagcacaatggaattttagggtttgaagagtttgctcgtgcactctcagtgtttcacccaaatgcttcagttgaagagaaaattgacttttcattccagctatatgatcttaagcaacaaggcttcattgagagacaagaggttaagcagatggttgttgccacacttgcggagtcaggaatgaatctgtctgatgaaattatagagaacataattgataagacgtttgaggaggcagacacaaagcatgatggaaaaattgacagggaagagtggcacaatctggttcttcgacatccatctttactgaagaacatgactctccagtacctcaaggacatcaccactacatttccaagcttcgtcttccattctcaggtcgacgatacctgaaattcttgcagttctttcgaatcggaacatcagaagataagcttgcggtaattttgtaaagttttggcatcggactgtttggaactttggatcggcagagagctagaggcctcggtgctctggaggatgttaaatttgagaacgcaaattgttgtcaaataactttgcttctctcatttgaagaatttagtattgttgggagcctttgggcaagctgttatctcttatctgaagttcccattttctcctctccccctttttggtttttgcctggttagcgatcaggtccaatcctctgggaattctcctgtgtgtacaaaaatggaaacagccttggcattgtttgttatcttttgctgggaagtttctccatcgctttgcaatctatagtgaagtggagcagaaaatggattggattttgtttgtacccanttcgccctatagtgagtcgtatn

SEQ ID NO: 35988 - DNA, 387 bp, Triticum aestivum
  unsure (1)..(387): unsure at all n locations
  Clone ID: PAT_TA_35988
caacggcgaaagcactctgctgggccgacacgggaactgggtgtctatctgctggggttggggttagaaggggtgtagctggttctctgtccaactgggtaggggtacaatctgcatgagtgtgggttatgtgtggtggggctggttcttgggcaagtacaaccgtggttctatctgcatcgacaggtagcacgatcttttctgaagaccgtgtttttactcccacagatactgccatcactccctccaattgaaatggctgataaacaagaaaagtaattgaccgtacagacattgtaagatagacaggtgcaatggatagtagggaagaaaacagggcatgaaataattcacatttatgttgtctaagcaaacataatagcnnan

SEQ ID NO: 35989 - DNA, 453 bp, Triticum aestivum
  Clone ID: PAT_TA_35989
gggtcgaccaagctgaattactattgaataatatgttgactaatgaaaataattggactcttcctgagccaattcctgaggcaattcctgaaccaattgagccaactcctgagcctattcctaaacccactcctaagaagagaggtgttttatttctcagtcctgaagatatgcaagaggcaaagaaatcaatgaaagaaaaaggtattaaagctgaagatgttaagaatttaccacctattgaagaaatacatggtcttaatataccgcctattgaagaaacacattgtcttgataacccgacacaggtagtaaaggtaaattctctctatagatatgataaagttgaaatcccctctactaaatttcatagcccatgcttagatgaatttgatgactttatggctagacaagaaagttttaatgcttgtgttggtagagagttaaagaata

SEQ ID NO: 35990 - DNA, 1521 bp, Triticum aestivum
  Clone ID: PAT_TA_35990
ccccccagcgccccccccgccccgtcggcggcgcccgccgcgcccgccggccccccggccccggcgcgctcctccggacggcccccgccgccggccccgccgccgtccgccgcccccgctccaccgcccccgccggcggctccggtggctgctgctcccgcgcctgtggccgcggggaccaagggcgttgccacgccgcaggctaagaagctggccaagcgccccagcgggggccccgccctcgcgcccgcccccccgctgctccgccccctcccgccgccccgggggctgccgcccccgcgcctccggccgcggccacggggggcgccccctccccccgcgccacctggcgcgccagcctcctcagggtgggccgtgcctcgggcccccgggctcccgccggtgcccccggcctccgccggcccgtgctctgccagccgcgctgcagtggccaaaaccaaaggtggctcccactcctgctgctgcattgcctgttggctgcagcttcctcagtaagggctgtgccgcacgcggccgtgcggccgcccctgcccggggccacggtggctgtgttccttgcgaaggccgctgccatggcgcttgcccagctccagggcctgtcagtgccagcattccgtgttggttaccccattctcactgataagctcgatgcgctgtatgagaaggtcaagccaaaggggctgacgatgaccgtgttgcttgcaaaggccgctgcgatggcgcttgcgcagcaccctgtggtgaatgctagctgccgggaagggacgggcaaaacagcttcaaccgaatgagtacagctctggcacttttactcggtcctgcttgggcatgtttggtctagatgcatgtgatgcagttcttccacctggccagggagctataatggctgttgctgccccagaacccacgggcaaaacagcttcaaccgaatgagtacaactctgggaacatttactcatgtccaacttgtggcatgtttggtgtagatagatttgatgcaattcttccagcattcgtgcaaagatttgcgaaaggctgttggggcctctaaaagctacagtgggcggctgtatattggaaggtggtctatgagttggtcacttgtcaattcactaccacatggctgtctacaggtctgtttatggtaccgatgagtccgcaatgggatatacttttgcaaaaattcgtgcggatcctgcgagcctaactttgtaggatgttcttggaagtggtctatgagttgttcaaccgtcggttcagtgccagtgagaagtctatcgctgagtttgtttttcgttttcctatctgtatctttgtagtactcaaggggatattgctttccttgctgtttgtactattttcacttggaaatactggatactgctggaaaggggttactctgctgatgttatgaagttttggaaagaaataagttatatttgtagaatagtttgcagcccaaaaaaaaaaaaaaaaaaaaaaaaaaaaaaaaaaaaaaaa

SEQ ID NO: 35991 - DNA, 609 bp, Triticum aestivum
  unsure (1)..(609): unsure at all n locations
  Clone ID: PAT_TA_35991
ctctcctctcttccctcccgcagtcacagcgggagtggcgtgaacgctggtgacgacgcggatgctgttgactggangttgttgccgatatgttgttgtggacgtagccattaatgtcaatgtcgaggtaggcgatcatggtggtgtacacacagnagcttgaagttgatgcggacgcggggtggactgatcatctaccatggagtcatgttgaaggtggagcttgattgaggggctacggtgtaaggatccagagagtcgaagcctattcagctgggaaaaagcgagtgacatgcagtttggactggagcctagtggtttgatggaagcgtgaaactcgtcatcggtcggtgatgatcggtggtactctgcagtgggggttgagtggtgtggtttagcgacccttgagactcgaccgggacagcggaggctcgacgcgataatagcggtgaggcatgcggtagcacggggcatggagacgggccagggctctggtggtcatacatgtggtgaggcaactgcgaatttgactcggggtgactacaagcaaatggtgaaaatcctttcaggtttcagacaggcggtcaagaaatgagcggtgatattgag

SEQ ID NO: 35992 - DNA, 1222 bp, Triticum aestivum
  unsure (1)..(1222): unsure at all n locations
  Clone ID: PAT_TA_35992
gccgcgacgagtcggaggggaaagatcaagatggaggcggccgcctccaatccgtcgagcaagaggatcgccctggtcaccggagggaacaaaggggtcgggctggagacgtgcaggcagctcgcgtccaaggggctcaaggtcgtgctgacggcgaggaacgaggccagggggctagaggcggtcgaaggcgtcaggcgctccggtgctgacgtcgtcttccatcagctggatgtcaccgaccctgacagcgtcgcccgtctggcggatttcgtcagggatcagttcgggaagctcgatatcctgataaacaatgcaggcatttccggtgccgagcgtgtcccgcgtcggtcggcatccggttctggtcgcgttgaaagcatggatgtagatcagagagttcaatggatgaaagaaaattccaaggagacatatgaggaagcaaaagaatgcatgagaacaaactactatggggcaaagcttgtcacgggggcactacttcctcttcttcagttgtcctcctctgggagaattgtcaatgtctcatcaggtttttcactgctaagaaacttcaacagtgaaaaactgaagaatgagtttaacgacgtcgacaatcttactgaaaagagactagaggagctgttggattcattcctagaagatttcaaggccaatttgatagaggcacatgggtggccgaccggtggctcgtcagcgtacaaagtcgccaaagctgccctcaatgcttacacaaggattctcgccaagaagtaccctaggatgcgcatcaactgtttgacgcctggttatgtcaagagcgacatgtcgatgcacatgggagttttgacgcctgaggagggcgctagcaacccggtgaaggtcgctctcttgcccgacgatggcccgacgggtgcttattttgatagggatggcgtggcctcgtttgtgtgactctgtcgtacgtgtaatggtttcgtccggttttactttcagaatatgagacacctgtatatgtgacacttattgaacattgtgccgtttaaccttgtgcagtttaatctgtgctgtgcactcaanaatgnacatgcgtgtgtgtatgatccatattggtcgatgaggtctatcgatcttgtgggtatgtgtagggtcaaacaatgcgacaacacacacacgatnacgtatgggtgttgctggcaggcaataggatgacgtatgggtgntg

SEQ ID NO: 35993 - DNA, 709 bp, Triticum aestivum
  Clone ID: PAT_TA_35993
catttttactggcctgaactgaaggatcaatatgcatattagaataagtacgatggttttaaatcatattactgacatatccgatgctaacatggcatagatacacaactagaaggatcaatatgcattaaacaacattacacgcagaataagcatgatggttttaaagcactactgacacacatctaacttaaatcatcatcagtgcttcgaatgaatgaagatccttgtccaaaacttgcatcatcactgataaggattgcatgagcttattggtggcgatcctatggaggtcgactcaaccatatcgttctctttgttccattgtcgaacccctcagtatcctcttcggctggaaactgcagacaacgtttgccgtgaaaaggagtatccttcacaagagagctacgtccatctgattcacccttgcgataattcttcatcacaaaggatatgtaggctggattgagacgcatggatatcccatctttaactcgcaccagtcctctcactgctttcttccacatgtcaacagtgacaatccaagcctcatcatcgcgatagtcccacttggagaggaggcaaacataatcgccacagaggatcggacaagctgtttgcatgtcgctcagaggcaactttttagctctagaagatggtttcaggttcttgggtggcaagggttctgttctaccatgaggaggcaagg

SEQ ID NO: 35994 - DNA, 406 bp, Triticum aestivum
  Clone ID: PAT_TA_35994
ctcgcctagggtttctggagcaaggaggtatttatagagcgaagaggcggtgcgggaggccaccaagcggggcacaacccaccagggcgcgcctggtcagcctgtgcattcggtttttttggtttgattcggtttggttcatacggtttttggtttatacggtttttatactttggtttatatggttttatacgaagatatggtccggtttcggttgcaaccgtttgctttcggtttggcttccgtaataaccaaattaaccaaagttgacgcgaatatttgaatggacaagaaacatttttggtcacatgatttggtatgtgcatgtagccatgtacctaagatttttcttgtaagaaatgcctacggatattagatcattattagatggcagtggcacacatga

SEQ ID NO: 35995 - DNA, 661 bp, Triticum aestivum
  unsure (1)..(661): unsure at all n locations
  Clone ID: PAT_TA_35995
ttcaactgcgtcgtcatccgtgtcatcaacacctgcagaagatccagttaaggcagagattgaaagttcaccggagagcagtgctttatctgaaggcattacagaggaagcaagcacagatacttcgttaaaagggaatgatgacgtcgaggagaaagcgcaggacactgngaagaaccaaggaaagcggcgtcgaagggctgaaaagtgttctgaattttttcaagtcccgaattcccgagttcaaagttcaagtcataaatgtggaggtgcccgaggaagctgaattagttgcggattcgtcagacgagttagtgcaagatgatgtgaagagcacatcagagagttcattggaggagcctagcacggaggaattccaggaggaagatgtctctgatggagattcagactcgaacgacgaaagtaaggggccggaagtaaagcttttcatcagcggagtagttcataataaagaggaggctggagcaaaatcttatgttcgagttcccgctgaaataaataacctggaaagggactcctttgaactctacatccctggaaaaggttctgatcgggatctgagtgaaacaaaggccgcgaaacagaaagtcgcggatatggctgctaaattggcgtcagagctcatgccctctgatgtcgc

SEQ ID NO: 35996 - DNA, 612 bp, Triticum aestivum
  Clone ID: PAT_TA_35996
catcgaagtcaaggaccggatgaaggacatcatcatctcacggcggggagaacatcagcaccctggaggtggagaaggtggtgtacatgcacccggcggtcctggaggcctcggtggtcgccagggccgacgagcgctggggggagtcgccctgtgccttcgttaccctcaaggaaggggccggtggctccgacgaggtggcgctggcgaacgacatcatgaggttctgccgggaaaggatgccgggctactgggtcccgaagtcggtcgtgttcgggccgttgcccaagacggcgacggggaagatcaagaagcacgagctgagggccaaggccaaggagcttggccctgtgaagaagagcaggatgtgagctccgttgctgagatacatataggaatagtggaccgtggacgctagcgccatcgtgaataaaggttatgctctcgggaaattccttagtgaagacttgtctgtataagaaattcaagcactcgatagggcacgaacacgaacaagagggagatataacacgaactctgcttatgtgctccgctgtgtttcgttgttcagataaagacctcatggcttacgctgtgtagcctcttctaaaa

SEQ ID NO: 35997 - DNA, 742 bp, Triticum aestivum
  Clone ID: PAT_TA_35997
caagaaaaaatttagggaacttagtcagtcacgtccagtcaaggctgttcagggcagattttacacgccatctaacaaatttatttggaagacagcgattacttttgtcttgcttggagtgcttacccttgttttccctactgaagaaggtccaactctccaggtcttaatctcttgtgcggcaaatatctatttcctttatcagcggcttaaaagtggatggaaatcattcttttatgggttcggctccttctttgcttcctggtttcttgccacattcttgatggtatcggtaattccgcctatactgccaggtccaagaaacttagaagtgagcacggcgtgtgttgcttacgcattcctttttgtatcatcaaccttcctgaagtaggaaacgtttggtttttaaatttcccatgctaaagcccttagccttgcagcagtcaatatggtcggtctcggctccctcctgcttccaatagcttgtacagcgctttggctgtcgtttatttctcaggggtggaaattttagttctttgctgagtttctgtctagtatatacatcaggttgtaatgtttgacatagatcttttttgccctggcccttggaacagtttgataccacctcatgtagtcattttcattgctgtattaaatatttggatagatcataagatattgacataaatggctatatgtggatcgaaaccacttttttttcccccgaaaaaaaaaaaaaaaa

SEQ ID NO: 35998 - DNA, 422 bp, Triticum aestivum
  Clone ID: PAT_TA_35998
gtgggagatcctctcggtcttcaaaagcctctgtaacagttcagtctcgcaaaatctcgaaggttggtgatagcgtgttcattgaggaaatgcctgatattctaagggagccttcttctcctggtatcgtgaagacttgttcccctaatggaaaaagagtttcaccgccacataatgcactcagcatttcaccaaaccgaaaaggagggcggaagctgatactgaaatcgatcccctcctttccatcactggttggggacacgagcggtggatctgcaatatgcagctccgacagcacaacagctcttgctttaggtccatcgtaaaagctgggctgggcagccgattatccgcgaccggagtacgacttgtagtccgataatggtacctcgcatatgaactctgcggcaaggctcaaggta

SEQ ID NO: 35999 - DNA, 400 bp, Triticum aestivum
  Clone ID: PAT_TA_35999
cggtactggaaaagatgctcgaactagcaccttgcccggagccctcaaaggaagataaaggggggaataatgaggtcgaaagcagggccccatcgctaccaattccaaccgagggaatgagcgcctccgtgaaggaggataaccaaggggaagaatctgaccttctctcgcttcgaggaatgaagaggactgcctctgaagatccggaaaccaaggcttccaaacaggagaagaagtctccaccagagggttctgccttggagggtgcccttgccgcacaaagtccgcgcaaggatcagccctccaatgagctgtaagtaatcaaaaagtactttaatagtggagatatactaccttacctctgaggaaaataaccgaagcatttatcttgcagtttgga

SEQ ID NO: 36000 - DNA, 400 bp, Triticum aestivum
  Clone ID: PAT_TA_36000
cggatgcggtggaagacgatgatggcgaaccacgaggacagcccgcacatccgagagaaggtgctctacgccgtcaagcgctactggaccgccgacagcgacaagagctcccaagagaagaaggcaacttcttctgaggtgtgaaatataatggtgagtgagatgagctgagctgatgcactgcaactcaggagatcagcgtgtgtttatttcaacttcttgtgagtttctctcgagtgtagcagtgagatcagcacgtgtattcctttttgattacgtcgtgtaggatgaacacttcttttccattttttcgagatgagatggtaggaaatattcgacacaaagatctacgtaccattttctgcccgtcacagattcaagaatgttgttatggcactcg

SEQ ID NO: 36001 - DNA, 505 bp, Triticum aestivum
  unsure (1)..(505): unsure at all n locations
  Clone ID: PAT_TA_36001
aggaagaagccaaaggaaggtatggagcgtatcaccggttggtgggcaaaggcggtccgcgtcagtttctttctgtccgtcctcttctcccaactgggtggagtgattgcggggtttgccttaaactactggttgcagatacaggagaagtgtaagtttggtggttttcttgagatcattcccttggcacttgctcttggtttctggctgctgttccatggtttctttggctggatctccatatcccaaaactgactctggacttgatgagtatgaagccggctatgagttcttcgaattagtttgatttatgctttcttcaaagttgatgtccatgtgcggacaagatcaacatttatgcttccatgttttagttttttaaaaaagctgtgccccgtgggcaagagcagcattaggctaaggtggtgtcggtgtgtggtggntagtgtaatgcaatgtaaccggttcaactcatctttaatattattaaattataaaaaaaaaa

SEQ ID NO: 36002 - DNA, 971 bp, Triticum aestivum
  unsure (1)..(971): unsure at all n locations
  Clone ID: PAT_TA_36002
ggggccacgggggcaagagaagaaggaaattatagacaatgatctgggtcgctaccgtctctactcgtcgatggatcaccgggcggcgaaatcctccagctccttcttcaattcctcacaacttttcttgaaagcagccacggattcctccacctcctgctcgcgctcgatccggagcttcctcaagtcacccatcagttcctcgacgaccgctttcagcgtcatccccaaggcactgctctgctcatgcagcatcttcctagccggcggcctcctcctccttctcggcgaccaccttgaggatcttcgcattgtcacccatgagttgctcgacgaggccggtcgccttgtcaaccgaggcatcgctgatcttgagcagcttcatcaagccgtcgaccagctcctgctgcttagtgacgccagcgagaatgtcatcgtcgccggccaaagacttcaggaatgccagctcatcgcgatggccgacgccgcgagtgcgcttgtgagagccctcgcgtgcccgtggagagctcgttcgagggctccgtgatgcgccgggacatctctgctgcggctgcggttttgcggcgggacctctctaatgcttccgcggcttgggctttgctgcctgggtatatgtccaccctaaatcctcctaccggcatgggaggaacgactttacagagaaaacattttgtggtgatgaggagaagaactgtgaatattttccaanggntaanttttaaaacccgatctaatngtgaatcatattaanttgatagtgtgaacaaattgcgatatacttaatgcattggtaataacaattgacgagaaacaagtcaaaattattgatgganaaggtgncacgtgttgcccccttaggnggcgacgcgctcgctctgngtcctcccgctcgcncctgtnaggaaattcanngaanggtaaaatcctaaaatgctaaaatcagtattaaa

SEQ ID NO: 36003 - DNA, 470 bp, Triticum aestivum
  Clone ID: PAT_TA_36003
gcggttttcatggaccacaggtcggacgtgcaccggccgcggcgggccggccatgaagagcgcgcccagggcgaggcggctgcaatgacgaggtcgctatcggcgtcgacgaagacggcggcgaggaaggacaggacggtggaagagcgggggagcaggctgaggaacaagtgaagcgtagtaacttgcaaggagcttagaattgatggccatggatgaactcccgaggagcgtgcatggccaacttcttgcttctgatcccttcccaatttgttggcatgcatacctgtggttcttgatcatttttcttactcgtattggtttcagtgcatcccatttttttggtgggagatgtggggtgggcgtcatggttgagagaggggtacatttttgtaattaaattaatggatggaggaataataatcaagtggctataatcatatacaatctatgggtatctcactaatcac

SEQ ID NO: 36004 - DNA, 997 bp, Triticum aestivum
  Clone ID: PAT_TA_36004
atttggtgtaaccccccttgattgttctttttcctctgtcttataatcctctgattgtcaatccagtcatatattgatgatgtattgatcattgtttatcagaagttttctacacattgctgctccggtccgcatctcccgcgtcgaccctcgccgccgccgacgcgcatctatacataaaagataataggaagtaagcttctatagtgtgacgtagaggtattggcaatatacacacaaccatggacattgtgcagctggcaggcccacgtgatttgctttgtcccccacagacattcctcagtattgctcagatgtggttccttcctgaaagcacatcgttacatggcacaatctggttcaactatgcctgtactctttaggtttatgttggtgtttacactctctttcttctggtctggagtcttgcatcttttttctgtggtgtgtacttcacttttatgttgtatacacaggtattttcagataaataaaagcaagaccattagagagcatgctgggccccgaatctggagagtctacgcgtgtatttgtaccgtattgtagaggttggttgatacatgtatgcacatttttcagagcaacgtgcagtggaagaagcagcctgtgaactgaaatagtttgcattggaaacaagtgctatgaaatacaaggatttcatcaattgcctattagaagacctattaaaaagtaacgattatttttgtaaatcaaggatgaaaagaagacaactgatgtgcaaggacgtgcaggtactcaaccacctagtgcgcatggatgtgatgacttcgtagtcttatgtagcatttggccgtttgtagtatttcggactagccaacttgtaatcatgaatcttatgtgcgttctaccatttggtgcttcaagtgttctggagtagaaatcttgtggtcaatggatgtgacttttaagtttttgggaccatttcgtgtttcaacccttttagaataacaaatag

SEQ ID NO: 36005 - DNA, 897 bp, Triticum aestivum
  Clone ID: PAT_TA_36005
gaagaatattgaacctgttgaagcacaagacggtataacaccggataatgtcccagcagaagagataaatgacactgaagccatggagactggagaaatccctcatgagagcacagatgacagtttaacagcaagtgcagcacttcctgatattcaacaagtcccagaacaagaagcagtcgaagataaggcatgcactgacaccacagaaaaccaaggggaacctcaacaaagcattgtttctacttctgctgagcttactccaacagaagaagaaacagcagtagtaaagcatactcaagatacacatgtacagaatgccagcagtgaaccgggaactgacccaaatttgcttgtccaatcagcacatcaatcagaattggctgaagacagcaagggtcaacttgtaaaggcagaagaaacaggccaaagtaatggtgccacccttgaagaaccaactgcagaagacaatgctgcgaatgaaatcagcccgcttgctgattctaaacaagagcatggagtagaatcaatggaacaaaacaaatgtattgatgctactgaaggtgaagaggcctcccatttaagccaagatcctggtttagaggagccagtttcagaacgtgatacaacaacggttgagccaacttctgatattcagcaagtaaatgacatggatgaagcagaagaaatggcggccactgaacccatcaacggggaagaaatttcctctcaaaaaacagatgttgctactttggaggatccatctccaacagataatgaaacggcgccagaacaaaatcctgttgagttagatgaagagaacttgggaaatgaaatcagcaatgcaatcttggcagatgaaaatatcaaagaggaagtacctgcccgggcggccgc

SEQ ID NO: 36006 - DNA, 802 bp, Triticum aestivum
  Clone ID: PAT_TA_36006
cgtacactcagactgctgcaacgcctcgtgcgagctgggttccgtcacctgcccgtggtcctgggccggggccccaaggaaatacaagtgcgcacgatgtggcacgatgaagacgccagttcactgctacaaactgacggcgaaggtggaacacgccacaggcacaatggaccttatgatcttctgctatgtggctgatgagttggtcagtgtctctgcacaagagcttgtcgataacattgatcaagacgacgagtggtacgccctgccagacgaaatcgaggatcttcttggctcgacgcacaccttccaggttttcgacaagtacatgaataggagcttcccggtgaagtcgatcatggacgatgctagcgtcccacccccagctgcatccgctagccaatgcacggaaaatgctgacccaggtcggtcatggacgatgctagcgtcccagcccctgctgcagccgctagtcaatgcaaggaggagaaagctgaccctgagggaagccagaagcctaacaagcggctgcgaggcgacgacgacttgatcaacctagatctagggttatagtgtatctagggtaatgcgtccgaaaggatcagccaatggagctttctgttcttctcctacctgggaacaactgcaactactgctgtgagtcactggatctagtgttagtgctgggtaacataccagaacccgtttaatccttttgaacattgtttcaaaaaaaaaaaaaagcaaaaaaaacatagtcaaaacctgcttctcacacagacggataacgcaactaacttca

SEQ ID NO: 36007 - DNA, 998 bp, Triticum aestivum
  Clone ID: PAT_TA_36007
cgaggtttaaccccacacacgcacgccacttgtctggccagctggctgggcccaccagccagctcttaggcgcactaaccactggttaggtgtgacaggtgcacaggtcaggaggccaaagctatttgacatgataataccattcaggcaggatggaggtggtgcacatagacgaggacagcagcgacaggcaaagaggttatacagcagggttcacgatgcattcgttggagcattttgtcaaaggacttctcatgcagctcctagcttttcagaattcgcccaatgtatgtgcttgggctttgttttgattgatggaccttaaagctgaagcattaatgcatgaacttgccaaatggatggagcaacaggcatagaagaaatccacaaccaatttttcttggctgcgccatcttccgctgacagtaactctacacaacagcctgctaagatcgtttctaggtgatgctgatgaatcatgtaaggatggcgcataactcaccagagggaaaagatcgaactacgggtaaccaaatcaaacagaagagaaggtccagttgtcgttgccttcacttgctttgtcgtttaccgatctgttaggttgccggttccccgacttgctatcaaggagaggggagagaaatatggattgggattctaggtaaactttacttaatttgttgcagaaaatgctcggtagatgtcatttatggatgaggttgtggcagtagttctcgggtgttgtctctatcttgataaagccttctatcagggcgcattagaggctgaagaatagaaaacatttggggtttctgtggcattgaacattcaacgtgtttctgcgttgctctcgcgcggccatgcacggccagttcagtaactagatggccttttctactgtaccggcgctgctacttttcacatgctagcttctttggaaagcgccaacagtgtgtcccacatgtaaagagtcccatgttacaaagaacataaccaga

SEQ ID NO: 36008 - DNA, 1028 bp, Triticum aestivum
  Clone ID: PAT_TA_36008
ttaatctgaaagcattacgaagacattgttccatctcaattttttgcctggctccttccgcaagcgcctacacgaccacacacggcaaaccatggaggcgtcgctgaccgcggccgccgccgctacctcgtcgtttccgccgcaaatccgtcgccgaatcatcaaattcaacccgctcgtgctccctaggcgaccccaattcggggactccaagatctggaccgccaacttccggggacacctggctgcggcctcggcatccacgccgccgccgccgggaggcggcctgtactcggcggcgacgtacgaactgacgccggataacgtcgaccgcgtcctcgacgacgtgcgcccctacctcatctccgacggcggcgacgtcgccgtcgtgtccgtagaggacggcgtcgtctcccttaggcttgaaggggcgtgcagcagttgtcccagctcgacgacgacgatgaacatgggcatcgagcgagtgctcaaggagaagttcggtgacgccatcaaggacatccgccaggtgttcgacggggaccagcagccggaggagacgacgcctgaggcggtgaaccggcacctggacatactgcggccggcgatcgcgaactacggcgggagtgtggaggtgcttgccgttgacggcgaggactgcctggttaagtatgacggcccagagtccatcgggagtggagtgaaggcagccatcaaggagaagttccccgacatcacgaatgtggtgttcacccagtgatctacaggtaggctggccggcttgatgccatcccagtgcagtaaaatggcgacatgtacgaaatgcagcgagattttgtttcgatgtattgtctagacaagagtttcgatgtttcgtttgggtagaaaaagttgcagcgcacgcaaacactacgatggaaattgaaatggaataatttctgcattttggatatgcgatatgagaatatgaatactacgtgggccgcgtaaggttcttcaagaaggaactcctcaaagaacgggacttt

SEQ ID NO: 36009 - DNA, 723 bp, Triticum aestivum
  Clone ID: PAT_TA_36009
ccggccgccacctcaggatcaccccgcaccacgacttccgtcatggctcctgcagcagccacggctgcgccctcgccacctgccctcccaacatgtgcaagggcaaggtgatggatgcgatgctgcaagaactgtccgcggcggctgcggcagggacgaggaggccgagtagagtggtgtacctcggcgatggtaggggcgactactgccccaccctaaagctggccgagcgggactacatgatgcccaggaagggctaccccgtgtgggacctcatcgccggcgaccggcgggccgtccgcgcagacgtgcgcgggtgggccgacttcaaggacctggagacggtgctgcttgacatcatacacgaatgcgccgcggccgccatggtggaacaagacggcggcgatcaggtggtggtgggcatggtggtgccagagtgccgtgccctttctgctcccaagatggcgatggcagttctccccaaagcaattcatgcgcccaactgacacgcatctttgccaaacaatatggacgtttggctgactcgatggaagcatgggagatataatggctttcccaatcgtaaagtagaaaaactatactgctcctggttccttacgtctacagcagtaccttaagcatgggacatgattagctcgatcatactctctcctggaacgggatccaatggacgtactgcatgcacggtttaggagcaactta

SEQ ID NO: 36010 - DNA, 537 bp, Triticum aestivum
  unsure (1)..(537): unsure at all n locations
  Clone ID: PAT_TA_36010
tacgggcgcgtgaagacgacagaagtcgacggggccgtgaagggcaaggccggggagcggaaggcttggcggggggtgctccgcgcggccccggacgggttgccgtcccagctggccgacttccgggacgccattgtggagggcggaaggaagctttccgactcctgcagccactgagcctgccgatagcgcgtccggcccgatcggttaaacgacgatggtggtgcttctcgcctccttgcctggcggcagcacgtggtggtggtggtcatgtacagcgatggtgctgcgacccatacgcagaggcggtaggagtgcgtaggcgtcttgggcagctcttgctatggtggcccggcttcggcttgcgttgcgtggtgtctccgcgtctttttacgtacgtacgttcttcgctctgctgtgctgtgtgtgtccctcagactctgccatcaagtagacatgcgtaccactaccagatgagagaatggctgcaaggaaagctagttgtacggttgtgtcagcaacccgcttaacaacnaa

SEQ ID NO: 36011 - DNA, 767 bp, Triticum aestivum
  unsure (1)..(767): unsure at all n locations
  Clone ID: PAT_TA_36011
aaatctgccgccgccaacatgcgccagcctccggcgttactgcctcttgcattgatggcaatccttatgtcgaacaccacgatgagatagtaatcgttgtagccgtgtcactttgtcggcgggtccgcaattgctatcttcttgaatctcatgtaggcatcatcatacgtattcaagcccagccagtccggaaggccgatcccaatggtggagaaggggtctaccggaacggccgcactgctgtggatgttgtgcaaaatgatggtggtatccggtcggagatatgcaagccaatcttcattggcaccgacccagacctatatataagacggtggggcagcggagaaattacgggatggaaatggaataactaagtactacatgatcaaactccattactgacctgctcatccggacaaaatccgactacctctcaacgtcggcaactctagcgggatcaacatgcaaccatggtcaaggagcggtggactgttcgaaggattgtcccatagaagacttctcctcgaatttcaaacaccgaagatcaaggctagcgcttcngactncatcaagtccggttctacttntaagnggggggngnccnccccncancaaanaggnggcancananccaanaaaccagtnntgacaccgaatcnccanagctgcctgcccangnaagcatccaanccgaaccggnanatgngtatctctcactctcgaggcaggttatcaatccnttcaagggcagnttacagggncattca

SEQ ID NO: 36012 - DNA, 1084 bp, Triticum aestivum
  unsure (1)..(1084): unsure at all n locations
  Clone ID: PAT_TA_36012
ggctattccttccacctagcttgtcggcagtgggnaactattggnacaagggtgttcacaagcatattttcaattttgacaaagatataatgagcttggatgaaaatgaaagggtaacttcgagnggttcactcaatgttcatcactgtgacgatacaaacatggtgatatctttcacaagggggcctttcctttttgtatttaatttcaatccagaagtcccctatcaactgtatcgtgttggtgtggatgaagctggggaataccaacttatcttaaacacggatgaaactaaatatggtggccgtggggaactcaagagtagtcagtatatgaaaaagactagtgacagaagagctgatggctgtcgcaactccttggaattggcattagcatctagaagtgctcaggtatacaagttggtccgaatcttgagaatataggctgtcgacactaattactgtgacataccaaataatcaatgtcctccgaagatggactatcattgccaatgttcaagttggaaacatgggtgtcgaaaatgagattggagtcggcatacaagtcaagctcccccagcgcggcaagctcagtgaagagttttgactgtgctataaattctggccatgagcaagttctcaaaaataaaacatgccatttcagctacagtacacctggtgcttgccaggatcttgaaaggaccccgctaccccctgatggcattttatgtgtactgggtgagacaagggggtggcattttatgtgtacagtttgtttgaattccggggagattttggcagaaaactgccaccgtcagatctagatctgatggctctgggggtgttcgccaggattgatctgacggctctgggggtgtttgccaggattttggtctcttggataagatttccctcatgaaatcacctcattccagatataatggttaactccccataggtagagcatggatgcgcgattgacgatgtacggttcagttcgagcatagtggagcaatgtgttggatttgttacgacggtggtttaattttaactataagcttcacagtcggtcgatcgatcggaaa

SEQ ID NO: 36013 - DNA, 508 bp, Triticum aestivum
  Clone ID: PAT_TA_36013
acgagatgatgaggcagagaagcccgtgaagtcccaggccggaaggacaagctctgtacacacaggtatactgttatagaaagaaagacagcaaaaaagtacatatgacgtctcaagcccgaaggacaagctctgtacgggccaacttgagagaaagatcagttatactggagatggaacatctcggtcccagaacccttgctgacaattgtctcagcacaccgatcgatgttcttgccgtcggtgacttatactgtaatcgttgtgccggtcttgttctgtagcctgctcatgtacaataggattttggatggctccttattatacatgtgcaaaatagggcatacttggcgtcaaagggtgcaaaacaccagtcatagttgtctttctttgttgttgtctcagctcagagagcacctgtagaaaacaaaacagaacagaacatggttgtatcggtatttcatttatatttattatcagttgcagccaaaaaaaaaaaaaaaaaaaa

SEQ ID NO: 36014 - DNA, 747 bp, Triticum aestivum
  unsure (1)..(747): unsure at all n locations
  Clone ID: PAT_TA_36014
gttgcttcttcatcacaccaccaccatttccgcataggcttgaccaccatacacttcccccacaccagcttcgcccactttgggtcctggcgtccgccgccgcccccgtggtgtgtccgctacttagggatggccacttcaactctgacccgcatataccccatcattccacttccgcattgccaagtgcaaaacaccaccacctccctgctaccaccatttgacttttgtccttgagattttgagttcgcggtttttccgtttcctaaggtgtttcggctacttagggacgagtctccatcatcttggtatctacatcaagaccaccgccactcatcatcgcaaaggacggtaacctcgacgtcaccttggtaccgtcccctccctccattgtacatcacccttgcccttgcattggataacccctagcccattttccattacttgcctatcgagactaacccgttgcgtattgccggcatcctcacttgtgcactcaggcgtatcgacctcccacaccaccgcgtaaagcagtccgatgacaatacacggcccgggtcctccccccacaaaaaactcgccccggggggggttctcgcatttgcattcaaanaaaagaaaaccnaaaagtttancaagaaaagganacaanactgtancatancatcaaaaatttcanaggacanattgtnactggtnatggtanaacaggaacatcntttcanatgaaaattacattgnccaagn

SEQ ID NO: 36015 - DNA, 1021 bp, Triticum aestivum
  Clone ID: PAT_TA_36015
cggcgcgtcggtcgtccccctccgcccgactccgcatccgcccccgcctcgtgcctccgtaaaacttgcatggacacatgatcggtttgaggatagcatggtggctgctggacttcctgggatagaaactggtaccaagttgtatgtgtcaaacttgcactacggagtgacaaaggaagatttacaggaacttttctctgaaatgggtcatttgaagaactgcattgttcattatgacaataatagacacccaactggttcagctgaggtgatattcactaggaggagtgaagctgttcaagcattgaaacgatataataatgtacgccttgatgggaaagaaatgaagatcgaaatgattggagcaaatttgggtttggctgctgctcctgcacctcgtgttaatgttgtttcaggcgcaagaggaagaggacagagagaagttgtgatgtcccatccaaatgggtttggtcgaggtgcaactgactcgtctagtttccttcctgggtggaagcgcaacaacggctttgctcaaagaggaggatcggtccgtgggcgtgggcgtggccgtggccgtggccgtagcacctttggtcgaggtcgtggacgtggcgtctatgtacggaaggggttggtgaaatcggctgaccaattggacaaggagctggacacctatcattctggagcaatgaatgtcgactaagatgctgcatcttatcacattgaacctggagcttggctgaggctttgaatttgagcttgttttatgtgtggtttgctgccgagttgccgttggtcatctcccagttgtgtgcacatatgttacatgtcttttacatcaagcttgaaaaccgtagatttgaactgcagttcctagttctagtccagcagtaacattgtaattggtggtcaacagctttgagcaaccatttgttttcggtggctgttgccgtttagtatgttttttctgatgatttaaaaaaaaaaaaaacaaaaaaaaaaaaaaaaaatttgtttgctt

SEQ ID NO: 36016 - DNA, 850 bp, Triticum aestivum
  Clone ID: PAT_TA_36016
gttcgtgaacacggcggggccggacgggcaccggcagttggcgctgcactgcgaggtggacatgtccatgttcttcatctgcaggttcgaggggtaccaggacacgctgtacgtgcacgccaaccggcagttcttccgcaactgcgaggtgttgggcaccatcgacttcatcttcggcaactcggcggcggtgttccagaactgcctcatgacggtgcggaagcccatggaaagccagggcaatatggtgaccgcgcacgggcgcacggaccccaacatgcccaccggcatcgtgctccaggggtgcaagatcgtgccggaggacgcgctgttccccgtcaggcagacggtccccagctacctcggacggccgtggaaggaatactcgaggacggtgatcatggagagcaccatcggcgacctcatcaagcccgaggggtggtcggagtggatgggtgacctcgggctcaagacgctctaatacgccgagtacgccaacaccgggcccggcgccgggacaagcaagagggtgacctggccggggtaccgtgtcatcggacaggctgaggccacgcagttcaccgccggcgtgttcatcgacggcatgagctggctcaagaacaccggcacgcctaacgttatgggcttcatcaaatgatcgagccagtttgccggccatttgactccggccgcgtgcatgcatgcatgcgctcgtccggtggatgctcgacgagacacgtggagttttaggaagaaattaaggaaggagacataaagcaagatctgtttgtgtattatttgtacagaagtgcaaaagcagttcaagcaaaagaatttctcctgtgtaatg

SEQ ID NO: 36017 - DNA, 632 bp, Triticum aestivum
  unsure (1)..(632): unsure at all n locations
  Clone ID: PAT_TA_36017
acctcgcagacatccccgagaagaagccgccgccgacgccgccgaccctcgcggccgccacttctccacggggcgcaaccatggtgacctccacgaagaagacgaagaagtccggggacaacatcaacaacaagctgcagcttgtcatgaagagcggcaagtacacgctcggctacaagaccgtcctcaggaccctcaggaactccaaggcaaagcttgtgatccttgctaacaactgccctccactccgcaagtctgagattgagtactatgctatgttggcgaagatcactgtccaccactaccatggaaacaatgttgatttgggaactgcgtgtggtaaatacttccgagtctgctgcctgagtatcatcgaccctggcgattccgacatcatcaacgcaacaccagctggccagtaaacctgtgcatgccattttcagtgtctcgtctgatgccattttcttgctggacttgatttggtcttgtgtacatcatttatcagtcaatcaagtttgatgggactatggtttttctttaaaagggttctgttcctggcttgattgattgctcttcgtggtgctgctgccagcatgcgtatgctgcgatcacgngcatgcgacgtaataact

SEQ ID NO: 36018 - DNA, 610 bp, Triticum aestivum
  Clone ID: PAT_TA_36018
ggtcccggacctcgcagacatccccgagaagaagccgccgccgacgccgccgaccctcgcgccgccgccacttctcctcggggcgcaaccatggtgacctccacgaagaagacgaagaagtccggggacaacatcaacaacaagctgcagcttgtcatgaagagcggcaagtacacgctcggctacaagaccgtcctcaggaccctcaggaactccaaggcaaagcttgtgatccttgctaacaactgccctccgctccgcaagtctgagattgagtactatgctatgttggcgaagatcactgtccaccactaccatggaaacaatgttgatttgggaactgcgtgtggtaaatacttccgagtctgctgcctgagtatcatcgaccctggcgattccgacatcatcaacgcaacaccagctggccagtaaacctgtgtatgccattttcagtgtctcgtctgatgtgtcatctgaggtgttctagagtgtagttcttgctggacttgatttggtcttgtgtacatcatttatcagtcaatcaagtttgatggaactatggttttggatcaaaaaaaaaaaacaaaaaaaaaaaaaaaaaaggccccta

SEQ ID NO: 36019 - DNA, 1339 bp, Triticum aestivum
  Clone ID: PAT_TA_36019
cgtcgccccacgcccacccggccacgcggcccctctcatcgctcccgtccctcctcctcgcccccgggcagaagcgcagccgccgccgccgacgccgccgaccctcgcgacgccgccacttctcctcggggcgcaaccatggtgacctccaccaagcacgacgaagaagtccggggacaacatcaacaacaagctgcagcttgtcatgaagagcggcaagtacacgctcggctacaagaccgtcctcaggaccctcaggaactccaaggcaaagcttgtgatccttgctaacaactgccctccgctccgcaagtctgagattgagtactatgctatgttggcgaagatcactgtccaccactaccatggaaacaatgttgatttgggaactgcgtgtggtaaatacttccgagtctgctgcctgagtatcatcgaccctggcgattccgacatcatcaacgcaacaccagctggccagtaaacctgtgtatgccattttcagtgtctcgtctgatgcgtcatcctaaggtggttctagagtgtagttcttgctggacttgattttggtcttatgtacatcatttatcgtgtcaatcaagatggacgggccgaacttgatgtagcacaagtgtacattacatttatcagtcaatcaagtttgatggaactatggttttggatcaaaagggttcaaaacgccgactatatgagcgacactgcgtcaacagtatctcactcaagttcgttccggcctctgaagaggctagttgactgagctgatgaacatctatatgagaaatggtaacaaagtttttgtgcaaccatcataatgactgctggtttcagaactcagtacttttgcaataatgcaatctccctctcgtgctcgcggtcgcgggcgcgggcctactgcccagccggacgacggttgccgggcgccgtggtggctatgtcgtcggcggcgcccacgccggggcccgtgcagaagtcggaggaggagtgggaggccgtcctcacgccggagcagttccgcatcctccgccgcaagggcaccgagtatcctggaacaggtgaatatgacaagttcttcagtgagggtatttacggatgtgctggctgtggaacccccttgtacaaatcatctacgaagttcaactcagggtgtggttggccagcattctatgaaggatttcctggagccataaaacggacggcggatcctgatgggaggcgaattgagatcacatgtgctgcttgtgaaggacatctggggcatgtgttcaaaggggaggggttcaacacgccgactgatgagcgacactgcgtcaacagtatctca

SEQ ID NO: 36020 - DNA, 1542 bp, Triticum aestivum
  Clone ID: PAT_TA_36020
ggtccccgctccggctcttctttcccttctgcccgtttgtctccccattccgaatcgcatctcgcggcggccggcgatcccccagaagcgaagatctatcggggttgcgcagcaccaccgccgacggaagctccggcgcgcgcggccgcaccaccgtgacgcgcctctttcgccgcgcctccggtcatatttcggtaggggcgatcgagcggggctggttcccaggagaagggataggagaggatgatactgctccagtccccatccaggttcctactccagatcctcaaggatcgcgtcgtcagcggcgacaagggcgtggacatcgattgccacacggtggagttcgacgatgtgcggtatcatatccagttttcaatgaggaatccaaaggtaatggtgctatcagtggcattgcccctcgcacctcctgaggctattctgcacgacgggcttcctcttggtgccattgatgctataaaggcggcttatggggcagtggttcaaattcttgatcctccaaaggactgctttgatctcacaatgaagataaacttaacaaagcttccgacagatgaaggttcccgacccttgaagagcagcggaatgttgtcttgacacaaattgcatctgtgagagaggttgtgctgggtgcaccgctgaagcttctgctcaggcatctagcttcaaagacagtggctcctaacgtggataagctggttgcccttgttcaccgtcctaatgaatcgttcttccttgctccccaggcagacaaagttacggttgtatacccaatgaggttccaggattcgattgatattgtcttggcaacttcgtttctgcaggaatttgtagaagcaaggcggactgctgcacttaacaatgccccttcctgtatgtggtctccagtaccacctcttgagttaaaaggcgtgaatgctgatgcacttgatgcaaatgctggttttgttacttttgttgttttccctcggcatgttgagggtagaaagctagacaaaacagtttggagtttgttaaccttccatgcttatgtaagctaccatgtaaagtgttctgaaggattcatgcacaccaggatgaggcgtagagttgagtctctgatccaggctttggaccgtgctaaatccgatgcagagaagctgaagaagttggtacatggcgggtcttttaggagactgagcatgaagcacgaaggcaactctaatcggtgaaggaagactcagacaagcaaatatatgaaggttttgctcaactttccatcatgggtgctactggtagaacacttattttaacttccggtaagatttgggtggcagccgttgaaacaacatgagcaccctactgtggcccgtcgcttgtttgtttgtttgttccgggaggatactgtatttatggtcgaaatttgacttgaggaataggtgagatttaattggtctttgtaaatctcgctgcatatgtcctgacgctattttgcacatagctttccacaagaaaaaataaattaggagtatgcagaaaaaa

SEQ ID NO: 36021 - DNA, 1008 bp, Triticum aestivum
  Clone ID: PAT_TA_36021
ctgagtggcggtagtattgtacctgtcaatggagtcgactctctttttgctgccgagattggccatgttaatacaaaggaggaatcttctaatagtggatcttttatgcgtaatatactggacaagatagggcttggagtccttgctgatccggtaaacattacctcggaaatctttttttttttgcttctccatcttgcattttagttgatttccagtgtcatggtaaagtttctttttatttgcatctacattgatgcttaaatcgtatacgccataggctacatgtatgcttgttcttggactgccattttcttcgcaacacacccagataatgatgtgtcttgagtttggactttggacatgagttgttggtttcatatgcttatataccttattatgtagcacagctgcatcatatttgcataccactggtcagttggccgattatttcacatgcactttttattcaacattgtctgatcaggcagagtaccataaatttatcttttgtttgctatttctttgagcagagacattttttgatttaatatcttactagttaacattacttatgcccatgatgtctgggctttaaagctgggaaagaataagctgcatgaaatgctgatgaaaactcctggatttggagaagccgttgcaatttctaagctgatgcaaatcgtcgactgcaagagagcaataaatttaggcgcatagttttggataccgcggttactgggcatacactaaaccttttatccgctacaacgaggatggatctaatagtggatcttgccaacgtaagtgtgaatttaacatagggcttggagtcccttatgttccgctgggaaagaataagcagcatgaaatgctgatgaaaactcctggatttggagaagccgttgcaatttcgaagctgatgcaaatcgtcgaactgcaagagagcattaaagttgtagcggataaaaggtttagtgtatgcccagttgccgcgcggacgcgtgg

SEQ ID NO: 36022 - DNA, 885 bp, Triticum aestivum
  Clone ID: PAT_TA_36022
gcaagggaacatgctcaccggtgcgattccaagcaacattagccactgcagcagcctcaggaagatggtaattgctgacaataaggggttgcaaggagcataccttctgagatcggcaacatgcaatcgctacgtcttgtacacctatacaacaacagcctcaccgggaccatcccgtcgtcactcgggaacctctcccaggtgactatcttgtcgctggcagctaaccatctcgagggatcaatccccgagacctttgggaacaatccacgtctcgagttccttcagctagccatgaataacctcgcaggtttgcttcctctttcgttgtacaaccagtcatctttgtacagattttatgtgacagacaacaacctgcacggccgtctaccagctgatctgggaagaagccttcctagcatacaacagtttggatttggggataaccaattcactggagttgtgcctccatcactgactaatatctccagacttcagctttttgatgttggaaataacggattcagtggggttgtcccttcagagttgggaagattgcagtatcttagatggttttgtctggatgtgaacaagttcgaggcaaacaatgagcgagaatggcaattccttacttctttgacaaactgtagcaggctgcgactgatgtatatagaacaaaacaggttctcggggcaattgccaacctcaatatctaacttgtccacaaacatccaagagctagatattttgaacaacaatatatctggtactattccatcagatattggaaatttgataggtcttgaggtgcttattcttgctggcaacttgctcactggggccattcctgagaccatagggaagcttatacaattgaagaggcta

SEQ ID NO: 36023 - DNA, 651 bp, Triticum aestivum
  Clone ID: PAT_TA_36023
gcaacaggatctaccggaaggagctggcgcggtccttcctcctgctgacggcgccggcgcgcagcgtgctgtcggcgcagggcatccacttctacttcctcctgttccagggcgtctccttcctcgtcatgggcctcgacctgatcggcgagcaagtggagtgatattgatatcaatgacagcagcgaccgaagatcgttacgacggcggttatttttcgtactttgcaggcatcaaaggagccctctgtaaagggaggcaacgtttgatgcttacaggaggaagctctctctgatatacaactgaactgtggagaatgtagatagatatagctctggatcatcatcatcatcatcatcaaaaagcctgggagacgcttttattctttcgggtcgtcgaaattcttttgtaagaagcaaaaaatcaaagccttttgggtgggtgggtgcctagatgacgggtggtcctttgttccttgttgacagaatttaccttcaaatgaagataatacttgttttcgccttgtactttttgccacgatcaatcattaattatcagagatacatgttcaatatagttcatttgtatctctttttcctgcaaaaaaaaaaaaaaaaaaaaaaaaaaaaaaaaaaaaaaaaaaaaaactcg

SEQ ID NO: 36024 - DNA, 387 bp, Triticum aestivum
  Clone ID: PAT_TA_36024
tacagctacgagaagacgacagaagtcgacgggaaggcgccgtttgcgaggctgatgctgcaggggaactacctctgcggagccctgccgcgtgagctgaggcagatgaaggagggcggtgttatggtgagcctggcggacaactgcttgctcaagtgcccgcacaagttcttcttctgccaggggccgccgcagaagaaccgtgacacatgtcccaagtgcgaaccatgagaggttccatactgtagataacgcattcatgtcgtataccttaatttcatcgggtactgtatttcatcgggtactgtccggatgatgaactttattgatcgaataatactacataactttgcttgaacgcggttaacatgccaaaagtggattgct

SEQ ID NO: 36025 - DNA, 760 bp, Triticum aestivum
  unsure (1)..(760): unsure at all n locations
  Clone ID: PAT_TA_36025
agctcccctacatgggccaggggaacggcgaccctctcggctgcggcatgtccgacggcggcatgggcgacgatcagggcgccatgcacccgctggaccaggccttctgccggcccatgggttcctcacagcagcagcagcagcacttcctcagcgacgccgcctctcaggttggggctttctggcaagatctgcagagcgtggttcagatggacatggggcagagccaggagctcgccacctcctccaacagctacgacgacggtccacatgaaaatggagctttgacatcgtcaccggggaagaagctcgatccgacgggaagcctcgacgccaccgctgtacatagagaggagaagcagagcctgagagtcagtcagcgaagcttgccattcgaccgtccatggaagcactctgagattcaacctaacagtgttgggcccttagcagtgtcttagctttctaatttccaccaatccatccgtcagtcccttccggtgtaatgattcttttgaacaagaaagggaacccggccgtgcaacagtagtagcttaggctagctctgcgtatcatcatcatcatctcctttcttcttgtgctaagcttccaagatcgatcggtacatagcgcggcacccttcctatccattctccctcaaatgagaggggattgcattgaagatgtgtaatagtatcatttgtattgccattatatatattataatacgtccgccccccttccatctgggggggcaaaaaan

SEQ ID NO: 36026 - DNA, 416 bp, Triticum aestivum
  Clone ID: PAT_TA_36026
cggtgactttcccaaaataaagaaatattgaggatttaataaaaaaatcaaataagattttatttcggagttttcggtgttttatttgaatttaggaaaaacgtgcgtttatcaaaattgcatttagggcccgagtaaatgttcaccttgtgcggcttgattttagaagcccgtgaaaatttattttggaatttttggagtccgtttagtatttctttttatttttcttccgagcggaataataaaaaaaacgaaccgacttcgggccgtacccgagcgggacaccgcccggggtagcctttaaatagcgccgccccgagccgccccatcccatcagccccgcctcgatccgtgcgcgtcaacagagccatcaccgtcgccaccgatgatcccgccgcccgacgttcgtcgcgcct

SEQ ID NO: 36027 - DNA, 418 bp, Triticum aestivum
  Clone ID: PAT_TA_36027
gtcataaaccctttttgaacatatatatgggtcatccaagcagagtgggacgggtctctcaactaaaacaccacccgacgtcgcctgatttagggacgaccctagtgtagctgcacggtagagcacacaccagatgacagaaaccttatgattatccatcgctgtaataactagtcaacaaaaatatagcatcactggttttattccagccgagggccggtgcagggctaaggcttgaaacttcggaacgaactccacaggtctgtccaggtgccgaccgatgaaccatcacttggagaggaacttccggctgacggactcgtagctcgggacgtggataacatcgccccatcatgccaatgtaagcggtgaagagattatcttctgtgcaaccgtagacatgtcgcggacgcgtggg

SEQ ID NO: 36028 - DNA, 1856 bp, Triticum aestivum
  unsure (1)..(1856): unsure at all n locations
  Clone ID: PAT_TA_36028
gtttgatcgggtgtttactgtattatggtatgttactacgaaacaccagtaagggtcatgccaagcagagtgatacatggttattgatctctgtaacaactagtcaacaaaaatatggcgtagctgattttattccaaccgagggctggtgcagggctaaggcttgaaacttagggacgaaccacagagacccgtccaggtgccgaccgatgaaccatcacttggagaggaacttccggctgacggactcgtagctcgggacgtggataacatcaccccatgatgccaatgtaagcggtgaagagattatcttctgtgcaactgtagagatgtcgtacagggtggtcgcctcaacagctctcacgaagtactcaacgggcttcctttgcccataagtcagaacctgtcttccaatatcttcagatgccacaattcttgattccaagttcatcagaactgcagccttggtagcctctttagcacgatcaagctgttcttgagtaacttttccaggggttgcaacttcaaggagttcccctgctgccaaatccaccgccgttgatgcaaaatctgggctagtggctgcatgaattcacgaaaagacctgaatcattgtagatactgttgaaagcagagaatgactcgttctggtcatacttgttcaagacacggagatacaatggagttcccctgctgccaacagggccaccaacagagaaagaccccccctagtgcatgaatgaattaagcacagacccaaatcatggagtatactgttggcggcagccaatgactagatcaaaagcaagtgcaatgtgtgtctttggtgcatctgcttggcaacgatagtcccctcccacatacaccgattttggctcttcatgacgtttcacaccaggaaggtctgagagcattggttccgcaatcgaaaccaactcatcatgttcaagtcctgatgctgcaagaaccatcctgggagcagtgtaattttcatggatgaattcctccagggtactaatatccaatctgtttatagcagattctgtagccatcaaaggtttcgccagtgccccagaatacccagccgaatgaagtgcctccaaaagtagaccttgtggattactagacacttcagatatttcagactttatcttctggagctgctctttgacctcccactctaagaatgctggattcctcacactgtcaacgagaacttcaaccatctctggtgcataactcttcagtgcgtcataggtatagctcatttgttcacgagaagcagatgcagagacatttccgccgatggcttctacctcacgaactagccgcaagtgactccgatttgttgtgctcctgaaggccattctctccaatagatgcgatgctccagatgaagcaggtgtttcataaatagaaccacagtcaatgtacaaacccactgatgcagccgcgcccggtgatgtctctgatgcaatcttgatgccacttggaagagtagtgatttttgtcttggattgctcaacaaaatctggtaggggtggaggaatggtaatgcctgggagcggaacatcaagagggggtagttggcttgagcctccgccaagaagccagctaaacagaccacctgaagactgcttcactacacttgtgctagcaaatctactagcaccatgattcttgagagagcgaaaatggctcccagcggcgcgatacatggtcgcctgcgagccgagatcccggggacgcggggggcggcgagacggtggaggggggagaggagccgccgccggtgaggggtttgatgcgagggcgagaccctccgccgcgccctcgtgccgaattncctgcagncc

SEQ ID NO: 36029 - DNA, 850 bp, Triticum aestivum
  unsure (1)..(850): unsure at all n locations
  Clone ID: PAT_TA_36029
caatgggtatccgtancaatgcaattgggttatgnttgaantcaccatctttatcannagttgtcagtggggcttattgcatacaaaaatgcnttccgtgtgaagtgttgtcatagtagtcggtttttgtccttgcatgaacaccatgaggattnttgacaggatcaaggntgtcatacttgtntgtcgtagaaagttccatggacattccccaaaatatcatnnnggggagtgccaacttccatggnggataaatggcgtgtcanaggagtntttcgtcaaagggtgcnggaaacgtggatccaacgtaangggatccagttaactatcggggtcgggttttggaaccggntacccgttaacagccccggnccatgggaatttcccacggtgtaaaattcttattggctggatgaaacacgtgtcagctcgtccagtgggtcagataggcgcctatcatatgtcgacacgtgccacggcccaccactggcccatttagcttacaaagccggcccgtttgacttggtcaaaagttaacgggctggcccatgaaaagcctgttaacggtctcttcgcaaatagcccatttcatggcccgttaactcacggcccgttaggccctaaaggaaatcggcccaacaacgtcatgtgggccgtcgaatataacaccagcccatttcacttttggcccatgtatggcccacgacgtctttcggcccatatgaggccttcgtatctttcggccctttacaggcccacggtgactctagcccataatgaacagtaattttctttatacccgttaacggcctgtgatttacatgggccgtttccagcccgtgttagcttt

SEQ ID NO: 36030 - DNA, 449 bp, Triticum aestivum
  Clone ID: PAT_TA_36030
ggtccacgacctcaacgggaccaacaccactgctaactcaatgatggatatacattcacttatcatgtccctcaatttcacccaaatcgagataaaaactgccaactttgccaactcatggggagatggggtgctagtgatggtctctggtcttgtacagaccaaagagtacagcaaccaaaggaaatttatccagatgtttttccttgcgcctcaggagaaaggttactttgtgctcaatgattatttccactttgttgaccaagaacaagtgcaacctgcacaggtgagagctcaggaagcctttgagaccaacatggcatccaacacagtccaaacaagtgcagagtacattcatgaagaaagtcaaacaatgcaagctgttccagtaacatctgaagaaaatgatgctgttgactgttacacttactctgagccaccacagcaag

SEQ ID NO: 36031 - DNA, 1998 bp, Triticum aestivum
  Clone ID: PAT_TA_36031
gctccctcaccccgggcccgtccagtcgagtccacccacgcgacgccaatccatctcctcgcctctcctctcctctccatcctgcgaaaggcgcagaccgcgaatacgcacgagcagtcagggcggacacatcctctcgcggcggcggcggccgctgcaccggcgtgggatctcgtgccgctcccccggttagagcttccccgccgaattcggatttctagggttactcccttctcgattgcgctccccattgcttcggtgctggcggcgtgtcaagtggggccgcactgcctacgcaagtggtacaatccgttacagcagaccaccgctatcttctacgggttcaccaccgaagcatgcaccagggtcccggtgaaggacctcaactggaccgcgacgactgcaacatcgatgacaacacatacactccctcaacaattgccacaaattcacccaaaatgtaattaaaactgcgaaatatgcacattaaaagggcgaaggggggcaagtgatggggcaaaggtgtgttcggaggcagtggcagagcatatgcgagaaagtgaggactacaacggtagtagcggcacgtcgaatggtttacattgtgccccatgcttatagaggcgcttttgggggacaaggaattgatgccccatggcgatagaaggaagcataagaggttttgatcccgtgatacatggagcggagttgtaaaactaaactattggagcactccattctgttaggttgcattttcggttttggggtttgtcttgggtttgccacagcagctcgtccatggacatgcctgtccgttcttaccaacagatactttatgttgctattctgtcttctcgttaatgttagagctgttctttcccgtctaaaaaagaaacaaaacaagaggagccagctcaccctccccctgtgccgccgcatgtgggggaacctgtgagggagcccgtaaacgaggcatatgcttctattctaagaactgcccacgccccgcctccgttccctattgctcaatcagtgcctgtgagtaaacctcaccctacaacagaagcaaaccaggcaactctagtgacttcatcggtggcagcagataagccaaaatctgacttctacacagaaggccatgacgaagaagagagcaaatctgtttatgttgggaatgtgccacaaaatgtaactgagggctgatcttgagaatgagttcaagaagtttggccagctcatccctgatggtgttgctatcagaagccgaaaggagactggtggctactatgcttttgtggaattcgaagaactgagtggcgttcacaatgcattgagggcttcaccacttgaaataaatgggcggcagatatatgttgaggagcggaagcctaacagtggaataaggggaggaagaagggggggaggcagaggtcgctttggcggcagtggcagaggatatgcgagaggtgacgagtacagcggtagccgtggaaagtcgaatggttatcagcgtgtccctcaccacgagaggggcattttgggggcaaggaactgatgccccatggcgatagaaggaagcataagaggttttgatccgtgagaagtggagcaggagttgtaaaactaaactattggagcgctccattctgttaggttgcgttttcggttttggggtttgtcttgggtttgccacagcagctcgtccatggacgtgcccgtccgttcttaccaacagatactttatgttgctattctgtcttctcgttaatgttagagctgttcttttcggtcttctgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgttttaaaggacccaattttacttccccgggcttgcaaggtaatattttttttttggggcccc

SEQ ID NO: 36032 - DNA, 430 bp, Triticum aestivum
  Clone ID: PAT_TA_36032
gtcgaccagccattagcttctgaaactaatgattacacaaactcctggcctggaaatacttttcaaccagacgttggtcttggatctatcggctttagctcttcttcacatgattaccagtcttctgctgcaaaacactcagtgccactatcagtggataaccatgtgcctgccatgggaacaggagctttgaacagttcttacagtcatcatatggcaggtagtgggaattcaacctctgttgctggtgacacgcaaccgatcatgagtgatgctttttatattgaccctgatgataagtttatgggcagttcttttgatggactgccttttgatttcatcggtattaatagtccaattcctgaccttgatgaactcgatgaactgctggatgacaatgatttgatgcaatatctgggaacgtaatcca

SEQ ID NO: 36033 - DNA, 454 bp, Triticum aestivum
  Clone ID: PAT_TA_36033
gaagatgacttgtttataagctcagttgcctcttgctcaaatttgtgggctctaataatggatgctggcactggctttacttctcaagtctatgaactttctccatattttcttcacaaggaatggataatggagcagtgggagaagaacttctatatcactgcgttagcaggtgcaaacaatggtagttctctggtggtcatgtctagaggaacacaatatgcacagcaatcctacaaagtaggtgactcgtttcccttcaagtggataaacaagaagtggaaggagggtttttacgtcacagctatggccactgcaggaagccgatgggcagtggtcgtgtcccggaatgctggctttgtagatcaggttgtggagcttgacttcttgtatccaagtgagggagttcaccggcgttgggataatggttatcgcatcactgctactgctgcta

SEQ ID NO: 36034 - DNA, 678 bp, Triticum aestivum
  unsure (1)..(678): unsure at all n locations
  Clone ID: PAT_TA_36034
acgtgtgtcgagttcgtggttcgtggatggcaggtatggtttcctccttcgacgtcttagtcgcggtggggtgccagatctggagttcgatggcgtgttaagggtgttgtccccgtctgattcgttcaaccgcaatggcttcacttttggtgagccaccttgaaagtcctcaaagctgcatatcagtgatggcgccacgtcgagttaaggtgaggaggtgatccgtcattcttttcttcggtggctgttgtgatggtgcaggaggcaggtgacgggcattgacgtcaagctcaaagatgttctactatcttttcagttttgtcatgagtctctttacatgacttgtattttggagttcatgatatgaatgaaacggttttgccccggtctgattcgttctaacggtaagggcttcacttttggtgagccaccttggaggtccgcaaagctgcatatcagcgatggagccgcgtcgagctcgggtgaggaggtgatccgtcattcttttcttcggtggctgctgtcgtggtgccgggggcaggtgacgggcgttggtgtcaagctcagagatgttctgctatcttttcagttttgtcatgtcggtccttacgtgacttctattttgttctttatgatatgaatgagncacgtattaccatacaaaaannngcatggtat

SEQ ID NO: 36035 - DNA, 740 bp, Triticum aestivum
  Clone ID: PAT_TA_36035
gctttgaagttgctgctgagtttagagaaggagggggttaaacctggagttaagacaaatctggtcctgctggattggctgtccacgttgcagttggtgcaagaggctgaacaacttgtacagaagataagaaaggcgggagaagagcccctagagatccatgtttaccttgctgatatgtatgcgaaatcacgccaggaagagaaagcccgcaaatccctcaagatcttggaagagaagaagagactgctgaaggctgatcagtttgagaggattataagaggccttcaggtaggggggttttcggaagatgcaagcagatatttcaaaatgatgagatctcgtggctttgttccatcagcaacagtcgaggccggggtcaggggcgtcggtcgcccggctggcaggtagttagccggtcatgccactgattctggtatgaaatctagcagtagcaccgacgacgtcacagcttattcagaggaactgatgtgataaagatccccattatcgggcgaattttggttgttatttaaggtctgtagaccataagctcagatgaagttgatgagtgcgtgaacccctggtgctagtgccatgaattttctgctctcataaatcgggtcttgcacttgtatttcatataacatgttttgtcattgtaaaatctgaatcgccagattgtgccaagaaacagatttatttctctttctcggagcaaatacccccgaaaaaaaaaa

SEQ ID NO: 36036 - DNA, 508 bp, Triticum aestivum
  Clone ID: PAT_TA_36036
gggtgggcgacggcgacgaggaatgtgagcggttcgtggtgcgggtggaggcgctgcggcacccgtcgctggcggcgctgctggagatggcggcgcaggagttcgggtacaagcaggagggcatcctccgcgtcccctgcgccgtcaaccaattcaggcaggcgctcaccaccgcagccgtctccaagaactactgattactaattaattctctagctgatcaatcaagcagaccgaaccttatcgatcgattggctttctgggtacttgaggagcgattcttctgtgctgttgactagttgagtctcctccccatcttttcttctctttccattttgttttcttctggttggggaatgacatgagatggttgcctgccatatgtatgcatgtgggctgtataatgcgaactgtcatttacagttagacctcccgtcaaaaataacaattgaaacaattcaaaagttatttttagctaaaactttgcaagatcatcaaaagttatatc

SEQ ID NO: 36037 - DNA, 1290 bp, Triticum aestivum
  Clone ID: PAT_TA_36037
gtaaattcacatcgatcgaaatctaacctttagctgacagctagctatatacgtatatactagctagtatctcctacgttcgtcagcgatccaccgacgatgagggagctgatctggcggctgagcttctcggaccggctgagcgacggcagcagcgccgtgccgcgcgggtgcgtgccggtgctggtggtgggcgacggcgacgacgacgaggaatgcgagcggttcgtggtgcgggtagagacgctgcggcacccttcgctggcggcgctgctggagatggcggcgcaggagttcggctacaagcaggagggcatcctccgcgtcccctgcgccatccaccagttcaggcaggcgctcaccaccgccgccgtctcaagggctactgattagcaattagttaattctccagttaatcgatcggtcgacttcttcaggcattcatgatggtcattggaacgatggtggacaggtggttgcggtcggcggtgcaggagatgaaagaaaataacctgacagaggttttatgtccgtatcaaagatgcaaaggaatagtttggcttgacccctatgacgatggtcgtgtcgaagcgcacctgctcatgactgatttcatggatggctatacttggtggataattgaggtgaggatgatgatgttgaggacgccgacggggcaggcaatgatgacacggggcaagatgaagagatgatcgataatggcggcggggaagaggccagacatggcggcggagaaggggccggacatggcggaggagaaggggacggacacggcggaggagagaacgacatggactccacgcagcagagttcgtcggtactaagttcaatcgtgcgggaccctcatgttcaagcattgcttcgcaaggagacgagtactgagagagctgcttctagagaggaggctaagctggagcaactagtggtagattcgaacactccattgtatgatggttgcaatcctgatgtgacccgcttgagtttcacgctccaactcgtgaagacgaaggctaaaaataaatggaccgacactagcctcaatgagcatctcaagtacctaaaggatgtttttcccccagggaatttatgtcctactagtgtggatgaggccaaaaagatcgtgtgccctcttgatcttccgcacgttagataccatgcatgcatcaatgattgcataatttattggaaggagcacgcggaaaaaacaagctgcccggtgtgcaatgcttctcaaaacaaaaaggccgggaagaaatctccccagaaagt

SEQ ID NO: 36038 - DNA, 685 bp, Triticum aestivum
  Clone ID: PAT_TA_36038
gccggccggtccgggaaccatactacacacatgtaaattcacagcgatcgaaatctaatctctagctaacagctagctacatatatatactagctagtatctcctacgttcgtcagcgatccactgacgatgagggagctgatccggcggctgagtttctcggaccgggtgagcgagggcagcggcggcgtgccacgcgggtgcgtgcctgtgctggtggtgggcgacggcgacagagacgaggaatgcgagcggttcgtggtgcgggtagagacgctgcggcacccttcgctgacggtgctgctggagatggcggcgcaagagttcgggtacaagcaggagggcatcctccgcgtcccctgcgccatccaccagttcaggcaggcgctcaccaccgccgccgtctccaagggctactgattagcagttagttaattctccagttatcgacttcttcaggtaattaaggagcgattttttggtgccgttcactcgttgactctcctacgcctgctgtcttctcttttgccttttgttttctctggttggtgatttacatgagagggttgccatatgtatgcatgtgcgctttataacgcgcattgtaatttacgttggacctcttgtcagaaataacaagtgaaatattttttcctcaacaagtgaaataaaaaaaaggccccta

SEQ ID NO: 36039 - DNA, 3246 bp, Triticum aestivum
  Clone ID: PAT_TA_36039
cctgcaagacatgccgaaaccctagcctcggacgcacagccacacgcgtcctccacggggagcctcctccgaccccgcggatggacgactcggagaacaacgcgccgtcgaccccgggctcgccgggcttcagcacctgccggctgccacccaacaccaccaacagccgcggcgcccccggcccgtcctcctactcggtcggcgatggcgaggcgtaagtcgaccccaaggtgctccctgaggactacggcgccaccgttatccgcgacgaggcaggaagacgagggggaggacctcttcaacgacgactacctcaatgcactaccggaggttggcttggcaataccagtgtggctcggttgggttatatgactcgatagagtatgagaggagccggcacgagatcatggttgctcgaagtgcttgagaaacggaaattcatgcaatgaatttgaggacttgcgccacagcacatcgaacattgccgcgtatgcttcatgatcaggatactgatgatcaactgaactccagactcatgtcaaggttaaagtgtatgaccagaagaacaaggcccaagagtacgagacctaggagctgaggccatgcttctccagctctcacttcagcgacaacagcttcgtcctggacgaagggcgtgggatcatcaggcatccagttgcagcataacaactcaatcaacatcagccgatgaaagaagatgagatgaacatgtatcgtgtgcaaggaacacttcgagagtgggtcacaagatatgaagtccggcgcttcatcgcaaagaaatttaaagaatttcttcttacatatgtaaaccctaagaatgaacaaggagagtttgaatatgtcagactaattaatgagatggttttagctaacaagtgtagtttggagatagactacaagcaatttatttatatacacccaaacattgccatctggttggccgatgcacctcaatcggtgctggaagttatggaggaagtgggcaaaaatgttgtttttgatctccacaagaattacagaaacattcatcaaaaaatatatgtgcgaataaccaaccttcctgtctatgatcaaatacgcaatatcaggcaaattcatctgaacacaatgattcgaattgggggtgttgttactcgaaggtcaggtgtgttccctcagctgcagcaggtcaagtatgactgtagcaaatgtggaactgtcctgggtcctttcttccagaactcttacactgaagtaagggttgggtcttgccctgaatgccaatccaaaggtccatttactgtcaacgttgagcaaactatatacaggaactatcagaaactcactcttcaggaaagcccagggattgttcctgctggcaggcttcccaggtacaaggaagtaatacttctgaatgatctgattgactgtgctcgtccaggagaggaaattgaggttacagggatatacacaaacaattttgacctgtctttaaatacaaagaatggtttcccagtttttgccacagtggtggaggcaaactatgtatcaaagaagcaggacctgttctctgcatacaaattaacagatgaggacaaggcagagattgagaagttgtcaaaggatcctcgtatcagtgaaaggattgtcaaatcaattgcaccatccatttatggtcatgaagatatcaagactgccattgcactagctatgtttggggggcaagaaaagaacgtgaagggaaaacatcgcctaagaggtgatattaactgtctcctcttaggtgacccaggcactgcaaaatcccaatttctcaagtatgtcgagaaaacaggacacagggctgtatacacaactgggaaaggagcttctgctgttggactcaccgcagcagttcacaaggatccagtaacacgggagtggacccttgagggaggtgcactggttcttgctgatagaggcatatgccttattgatgaatttgataagatgaatgatcaagatagggtaagtattcatgaagccatggagcaacaaagtatcagcatatcaaaggcagggatcgtcacatcccttcaagctcgatgcagtgttattgctgcagcaaacccagttggaggaagatatgattcttcgaagacattcactcaaaatgttgaactaacagatccaatcatttcacgttttgatgtcctctgtgttgttaaggatattgttgacccatttacggatgaaatgcttgcaaggtttgttgtagatagccatgccagatctcagcccaagggtggtaatcttgaagatagagttgtagctgatgaggaggatgatccattgactgttgcccggaatgctgacccagatatcctttctcaagacatgctgaagaagtatatcacatatgctaagttgaatgtattccccaaaatacatgatgctgaccttgacaagataagccatgtctatgctgaacttcgacgtgaatcatctcacggtcaaggagtccccattgcagtaaggcatatcgaatcaatcattcgaatgtctgaggcacatgcaaagatgcatctgcgaagctatgtgtctcaggaagatgtggacatggccattcgtgtgctgcttgactcgttcatctcaacccagaaatttggtgtccagaaagcacttcagaagaatttccggaagtacatgacgtacaagaaggattacaatgaactgcttctgctccttctgcgcaccctggtcaaggaggcgctgcactttgaagaaatcgtgtctggatcaaccacacgcctgactcacgttgaggttaaagtggatgacctgaagaacaaggcccaagaatatgagatctacgacctgaggccgttcttctccagctctcacttcagtgacaacagctttgtcctcgatgaagggcgtgggatcatcaggcatccagttgcggcataacaactcaatcgacctcagccgatgacccttgtgtgatgaacagctacctctttgttcaagagctagtgatggagctagaaatgtccacatgtagtgtaagttggcaaaatgactgcttttgtctgttttatgggaattctgatattggtgtactgtttgctatctgaaacccttgtgcctccagtggcatttagagtgtctgtaccttcttgataccataattcagtgttatgcgactgatgccatcctcctacttgatattataattcagtgttatgcaactgacgcctttttttt

SEQ ID NO: 36040 - DNA, 1306 bp, Triticum aestivum
  Clone ID: PAT_TA_36040
tgccgtggtcgcggccgaggtacgaccggcggggtaacccctagaatgcatgtggggtgaacaaacttgtggagccacgctgcaccgttgtcctcgctgccacaaatcattgcctagacgtatttgggttctgctaaggtgtacataattaacatcagagatgcagaagcttcatcggatttggaaggcaatgtacgagacacccgcctgaatggcttcggatgatctaatcatggaacgatccttggtttgttgctgatctaactgtcttccatttttagctgatgagcaccaagcagactacatatgagaacttcaggtatcggtacgaccggcgggctaacccttataacgtaggtgtggtgaacaactttctggagatcttctgcacttctgtccccgcttccaaaaacaatttccgagcttggatccccggcgagcaaggtttactgcaatcacgcccacctacctggggtttcatgagcccaaacatgggccaaacctgttggaagaccttgaattgggcaggaagccagctgcatgggacgaacctcggtcaggagctgatataagagatttaggagttgggggcatgctggatgagaaagagggcagaataacccatgcgtcaccggatctgagcagagaagcccttccagttgagctcatggaaggcagggctgttatgcattcgagacgatcaagctggggtcacagaagtgggacctcagagtcgatggacagcatcgccgtgcagatgggaggtggagaaactaactggggctcggtcagcagtggccacggcacaaccagtggaactcactagcaaaccgtgcgccgctttctgacgccgcaccgggtctgatctcaacaaggaacaaccctgtctgatctccaaaatgaagaaccggcctttctgagtatcctgtgagcttgtgcctttcacctagggtatacaatatgccaatgctttcttacctgtgtccgtttcatcttggaagggcgtcagtccttttgatgtgcctctcgtttggtgttttaagtaagcaaagaaaataacagaagagatttaactcctgctgcgtggcttggattgtcttatctgtgtgtatatatttatcattggaacagtgtgtaagaaagtgtgctctgtatgatttgctgcttgtaatattcgtagctttgaaatcatgttttataaatgtactgtagttatcatcagtttagggttgtgatttgtgagacatggttgcctagttgacaagttgtaaactcaaagctgcttccgtggaattattattctacc

SEQ ID NO: 36041 - DNA, 423 bp, Triticum aestivum
  Clone ID: PAT_TA_36041
aatttcttgcccatctggccccgtcggtccgacttcggccatatggttcgggtccagcttagtgtagcgcgtcttcaccatagcccaggcttctcttgcaccttgctggcaggctaacatcttccataattggaagcgccgccgtgctccttgaagcatatccacaagctcccccatgccattcggcaggaagcttgatggccacaaggcctgagcaatgccctgcatcacctgccgagctcgctcgtgtagttgtgagaggtcttgcagtaaatcgcctgcagacaagggcatctccttctcagggcggcccgttaacattcctgcaagtaaaattctttcaatatgcttcctcgccgagttgtactacagttcgtctaggcacttaccataaatgccgtgtcggaaacccttttgttcccc

SEQ ID NO: 36042 - DNA, 1027 bp, Triticum aestivum
  Clone ID: PAT_TA_36042
gtcgagcaggtattggccatagaggagtcgttcaaacacagggtgacaaatgtggtgttcatggggatgggtgagcccatgctgaacctcactgcagttctggaggctcaccaatgcttgaataaggaactaaagattgggcaaaggatgatgacaatctcaacagtaggtgttcccaacacgataagtaagctagcatctcacaagcttcagtcgacactggcagtcagcctgcatgccccaaatcagaggttgcgcgaaacaattgttccaagtgcaaaggcatatcctctggaagcactaatggatgactgcaagaattatttcctcgaaactggacgcagggtatccttcgagtacactctgctagctgggattaacgatgaaaaggcgcacgctgaagaacttgcagcgctgctgcatgcatgtggaggcggttatcacgtgaacctgattccctataacccggtagaaggatctgagtacaagaggccttacagaaaagcgattcaagcgtttgttgatgcgctggaatctcggaagatcacagtcagcgttcgacagacccgtgggcttgacgctaatgcggcttgtgggcagctcaggaatgagttccagaagaatcctctgctcgagtcgtccccaccctctgagcccaaccaactgctcgagtcgtctacgccctcggagcccagccttgttccggcttagtgatggagtatatctcaattatgtagaaattgagattttgtgaatctgcattctaaagttcaaacaggccctgaattgctctgctcatacatagatcactggcttataagttataaagcttattagggggcagcctcctgtagctgatgagtttattcatatttgacgtgagaggctcctgttcagttgagatttgaaggttttttttaagctctgatgtattctgcattgagtatatgtatttgttgaaagttctgtatattgcgtggggattttggaacaaggtaaaaaaaggaaaaaaaaaaaaaaaaaaaaa

SEQ ID NO: 36043 - DNA, 739 bp, Triticum aestivum
  Clone ID: PAT_TA_36043
tacgatctggcaggtgccgcagtacgtggtggtaggcgcggcggaagtgttcacgttactcgggcagatggagttcttctatgacccgtcgccagacgccatgcggagcgtctgctcggggctctccagcgcggcgtttgcgctgggcacccgcgccacgtcggcgcccgcgggcgaggtggtgccggggtatgtgccgggcgggcggcccgggtggatccccgacgacatcaacgacggacaccttgactacttcttctggctgctcgccatgctctgcaccggcaacttcggtgcgtacctgctcgtcgcacggtggctatacctacaagaagaccgctgactaaacctggcgatcactgtgccgtatgtgctagggtactgctttgatgcaataaacgtgtaattgggcaaaggtgcctgtgttgcgggcaaaacgtcgacggaatggactactttttctggctgctcgccatgctctgcatcggcaacttcagcgcgtacctgctcgtcgcacggtggtatacctacaagaagaccgctgactgaacctggagatcaccgtaatgtaagggtattaaaccaaaaactaccataattcacggatccctcacgaaagcctaccactttatgattttgtcctaaacctacttttaaccatttttttgaaaaaatcggttgttgtcaggaaggactttcaactctcttctcatcctactcatgcatttcaccgttcgac

SEQ ID NO: 36044 - DNA, 516 bp, Triticum aestivum
  Clone ID: PAT_TA_36044
gaggagttcagaggcagtcttcttgaagaatttgtgaatatatactctgttgatgatgtggcacgcagtatcaattgcatcaatccagaaacgacgaggcgtcttttattcatcaagcatagtgtgagccatctcaacaggagttctgttcttgcgctccacgacgccattctgctgaggagtacaaggaccagataactcatgagtaatatcaagttcattaagatagtcatcaagaccagaattcttgaactcggtcccattgtcacttctgatgtgcttgatcttcacaccaaagttggttgaagccctcgaggaaaatcgtttgaagacttcctgcacctcatgtttgtaagtgacaatgtgcacccatgtgtaacgagaataatcatcaacaataacaaagccatatagagacgcatcatttgtaactgtggaataatgattaggaccaaagagatccatgtgaagcaattcaaatggtcgagtggtagtcatgatagtctttgctggatg

SEQ ID NO: 36045 - DNA, 1966 bp, Triticum aestivum
  Clone ID: PAT_TA_36045
gagaatgctcgattgcgatggaggcggcgaggagctgggttacgcgggtttcggtctacagaaggtgcaacagacagcagcactagcagcagcagtgtcgatgtaaccccagttaaacccgcagaggatgattataacttcttgcaagaaggacggaagcaaactgaagaaagactgcagagagctcttgccagagtgaagtccatggttcggtaccccgaagcccgggaccaacatcagacgattctgactgtcgtaacaaaaatgcaggaatcccagcctgtggaagaaagtatgcttgaggagtcgacggagatggatgaaggctttttagatgagtgaattcaaagagctctgggacgatgacctgccgccgttgcctggctatttctaggtcgttaccaagtggcgttcggtcttgtagctgacctctctgatttgtttggtaggctcaccagatagatgatagtgactaaattaccttgtccattatggtttgagtttttttgttggtctcttggttgtctagctctgcgtgactccttgtacagtttctccaatccaggacgaaaatgtatctccaataataactgctggtgtaagcataaatttcagagatgttcatggatggactgcacttcactgggcagcattttgtggcagagagcgaacagttgttgctcttatagcattaggtgcggctcctggagctttgacggatccaaggcctgatttcccttcaggacgcacaccagctgatcttgcgtcgttcaatgggcacaagggaatttctggtttcctggcagagttttctttaacaagccatcttcaaaccctcaacctgaaggaagccatggggagcaatgcatcagagatatctggtctacctggtattggagatgttaccggaagaattgcctcaccatcggcaggtcaaggtcttcaggctggatcgatgggagattcactaggtgctgtgcggaatgctgcccaagctgctgctcggatatatcaagttttcagggtgcagtccttccagagaaagcaagcagttcagtatgaggatgacaatggtgtgatatcagatgaacgtgccatgtcactcttgtcttataaaccatctaaaccaggacagttcgatcccatgcatgctgctgcaactcgaatacaaaacaaattccgtggatggaagggaagaaaagaatttttgcttattagacagcgaattgtcaagatccaggctcatgtgcgaggtcaccaagtgagaaagcattatcgcaaaataatttggtctgtcgggatagtggagaaggttatattgcgatggaggcggcgaggagctgggttacgcgggtttcggtctacagaagttgcaacagacagcagcactagtagcagcagcgttgatgtaatcccagttaaacctgcagaggatgattataacttcttgcaagaaggacggaagcaaactgaagaaagactgcagagagctcttgccagagtgaagtccatggttcaagtaccccgaagcccgggaccaagtatcaagaggattatgactgtcgtaacaaaaatgcaggaatcgcagcctgtggaagaaagtatgcttgaggagtcgacggagatggatgaaggctttttgatgagtgaattcaaagagctctgggacgatgacatgccgttgccgggctatttctaggtcctaactaagtggtgtttgttcttgtaaattacctctctgatttgtttgttagcctcaccagatagatgatagtgactaaattaccttgtccattatggcttgagtttttgttggtctcttggttgtctagctctagtggctccttgtacagtatatccatcctgggtgaaaatgtacctgaattatgaagttaaaattgttcagttagttgcttgacattagaaaaaaaaaaaaaaaaaaggcccctaccagcttcaccttcag

SEQ ID NO: 36046 - DNA, 631 bp, Triticum aestivum
  unsure (1)..(631): unsure at all n locations
  Clone ID: PAT_TA_36046
gagataattgcgctctggggcggcgtcgtcatcaccgccttcgactgcttcatctttctattcctggagaactatggtgtgagaaaattggaagcgtttttcggcgtcttgattgcaaccatggctatatcatttgcgatcatgtttggtgaaacgaagcctagtggaaaggagcttctgatcggtaattctctgtctgatatgttggcagatgcttttgtttctgatgcactcttgagacgtagaagaatttattcagtatttttcataattaggtttggtggttccaaagctaagctcaaagaccatcaaacaggcggttggaattgtgggctgcatcatcatgccccataatgttttcttgcactcagcgcttgtgcatgctggcaagcttgacacagaaaagggatcgcccnttcccgtccccaaaaccggggcnacngtnttaactctggacagacacacattactggncatatcaagcaattttcaagggaaggtcctaaaccnccntnaaaaatggttcaacatgataancaancttgcaatatcnacaanatgggcttantttgaacgaaatcacanggnttctatagccccaagttctaancatnatcattgaaatncccnn

SEQ ID NO: 36047 - DNA, 396 bp, Triticum aestivum
  Clone ID: PAT_TA_36047
ttccttgattgaaaagtatgatattactctttacgaatctgaaaattttgacatacttgaatattgctatgaaaactatgctcataatgtctatgtcaaagaatttattgaaagaatgaccgttgcttctaaagaaaataatgatacgcatgaatctttagataattgtgatcccgatgatttgattgaaatatcccttgatgaacatgatgctttctattcttgtggccatgatgccaatatttttgaagacgaatttgctataattccttatgttaaacatgagatcattgctattgcacccatacttgatagttccttcgacgaaaagcatgactgcaatgattttactataaattcccttgatgtcaattgtgctaataatatgcaaaacct

SEQ ID NO: 36048 - DNA, 487 bp, Triticum aestivum
  Clone ID: PAT_TA_36048
tgacctctaatgttgcatatgcattgcgagaagactgtatctgaatgcccgtacattgaacaacgaggacagtttttgtcttctgggttatgaaagctccgtctaaggatgactgactcaagaacccatgcccttgattcttgctccgaaagtggacctgaaaaaactacaaggtcgacgattgcgcgaggaacacaatgggttttctctctatcatctgcatttgttctcagtcgtgtacatgttgttcgctgaatcatgtggtatttccacgtgcactgcatgttgtgtggtggattcaaaaagactgagcgacaaacattggctgttctctttacacggcccgcggtatgttgagtattgagatgtcgattttgctagtaggtcaatgatggagatgaattcggggcatgtatggactatatgtgcagtttttaattgtatgttgaattatttgttcctcataaaaaaaaaaaaaaaaaaaaaa

SEQ ID NO: 36049 - DNA, 590 bp, Triticum aestivum
  Clone ID: PAT_TA_36049
ctcgtgccgaattcggcacgagatctctgcaaaactcgatcaagcttgcttaagcaatcatcaaaagaagctttagtatttcatttcttaccacttctttcatcttaggatttaaccgtcgttggtgatcaacaactggtttagcatcatgctccagactaattttgtgctaacatagagtgggactaatgcccttaagattatcaagagtatatccaatagcaacacggtgcttcttcagagttctcaataatctccttcatgatctgaaaggttagcactaataataacaggatatatcttcttttcatcaagataagcatatttcaaagtatcaggtaattgtttaagctcaaacactggatcacccttgggtggaggagtatccccaaggatttcaacaggcaaattgtgtttcaaaacaggcatttgattaaagaatatttcatctaattccttcctctcattcataaacatatcattttcatggtctagcaaatattgttctaaatgatcaatgggaggcacgacaatagaagcaagatcaataatttcatccttactaggcaaattttttgtcatggggttgt

SEQ ID NO: 36050 - DNA, 493 bp, Triticum aestivum
  Clone ID: PAT_TA_36050
gatgacaaccttgctatggtggtggctgacgacgaccttgctatggtggtggctgacgacgaccctgctatggtggtggctgacgacgacctcgcgattgtggtgcctgacgctgacctcgcgttttggtgcctaatgatgacctcgcgatggtagtggcgccggcgattccacagctgggcgacaggaccatgccaattgtggtagaggagtacatccgcgttgggatttgccactctgagcgcatcaggttgatgaaggagaagaaggaggagtgaagatgttaagaaaatgaagtggtaatgttaagcatgttgggttaaagcttgtcaatgttaagtatgtcagctttaattttatgcatgctcatggatgctgtatgacagtgtgagccaagcttagatcgatattgatgagcatcgacattttgtgcatgctcatggatggttaagtatgacagtgtcatctaaacatgtcagtttcttaattatga

SEQ ID NO: 36051 - DNA, 593 bp, Triticum aestivum
  Clone ID: PAT_TA_36051
gcaccaaccctagccgccatgcacaactcctttggccatccgcaccaaccctaagccgccatggacatctcctttggccacatctcggtctacggagttgtgatgggtgtcaatttgtcttgctcctcaatcttagcagatgatgaatttgcctgttgtgattggttttttcccaccccacgagtgtcacctcgtttgtctggccgataaagattgaatctttctcactgtatggttcatgttgggtgtagatgagactgggagcaaggcatgtcgggtgggggagccaggccgaggttgcaaccaagcacctcacttcatcagaacaacagagtcaacagggagcagatcaactctgaaactaccgaaaagttccaagttttcagttccaaattttagcattggaagcctcaaggctcacatcgtactagagatcatgccggtaggcaagtagagtgaatgaaggcagatgtttttagcagttatgttcgctaccaacgtgttatcatctactgacactagtgtagtgtaaaaaacgttcttatattatgggacggagggagtactcctttttttgtgtgccaaaaaaaaaa

SEQ ID NO: 36052 - DNA, 696 bp, Triticum aestivum
  unsure (1)..(696): unsure at all n locations
  Clone ID: PAT_TA_36052
acgtgggatgaaatgtgcatcttcctttctttatttttgtgtcatacctatgtaccgtgggactgaaaaatgttgtatcttcagcagaatggagacatcataaatattgatgtaaatgtgttccgaagtgtaagttcactctcctaggattgtggatatgcttatgtggtatgtttggcatacagtcggattttgctgacaaattgcttgcaaggctgataggtttattgagatgcctcatatgcaagctcctagcccactgttgcagttgtctgttgtggagatgactgggttccatggctaacataacacattttacctgttatgtactccatctggttggatagcaaattgcattttaatgctgattcaatgcttatcattaagtatttcttatggagaaagaaagcagagtatgccatttcagcgcactacgatcgcacctgtgtctgggaggaagttcttcagaacaagcgcttaaacaagtacaatcacactgctatcgacgggcaattttacttttatcagtctgagggcctgtgaagtttaatgcctctggccaagatcctgttctaccgagttttgtgccgcatggtcctttcttgcctttggttcaatgaggtcaaccgtttcacctcacgtaataaatcgagtnttacatacacttgcttgaagctcatgagaatgaacgctgga

SEQ ID NO: 36053 - DNA, 426 bp, Triticum aestivum
  Clone ID: PAT_TA_36053
aattccggtcgacgggccacggcaagaggcgtgctatgacagcttcaactaccgcggaggtgccgcgaggctgcggtgatgcttcaatttccgtggctacactcggtggtgagctgcgctccaaggggggccgccggtcctacaacgacctgccggtggctgcgctgctacgaggccggcctgatgatttcccaactctattttcttgattgctccgatctgcaccgacatgcggtcctgccgaggtcgtccgatgtacatgctaatcttaggccactggagctgcaagactggcatgggactcactgctgctgccgggacggcaacaaacggggcagcgacgcctgggcctcggccttttttttggttccttcctcgctggtaccaggataccagctgtgtcttagtgtctcgcttctcctgagc

SEQ ID NO: 36054 - DNA, 722 bp, Triticum aestivum
  Clone ID: PAT_TA_36054
gcccctcttcccctcccgccgtctgtgccaccatttatctttcaatcgccgctcctccttcaacagcccccatgccttataggctcgcctctctcacggcgcggccctctgaggcggccaggctcttcgacgaggcggggagatgacagtgctgcagggcgagagacgccagcattgcggcagcatcgcagttcccggcggcggcgctgagggatgtggcaacgcggcgaggggtcacagggcggcgccggctaccgcagaggtccacaccacggaggtgccgcgaggctgcggtgatgcttcaatttccgtggctacgctcggtgctgagctgcgctccaagggcggccgccggtgctatgagtctatgacgacccgccggtggctgcgctgctacgaggccggcccggtgatttcccaactctattttctggattgctccgatctgcaccgacaagcggtcctgccgaggtcgtccgatgtacggctaatgtgaggccaccagagttgcgggactggcacgggccgcacggctgctgccgggacgacaacaaacggggcagcgacgcccgggcctcggccctttttttggttccttcctcgctggtaccaggctaccagctgtgtctcagtgtctctcttctcctgagctggggcatgcacgcatatgttgttgttttctatttaattgactcgtatgtgatcttccgagatgtttttgt

SEQ ID NO: 36055 - DNA, 823 bp, Triticum aestivum
  Clone ID: PAT_TA_36055
cggacgcgtgggctccggaaggctctacccgggatggcgcaaagatggcgaggagaagtcggccccccccaggttcaccgatgacctcacctaggtccccacctggatagtagaccccctcgatggcaccaccaatttcgttcatggctttccttttgtgtgcgtctcgattggcctcaccattgggaagattcccaccgttggagttgtgtacaaccccatcatgaatgagcttttcacagctgttcgtggaaaaggtgcttttctcaatggttctccaattaaaacatcgcctcaaaatgagttggtgaaggctcttatggtgacagaggtagggaccaaaagagacaagtccactttggatgatacaaccaacagaattaataagttactattcaagattagatctatacgtatgtgtggctctttggctctaaacatgtgtggagttgcttgtggtaggctagatttgtgttatgagatcggttttggtggcccctgggatgtggctgctggagctttgattctaaaggaagctgggggttttgtttttgatccgagcggtgatgcgtttgatctgatggcgcaaagaatggcaggatcaaatggccacctcaaggatcagttcatcaaagcattggttgatgcaagctgaataacttatttctcgtttcaagtagaatgtaagatggccccaccaataagtaattaaggactaatttttgcgtagttctaagtggacactatatgcatattttgcaaacatggcggatctaatgacatgtggatatattgctcgttttatgaccatgcaagtaatggt

SEQ ID NO: 36056 - DNA, 673 bp, Triticum aestivum
  Clone ID: PAT_TA_36056
ttcaagaggtccatgactcaccatactcgatacaccctggaaacaccaagatgtattcggatttgaaggaacatttctggtggactggtatgaagaaggatattgctgagtatgtagccgtatgtgatgtatgtcagagagttaaggtagaacatcagaagccagcaggactattacagcctatgtcgatacccgaatggaagtgggataaacttggcatggactttatcactggattacccagggctaaagcaggatatgaatcaatctgggtagtagctgattcgcttgaccaaagtggctcactttatcccagtgaaaaccacctatacaagtgcgaagttggccaagatatatatgaccaggatcgtatgtctgcatggagttccgaggaccatcgtatcggatataggaacacagtttacctcaaagttttggaatcagctgcaccagactttgggtactaggctagagttcagtacagcctttcatccgcagacagatggatagaccgagggagtcaatcagatcctggaggacatgttgagagcgtgtgcgctagattatggatctagtagggatgataatctactttacgcagagttctcatacaagaacagttaccaagccagtttgaagatgaccccttttgagcctttgtatgggagaagga

SEQ ID NO: 36057 - DNA, 642 bp, Triticum aestivum
  Clone ID: PAT_TA_36057
ggttctccccttccactggccaccgccaccgccgccgccggcgagccacgcaccttctccgcgcccccatcccctcgccaagacaggaagattcgcgcccaggaggttctcctctgacagcggtcgcgcccgccccctccaggtaatattctactgtactgagcacattgaaagatggttaatgcaatcaaggggctgttcatctcctgtgatataccaatggctcagttcattgttaatatgaatgcgtcaatgcccgcatcggagaagttcatcgtgcacattcttgaccccacacacatgtttatccagcctaatatgggagattacatcaaaagtaagatggcggagttcagagatcagaacagctacgagaagccaacatgaagggccactatccattaccgcggtgctagcttcaaactccatccagagatacctatgttgattatcgctatgtagaatggttatatgccgagactgaatgttatgtctctccgtgatgttctggaatgacaattctgtagtatcgcagagttttgcgtcttatgtatctttggagtgagcctttagctgataatatttccggtgatgttgatcttgataccttgcactgaataaagtaccacttcttatgtatta

SEQ ID NO: 36058 - DNA, 874 bp, Triticum aestivum
  unsure (1)..(874): unsure at all n locations
  Clone ID: PAT_TA_36058
ggttcctgcacccgcccgcgactccccccccgccggccgccgccgccgcagccgcccgccccgcccgcccccggagtaggccggattcgaactccgccgccgtcgagccgcgtccccgcggagcgccgccttcctctccccaagcccacccggctcccaggtttcccctcacggcgggccgctgcatccatccatccatccggaagacgccggtcgcggccgccgcgtctcctcctccaggtaatattctactgtacggagcacattgaaagatggttaatgcaatcaaggggttgttcatctcctgtgacataccgatggctcagttcattgttaatatgaatgcgtcaatgcccgcatcagagaagttcatcgtgcacattcttgaccccacacacatgtttatccagcctaatatgggagattacatcaaaagtaagatggcggagttcagagaccagaacagctacgagaagccgacatgaagggccaccatccattaccgcggtgccggccactatccattaccgcggtgctagcttcaaactccatccagagatacctatgttgattatcgctatgtagaatggttatatgctgagactgaacattatgtttcactctctcgtgatgttctggaatgacagttctgtagtatcacagagttctgcgtcttatgtatcttccgagtgagcctttagctgataatatttctggtgatgttgatcttgataccgtgcactgaataaagtaccacttcttatgtactattaccttgtcaaagatgttccgggtaantaatactgggantcctggatagancaantagaactttactaacatgctttccaaanccaaaacatgctccccaatg

SEQ ID NO: 36059 - DNA, 396 bp, Triticum aestivum
  Clone ID: PAT_TA_36059
attcggcacgaggagcccatgtacctgtacgcctccttgtgggacgcgagcgacgtcgacgaggggaggtggaccggcacgtaccatggccgcgacgcgccctacgtctgcagctacagagacgtcagggtgcccgttgtgggagaggaagaagaatgtcaggatgatgcgaacgccggagatgaggccggtgctgcgggggaggaggaggttgatgccgaagctggtaaagattagatgtcggcgttgtcccgcctctgatcgtgccaccagccatgtggaattagctatactatcttggtcatgagcgctgcaataaaagattcatgaattatttgccgtggaggaaaaacaatgaaacacacacagttcatttgtaaaaaatataataacaat

SEQ ID NO: 36060 - DNA, 1345 bp, Triticum aestivum
  Clone ID: PAT_TA_36060
gcacgcgtccgaggacgcgtgggtttgccgccatgggttctgcaggaggtgcacgccgacccggacatcgtgtacacgcgcaggtccggccgccgcaaccccgagtacatctccctgtccggcgacacgctgccggtgctcaagggccggacccccgtccaggtctactccgactacatgcgcagcttccgcgacaggttcgccggctacctcggcaccgtcatcgccgaggtccaggttggcctgggcccctgcggcgagctgaggtatccttcctacccggaggccaacgggacatggagtttcccgggcatcggcgagttccagtgctacgacaagtacatgcgggcgtcgctgcaggcggcggccgtggcggcggggcacgagaactgggggacaagtgggccgcacgacgccggtgagtacaagcagttcccggaggagacgggcttcttccgccgggacggcacgtggagcaccgagtacggccacttcttcctcaagtggtactccgggatgctcctggagcacggcgaccgcgtgctggccgctgccgaggccatcttcggcggcactggcgtcacgctgtctgccaaggtcgccggcatccactggcactaccgcacccgctcccacgccgccgagctcaccgcggggtactacaacacgcggcaccacgacgggtacgagcccattgcgcagatgctggccaggcacggcaccgtgctcaatttcacgtgcatggagatgaaggacgagcagcagcccggccacgccggctgctcgccggagctcctggtgcagcaggtcagggccgcggcgcgggcggcgcgcgtggagctcgccggcgagaacgcgctggtgcgcgtcgacgagcaggcgttcgcgcaggtggccgccaccgccgaggccgccgggctgagcgcgttcacgtacctgcgcatgaaccggaacctgttcgacggcgacaactggcgacggttcgtcgcgttcgtgaagaccatggccgacggcggcgcgaggacggcgctgccaaggtgcgagggtgggcactcggatctgtacgtggggttcgttgacgccgccaaggagcagagggcgccggagtccgaggccgccgcggcattgtagggagcttacgtttgtgtacacatatcacatccccttgtgtatatgcacgacgtggtaacgtgcgccgggaggggggctgtatattatgatctgtgcgtgcaggttacaggattttatggctgtaatcgagcatttgtgcttaggccaactcacgaagtttttctattccattcgagaatgttggaatttcggagaagatgtaatcgcattaaac

SEQ ID NO: 36061 - DNA, 710 bp, Triticum aestivum
  unsure (1)..(710): unsure at all n locations
  Clone ID: PAT_TA_36061
ctacgagaaccccaggctgagcaaggacggncgggtcatccccaccaaggagatgcacttcttcaagaccatcgccagcttccacttgtacatgctcatcaagtacaagctgccactcgagatcctgcacgtggtgaacctgctcctctgcggcctcttgtcgcaactctacgacgatctcaaccggaaatacaagttcgtcatgcatctcgtcgacgtctacggtcccttcgccttattcaaaggatgcttcgacgacatcaacttggagcggctgcgattgaccatgaccaagacaagcccggaggatgacatgttcaattttgatcccaagaccgggtccactggaacgactaattctacaaaatccacataccgggtgtcctcaagtatgtgctcaagtaaaaccacagcaaaatttatcaagatatatgcaccttatcttctccacaagccaaaaaccacatcgcgcgtgttcttcttgcatgggtatgtgatggaaaaacaaggaagacttttcacatgccggctagattattatgttggagaaggacatcattgatcggtgataaaaacaaaaaaaacaagcatgtattcttgaattatatgttcaggtttgtgtaatttgctcatgtcttgaaatgagctgggatgataaaatatatgtattcatgtcatgtttgaaacacagcagacaagagaaggctgac

SEQ ID NO: 36062 - DNA, 419 bp, Triticum aestivum
  Clone ID: PAT_TA_36062
gtctggggcgccatgattgccacccagagcttcgctagctaggcctagctcgcagtgatcgcaccatggcgaagcgaacgtacaggagttagtatgtgcgtggtgaagtaatgcggcgacggcagggccggcgctgctagctgctgccggcgcggcagcacgcaggacatgatgcagttaatggaagaacgaaggggagctacaaccagctaggaaggggagctgcagccagctaggacatgatgcagtgaaggaagacatgcatgcagcggcagtgaactaaagagctctggaggcaggcacagaaggggcagcccggccggaagaagtaaagggcggagggggaacaaacaagcacgccggccgtcgcgtcggtacttgcagccactcaccatggctgcatcgggagtctggacttg

SEQ ID NO: 36063 - DNA, 616 bp, Triticum aestivum
  Clone ID: PAT_TA_36063
aaaaaaacctctcgcctgactccagcgaaaaggaaaagctcctgcacgtaccccacgttcgtgccgcctccacaccacccgccgtctacagcataaccagcacggtcatggcgcgcgtgtcgctgatggctcgccgccgtggtgctcgcgtgcgcgctgctcgccaccaggcatgcggcacgccgccgggccggccccccgcccctcccgcgcgccgacccggcctgctagcgcggggttcccgtggcgccgggcgtctccgtggcggggggcgggctcggcccgccccggccgtcccggccggcggtctccattcctggtgccggcaaggtcgaccgcgacggcgatggagataccgacgaggacgacgagctgccgtcgttcgacacccacatgaccatcctcggccactgagaggatccaagcctgacttctaagcgcatggttgtagtatcttcttgcatttgcgttgcttgtgtagttgtgttgctgcccagaagaaagaaacagaaaaaggaaaggtatgagagagtgagcgtgtcacgatgatccccgctagctgatgacgaaatttgccagttgctcttgtttcttgttaaaaaaaaaaaaaaaaaaa

SEQ ID NO: 36064 - DNA, 737 bp, Triticum aestivum
  unsure (1)..(737): unsure at all n locations
  Clone ID: PAT_TA_36064
gccggcacaaggggagctccggccaagcaagaatggacgccgagctcctagccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgcggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatgtatgtacgcacctgcctgcatgagcagagcgggtgccatgccatgcatgtaaacccctaaataaaatctcccgtggttttgcttacatcgtgttgttagatcctcctcctattagtgttgctttcgggttcttcttatgcacgagcaggatcagaggccggtcttttgttcgaaaaaaaaaaaaaaaaaaggcccctacctcttctctatggttccatttgcagcagtattttcttcttctgttgccgagttctgtatcagactgccttgttttgaggtttatccctattcatncttaaatataggtatag

SEQ ID NO: 36065 - DNA, 968 bp, Triticum aestivum
  unsure (1)..(968): unsure at all n locations
  Clone ID: PAT_TA_36065
gctcccttgcatccgacgagcgagtgacggtgactcccctccatctccggccatcttgctaatgtccttttcctcttcttctttcccctcttcttcttcttcttcttcttcttgctggttgatgtcgggtccttgtgctctgtaattgcagctcgagcccttcaagagcgaagacaccaagctgacaagctaggtagaaagaactcctcttggatcgatgtccatggacggcaagacccctgatctgctgcctctgagcgcggccaagaagaaggtcctcgatgatgtccacgtcgcactggcctgcgtatatgcgctccacaacgccctcgccatcgtcttcagcacagcagtcggctacatagccgtcgactacttcgacgtgtcgtgcagccagctctcctccattctgccgtgcgttgagctgacggacgcggagtccgcctggttagccgccctctcgatcgggattctgtgctgtgccccaacccaggcggccgcggcggcgctggcgctgctgctcccatgccgccgtcgccgggcccgccgcgtcctcgcctacctcgcgctcgccgtcaccttcctcttccattgcatgtacgccggcgccgtctggatcttcctcgccgccgacccaggatacatcttcggcaagatcttttttaccgtggtcatctgcctcatcctggtgtgcgacctgacctgcctgtctgacctccttcgaggtgatgggtggggcaagcagtagtgcactagtaggtacgcaacctactagctagttcagctagcagcaagctgcaagggctcatgttcgtggatcagctcgtgaggtactgatattactgatgagagcgtagttctaggagtaatctagagtatgcattaattctgctgtgacgnttgatggatcatgttcgtggatcagctcacacgtctgatgagagcgtggagtatgcattagttctgct

SEQ ID NO: 36066 - DNA, 563 bp, Triticum aestivum
  Clone ID: PAT_TA_36066
agagtgaagtcgaatggattccgacaacgataatataggtgacaatgagtctgaggtcgtagagaactacttaccctatgtttgttttcttggatttcatccttacaaagaagtcatcttcttgatcttctttcgctaaaaagagcagtggcctatcatctgaatacctcaatagtgcaggatttgggtaatatatggcccaatgactacgacgctgggcatgcgggaggcatagacaagtcttttctgtacacaccttgtttgatagcagatttcccagaaaacagattggaagcccatgtttgaaggctagctagccagcttatttgtttcaaacagtttgagtccttcagacttacgtcgtacttgtgttttgagtccctgttgttttaatgtctgctaccttgacaagacaaaacttgtttacagcttgacttgtcgcagggcttgtaagcagtgttttactccagcaaaatttcgtttctgaactgattgatgtatccaaaaaaaaaaaaaaaaaaggcccctattggctcaaaaaaaaaaaaaaaaaaaaaaaaaaa

SEQ ID NO: 36067 - DNA, 551 bp, Triticum aestivum
  Clone ID: PAT_TA_36067
gtcgtctcgcaaaaccctagcagcctctcccaccccgcgccatcccacccccgccgcagccgcagcagcagccgtagcccgatggaagtcgacagagccccgaccgctgccgcggcaggaggatcctcctctggcgcgatggcggtggacgcggccggcggcgtggagaagccgcggttcgacgccctgatgccaagcgagatgagcggcgggaggccacagtaccgcaaggtccaggtgccgccgcaccgctttgcgccgctgaagaaggcgtggctggagatctacacccccgtctacgagcacatgaaggtcgacatccgcatgaacctcaaggcaaaaagggttgagctgaaaacaaggcatgatacaccagatgtgagcaaccttcagaagtgtgcggacttcgtgcatgcttttatgcttggatttgacattgccgatgccgttgccttgcttcgtcttgatgacctgtatgtggactccttcgtgatcaaggatgtgaagacacttcgaggggagcatctgtcgcgtgccattggctcgccttt

SEQ ID NO: 36068 - DNA, 1074 bp, Triticum aestivum
  Clone ID: PAT_TA_36068
gccggcctgggctcgccaaattcaccttgcaaaaccctagcagcctcccacccggcgccatcccacccccgccgcagcctcctacccggcgccatcgcacccccgccgcagccgcatcagccgtagcccgatggaagtcgacagagccccggccgctgccgcgggaggaggatcctcctctggcgcgatggcggtggacgcggccggcggcgtggagaagccgcggttcgacgcgctgatgccaagcgagatgagcggcgggaggccacagtaccgcaaggtccaggtgccgccgcaccgcttcgcgccgctgaagaaggcgtggctggagatctacacccccgtctacgagcacatgaaggtcgacatccgcatgaacctcaaggcaaaaagggtcgagctgaagacgaggcatgatacaccagatgtgagcaaccttcagaagtgcgcggacttcgtgcatgcttttatgcttggatttgacattgccgatgccgttgccttgcttcgtcttgatgacctgtatgtggactcctttgagatcaaggatgtgaagacactcagaggggagcatctgtcacgtgccattgggcgcctgtcagggaaaggaggcaagaccaagtatgccatcgagaactctacgaggactcgcatagttattgctgatacgaagatccacatactcggatcctttgttaacatcaaggttgccagggattcactctgtagtcttatcttaggttctcctgccggcaaggtctattctaagcttagggctgtatctgctaggttggcagaaaggtattagttgagtctgggtcacattatatagctgcagttttggccttgtaaggtgttgtatccgctgatttgtgtccctgtgctatgcattgtcttgatacgaagaacaacttcgaagtgccgagagatctgtggtgatattccttgtgttctgttctcggctttttcttgagaaaatgctgttctgatacacgttactatatgtttgcttcgactactatttatatatgccaaatactgttgtgtaaaaaaaaaaaaaaacccacgcgtccg

SEQ ID NO: 36069 - DNA, 866 bp, Triticum aestivum
  Clone ID: PAT_TA_36069
gccggccgggctggggtgtggtctttgaccgctagtaggccgcctccccattccggccgaaaccaaaccaaaccctcgcctcgccgccatggccgacggcaccggcagcggcaggtcccgtctcagcgccctccaccacgacatcctccatcacatcatcacctacctccccgtcacggaagccgccggcgccgccggcctcgcccgcgactggcgccacctctggcgctcctacccgctcgtcctcaaggatgcccgcatccccgaggccgcgcgcgacgccgtagtcccccgagtcctccacgaccacccgggcaacttccgcgccgtcatcctccccgactgcaggctcgcctcactggaccgtgagctccccgcctggccgcgcctcctcgtcgacaagcgcacggagaaactccttctcgcctacagatgggtcatggaccagcccaaccccgcgcgccttcttcccgccgacatcctccgctgcgactcgctccaggagctcaccctggacttctggacgttccccagcggcaccgaggtccttcttccccgcctcaggactctcaccatggtaaggattggcacaagcgatcaggatctggagtccttgatcgctgccagccccgttctgcagtcccttaggctcatcgtcaatagccccaagcacgtccggctccgcagcaaaagcctcatgtgcgcgctcgttgggctatccacggtggaggagttgaccgtggtggacacgccgctcctggcgcggttttgctggtccgggcctggtaagggggggaggatcaggatcgtttgtgctcccaacctgcgggcgctcggttacctggacacaagagttctcaagctgc

SEQ ID NO: 36070 - DNA, 1508 bp, Triticum aestivum
  unsure (1)..(1508): unsure at all n locations
  Clone ID: PAT_TA_36070
aaaggaacaggataaaagaaaggcttgacaagatgcacaaggagaagctgctagatttttgtgatatacttgatgttcagaccaaacacactttaaagaaggttaatttgcttcagcacatgattgtaatgatctaagcagtgaattctgtagtaacagtattttgctgtactcaggaggaagtttctgccaaattgctggagtttctggagtctccttgcattaccagagatgttgttatcagtgatgtgaagaaagggaagaaacgccggaggaggtctaaaggaactagccaggcaacggctgaaggtgcttctggagagaagaaaaagaggaagagtcggaaacaaaaagttgaggctgaaaatgagaatgatgatgaagatgatgctggtcctgctggttctgaggactcatcaatgggagaaagtgatgaggactctgaagtgaaagaagagaccaagagtgatgaagagcctgaagcaacaccggtgaagaaaaagtcaacagatggtaaacaaggaaagaaggaagctggatccaaggcaaaggaaaaggatgcatcggtgaagaagactcctactaaatctgtaaaaagcgtgtcaaagccaaatgtgaagttggagagcaaaaaggctgccaagaaaacaccaaagaattcaacaaaggaaagcagtacacctgtagagaaggccaagaagaaggttgcaaaaccgaaaaaggatgatggaaaggagagccaaaacaacagtaaggcacgcaagaagcaaggtgccaaggcatctggtgaaaataaaggaaaaggcaaggtagccccaaccactaaacagttgcatggtgttgtcagtaacatattgaaagaagtggacttcaatacggcaactttggctgacattctccggaaattaggagaccactttgacatggacctcatggacaggaagtccgaggtgaagcgcatcatagaggaagtgatcaacagcatgtctgacgatgaaggcgaggaagaaaacgaggaagaggatgcagaggagaatggcaagaaggaagaagattcaaaggaggatcctgatgaagaggaagagaaataagccagacgtgatcggactgaccggtctcctgtatttgtcgagtgttcttgttggttgctggggctcttctggcctgtacaatggtggcaccacaacagccgttttggtggtggtctgggcaggtgctagactgtctgtttgttagccatttgatgtgatggccctgcgcgcctacctggttgttgtgcttgactcgtggtgttattgacctgtagtctctttagttgccggtcatgtacaatagctgtttggttatatgactctgttcctttcttaggtagctagccctgactgtaatttgcagcatgcatacttgtctgtgttctgttccttgcattttatccatgtaaaacagttgtattcttgtggatttcttgcttgtgccgtctgcgtttcatcatgtncttaaacatcgtt

SEQ ID NO: 36071 - DNA, 534 bp, Triticum aestivum
  Clone ID: PAT_TA_36071
gccggccgggtccgaatggttgttgccgtccttgccttgctcgtcgtggctacagtggtggcgccggcgcaggcggtagactgcaggacagcgagcacccggttcaacggcatatgcatcctggacagcagttgcgccaacatgtgcatcaccgaggggttcctggctggcggggagtgtgaaggtctccaccgacgctgcatgtgcaaaacaccatgctaggcgaagcatatgcatagtctggactgcttcatcaggaagtttttccgatttagataaaaacaaggaaaaagatttttttttctaaaagaaaagaaaatggagttgtaacacatactgtgttcttttagttttttttttcacatgttcctttgggagattgtggttgtgcatttgatgcatttttgttgatcgtacaatccagtttgatgtgtttttgttgtaagcttgaagttggccattttgtcattgtgtaagattattttccaagattcattcatttgtgatcaaaaaaaaaaaaaaaaaaggccccta

SEQ ID NO: 36072 - DNA, 1653 bp, Triticum aestivum
  Clone ID: PAT_TA_36072
gccagcaggcctcgccccgtcctccataatccccgaccctacacacccttaccctcgaatcctccgagcccaaaaccgagcaaaatcgatttcaagcggaccaaaatccggcaccgcatgggtttccccaggcactgatccggcgggtggacgctaatgcggcgccgctgaagggacctgctgcgcccgcggggttcacatggcggcacagaacggcagcggcggcgcggcggtggtcctcaacgtgtacgacctgacgcccataaacgactacctctactggttcggccgcggcatcttccactccgggatcgaagttcatgggtctggaatatgcttttggagcccatgatctctcaaccagtggggtttttgaggttgaaccaaaacgttgccctggctatgtctatagaaggtctgtatggatgggtacaactgagatgtctagggcagagttccgctcgttcgttcaaactcttgcaggaaagtacgatgggaatacatatcatttgatttcaaagaactgcaaccattttacagatgatgtctgtaagaacataaccaaaaaaccagccccttggatgggtaaatcggctagcaagagtgggttactttttcaatcgccttctaccaaaaagcattcaagtctctactgttactcacgcagcaacccatcctgcattctctgatgatgacgtggattcatcaggttcatcccttaatggggacagtgatatggatgacctggaccagcacctgctaccagccgcaggcaccgaccttcaatccatagtcgtgtcaccaaagccatcgaaagatctcgtttgaattatcctaccatttgggttccctgctgcagtttaacggtcgtacttcgccagcttgtgtgatatccaagtatagttgaatgttgattgtattgattcttttccaacgggttttgatgtgtacgcatataggaattgtcgggtgatggagtgattttgcaactctttgtcctttgctcagttgttgcatagttgttcaggcatcagtgtcatgtgttctccgttgctgccaggcccaggcaaatgttgtcatcctccgcttcaatggtctgatgttgtgataatatctaatgcctgaatttctggtgaccagtaattagtaaacaagcagcttaaaccagctgtcagggcaaagtagttttcagttctatggggaagttgtaggatgcagaagaaaactaaaaattgaagaatggtcgtgaattataacgatgtatgggtttatctattgattgacagggttggtggcaaatctctcggcagagtttgtgtgtgatgttgcagtcatgttcttgtttgaagaacaggtggatatcgagcatagttaaaaaaaatgcgcgcctaggctctaggcagtagcgaaacacctagcacttaatgtgcgcggcataattgcgctcaagtgtgtgcttcagaaaagcgcaaggtggtggcaaaacacacaattaatgcctagcgcttcttttagctttgacattgagctggcatcataactgaatgtttgcagctaatgaaaatggtagagtgctagtcatacatgatatgttcattggtagccgtctacattttatggactgagggtgctagttatgtcaaaatatttact

SEQ ID NO: 36073 - DNA, 854 bp, Triticum aestivum
  Clone ID: PAT_TA_36073
cggccgggccctcttcaccaccaccttcaaaccagtcactcttttcacggcttccagcctaccacactcttttttattatacataataatttaggtcgcttcgcagcttcttaacaacaatcccgttttcctaccttaccaattactatataccgtaattcctaaatccaaccttcaagatgcagttcaccatctccgccgctgccctcatggctttcgccgcccaggctcttgcccaggtcgctgacttcgaccccgtcctcacccccagcaactgggagcaggtccagaccggtgagaccctcgagatcacctggcaggccaagcccaagtactccggcgagaagatctccatctctctgatcggtggtgctacccagaacacccaggtccccatcaagaccattgctaccggtgttgacaacgacgctgcttcctactcctggaagatcgactcttccgtcggcaccaacaacgtctacggtctcgtcctcaagctcgagagcaaccccgaggttttccagtactctttccccttcaagatcgagggtggcaaggagaagccttccgaggctgaggagaagccctccaagaccgaggagaagaacgactacgagctccccactgaggctcccaagcccaccaaggaggcttaccccgttcctcacaccaccgtcgttgctgtccacgagaccgtcactgtcccttgcaacaccaccaccgttggcggttctcctaccaccttcgtccccgttgtcaagactcactaccccgtccctcctcctgctcaccaggctcctcctgccaacacaaacggcactgctcccccacccctcccgtttacactcaccctg

SEQ ID NO: 36074 - DNA, 812 bp, Triticum aestivum
  Clone ID: PAT_TA_36074
ccccctccggctgataactattcttcttcttggatcatcatcaggagactaataccatcatagttcgtattttatacggaaatcaatcgcaatgactgcgacaggaacgagcgtttcgctcctcaagtttgtgggcactgtctcacttggcttgctgacgggtgtctcatactccatctcatctctcgccctccctgcccttctccgacttccttcctcagcttccgcctctcacggcctctctaccctcagcgcagccctcaagacacctgttctggccctcacgtctctcgcttctgcgccgttccttattagcttcttcctcgctccccgctcatctcgccatccttaccttctctacacagccatcctcgccactctatcttccgtcgcccccatccttattcctacacctacacctgctcctagacgtaccgcttcatcggcgcctcgaaagtcttcgcgtgctaagatggaggccagctacgaagttctaggcgatgctcacagtgagcccgccagcgacgaagatatcgaagacatcaatggcgaggaagttcgagctgaggtcgagggtcttacgcgaagctacctcgccaggacagctatttctgccctgggctttgccatggcagtcgttggtatttggggtgatggtgcaccccagtctgttgtctacgtctcataagaaggacaggcagttctaaattgcgattttcccgtttacataaattgatgaatattcaaaacacaagggcggtcgatatactcagaaattaggaacatctccgatcaatactacttaatgaagt

SEQ ID NO: 36075 - DNA, 1122 bp, Triticum aestivum
  Clone ID: PAT_TA_36075
gccggccggttttcaaaaatcttttactccaactctgtcttccttgacatcgatattctcaccatcccaacctttgtcactataactttacatcatattcattcaatatgggttcaatctccacaaagggaaagtccttcccaccaggcatccacgttccttctttgacatggttcaagaatgatgcagagcaagaggtcgactgggaccaacagagtcgccatattgagttcctggttaactctggccttgatggcatcgtaattgcaggaacaaacggagaggcagtcacactttcagcagccgagaagtcacgactagtccgaacgacgcgcgagattgcaacctcttgtggccgccccgatattacaatcacaatgggaacctcgtcacagacaacaagagacgccatcaacgagacaaaacttgccaaggaggcaggtgctgactttgtgctcgttctgacacccagctacttccacttcgccatgacgcaagatgctattgttgcattcttcgaagagctcgcggatgctagtcctgttcctgttgtcatttataacttccctggcgttgtagctggtctcgacgtcaactcggaaatgctggagcgtctggccaagcaccccaacattgtcggcgtgaagcttacatgtggtggtatcgcaaaggtcgcccgtgtcgcagcccaatacaagccagaggagtttactgccctcgccggccagagtgactggcttgtccctgcgctatctgtcggtgccacaggcgcagtcacaggcgttgcaaacttataccccaagacttgcctgcaaatctttgacttgtacatggctggcaagacaaaggaggccgaggctgcgcagctcgagctggccaagatggaatggggatttgccaagggcggtatcaatggtaccaagtggattgtggccaagcttctgggataccccgcagatagctgccactgcaggaagccttaccctcagtatgttgatgagagtaaacaggagtggattcacagtgttgttgagcctctttcggccgttgagaagagtctcggcaagaggggcgctggtatctagatggggttataaatttgaaccgacttatgacatatgt

SEQ ID NO: 36076 - DNA, 699 bp, Triticum aestivum
  unsure (1)..(699): unsure at all n locations
  Clone ID: PAT_TA_36076
gccggccggccgggccggacctcctcaaacacagccacacaaggaccatctcctcagtagtactaccagagcctcccagctagcaatggcaaagtgcctcgctgtcgcgctactgctactggtggtgctcgcgtactgcaacgggagggagttgaaccagaaggacggcgcacttgcagcgacacgcggtgccggtgccggtgctggcgtcggggagtcgaagattttggggttgccagacttgccggttgtgggaaccactaccggtaccagtaccattaacggcccgctggtggtgattccggggatccctgctcacccgtgatcatctctagttcatgtgctggcttacatacatacaagctgaagctgaagctgaacttaattgtggttttagatttgtgtagctagcaccacccggaagaaaaacactggcttttcgcccatgtccatgttccttaatgagcgtgtgtatctgtgtttctcttcagtttatgttggttcctttgtgtgttgcatgtatcatcaacgtaatacatactactttgtcagaaaaaaaaaaaaaaaaaccaactacctatatgagnctattancccgctaacgggcctcgtttaaactctgaacggaaaacctgggttnccaatttanccctnnaaaatnccnttccantgntaaancaaggcccccntttccttcaa

SEQ ID NO: 36077 - DNA, 890 bp, Triticum aestivum
  unsure (1)..(890): unsure at all n locations
  Clone ID: PAT_TA_36077
aattgtttacttccagacagttactaggttacttgccttactaacatctcaccccatccatatatacaatatttttcttttctctttcttcatctatgatctatacttcttaaccacatcaattttatatatacacaatggctaccaacattacctggcacccctctctatcgcgcaaggagcgcgaagagacccgcggccagcgcggtctcaccatctggctgaccggtctctctgcctctggcaagtccaccgtcgccactgctcttgagcagcacctccttcacctgggcgtcgccgcctaccgcctggatggtgacaacgttcgcttcggcctcaacaaggaccttggcttctccgaggccgaccgaaacgaaaacatccgccgcatctccgaggttgctaagctgtttgccgattcttccaccatcgctattacctccttcatctctccctaccgagcggatcgccaggtcgcccgtcagctacacgagcaggccactcaaggcggcgacgcgcctatccccttcgtcgaggtctacgtcgatgtgcccctcgaggttgctgagcagcgcgaccccaagggtctttacaagaaggctcgcgccggtgaaatcaaggatttcactggcatctctgctccttacgaggagcccgagaaggctgagatcaccatcaagactcacgagaactctgttgaggaatgtgtcgctcagatcgttgagtggctcaacgagaagggctacctcaacaagaaataaatatgtanatgatgatgatgattgcgttttgcgtttcaacgagatagatagggtattaatgccatgtcggctacagacggtcgcacatacaggcatgatcaaaagatagagtacggtgtctccttctac

SEQ ID NO: 36078 - DNA, 800 bp, Triticum aestivum
  Clone ID: PAT_TA_36078
ggcgcgacgaggagagccggcccgacagacgccccctcctctcctccgtgacctctctctccatggccgccaagaggaagctccgcaggtcgccgccggcgaatgcgaaggcgtaagccaaggaagaagacgcggaggggctcttctcttcgcgctccttcgcccgcctccaaggaggctcctcatctgatctgagcaagtagcaaaagcagggaaacacacatgttggttattaagcagcagcagcaggatcaaatcagaagcttggagaaggagggatctagaggaaggggtcttgttattaaactgagtactgagctgtggtgtggatgtaaacaaagtgttttgttcccgaaacacagccgtggtgattgtgacagaggatgatccagattgcagccgtcatcctgtcgattagccctaggcccggccgcgcaacggacaatataatcaaagtttattaggaacgctggccttggtttcagtcattatcaaggttcctaattgagcgatgcagctgtaccaatgttcaaggagtgtaaacacctctgaattttgtttacaacatcgacagcagtgttagtcatcatgtcatgaaaatgcacatccagatgcagtctatactgctagaaagaaaagagacacaatgtggtgaaaattctgaggtcactcaaataaaaaggaggcgcattattcaaaggatttttgttcttttctccttcacttgatagttgatatatataacaatttttgttgaattttctaatacttgtcattaaataaaccctttttctgttact

SEQ ID NO: 36079 - DNA, 472 bp, Triticum aestivum
  Clone ID: PAT_TA_36079
gccggccgggtccgaacgagaggttctccttgggatatgacgctaatcttgaagaactaaggctgcacatctatgggtaggaagaagtagaattctagagacgaatgatcaatgaacatgtgggctgtcttgaatacctgaagatgcatgagatgaaatcaagcagaaggatagggagaactaagtaggaccctagacaggaattcaaaggaaagataaacatatccttgattccattttttattttttatattatttttgctactgttttagatccaaagtaaaggctagggctttgagtatgaatggttcaaccgttaaatcgacaagttgctaccaaatcaagattcgtccagtgagtgacacatgatctggccacaagtgtgtgtgccaaggtaaatgtaacttgtaatctcaccctggataaactaatacgtgcggttcccaaaaaaaaaaaaaaaaaaggccccta

SEQ ID NO: 36080 - DNA, 871 bp, Triticum aestivum
  Clone ID: PAT_TA_36080
gccccgcggggggccgagatccatccttaccagaacaaactctaagcacggagcgagctctgcagggttcaggccatacagctgtccatacgcgggctcagcgtcccccgctgcagggcccccttccgatgctggtgtctcatctcatcaatgaccacacggtggacttgcacgaacgctgcaccgcaaaccaccccctccgtgaaccccagcccctacgaaggggaaaacgcgacacggatcctcactgtgctcaagtgttttggtcagcacttctcccgccacttccaggcgtccctgctggggatgtccccggtgtacatggcgttcctgcggttcatgggggaggagagcgaggctcggggcttctgctacagcctggaggtgggcgggaacgggcggaagctgacgtggcagggcacgccgcggagcatccgggacgggcacaagaaggtgcgggacagctttgacgggctcatcatccaccgcaacatggccctcttcttctccagcggcacccggcaggagctcaagctgcgcgtgaccggccgcatctggaaggagcagtgaccgacgacgacgagccatggctcctgctgggggcacgcggcctgcctgtcctccggagcgcgccgctgcagcaaagagtaccagatcggcaatcgcggctccagcctgtctgtctgtgcacatgcatgcctcttcggtcgtttgttctctccgtgattccattgttttgttgccttgctgggagactgtctgctacttttgctgctacttggtgtacaaatgcttgctggaagggaaagggttcccaagaacgtacttcttcttatgttgtgaaatttcttcaaatttgtcaaaaaaaaaa

SEQ ID NO: 36081 - DNA, 775 bp, Triticum aestivum
  Clone ID: PAT_TA_36081
aggagttcggcgcgccgggcggatccgttgcttccctggtcgacgacggctacttccaggccacctattccctgcctcctcccttcctgaattcattactgcgttcgagcggccggccggggggggcggctgcccagatcggcagatccgttgcttccctggtcgacaacggccacggtctcctcctccctggtggccacaggcgccccgcccggtcagctgcacattcttagatccggaggccaatctagtagaggtcgagtccatggtgatgttgccacggtttctcctccccggtgctcctagatccaacaatagctcactagaggcaaggcggtggttcttgatctcctcgcctccttcgccttgcaggctcggcagcaagcacatgaagactcatgagcaagatgcactataactggaggcaaaagggaataacttttctttgatgtgcaatcagataacaaacccaatgcaagctttggtagtgatgcttatttagcagggaccacttcagaccatactcggggctctctgttcatgtactagaaaaggatcgtgtcatgttaagttatatatgtatgtctcttgtgtactcaaattaggatggatgtcatgcactcaaatatttctacctatgctgatccatttggacatgtattcaaaatttgtgcttgacaaaaaaaaaaaaaaaaaaaaaaaaaaaaaaaaaaaaaaaaaaaaaaaaactcgagactagacctcggccgcgaccacgctaatcactagtgaattc

SEQ ID NO: 36082 - DNA, 581 bp, Triticum aestivum
  Clone ID: PAT_TA_36082
tgccgagccgggcaagagctcgtgccgaaatgaggagcgggcaatagcggcggcggcgccgacgccgacagggaagaactaggcgacggcgaggggccggagcgggcgatctctctcctccattgaagaccggccgctgcgccatccttctacctcgccccactctccccaagtcagcagccgatctgcgaccctcttcttccatccccggcgcgagctcggcggccgcaccaacctactccggtggccctccccaacgtttctatgccggccagcttcaccgcctcacagccgcagcaagaccccgcttggggcagcatcgtgaagactaagtgcatcaatcactacggaagcgacatcggcgagattagagtcgtctgttctatacagcaataatttgatcatggttggaaatataataatattgtacatcggtgcttgttgattagggtcgttttttgacttctaaatattcagaattcatgttatagtttgatattttttcttctaaaatatcaaattgcaacaagcttctcataaaaaaaaaaaaaaaagaaaaaaaaaaaaaaaaaaggccccta

SEQ ID NO: 36083 - DNA, 758 bp, Triticum aestivum
  Clone ID: PAT_TA_36083
gtgcggcgctcaggcgccggtttcataaagatgcattagctcggatctattctgcttcaataatgtatgggtacttcctcaaatctgtcgctgtaaggcatcgcttggaccttacttttgctcggtcagaagaatgtttacagccaattcagcttctcaatgctcaacttgcaactacccgtaaaaaggaacagcaagaggcctttgacggttctgtggaaacggtgccttcctcgaaaccgcggtctgtcgttgatcctcatgacctgaagagttacatgatgggcttcgacccaaagaccttggagttatgcgcgaagctgcgcacaaacgaggcttgtaatctcatcgagaagcacagctgggcactctttggagaaaagatgggctccacggagattgacgaggcggtgatacttgatccggcatccctgaaaagactgctgcttgaagccattgcatttggttccttcctatgggatagcgaagactatgttgatgagatatacaagttgcaggacagctgaaaatggatctccagaagattcctgaagaactgtagatacggagctcgctggaagaagagtttgcagaagattcctgaggccttgtatatattttaggaattgcctcttttttttctgtgcatgtaaatcttgacctcgcaggtgctaaaatatgtagtagctttttttttctgaaataacaaccttgcaggcactaaaaataataatctacttatgaccttgttgtaaaaa

SEQ ID NO: 36084 - DNA, 964 bp, Triticum aestivum
  Clone ID: PAT_TA_36084
gcaggtccttagtaacatgcatgtcctgatatcggacatttcggacagtccggtggcctgttggtttttgtccaatggttagtcaggcattcctggctcagtggagcatgacctctgcccgatacaggcgacccaccactcggaccgaatttctacacaggactgggacgacaactacaagacccaaagcgtatcggctgatgtccttagtttcatgctatcctatatgacggaggattctgacctatgtccgagttgcacatttctgttggaatatcatactagtactcaatactgggacgacgagtacactaccgaaagcgtggcgtcagatgtccttggtatgatacgggccctaatgactgctgaagaaaaccgcgcaccagttatttcaggactagtgcctagttttataagaattccattctcatcagaagatttgtctattgctatattgtacaaggctttctcatacgtgttaccacttgaggatgtgctcgagaaccccgcgtgccttctttggcggtaacgttttcgatccttcaacttctaggggataccccatcgtgatctgtgtattcattccttgtacattttaacctacccttttctgctgcagcattcgtgcgtgccttctttgggggttacgttctctctcctttattatatagggtagtcactagggttgggatgggatttcctcccttgatagtagaagaaaaagagacacctttaaaatggaggcaaatcattctttgtagggcaagttgaagccagccagtcggtcagtcttttttttggttttacccaggggcaggggtcgttgggagaaaaagtcattgtagtaatgtgttggtagtattccattcccccccacagttatagattgtacaaatttacagtgtaaatcaacagtgcaagaagaaagaaatccatataccaaagaaaaaaaaaaaaaaaacga

SEQ ID NO: 36085 - DNA, 802 bp, Triticum aestivum
  Clone ID: PAT_TA_36085
gttcggccgaggaaggcccacccatcctcctacctaccagcgatctcccacctccccgcaaaacccaccttcttagcggcaccagaatccatcgcgcccaaggcggagagcgagccggccggagaagaacccggcggcgaagaacccggcggaggagagaagcgcgaggccgagaagcggctgcccggccggaagtaagccgctggccgagaagcggctgccggcggggaagaccgccgccggcaaggagggtggcggcaagaaggccaagaagaaagggtagaaaagcgtggacacgtacaaaaccgacacccccaaagtgctgaatcaggtgcaccccgacatcggcatctcatccaaggccatgtccctcatgaactcctccatcaacgacatcttcgagaagctcccccgcgaggccgccaagctggcgcgccaccacaaggagcccaccatcacgtcccgctcgacccagacgtcggtcccgctcgtcccgccggccgcgctcgccacacaccccgcgtcagagggcactacttctgtgaccaagtccacctcttcctgtgcttcgcgctttttcgctgcgtggctgtctctctgtagttagattatgttccgatgatttgattttaccctatcgttcaattatgttccgactgtcatgcaataataaattgcgcactcagcactgttaattggatctgaagtaacaatgttcagcactgttattccgtcggaaatatctgaagaaatgctatcgttgctgcttcaaaaaaaaaaaaaaaagtggacgcggccgcga

SEQ ID NO: 36086 - DNA, 624 bp, Triticum aestivum
  Clone ID: PAT_TA_36086
gccggccgggtccgacccaccagccgccgccaccaccgctcctcctccgtttccatctcagtcagctccaagccgtcaaccatgtccggccgtggcaagggcgggaaggggctgggcaagggcggcgccaagcgtcatcggaaggtgctgcgcgacaacatccagggcatcaccaagccggccatccgtcgtctggcgcggcggggcggcgtgaagcgcatctcggggctcatctacgaggagacccgcggcgtgctcaagatcttcctggagaacgtcatccgcgacgccgtcacctacaccgagcacgcccaccgcaagaccgtcaccgccatggacgtcgtctacgcgctcaagcgccagggccgcaccctctacggattcggcggctgacctgcgcccgctgctgctccatcgagtcgactctgccagctgctgctgctgttgttctggtgctatggtttcgtttctgagttcgtgcgttgctgttccatcagtctgtgtagttagtggaaggtgatggatctgaatgtaatgggattgttgcttcttgcaagaaacgaatctgaatgcaatggaagttgtgctgcatctctccataaaaaaaaaaaaaaaaaggcccct

SEQ ID NO: 36087 - DNA, 835 bp, Triticum aestivum
  Clone ID: PAT_TA_36087
cggggaagcacccccacccccaccgccacccccactcccgtatcctgatacatttgaacagccaccaccaccgcctcagtatcctccatcaccagagtctagcccaccaccacttccaccttcaatgccgcccccaatcccaccaccaccaccaccaccaccttctacagatgcatttatgccagttcctgctcttccaatgggaggaatgccatatttcccaccgtttcctccacctgtaaactatcccatgatcaacatgccaccgcctttccctggtgccccaaaccctcctcacccaggtttccttggatttgggggtcccttctatggcccgcctttcccctcggcaccccatcaatgaacaggaaatgagagtagttcgcttatctgcagattagtagcgccagtcagccagcatatgaaatcgaggtacatggagctttggaaaacttgtcataggtttcgtttcatcctcaaaggatatatggttcgtgatgattcatcactgttatgtgttgtggagcttggaaggctgtcccagtgttgtacattttagtcagttagcctgatattagcttgcgcagacatttagtcaagttgactgatctagttgttcccagcttggccatggagtcaaaactatagatttcgacatgtttggattctgttgctctgtcggccagactgagctctgaaatcgtgacagtcaaagacagattctgtctggcatgacttgttggtaactcgttattacctgtattctctgggaaattgctgcgacagaaaaatacatagctgttcttgtgaaaaaaaaaaaaaaaaaaggccccta

SEQ ID NO: 36088 - DNA, 993 bp, Triticum aestivum
  unsure (1)..(993): unsure at all n locations
  Clone ID: PAT_TA_36088
gggctcacgagtccggcacgaggcccaagccggaacacagatcgaccacaagtcggccaggacagctacccacaagtcggaaaggaaaaccacgcgagatgaacgcacgcgacctcctcttctccggcgtcgacatcgtcaagcaacaggcgagcgccgtggcctccaccgtctcgctggccaagccgtacctcccggcaaagctaaccgagatgaacacgggcaacatcgtcgccggtctcggctacgtcaagaaccatacaggagcggccgtggcctccaccgtttcgttggccaagccgtacctcccagcaaggcttaccgggatgaacaccggcgacatcgtcgcaggtctcggctacgtcaagaaccatacgggagcggccatggtctccaccgtctcgttggccaagccgtacctgcccgcaaagctctccacgcgggacggtgccgtgggaaccgcggcgatggtcatcggggggcgccgtgggcgcctacttcctctggcccgctgcggccgcccccgccgcagccggcgcaatgatgaagtcgcccggccgctggcgccgcggcggctgccgccgcattcgtgtagggaagcaagcaagcgcgccccttcgatctctcccctttgccttgtttccgtgtactgtgtttaactggtagtgtggctcggactatatggtggtgcattccacctcgtactgttttctcccgcccgggggggggagaagacggggtgataataagcgctgcctcgtactggtatttttcaactactgtataaagtataccccttgccgtgggagcgatagatgttgggggtgataatagcgtgcctctaccgtgttgcattgtcancaatggttctgttgcaaatggngtttgaacaatgcggctgcggtccgctgatccantcagtgcaatngccaaatgtatatccgtcncctcaananccnctccaaagggggccgtacaattccnnatgatntt

SEQ ID NO: 36089 - DNA, 818 bp, Triticum aestivum
  Clone ID: PAT_TA_36089
gccggccggttcgggatcaccccttacttctctgcgccgcaactcgagcccatccgccagcaacagccgacgtccgtgcacaaggcgtcccgggttttcccgttgcacagcgtggagcatgtgctgacatactcgcgacccccatcgctgactacgatgaagtagccgatgaagttccatccgatggccacaaagacgttgtgctcggtggacaccgcgagctgcgcgccgttccggcaggccgccgtaccatgagtagttgtagtcgatgaatctcctcgcgccgacgacactgtttgtggaaagtggtcggaatgcgacaaccttggtctggacatgcaccgtgccgtccgccagggagattggcgtccacctccacgccgtcgcccaggagcagcttcgagggacggcgcgtctcctcgcaggtgaggttgaagcccttgcgaaagcagccttgccggaagccgaaagggtaggggacggagacgttgccgcaggcctccgggcagccagacaaggctactgggccatcggcgacggctgttgccacgaggaggagctcaagtgccaacaccgttgcgacgacgagctttgcttgtgacatgcagcgagatacaggcttgccggaagctgcatgagcatgcaacatgctgctgggcaagcttggcttgggtgctagctagaggaaatggtgatactcgtattgctagtactcgacctcctctgcaatttgtagagaaaagcttttgtgttcggtcttctcagttggcttcacgccgaccaggtacagtagtgcacgaatatagactaatcaatct

SEQ ID NO: 36090 - DNA, 672 bp, Triticum aestivum
  unsure (1)..(672): unsure at all n locations
  Clone ID: PAT_TA_36090
gccggcagagccgagctcccctcgtccttcccttgagctcactgagatgttcctcatctctgactccggctgcccctggaagccgtcggaggacatgcggttcgcgctcatggagggcgtcaccggaggaggggggtcctcttccggcacgacactctacttcgacacgggcacgatcgggccatgagatggatggatgattggccataaagcttattggctctattgcacacagacacggtggttgtgtgattagtagcaagggagggagggatgatgaatggatgatatcagatactaaagatttattaatcaaatggatgaatagcccccatgaccatttcgtcgaaattattgtgtatatgtatgggcgctgtaatcagctggctgaaatgtgatggtgtacaagcgaaatttcaggtgacctgtaaaaactttgctcaagctactaccacaatagctaattaattaatctgattgtttgtatcgaaaaaaaaaaaaaaaaatatcagctactaaagatttattaatcaaatggatgaatagcccccatgaccattttgtcgaaattattgtgtatatgtatgggcgctgtaatcagctggctgtaatgtgacggtgtacaaacgaaatttcaggtgcctgtaaaaacttttcttagcnacaccacaa

SEQ ID NO: 36091 - DNA, 1048 bp, Triticum aestivum
  Clone ID: PAT_TA_36091
agttcgaggccaagaagatctggtacgagcaccgtctcattgacgacatggtcgcccagatgatcaagagctccggtggttacatcatggctctcaagaactacgatggtgatgtccagtctgacattgtcgcccagggcttcggctctctcggtctcatgacctctgtcctcatcacacccgatggcaagaccttcgagtctgaggctgcccacggcaccgtcactcgccactaccgtgagcaccagaagggtaacgagacctccaccaaccccattgcttccatcttcgcctggacccgtggtctcatccagcgtggtaagctcgacgacacccccgatgtcgttgccttcgccgagggccttgagcaggcttgcattgacaccgtcgacattgacggtatcatgaccaaggatcttgcccttgccactggcaagtctgagcgcaaggactatgccaccaccaacgagtaccttgatgctgttgagcgccgcctcaagaagactctcaaggagaagctgtaaatgtctttgcaatgattctcagactccccctaatcactcaaaaccttccgctctcgccttctggtctcttgtaacgacaagagcacactctctttcatgaactcatcaagcatcggcgtcggatttgttgtcatcatctgaatagcatctcactccagtcttgaaaaccacaagaacctcacctcttgtggcctcttgaccactcgtcttctcaacagaaaagaagatggcgttgtcaagtgcattcatgcacaggaactcgctgcaaggtcacatgcagcgggctaacgatttatgaagaacgttcctccatcgtcatcgtggttggataggatgttgggcttctgaatatgtaaaggcaaagatatgagagaggaggttagcatgatacatcctgcatagctgaggagtagatgctatgtagatagaaagcttcttgctcttagcacattagacataacgggatacccagccctgctttatagttttccacaaaagaaaaaaaaaaaaaaaaaaggccccta

SEQ ID NO: 36092 - DNA, 866 bp, Triticum aestivum
  Clone ID: PAT_TA_36092
gccggccgggcctagggtcaaccaaagttactttctgaacacttttacagataccttcgacataatcgaccacaattctttccatctttggcaatcaacaaatccccaacatgccaatctcaccaatcctcacattcaaggccggccagtgcgaggtcgatacctcttccaagccttacaaggtgaagccgcaatctgagcctggttacatctacctatactccgaagatgatcttgtccatttctgctggcgcaagcgcaccgagccactcgacaaccccgagctggacctgatcatggttcccaccgatggcagcttcactccctacgaatctacaacatcttccgagcccacctccaagactgatggtcgcattttcgtcctcaagttctcttcgtcatcccaacgacacatcttctggctacagtcaaagccccagagcgagaacggagacgcagcctactacagccctcgtgatcgcaagatcggcgatatcgttaatcgattgctgcagggtgaggaagttgaggtggctgaggaaatggccaccgtccgcaacgatgaccaagacgacgatgaggacgaggccatggaggatgccgataaccagcgcccccgagagcaacgaggcagtggaggcgcgggacctgatgctacaggaggagatgtccgcgaggagggcgagggctcgcgagagggtggagctgatggtgctagagcgtaggtgaatccctttgcttggctgaacagaacggcatgcgtgcatatgttggaattggagtttagacctagatctgggaccgcagtttaaactgtataaagctagttttcttcgctgcgagaaaaaaaaaaaaaaaagccccta

SEQ ID NO: 36093 - DNA, 630 bp, Triticum aestivum
  Clone ID: PAT_TA_36093
tgcggccgcttcgcgagggcctggatctcgagatgagaaggaatcatccacatttgcccctcgatccttagcaatagcagcacccatgtcctagtccactcccacaccccaactttccccgatccagatcccctccacctcctgtcttctccatagcttgctaggttccccgaatcgagaggaaatcaacatgcatcggctgggagaggagcttggcgacggagaagagggagcggagctcggtggcgggagaccggctgttctgctcttcgcagatctcattggcggagtccggcagatcgcgagggcgtggatctcgtcgatggagcgctcggaggagaagtccggcagatcgcgagggcctggatctcgagatttggcggtatggtgaccaagcaggagagataacatcggactacctccacgccaccggaaacgctcttaaaccaccggaaacgctcttcaagcaggagagataccacagtactaccacagcccggtgggtgttgagctcttcaaccatttggagacggacttcgccatgaagcctgaaggctgcgttgcgcagatgatcgcctaggaggattcgagtccattggcgtttgaacatcgaggcttggaagatacatc

SEQ ID NO: 36094 - DNA, 420 bp, Triticum aestivum
  Clone ID: PAT_TA_36094
gaggcaaggactatatgtggaagtggccatcgacaagggtctcgggagcctatttgtgtgatgagagcaagcagcgatccgattgtggcatgtgtgcgtgacgtgcttttgtattcagccggccggcgacgagtttgctagcgaggtaacctaggtcgctgagtacatgcggtacaggccagccgaaaacatgaagtaagaccgtcagctccgcttcatcgtcttggtcgtccatcgtcgcatgtcaccgaagagtactagcaacgtggcctgagccaacagatgatatgaaggaaaggttggccatggcagggaaggaaccttggtgcgtgattgataattattgaagtacctaaaatgcccttaactagtcaatatactgcccaaaacctccagtagtatcgactcatctggggcctc

SEQ ID NO: 36095 - DNA, 2356 bp, Triticum aestivum
  Clone ID: PAT_TA_36095
aacactctcggtcacctggtcgctacttccaccacgcctcgatcacctacttgtctcagcctaatcccgttactgctcggtgggaaggggaagatcatctcagggatcctaaatttcagctggatgcattcagataccgaacatctagactactgcatagtgttgctgctcgactccagaagcacatgaagacactcggaggtttcggtgcgtggaacagatgtttaaaccatctgctcacactcgcagagtcacacattgagtctgtcatcctcgcgaggtttatagaagcagtgaagagttgccccgacgaaaaaacacgagaagtactgaagctggtgtgtgacctttatgcacttgaaaggatctggaaagacatcgggacatatcggaatgtagactatgtggcgccaaacaaagccaatgctatccataaactggtagactacctcagttaccaggtgaggcttgtggctcgggaacttgtcgacgccttcgatgtcccagatcaaatcatccgcgccccaatcggcatgcaatcggaggcctatgctcagtatacacagggtgtcggcttctacagacaaccaacatagacctaccattctgctgcaagctcagaccgttaggcaagaagctatatggacaaacttatatcatatacccaacagagtgagtcaaaatcaagtgtacaataagttttatcccaaaaaagtgtataataaaaatgagatgtgtataagtgataatattgtgaataaattttgtcagactttgttttggcagcatggctgtgaataaagctcatatcccaattcgggaccttgaaacccatgctgttcttcctggaattgagatcaatgattgtgggcacaagataggcctaaatggtgtagacaatggtgccctgagattccgttcagttaggataccccgtgacaaccttctgaaccgattcggtgatgtggcgcgagatggaaaatacacaagcagcctccccacgattaatagaagatttgcggcaacccttggtgagcttgttggggggcgagttggtcttgcgtatagttcggtgggagtactcaaagttgcggtaaccattgctgttagatatgctttactgcgccaacagtttggtccacctaaggagcctgaaatcagtgtgctggattaccagtctcaccagcacaaactaatgcctatgttggcatcagcgtatgcatttcattttgccagagcgtatctggtagatatgtactcggaaatgaagaaaaccaatgacgaggatgttaccgctgatgtccatgtactttcctctgggttgaaatcctacataacttcatacacggcaaaatctatcagcatatgccgagaatcgtgtggtggccatgggtatgctgctgtaaatcgctttggtggtctgcggaatgaccatgatatatttcaaacattcgaaggagacaacacagttctgctgcagcaggttgctggagatctcctgaagcaatatcagcaaaaattcaagggaggaacactctcggtcacctggaactacttgagagactcgatgaacacctacttgtcccagcctaatcctgttactgctcggtgggaaggggaagatcatctcagggatcctaaatttcagctggatgcattcagataccgaacatctagactcctgcatagtgttgctgctcgactccagaagcacatgaagacactcggaggttttggtgcatggaacagatgcttaaaccatctgctcacactggcagagtcacacattgagtctgtcatcctcgcaaggtttatagaagcagtgaagagttgccctgacgaaaaaacacgcgaagtactgaaggctggtatgcgacctttatgcgcttgaaaggatctggaaagacatcgggacatatcggaatgtagactatgtcgcgccaaacaaagccaaggctatccataaactggtagactacctcagttaccaggtgaggcttgtggctcgagaacttgtcgacgccttcgatgtcccagatcaaatcatccgcgccccaatcggcatgcaatcggaggcctacgctcagtatacacaaggtgtcggcttctacagacaaccaacatagacctaccattctacttcaggctcaccgttaggcaagaagctatatatagacaaacttatatcatatacccaacatagtaagtcaaaataagtgtatgataagatttatataaaaaaaggtgtataataagatgagtaatagacatcagatgtgtataagtgataatattgtgaataaattttgtcagactttgtttggcagcattgctgtaataaagctcatacgtggca

SEQ ID NO: 36096 - DNA, 818 bp, Triticum aestivum
  Clone ID: PAT_TA_36096
gaattcaccagtgattagcgtggtcgcggccgaggccaagtcactcttcctgtcccgtacataggtgctgctttgggtggtttgataaagctagagccaaaatgagcaagcctgtgaagattggaccatggggtgggaattctggcagcgagcgtgatgtccagccaaagcccaccggtatggttagtgtgaccgtcagtagcggagctatcattgacgctattgcattcacctatgtgggcaccgataacgctgaacactcttccggcatcaagtggggtggcactggtggcacggaagatacggtgggtaaattgtttgtttttaaaaattctttgtcttgtactatatggtgaccgatcgtcggcttttcatattgtttgagctgggtcgggcattgtatctagatccaatccaacggctagggttactatttctccctacatgtacttgtatacctacctcttacctacatgacctgatgatttccacctagccaatgaaggaaggagtgtgtaccgtatgtgacgtagtactggcagcacctgcttgctagaataaataaacttgcaagtgctttgcatggcacttttgcatatgtgtgtgataatgtgtgacgccatgatcctcaagtcgtgggatggcacgacaagtgtgtgcggatcgtacgtggcgctggtcttcaggctagttattagccgaggcatgcgttgcgttgtaaaggcgtacatgtatgaataaaagaagtttgttgcaaggcttgttctagtgcaaaaaaaaacctgcccgggcggccgctcgaaatcactagtgaattc

SEQ ID NO: 36097 - DNA, 1281 bp, Triticum aestivum
  Clone ID: PAT_TA_36097
cgtctcagccacgcccaccctcgtctcatcctctccacacgcgcaccgacgcacttccatggccgccgcctcctcctcctccccccctcccagctccgcctcctcgcgccttttacggactttgcgggcgtgcgtgtgctagggtggatcgtgcaagagcagaggcgtacgtcttggtttgtcggttaagggaggagctaggctgtggtgtggggtggagctagctgggggataacccgatgaggcgaacgacgagcttgacggaggtcgcgccgccgtcggtgctggcggtggtgttggaggaggaggacgaggacgagcagggcaaggcggtggtgcaggccgaagaaggtggcgccggcggggggcaggactggctggcggccctaggcggcggcagcggggcccccgggacggactggctggcggcgtaccgcgcgcgcgcgccgccggcgcgggcggggctccggcggaactcggccgactaccccaaggtcgagacagccgcgttcctccgccagtgcggcctctgccgccgcctcctcggccccggccgcgacaccttcatgtacaagggcgaggcggccttgtcgagcctgggctgccggcagcagcacataacgcacgacgagtggaaggacacgtgcacgtcaacgcccatgagcgaggcggcggcgccggcgaccagccgcggccgctccggcacgaccgacaccggcggcacggtggcggcggcctaacctgacggcgcacgagaggcacgcacgctatcatcttccgaagctacctgccggccagtagctctggaggctctcgcttctcaccgcccgctacgcatgtattactctcgtacgtagtacgtaccaacgcctccaatatgaatcgctggtaatctgtgcaggccgtcagccaccgctggtcgatcgatcgaccatcgcctcagtacaactgcatagctttttatcaattgtatgtacacttggagatcgattccgtttatgagaccattccatccaacaccgcttagctactcgacgtccatcgtgggctgcttacccgccacgactgtgaatacctaatacctggtcagtactgccaccgtgcgaccacaatcacccagccttctctcgcctgctgtggttttcaccttttcaaactcccttataattccccacgacacattttcgtcaatggagaaggtggactcatctgtactgtattgaacacgaacaagccttccagattgcaagaaaggcagaacatattttctcgtgccgaatc

SEQ ID NO: 36098 - DNA, 763 bp, Triticum aestivum
  Clone ID: PAT_TA_36098
gccaggcgatccacaccgctccctgctggggcctgacgcacggcgcctcgccgctgccttgagaggggccagtcgtgccgtcgcttggaggagcagccaccacgctgagagggtcgtgggcgtccgatgccgctgcagtgctgcggtacgggaagcgccatgcatatggtcgcggcctggtgcgccggagggcgccgccggcgtcgagatctggtcctgccgccggaagcagtggttccgagggtggccgggccgtgggctgagcgctgcgcgccgtagtgcaaggagccggaacaggaggggtgcctcacaaacaccgtctcggctggccgctgcgtcgtcactcgtcagtggccatggccgattggcgtcggctgttggtaagggagttggccgttggccgggtgtcttgcacgtcgtgcaccggtgcgacgtcgaggctgggctctccgctgcaagcaggtacgtcgcctggattggaggttactagtacgtatttgtctaagaacaaaatttggaataggatcacctgatgatgtaacgattaagatcaagagttctggtctttaaggctgattcgggatgcttgctgtttgtgactttatctcttgatctttgcgttgtgcttcctgattcttgttcgactgtttttccgctcttccagttattgttcttcagatgtgtgttcgtcatggtagatgcaagaaattgtaaattcgaaaaaaaaaaaaaaaaaaggccccctagggcccgcggccgctct

SEQ ID NO: 36099 - DNA, 886 bp, Triticum aestivum
  unsure (1)..(886): unsure at all n locations
  Clone ID: PAT_TA_36099
gccggccgggctgggcaacctcgttaggcctcctcctccttcgggatctgccagtatgatcgccccgagtcgtttctcggcttggataatcgaacaagcacggagcagaaatccatcctatgcagagctggatcctcgtgtgagattggtgaggaggaccacctcggaagcttttcccaatttgggaaactcttgcggttggagtatccgtatgtctggaacgattctatcgtcatgacttacatgactaggtatcatgactactgagaagaagaggttcaagcgtcaggaacaagacgtatataatccagactcaaactcgtcttctagattttggaaccagattcatctcaactcagcagccttttgtacattctttataccctttacattcgcttcttatacaaaccaatatctttcgtttcaacagcttgaacaaccttcatcatgctttacacatctattctcgttgctcttgttcctttcgcagtggctggtcccattgctccccgaaccggccttggaggtggactccctggtctaggaggcggctctggctctggcctccctagccttcctggtcttggaggtggctctggctctggctctggtcttcccagtctccccagccttggaggcggctctggtggcctacccagtcttcccggcctaggaggtgactctggttctggctctggtctccctagtctgcctggccttggaggtggttccggttctggtctccccagtctccctggtcttggaggcggttctggatctggtggtttgcctagcctcccaggnctcggaggcggctctggctctggttctggtctgccccgccttccaggncttggagggggctctggcggcctccccggcctcg

SEQ ID NO: 36100 - DNA, 558 bp, Triticum aestivum
  unsure (1)..(558): unsure at all n locations
  Clone ID: PAT_TA_36100
gccggccgggttcacacgtgccacccctccaggggtctttacagaagcacggctcgagcgagaccgcgagcgcagcgaccgaaaggcgacgacggccaagatccagtccttcgcctccgagtttctccggcagcgaccggagagacggaccgccccctccctccggtgctctgcctgcatgctccgcccaccagcgaccgcgacggccgtggtcgtcaccctcctccttccccagatctaccctccccctcgaagttcctgcccctccggtgacggcaacggcgacggttccacggtcaacttccacctacttccaccaagaggctgtctaggtgctgttttgggtgtttcccgtggtgcacatgggtgctgcctttccctacagtgctctgaacctctgacatttagcaaatgattttgctttatcccgaaaatgctaggtggttggcggcggcgttgtttcnatnggctaaantcatttgggcccgtttgggccattggnaaatattcaacctggatgaaantncaacgaacatccgantngtggggaacctaatt

SEQ ID NO: 36101 - DNA, 711 bp, Triticum aestivum
  Clone ID: PAT_TA_36101
ggccgtccctcgcctccgcccctcgtctgatcatctggtcctggtgtcccccttctgcccgcttcgccctggccctcgtcgccccggcggtggtcgtggccctgctcccttgacccctggctcgtctgcctcccctggccgcccccgtggtgagcaagctcctcgcgtgctattacccctggcgttgatttgatgccgatttttagaaacaaaaaattgattgatgggtttatttcagtagtctaaataggttaatcttcttggtttgttggcgtgcagatgattgatgagctgatcttcttccaccagttgtagcgggagtgatgctggagcagtacaacgatcattagatacatgtgccatttgggcagggagaagctgggacggccctaatgcagtaacaccaccatgtggcaaatccagcagatggacacaacattggtgcctgggtgatgggataatgtatgtgtaccagtgacatgatatttgtgcttctcgtccaatctatattgttgtgcacttgtgtacttgttgggcctttttgccgtgcacttgcaattttagaactatttttttgttgttgtgcacttcttggtccttgaaccttgctgtgtataggagtcaatggatgatgtattgtatttcctatgatgtgttactgaaatgaaatatactgttttttttgaaaaaaaaaaaaaaaaaaggccccta

SEQ ID NO: 36102 - DNA, 888 bp, Triticum aestivum
  unsure (1)..(888): unsure at all n locations
  Clone ID: PAT_TA_36102
gtcacccctaaccccacnccacgtcggcctccctatatcacccaacactacgccggccgtaccgatcacacgcactacagccaccaccgctctctcctgcaacctccgttgttcagagcagcaccagccagagccacaagcaatggcggcgaggagcggcattgtcgtcgtcgcggcggcgctcttggccctggtggcggtgtcgcaggcgcaggcgccgggcccctcggcgacgccggccggcccgccgaacgtgacggccatcctggtgaagggcgggcagtacacgaccttcatgcggctgatgaaggagacgcagcaggacacgcagctcaacagccagctcaacaactccttcaacggcaacggctacaccgtgttcgcgcccaccgacaacgccttcaacaacctcaagcccggcacgctcaacagcctcacccagcagcagcaggtgtcgctcgtccaggcccacatcctgccccagtactacaccatggagtccttccagacggccagcaaccccgtccgcacccaggcctccggcgagaaggagcccatcacggtcaacatcgtcgccaccaacaaccaggtcaacgtcaccaccggcctcgtcgaggtcgccgtcaacaacgcgctcagcgccgtcaagccgctcgccgtctactcggtcgacaaggtgctcctgcccgaggcgctgttcggggccaaggcgccggcgccggcgcccaccgccgccaaggggggcaagacaagaaggtgaggcggccgggcggcgggtcgggtccgagcacccacggcgggcggcgcgcgccgcgggcggcttgctggatggcgtctctggtactctgtaaatggtactggatntgatnacagaccatgcataacatt

SEQ ID NO: 36103 - DNA, 1017 bp, Triticum aestivum
  unsure (1)..(1017): unsure at all n locations
  Clone ID: PAT_TA_36103
cggacgcgtgggcagccccctggagctcgtgttatccacacctattgccttatgcagagggataccttggatggtgatgcttttgtcgattcaccaaccggcagtccatcaccgtggaactctcattcgctggatcaaataacagatgctgatgtttcccggatgagaaaaaaagtggggcagcgctcagatgccttttggtggtgccaatgcatctcaacagccacgtaaagatgtcccaaaagggtttaagaagctgctgaaatttgggaggaagaataggggtgatggtttagtgaatgactgggtttctgcttcaactgcctcagaatgtgatgatgatatggaagatggccgggatctggcaataggatcctctgatgatttcagaaagtcaagaatgggctatctttcttcatatgatggttttgttgagaacgaggttttgactgaacaagaacaatcgctgcgcagctccattccaaacccccctgcaaattttagactgagggaggatcaactgactggtagctcaattaaagcaccacgttcattcttctccctgtcgacattccggagcaaaggaggcgatgctaggctaaggtgaccctcaagcaccagagctggattgtataaaatttcttctggaagtaggtaaagatatcaaattttcacggatggtacgcggacactgctagcttgtcatatataaatacatatcctgtatctatggtaattcttataagctgcaagttaagcgtttccactgttgttgtttgctaattctttttccttaaatcttttttcatctcttgtgtagagttggacttctagaattttttttgcaatttttccacttggccagagacattgtattatttttataatttttgaatgctgtactccactcattgttcgcgtcaaccatattacacaatcattcaagcaaaggggggccgtacaatcgccaaatggncntagcngccaangctnnttaaactcctaatggaaaacntg

SEQ ID NO: 36104 - DNA, 1381 bp, Triticum aestivum
  unsure (1)..(1381): unsure at all n locations
  Clone ID: PAT_TA_36104
ctccacggcagtgcagtgtcccactggcgtgcgagctagagccggcaatgccaggcagggggctcaaggggcgttccttgaccctgaaagggccgcagccgtagaagtgcccttcaacatgtcctctcgccacaagagcttccgaacggcccaagaggagctgctgggtctccgaaagttagtaggggagtaccgcctcggagagtttgtgaacaggttccggcatggctcgctggtgatgcggctgcccgactctgagatcggccaaatccccacggttgcaatttgtcatcatcaacggggtcattggaatcgtctcttctctacctcacgaccatgtatatgtttttggagaaaccccagagaacattcgtcaatttcatcaggggtctggggaggatggttcgcatgagctgcaatctgaatgtggccgtcatgggcacatacttgccctgtatacccatacccgtggtgatttccttgtagtcggagacctgatgaagtcgatatctttgcttgtgtacaagcatgaggagagtgcgattgaagagctcgctcgggcctacaacgcgaactggatgactgcagttgagatgattgacgatgacatctacgtcggtgcagagaacagctacaacctcttcactgtgcgcaagaatagcgacgcggccacagacgaggagaggggtaggctggaggtggtcggggagtaccacctcggagagtttgtcaacagattccggcacggctcgctggtgatgcgcctccctgactcggagatgggccagatccccacggtcatctttggcaccatcaatggggtcatcggcatcatcgcctccctgccccacgaccactatgtgttcctggagaagctccagacaaccctggtcaagttcatcaagggtgtgggcagcctgagccacgagcagtggcggtcattccacaacgacaagaagacgtcagaggcccgcaacttcctggacggtgacctcatcgagtcgttccttgacctcaacaggtccaagatggaggaggtggccaaggcgatggcggtccctgttgaggagttgtccaagcgggtggaggagctgatgagactgcactaggtggtagcgccgggccgtgtatatcctgttttatttgttcgttttcgctgtgttgtaaaccgttggctgctcgagaatgatcctctgcaagtgtttgtagcaacatcccttttctgttgataagagtgtaactttatctgtgctgatgtagaattttagtggtgaatctctctgttgaaatggtatcaagaaagtttggcacaaaaattaggcgtgaatgtcgatggtgataaccatctgggaatgcanaactttagacttaggtttctgat

SEQ ID NO: 36105 - DNA, 754 bp, Triticum aestivum
  Clone ID: PAT_TA_36105
atttgcctgatacctgaggtaccattcacccttgatggaccaaacggagttcttcggcaccttgagcacttgatagagaccaaggggtttgctctcatgtgtgttgccgaaggtgctgggcaggaatatttgcagaagtcgaacgcaactgatgcttcagggaacatggttctcagtgatatcggtgtgcaccttcaacagaagatcaagtctcatttcagagagataaacgtccactctgatgtgaagtacatcgaccccacgtacatgctccgcgccgtgcgtgccaatgcgtctgatgccatcctgtgcacggtgctcggtcagaatgctgttcatggcgcctttgcagggtttagcggcatcacaaccggaatatgcaacacgcataacgtttacctgccaatacctgaagttatcaagacgccaaggcttgtcgatccaaacagcaggatgtggcacaggtgcttgacatccacaggtcaacctgacttttgttgatcagttctcgacagccaagtttgtaaactctagtgctagaagtaccggtggtgtacaggattgtgaatgtcattctttttgtcttccatcagaaagacatggtatggcctgtaatttctggctgatcccgagctcaactgctaccggataaacagtaaattaaaaaaacaacatatgctaccgttgtaatcatggctgcatgtaacgcaaactctattctccttaattaatggatgtgcatgtcttttgcctc

SEQ ID NO: 36106 - DNA, 622 bp, Triticum aestivum
  Clone ID: PAT_TA_36106
gccggcgtcgcttgtcttagcgacccacttcatttacctgctccactgttacccgtccatcaccttccagccgcttccttccccatccgtccccggcgtcactgtcgactcgtacagagtagcgagttcgtcgtctcgggcgaaatcaggatcatccaaggcgaggggcgccacgcccccccggcggaaggttactgccaggccgcagcacaccaggcgcccgccgggcccccagcccaggccgccggtagggtcgccacctgcgtatgccgcctgctcgccgagcgccgagcccagcttcctcccatcctgtttggctgcgctttgctactgcctgccgcagcgccgaggtgctgctgcctggcatccatcataatcgtcggctaaaatagccggccaagcccgacatgcgtcaactgtacaaacgacatgatatcaagaagattattctccatcttgtatatacacataatatgatgatctctctctatatatgtatgcatgtattcgctaattattgttatctcactacggtgctgcctacctgtgtaacccgaatccatcagtaacaaaggctttatgatcttaccatcttaaaaaaaaaaaaaaaaaaaggccccta

SEQ ID NO: 36107 - DNA, 525 bp, Triticum aestivum
  Clone ID: PAT_TA_36107
gccggccgggttgggacttccgcagcaaccaacaacacaaataagaaaaggaatagctaactatctcccgtgccacatatgaggaactacacatgggccctatgctttgtagctcttgtagccatggccaccactttcgtctcaggccatgcaacaaggagttacataggtacaactgacatgtgtgcagctggagctgacgaccactgttcgccaccagaacgagctactggtaacattctgtgcaaggcttgctgcgctgcccaaggttatgacaaggataagagcagttgttgtcaaggcagtagtagctcctgctgctgtgtaaaggactgagaagtgccatgaaatgagtttatatatttgctagaaatattgcctgaaggagaatgaataaatagtctgggtgaacctttatttagttcatacaaaacaatcaataaaccattgagaattgttgatttaataaaaaaaaaaaaaaaaaaggcccctaaaagagcgcaggaatgccaatgaaaaagtgca

SEQ ID NO: 36108 - DNA, 981 bp, Triticum aestivum
  unsure (1)..(981): unsure at all n locations
  Clone ID: PAT_TA_36108
gccggccgcttcgtctcgtagttgagaagtgggatgatcactccaaagatgagttctgctctgagcaagtgaaaatattgttttatgctatctatactacagtcaatcagcttggagtagtagcttctgcaatacaaaaccgtgatgttcgaaagcacctgatagaattatggctacaactgttgaggtctatgatgtctgaggcagaatggcggatgagaaaatatgtgccaacagttgagcaatacatgtcaaatgcagttgtttccttcacactggggcccattgtgctcacatcgttgtactttgttgggccaaagctctcgggatgtgttatccaagatcaagaatacaggagttatttaggctaacgagcacaattggtcgtctcctcaatgatatccaaggccttgagagggagagcagggagggaaacctggattgtgtctcactacttattctccacagtggtggttctatgtcaattgaaacggctaaagaaacgatacagaaggccatagcctcatgtagaaaagacttgctaaagctggttcttagggaaaacacagttgttcctaggccatgcaaggagctgttctggaagatgtgcaagatagttcacttgttctactctcagactgatggatttagctcgccaaacgaaatggtgagtgcggttaatgcagttatcaacgagccgctaaaactccaaatcaacaatcgacctttgcccatgcagtcagtaaattaagggttccgtgtattttgccttgttttaatggaccgatcaatctgatgctctcttgagaaaaaacttatgaatcagataataaccagcagtacggatacactgtgtatgtggtacatcagaaacaactattgtactatatttgttattcaacttcctatctaaatatgtcacatttgcatatgtattatatatttggnatagctgcaaaaaaaaaaaaaaaaaggccccta

SEQ ID NO: 36109 - DNA, 875 bp, Triticum aestivum
  Clone ID: PAT_TA_36109
cgcacccccacccctcccactggcggctgcctggtggctccagggggctctggcccgccggcctggggcgcgtccagaggcctggggcgtcgtgcgagggcgcgtatgtagcaacattcgatgcactcctcaatgcaaagcagtcctttccctcctacagctaggagggttaggccgagggctttgacgatcacgtctttcattgcagcagcagcagcgtcgtcggccgaggttggagtgcctcatggatttgctccacctgcagctgtgaacaggagccttccctctgatggtgaaggtgtctctagaccacccgtcgatcgaccatatgcgtggggctgggagggctttgggccattcccgtgggtccctgtcgacggcgaacctcactggtggagcacgttcaatccgatgcagaaccatacacatggaggtttcactcgaagacctgctcccggggagcggataccgcagagccacccggacagtgtttaccagcctgtgcctcccctgaggatgccaccattcttgtgaagaaagaccatttctcccatcgctgtgtatatcgggaattatttgtttcgagagaggccgagtttagactgttgaagggtacccgaaatgatgccactggcgtgtgcttggtgtttttagggttctcttgccagcggacctggatttcattcaaatggctgtggtgacttatgagatcgcatatgttgcggtggtcggaattgtttgtaaacgtttgccgaaactgctgccgttggacatgattgtgatgccattactcattgccgcatttttcaaaaaaaaaaaaaaaaaactcgagactagacctgcccgggcggccgctcgaaatcactagtgaattc

SEQ ID NO: 36110 - DNA, 1193 bp, Triticum aestivum
  Clone ID: PAT_TA_36110
cactggatcaactggagttctggaagcactccaaggttcatccatcactctggatagacctgctgatgatggatacaactggcgtaagtatggacaaaaggcagtcaagggtgggaagtatccaaggagctattacaaatgtaccctgaattgcccggtcaggaaaaatgtagagcactctgcagatggacgaattattaaaataatttatagaggtcagcactgccatgaacccccctcaaagaggtttaaagattgtggtgatttattgaatgagttaaatgatttcaatgatgccaaggagccttcaactaaatcacaattaggttgtcaaggttattatggaaaacctataacgccaaatggaatgatgacggatgttttattgccaacgaaggaagagggggatgagcaattatctagtttaagtgatatccgggaaggtgatggtgaaataacaactgttgatggagatgatggtgatgccgatgcaaatgaaaggaatgcaccaggtcaaaagattatcgtgagtacaacgagcgatgctgatcttttggacgacggctataggtggcgcaagtatggacagaaagtggtgagaggaaatcctcacccaaggagctattacaagtgcacttaccacggccgggacggcaagaagcatatcgagagatcttccgaggaaccacatgctgtgataaccacatacgaagggaagcatacccatgacgtgcctgagtctaggaacagaagccaaggcacaggtcaacaccactgcaaagagcagacttattcagaacaaccagctgctagcttctgcagtagctcggaaaagagaaaatacggaacagccattctgaacgatctcgccttctagtttggtcccggtgtcttctttaccgaccacagtggtggctcgcgaaagaaagaaagaaacacaattcggttggttcttcggtgacgggctgttgctgctcatgctctgtttgctgtatattccccactccagtaataaatcttgcatatgcagaagttgtaactgctgaacatgatgggtggtccattgttggctaaaaccttccagttggaccagcatgactgcgtgtcaggtgcacatactttgttgaaagcttggatatttcagttaaacagcaaaaaaaaaaaaaaaaaaggcccctaaactgcaatttgaa

SEQ ID NO: 36111 - DNA, 667 bp, Triticum aestivum
  Clone ID: PAT_TA_36111
gggctgcctgccatcggctgcttgacaccaaggaggaaagaacaaacagcagcagattttagcgcctccccagcctttgttgatgggccgcagtgcaattgcaaaatcaactggtcttctccgggaagttaagaacaggcaaagctctaaccttacgagccgggtgcagccaacaaaagcaaggtcggcagagacagcactgtgggtgccacacccaaggacagggatctactaccccaggggctttgagtgggtcatggaggatgtcccaagcagcgcagcaacgttccagcagacatactggctcaggagcggcgacgcagagacagcaagctcccccacatcaaccgacggcacagctgcctttgataatccatttctgtgaatgcataagaggcttcacactggaagaatcactgatagcagcagttctacaagccaccaccattgttgccaggtcgatacataatatgataaaccagctgctcagttttccagcatgtaggcaccgcatccaccgaaagatcagtgttaaactctgcattaatcttctctattgcattctcattttcactgattttacttaaataaaagccgcacctgattgtaatatttggaaaaaaaaaacaaaaaacctaatcgaataaaaaaaaaaaaaaggccccta

SEQ ID NO: 36112 - DNA, 552 bp, Triticum aestivum
  Clone ID: PAT_TA_36112
gcaggccgcttatcaattagctcgagtgagagttcagaaacactccttcgctacacctcgttcacttccaactatctccacgccacagagagagataagagtgtgtgtgtgtgttgaagcaaagatgaagcttatggggagccggaggagtggaggaggcctgagcaggagcctcaaggagcacagggccaggctctacatcatccagcgctgcgtcgtcatgctcctgcgctggcatgactgaggactgactacctcgctccatggattccatggatggatggatccgtccttccattccattccatggatggtgtttgaagcaaagatatacttttttgattttgggtctgtaggtaggtaggaaggtgtcggcaggtagtacttgtacataagaggttggttaattatagaagtagaagtagtagcaaagcaataggatcgatcgagtgttcgttgattcaccactttctctgccctccacccccttcagcaagtgcgtcccattgtacagttacatcactgccgaatactggaatgcaatatcggctg

SEQ ID NO: 36113 - DNA, 606 bp, Triticum aestivum
  Clone ID: PAT_TA_36113
attagaggcattggggacgcaacgtcctcgacctattctcaaactttaaataggtaggatgacgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagacagcaggacccccaggcagcagcaaagcggctgacgaccgaggcgctcgcgaggaagagcaaggatgacatctcctgcattgtcatccgcttccgctgctgaatcgatcccattctccgatcatttcaatttctcgatccatgactgatgtggcgtcgtgacctgattctcgctgctccagattgaaattatgtagttgctgttattgtttgtacctatagtagctgtgaacatgcttgagattagaacattgcatgggaagacggtggagagtctgaggcttggggctagtagtgagtagtggctagtgtgtgcagggtgtgtcattcatctgtgcatatgttacaccgccataagttccccgccaatctgtggaacatctcgtttg

SEQ ID NO: 36114 - DNA, 597 bp, Triticum aestivum
  unsure (1)..(597): unsure at all n locations
  Clone ID: PAT_TA_36114
ttcgattcggcacgagtttttttttttacggaaagagggagtaatattctactcatttattagtgcttcaaaggacgagataatgaaattaaccagagcggttgtggtcgccaactgcagattcatgagacgcgagggacagattagttcgcagctggcttgaaggatttgagctggcgggttttggtccaggactgctcgtagacctcggcgaggtacgacgcgttcttgccggagtcgtcctccgcgtcgacgaagaggcggtagttcatgccggagaccacctgctgctcgccgcgcgtgacccggcgaaaccgcagcccgttgctagccaggctcgcatgctgcaccgcccatcctcccagctcctggatgtgcgcgtccttcaagttcgggataggtccccactcgccgagcctctcactgtggtcgcccaacaccgctgaggcgactgcgagggtcatggcgaggagggcgaggaggacgaggggtcgtcgcgccatggagagtcggtgttaggaattgggtgttgggggtccggggacggntggatgctcgaagggagtgattgtgtaaggcggataggtttgctcgtgc

SEQ ID NO: 36115 - DNA, 650 bp, Triticum aestivum
  Clone ID: PAT_TA_36115
ttcggcacgaggctcgcctccaccgcctcctgtcccctcgcgcgttccgcctcccagttgcggctccggtcgttcccctcctcctcggttgctgagatggccggtcgtgggaaggcaatcggcgccggcgcggccaagaaggcgacgtcaaggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacacgtatcgtgccccgccacatccagctcgccgtgcgcaatgacgaggagctgaccaagttgctcgatgacgacgacaactgaggccctgacctttccctcgctgccaccgcccgcaccttggaatacatttgcatcacaaagacgagtttcttgtttcgtaggatttagtgtcttcgttttcaggagagtcctggatggcttggtattaggagaatttctagttggtggtcggattagttgctttcatcccatggctgtgaatatggcaaacaaattttcgggtgtttaaactcagatgtaaggctgcttgatcttatccg

SEQ ID NO: 36116 - DNA, 595 bp, Triticum aestivum
  Clone ID: PAT_TA_36116
gcttcttccacatttccactgagcaaagagaagcaaatcggcagagaacgaagcaaaccggccgacggttcctggcccctcgccatggccggcaaagctagggtgttcatgtgcgtggcgctcgtcgtcctcctgctccttgtcgagattgcggcggcgcgtgctcgtaccggtgcagcaagtcgagtcgaccgaatctgtgcaacagggcgtgcaacacgtgctgccggcgatgcaactgcgtgccgcccggcaccgccggcaacgaggacgtctgcccctgctacgcccacatgaccacgcacgacggccgccacaagtgcccatgatacaaccgccatctccacggtcaatcaagactactacatagtcgatcgtcatggcctctcaattaatatcacatctacgatcagcgacagctagactaccagaggcacgatctatatgatacatgtactactcaagctagtgctgctacctatgtaccttgtgctcatccatacgtgatcgacccatcgtgtaagcatgtttgctatctcattctcacgcagtggtaattgcgtcgattgcactaaaacaattagtgcgtgtgtta

SEQ ID NO: 36117 - DNA, 784 bp, Triticum aestivum
  Clone ID: PAT_TA_36117
ggcgagtcgacgggttctgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatgacgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagaccacgcacgacggccgccacaagtgcccatgattcaaccgccttctcgacggccggtcgaggctaatgcatactagatcatggcgtctcagtaaatatcccatcaagctagctacagccaacgataactagactaccaggggcacgatcgatatgatatcatgtactcaagctagtgctgctgcctatgtaccttgtgctcatccatccgtgatcgatccatcgtgtaagcat

SEQ ID NO: 36118 - DNA, 539 bp, Triticum aestivum
  Clone ID: PAT_TA_36118
gaatcagtttccaattattgcttccagccccaattgataggatcaaaacaagctcatgaaccttgctatgtcagacatgacggagatacagtacggctgcatcattccaaaatcgaaagtacaagagcaaggtcacacaagcattacgcagaatagttcaccactgcagccactattgtgcgcaagccgctagttgtaattttcaccgcccagtagaagatttgcatgtaaacataggacttggacctgagcaccatagcgctattcaccaccaacttgacgtttccaggagtcctccacgataagctcgtcaacactccagtcctcgtagcttccatctggtaaatatcgcctgattgtgaatgggatcttgcgtgctctcaattctttcatggcaatctcaagcggatcagtctccccttcaagctcaaccataactggagcgttcatgctaatctgcaaagcacgcgtaccaagaatgcgtgcacgctcatactttgtcatatactttgttgttttgcgtgcacgtgctatctttt

SEQ ID NO: 36119 - DNA, 492 bp, Triticum aestivum
  unsure (1)..(492): unsure at all n locations
  Clone ID: PAT_TA_36119
cacggcacagttgctaggacaatcgacgcgaacgtatcagaagctgagggcatatacagtgccctggagaagctgggcatcgactgggaagaggttggcaagcagctggagcacgagggcgtgagctccttcaaggggagcttcgacagcctgctcacgagcttggaggagaaagggcaatgccctcaaagaccgccgccaacctgtaggcgctaaaatttgttggatagaatggttttgggtacccggcgcttggcccatccaaaccgatttacccaaattaaaaatgccagctttgctggtctccccctttccatttccgggaaattgaaagctccccaatttactgggtgagttcctttggtatccctaagcgtgcctgggctntccattggtgtaactggaggtttgtttctccgcaactgctatcctttttcccggatcaattgggttttttgnagcaaagtggagcccaanannaaaaaaaaaaaa

SEQ ID NO: 36120 - DNA, 726 bp, Triticum aestivum
  Clone ID: PAT_TA_36120
gccgccccctccgcatcttcgtcctgcaagcagcgccgccgccttccaccggctcgagctccagccttcccttcaaccatggcggacgtcgatgtcgatcccgaggtggcggccgccggtcccaagaagaggacgttccgcaagttcagctaccgtggcgtggacctcgacgctctcctggacatgtccaccgaggacctcgtccagctcttccccgcgcgcccccgcagaaggttctcgaggggtctgaagaggaagccgatggcgctcgtcaagaagctgcgcaaggcgaaaagcgaagcttctgctggtgagaagcctgagcaagtgaggacccacctccgcaacatgatcatcatgcctgagatgatcggaagcgtcgtgggcatctacaatggcaagtgcttcaaccaggtggagatcaagccggagatgatcgggcactatctggcagagctctccctgtcgtacaagccggtgaagcacgggaggcctggtatcggtgctacccacttcgtcgaggttcattcctctcaagtgagaatatggtcagggaaattgtctggggtgtctggaatccagtgttcatatcgtagtcaaatgtagtgcctggaataccgactgtcaggccaatggcgggagcagcaccctttggaacccggaacttaaatcccggtcacagatattggaggtttatcgcaagggaagaatcaaaccatgcttaac

SEQ ID NO: 36121 - DNA, 655 bp, Triticum aestivum
  Clone ID: PAT_TA_36121
tgaggattcggacgaggatcagtccaagtcaactgttcgaacgagatcttatcaatatctgccatgctgtcagataattgctgtttgttgagttattctgacaaagcaaatggtatcgtctcgcctctttgcatctgctgaccaccgtggacttcgtctgttattaccatattctttctctagtacccaattgcttcctccggcctagggaggctcaaaaggctgctgatgaggcgaaggctcgatttggccatattgatggggaccatctgacgcttctgaatgtataccatgcatacaagcaaaacaatgaagatccccagtggtgttacgagaactttatcaattccagagcacttaagtctgcagacaatgtcagacaacagcttgttcgcatcatgactagattcaacctcaagatgtgcagcacggatttcaatagccgtgagtactatgtcaatataaggaaagccatgcttgcagggtatttcatgcaggtcgctcacctggagcgaactggacattacctgactgtaaaagacaaccagggtgtccatcttcatccctccaattgtatggaccataagccagagtgggtcatctacaatgaatacgtcttgaccaccaggaatttcatccgcacagtcaccgatat

SEQ ID NO: 36122 - DNA, 671 bp, Triticum aestivum
  unsure (1)..(671): unsure at all n locations
  Clone ID: PAT_TA_36122
cccacccattcccctcaccgccgccgccgccactgcgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgtcggcaacgtcctcccgctccgctccgttcctgagggaggcgtcatctgcaacgtcgagcaccacgtcggcgaccgcggtgtcttcgccaggggcatccgggtgactatcgccatcgtccatcaggccacccaacccccgacaaacgggcacccttcaagggaatcaaagnnctccccctctgggtggcccaaagaaaagattgtccccaaagcaagcctgcccgtggcccatgaattggttcanggtttgcttggtggggtggccaagaaccttgagaaagcccaaatggcttcaagggcttgggtaaaccgccctacccacaa

SEQ ID NO: 36123 - DNA, 1100 bp, Triticum aestivum
  Clone ID: PAT_TA_36123
ccagttcgagttccaccgcccgcagcaaccaaagccaagtttcgaagccgccgccgccgaggagcaggagaaggcgagaagccatggcccgtaccaagcagaccgcccgcaagtccaccggcggcaaggcgccccgcaagcagctcgccaccaaggcggcgaggaagtcggcgccgaccaccggcggcgtgaagaagccccaccgctacaggccaggtaccgtggcgctccgtgagatccgcaagtaccagaagtccacggagctgctgatccgcaagctgccgttccagcgcctggtccgcgagatcgcgcaggacttcaagacggacctccgctttcagcccacgccgtgctggcccttcaggaggcccgcgaggcgtaccttgtggggctgttcgaggacaccaactgtgcgccatccacgcaagcgcggaacataatggccaagacatccaggtcgccggccgaaccgggggagggcgcctaacgaacgaggaaggtcaggcccccttaccaacggggcaaagttgggcggcttattaaaactaggtgatagcttcccttggcgggaaaagattttgtggcccgtggaaaaaactggggtgttagtaatccaagtagggggacctttggcggttaatgggtttaattgggcgacaattccaaaggaggcctatatattggaaaaaaaaaaaaaaaaaaacttggggggggccccgcccccatttcgcctatgtagggggggatataaattactgggccggtgttttaaatgcgggttgtgagaacctgggggatcccaattaatcgctttgacgaactcctctcttccttattgggaaaaaaaaaaagccccaccctatgctctttccacatttgccaccttagagggcaaggcaatattagcgcatattttcttacatatccgtatatttgtttaaaagtatttttttcataggggcgggagtggcgaccttcttttttataagaaaccccccgatgttggggtgttttctattaaccaacagtcattaatagaggtgagctctccagggtggacatactctatggttgacgcgctccgtacccttctcttatcc

SEQ ID NO: 36124 - DNA, 434 bp, Triticum aestivum
  Clone ID: PAT_TA_36124
gaaatcctgaagaaagctcaaaagcgctgtttgatgagcctgcgtagtattaggtagttggtcaggtaaaggctgaccaagccaatgatgcttagctggtcttttcggatgatcagccacactgggactgagacacggcccggactcccacggggggcagcagtggggaatcttggacaatgggcgaagccgaccaaggccctgatgcttgatgcaccagccgagaagatagaagcttaggatgtttgccatgaaagggtttttactagctgggagctgtctgttgcactttgctttattatagtcgagaacaaggtgtctttgaattgtgctacttgtggaagtctctgtttgctgtcaaagttttggattatggtgcaatgctactctctgttatcggcaaaggatgctacataattatgccaaaaaaaaaa

SEQ ID NO: 36125 - DNA, 677 bp, Triticum aestivum
  Clone ID: PAT_TA_36125
agcccattacgagttctatcaggtaaagccaatgattagaggcattggggacgcaacgtccctcgacctattctcaaactttaaataggtaggatggcgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgcctcctcggccagctctccaaggaggtcggatggaactacgccgacaccatcagggagctggaggaaaagaggaaggagaaggccaaggtctcctacgacaggagaaagcaactggccaagctccgcgtcaaggccgagaaggcagccgaggagaagttgggaactcagctggagatcctggctccgatcaaatactaagagatatcagagctttcgtgcgccatcagttttgggaaacctctgtcgtattttaagtagtttggtaactctgatagtacaatctggttggtaaacctttgttatgcatgcagttctgctaccctcatttgaaattttctaccggtaactgttccgtttatcaaat

SEQ ID NO: 36126 - DNA, 821 bp, Triticum aestivum
  Clone ID: PAT_TA_36126
ggcgagtcgacgggttctgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatgacgcggctgcttcggtgagccgtgccatggaatcgggtgctccaagtgggccaacagtgttgatgttacatctctccgtgatccacaggaggatgcggtgcgtgtcaagaaccctgagtggcttgttgtcattggtgtctgcactcacttgggttgcattcccctccccaactctggggacttcggtggctggttctgcccatgtcatggctcacactacgacatctcaggtagaatcaggaagggcccagcaccatacaacctggaggtcccgacctacagtttcttggaagataacaaaatgcttattggctaagagcactggccgtaagattaatccctatggtgctgtgctgccattttgtgttggtttgaccattcatctttttgttgctcggatagtcctttgatggactgttatcttagt

SEQ ID NO: 36127 - DNA, 563 bp, Triticum aestivum
  Clone ID: PAT_TA_36127
gtgaggcagccccgctccgctaaacctcgcaacaacccccgtgggcgaccaacccagcccagccgcccccctctcctcaccaacccccgagccggaagcagagccgcgatggccggcaccgtgcccaagctcgccgctccgaggccggcggccgcggggccgctcccctcgcagtccctccgcgccgccgcgctcgccttcgccccctccgcccgacgcttccgcgtctccctcgccggccgcgccaggagccccgtcattgcgatggcttccgccaaggaagggaacggtgcggtgacgaagaggaccacgctccatgacctctatgagcaaacaagggtcaagtccccgtggtacgacaaaccttttgccggcctgtcaccgattttgctgcccctacatcgccaacggtggccgtgggggcaccagcaacccaacgattttcccggaaagccatctctttattcaaacgcctttgacgggccagtcaagggaggctattttcacctgggaagggatgcggagaagcggcttaccggggaaccccgccattaaagggacac

SEQ ID NO: 36128 - DNA, 707 bp, Triticum aestivum
  Clone ID: PAT_TA_36128
ggtctgacatgcgtgcgagtcgacgggttctgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataagggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatgacgcggctgcttcggtgagccgtgccatggaatcgggtgctccaagtgggccatttttggtaagcagaccgagatcgggagggcgaccttttccctgttgcatcccttgacgaatatgctgaacaggctgtacagaaggatgagtctgatgaagaagatgccagggattttgtgaaagattaacttggcaaggtttggtactgtaaaaggatatttagttttgtgcgcggacgctccttcggggtgttctaactcagcggagaaatgccaacacttgttttagcagagatatatatttct

SEQ ID NO: 36129 - DNA, 846 bp, Triticum aestivum
  unsure (1)..(846): unsure at all n locations
  Clone ID: PAT_TA_36129
aagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatggtgcggctgcttcggtgagccgtgccacggaatcgggagctacctcgccaacttcaacgaccacctcaccggccacctcgacgaccgtcgcatctccggcctcagcggcatccgcgtcagggctttcttccgctggtggtccatcaccgggatccgcgccgatggagacgagcttgtcttcgaggtgggctccgtctccgcccaagttccccgcccgccacttcaacgccagcctcgaatgccccgccaaggccgactcgtagtactataacaaggaactcttgcgtgcctcatgacactggcataccatcaagtcgccttgacgtcgagcactatgattgtttttaatctctcactgcctttgtaattactacttgtgtataagtctggatccctaagccaccactccactttcgacaccaagaaagcgggataatgtaaaggttcttctttgctcttttgtggaggcttgtcgtaataatccnggaac

SEQ ID NO: 36130 - DNA, 585 bp, Triticum aestivum
  Clone ID: PAT_TA_36130
aagacacgtggtatgggagccgggcgcaagctcaagacccaccgcaggaaccagaggtgggctgacaaggcgtacaagaagagccacttgggcaatgagtggaagaaaccctttgctggatcgtctcacgccaagggcattgtcttggagaagattggtattgaggccaagcagcctaactctgccatccgtaagtgtgctcgtgtccagctggtgaagaacgggaagaagatcgctgcctttgtgcccaatgatggttgcctgaacttcatcgaggaaaatgacgaggtactgattgctggattcggtcgtaagggtcatgccgtgggagatattcccgggtgtcaagttcaaggtttgtcaaaggattttggggggggcgctttttgcttcttcttttcacgggggaaaaaagggggaaaaccccccgggctttttaaataggcgttatttttgtgtttgggcaaagggtttggaaaatggccccttgtgaaggggttttgtgtgtctttaaaagaaggggaaaaaaaatgccccccctctttttttttacaaaaagggtgccctcttttttaatcccccgaa

SEQ ID NO: 36131 - DNA, 655 bp, Triticum aestivum
  unsure (1)..(655): unsure at all n locations
  Clone ID: PAT_TA_36131
gccgggcgactgtttaccaaaaacacaggtctccgcaaagtcgtaagaccatgtatgggggctgacgcctgcccagtgccggaaggtcaaggaagttggtgaactgatgacagggaagccggcgaccgaagccccggtgaacggcggccgtaacaataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagctttactgttccctgggattggctttgggcctttcctgcgcagcttaggtggaaggcgaagaaggcccccttccgggggggcccgagccatcagtgagataccactctggaagagctcggattctaacctctgcgccatccacgccaagcgcgtcaccatcatgcccaaggacatccagctcgcaagacgcatcaggggagagagggcctagattcgtctgcttccttcccagtgtctgtactctgatctgcaggtgtagagatcttgttgtgattccccgttccagataatgttatgttctagtgtctgatgttaccatcttgntgtcatcaaaaaaaaaaa

SEQ ID NO: 36132 - DNA, 849 bp, Triticum aestivum
  unsure (1)..(849): unsure at all n locations
  Clone ID: PAT_TA_36132
gatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgccccgtgtgtcccgtgtcgtgtcgtcgatctaaataagagagtcgtgtgtcgtgtcttcccctggtccgtccgatgagatctccgtggttggtttaggagggttttaggtggactctttgggccgctgggatctgcgtccggcggccttggttatcttcctgtgtctgctgctatcttaaccgtttgaaatgagatgaaactccgctatgaantaatccgtaaaaaacctggcccggggcggnccnctccaanccggccccgggggcaaggttncaaggaatgggccgcaanttggtatggnggggtttt

SEQ ID NO: 36133 - DNA, 498 bp, Triticum aestivum
  unsure (1)..(498): unsure at all n locations
  Clone ID: PAT_TA_36133
ctgccctccccttctccttaggttaggttaggctaggggcttcgcagagctcgcggaaatggtggccttcaggttccatcagtaccaggtggtgggtcgcgcgctgccgacgcccggcgatgagcagccgaagatctaccgcatgaagctctgggcgaccaacgaggtgcgcgccaagagcaattctgggtatttcctgaggaagctgaagaaggtgaagaaagagcaacggcagatgctccgccatcaacgagatcttttgagaaagaacccaaccacgattcaagaactatggcatttgagctgcgttaccaagagcaaaacccggtaccacaacatgttacaaggatacccttacaccacactgaatgggtgccgttgagcaaatttcactgaaatggctctcgccaacgtgtgagntnccctgcatcagttatcaagaccgcgacgtcaactcaantatcaagagagacaacacaagcattcacaactccaagt

SEQ ID NO: 36134 - DNA, 422 bp, Triticum aestivum
  Clone ID: PAT_TA_36134
cgcatgatccacaactaatatagaagatgcatttccatcccatctagtaggtgctgactcgatgcaaacaaattaaataaaattagtaggtgttgactgctcacacaccatatatgttgaacgatgctagctgatgtaccaatgtgatgttgcttgcttgattgatgactggttgtcattaactagaaaaaagaataagaaaaccttgtcaatttatttgaggagaatccttatcccattcattagacaaccattactactacttgtatttgcatgtttgcttgcttgcttgcttgtagcactatcaagtgtggggaaatccactactaagatgtgtggagctgggacgctgttggatcattaacacttgtagcactaacaagtttgtactgattgcagatagaaaaccctgtgattttttc

SEQ ID NO: 36135 - DNA, 650 bp, Triticum aestivum
  Clone ID: PAT_TA_36135
cggccgctcgagccggcgggccgggattgcagtgaatcccacccacagcgcagcagcagccagatccctctcctccgtcggaatggcccgcaccaagcagactgcccgcaagtccaccggcggcaaggcgccgcggaagcagctggccaccaaggcagcgcgcaagcccgccccggccaccggcggcgtgaagaagccccaccgcttccgccccggcaccgtcgccctccgggagatccgcaagtaccagaagagcacggtgctgctcatccgcaagctccccttccagcgcctcgtccgggagatcgcccaggacttcaagaccgacctccgcttccagtcctccgccgtctccgcgctccaggaggccgccgaggcgtacctcgtcggcctcttcgaggacaccaacctctgcgccatccacgccaagcgcgtcaccatcatgcccaaggacatccagctcgccccccgcatccgtggggagagggcctaggtcttggttcgccggcagtactgggtagtagctgctcttgtcctgtgatcctggtgtgtgtcgggtgcttctgtttgttggtgttgatatgatgtgtcgtctggtcctatgtatgctgatgctcgaatgaaattgcaatggaaagttcagtgttacc

SEQ ID NO: 36136 - DNA, 422 bp, Triticum aestivum
  Clone ID: PAT_TA_36136
cgtccgcttcgctcaccgaaatggcgaaaccctcccaatcgcgcctcctcctcgtcttccccgtcgccgccgtcctcgcctctgccttcctcctcccgctcgcccgctccgacgcctccgggcccacccccaccgccaccgcctacgacgagctccgcctccgtggcttcccgcgcggcctgctcccagccaacgttcgcgggtacacgctcgacgctggctcgggggacttcgccgtcaacctcgactccagctgccgcatcgtgctgccggcggggagctacctcgccaacttcaacgaccacctcaccggccacctcgacgaccgtcgcatctccggcctcagcggcatccgcgtcagggctttcttccgctggtggtccatcgccgggatccgcgccgatggagacgagctcgtcttc

SEQ ID NO: 36137 - DNA, 707 bp, Triticum aestivum
  Clone ID: PAT_TA_36137
gagagagagagagagagagagagagagagagagagagagagagagagagagagagagagagagagagagagagagagagagagagagagagagagagagagagagagagagagagagagatgggagctgggcgcaagctcaagacccaccgcaggaaccagaggtgggctgactaggcatacaagaagagccacttgggtaacgagtggaagaaacccttcgccgggtcctctcacgccaagggcattgttttggagaatattggtattgaggccaagcagcctaattttcccatccgtaagtgtgctcgtgtgcagcttgtgaaaaatggaaaaaaaattgccgccttcgttcccaatgatggttgcctgaacttcatcgaggagaatgacgaggtgctgatcgctggattcggtcgtaagggacatgctgtgggagatattcccggtgtccggttcaaggtcgtcaaggtgtcaggtgtttttttgcttgcccttttcaaaaaaaaaaaggaaaagcccaggttttaaattcccgttgcatggagtagacagtatgtcgggcctttaaatgttaaaggaggatggtccctttgtgtttacagcccttttaagttgataacttatgatcgtgttggtgaaaactatcccttgtcccattttgcccctgttatgggaaagggctcctgttatgagttttgttccccc

SEQ ID NO: 36138 - DNA, 777 bp, Triticum aestivum
  unsure (1)..(777): unsure at all n locations
  Clone ID: PAT_TA_36138
ctcgcctccaccgcctcctgtccctcgcgcgtnnngnntcccagttgcggctccgvgtcgttcccctcctcctcggttgctgagatggccggtcgtgggaaggcaatcggcgccggcgcggccaagaaggcgacgtcaaggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacacgtatcgtgccccgccacatccagctcgccgtgcgcaatgacgaggagctgaccaagttgctcggcggcgcaacatcgccagcggcggtgtgatgcccaacatccaccagcacctcctccccaagaaggcctcttcctccaaggcgtccaccgtcgatgacgacgacaactgraggccctgacctttccttcgctgcaaccgcccgawmthtggaatacatttgcatcacaaagacgagtttcttgtttcgtargatttagtgtcttccgttttcarggagagtcctyggatggctttggtattarggagaatttytagttggtgggtcgggattagttgctttcatcccatggstggtgaatattgggaaammaaattttcggggkggtttaaactcavatgttaagggtgcyttgattttattccgggtttccaygggttgaagaaattkaaaggga

SEQ ID NO: 36139 - DNA, 668 bp, Triticum aestivum
  unsure (1)..(668): unsure at all n locations
  Clone ID: PAT_TA_36139
gtgattttggctcgatcatgccctggagtggtctgatttttcatccaaagccggttagcgggggcgttatcctctttggatcacctcgttcctgtatgacaccctacctctccggggtgttgttgggtggcgaccagacgaccaacgttcaaggctcttctccttgcttggtcagatgaagatggaagttgaagtcctcctccttgctggttttgctgatgagtttggtgaaggggccggttggtggggacctccaatggctgccgttgtggtgctgcaagcttcgtgctcttggcgttgtcttggttcatctttgctcaatgatgctgcaagatgcctccccaacttgctaatcgttcctgaattttcatggcgganctcctantcaaggttcgtgcttgtcactcgttgattgtggatgctcctctgttgcaccgtggttttcggtacgcacgccggtgcggtgcgttangccgcttgccaagtcttggtattgtgatccttcnacnactcccctcatctaattgtgcctttcgtgggttgtccttggtctcttgttacngttttccaaccggttttccacataaactggatcaatcttatggcattaaaggccacttttgaaatatattccaggttgggaatctttccccccggtgaacattttc

SEQ ID NO: 36140 - DNA, 699 bp, Triticum aestivum
  unsure (1)..(699): unsure at all n locations
  Clone ID: PAT_TA_36140
ccgccgccgcctgatagctccagcgccctcgccgtcggctgcccggctgccgtcctcccgctacgagctaggcatctccttcgccgatccagcatgggtaagacacgtggtatgggagctgggcgcaagctcaagacccacaggaggaaccagaggtgggctgacaaagcctacaagaagagcatcttgggcaacgagtggaagaaacctttggctggttcatctcacgcaaaagggaacgtcctccgaaaagatcggcatccgaggccaaagcanctaactctgctatcccntaagtgtgcccgtgtcccactgggtgaaagaacggtaagaaattgccgcttttgtgcccgaacgacggtgcttttaactacatcccaggaaacgatgaagtgctgatcgcgggttccgncccgtnaaggcacgctgtgggaaatccccgtgtcctttcaaggtngtgaaggctcccggcttccctggtcccttnaaggagagnaaganaaccgagnttttaaaacctancccctcncanaaangacaagtatgcttggagtncgggactcatgtgagaactacgaatgtttcaaatttgttnaaaatcgaattantcaaacgtancgcttcattctgntcgngtaaataccttcctgaaaaaaaaggggccggccatttcccaaaggncntaccccaaggcgtctt

SEQ ID NO: 36141 - DNA, 742 bp, Triticum aestivum
  Clone ID: PAT_TA_36141
ttgaaatgttatttcctgtgacttctccaattccaaatgtcccaaactggagtattgaaggattaatttctcatgcgaaaattctagaaaagaagccaattgagcaacggcaccttcaaagaagaaaagctttgatcaagtcaaaggctgatacggcattcaagcagaaggagtataagatagcaacaaagatttatgatttggcaatagctcatggggagagtgcaacactgtatgcaaacaggagtgtttgtaaactgctcattggtgatggtgaaggtgctttgtcagatgctctcatgtgcgaatgctgcgacctgattgggcaaaagcttgctaccgtcaagctgcagctcacatgctactcaaggagtatgaacaagcccgtgatgctctcctggacgcacacaatttagatcctgggaatgccgaaatcgagggtgaactacagaaggctagggagctcatgaagaaccctcctggcgaatgtgagcagtgcacggattccggggatgcaacatgtgccagttttcactaaactagagcaagcaggaccttctaatccttatgttctgctaggaaccaaaactcttgaattcatgtggagctacgtcttcagactgctagcacggcttgtatgaatttgtcttgtctggcctgtggatcttactggccgtattcagttcctttacatttggccagacttattatctttcatgtgccaggttcttctataagtcct

SEQ ID NO: 36142 - DNA, 884 bp, Triticum aestivum
  Clone ID: PAT_TA_36142
ctcaactccatgtccatgcacctcggaaagatcgtcggatgctgtgatcgacggcctgaacagcaagacccacatgaagatcctgctgaagtggatgtggggcaggaggatcatcaagctcttgtgcacgtagcgaggagctgctcttcgcctcgccttgcgctgatgaaaaataccagtgctttcattgctaataatacacgcatgctccacaactaatatagaagatgcatttccatcccatctagtagtaagacacgtggtatgggagctgggcgcaagctcaagacccaccgcaggaaccagaggtgggctaacaaggcatacaagaagagccacttgggcaacgagtggaagaaacccttcgctggatctgtacatcagctcccatgatgttgcattagctataatctgtactgctaaaagaggagtataaactggagtaattttttcagccattatatttgttttcttttgggctgatgctctccactggagtacagctgggtactgcatctctttttgcattccttttttagtcagtccttgaacattttttaaaagatgaactagagtactcctggagagcagtacatggagtatagctgtaacttcttgcagtatagctgtagcagtccattaagagtagttttgcataagtagcattatgagtgtgatgtggaggtaagagtggagtctctactctagaaagagggctctgaatcgctgtttagcccattcgatttctgtggtttccagtttagtgtaggaacacagagcaatgtggctggagtttgattttcagtcggcatagtctgcctatcctactgatttgttgcacgtaattagaatttgtaggtttagtagaacgttccttaatccat

SEQ ID NO: 36143 - DNA, 503 bp, Triticum aestivum
  unsure (1)..(503): unsure at all n locations
  Clone ID: PAT_TA_36143
atctcggcttcctctccaagccacgcgacgcgagaccagagctccggccatggcggcgacgatccagtccgtgaaggcccgccagatcttcgacagccgcggcaaccccaccgtcgaggttgatgtgtgctgctcagatggaacctttgccagggccgccgttcccagcggtgcatcgactgggtgtctatgaagctttgggagctgagggacggtggatctgactacttggggcaagggtgtttccaaaggctgttaacaatgtgaactccattattgcacccgctttgggtcggcaaggaccctaccgctcaaactgactccgacaactttaagggtcaacaacttgatggaaccaagaatgagtggggtttggtgcaagcaaaacttggtgctatgcaacctgctgtataacaactgtttgcaaactggaccatgtcnagaaatccactgtacaacacattgcaacttgctgggaacaacangtgtttcccttccggctt

SEQ ID NO: 36144 - DNA, 1085 bp, Triticum aestivum
  Clone ID: PAT_TA_36144
ggtgcgagtcgacgggttctgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatgacgcggctgcttcggtgagccgtgccatggaatcgggtgctccaagtgggccatttttggtaagcagaactggcgatgcgggatgaaccggaagccgggttacggtgcccaactgcgcgctaacctaggacccacaaagggtgttgatctgcctctgaaggtgtttagagacgctggaatacatggtcatgcgtttctcactgctgggaatcttgcgaaactgtcggagggccagtacaagaacttctcgcttgatgaattccgccgttcgtttaggagcactgctggcgtcggcattattttgccaactaaactgttccgggtggaggtgaactactgctacattctgaagcagtctcagcacgacagcgggaagacgggaatccagttcagcttctcctcgccctagtagagacctgccaccaagtgtcctgcagtcgacgtggcatcccttctgctcttttctttcacgacgagtacctgctggacaagcgtatttgtgttttcagccttgttttgggcaccgaggagcctggaatatcttacgtgctgttcggtttttttgcacatcttccggaagagttcagttcgcttcccttgttaacactagtgattgtcgtggacatgcctatgtaactgaaataccgatgctgcgatggggatagaacaataatttaggcggacgagaa

SEQ ID NO: 36145 - DNA, 607 bp, Triticum aestivum
  Clone ID: PAT_TA_36145
catgcatcctgagattgctatggaaaaatacatgaatcttttgtcagaatttcttcctggatggatgggagacacaaccccgagcacagagaaacagaaagttgatgttgattctgaaggggcccttttaacaatgactactcatacaagtgacccacagatcaatcaagggaatgaaggtagtactagcatagatgaaggtccactaacagttcctcctaaccccgaaaaagggcagagctctgacgtccctaccgaatgaacgtaacggtcatcgagtatttcttgcatcggtgatgtcagcgcattgctgagatcgctgctgatgccttccccataagattaggtttgtacagtgtttgtggttgtgctaatattagtgctgtaatgggtgttggtacgtgtaatgtatatgactgtatatatatcccacaacgaccgcctgctgcctgtatatcggccagtatcaaccttatcgtcaggtttagtctgtgtaaccgcatctatggtaaagcggtaatttgtatgccatctcgctgtttgggatgagaaattaagtggttgaagaatggataatcctacgtccaaaaaaaaaaaaaaaaaaaaa

SEQ ID NO: 36146 - DNA, 394 bp, Triticum aestivum
  Clone ID: PAT_TA_36146
caagcaaactaacgcaaccacgcaattggtttacagtagtagcacaacacaatgggcagacatagctgtatcagacacaccaccacaagacctgctgtgtgcgtcacaattcttagcagcgaccgttacgaccgtgcaatgcaagattgctagcgacaaggatttgaggaggacaagacggtagctatcgacaaagattcaagaaggaccagatgccactatggtggttgtaatattagtcgagacgaatctgaaaaaattgagttgagttgttgagatgtggagatatgatggattttgcacaaaaaaaaccagtaaatttttgctacagagaacatatcggtgtgcatgtatcgattgcacttgcttcatagcgcaatacgtttatcctgct

SEQ ID NO: 36147 - DNA, 501 bp, Triticum aestivum
  Clone ID: PAT_TA_36147
ggtggaagtcgttcttctcgtccgggtccgtggccatgtacatggtcctctactcgatcaactacctggtgttcgacctcaagagcctgagcgggccggtgtcggcgaccctctacctcggctactcgctcttcatggtcatcgccatcatgctggccacgggcacggtcgggttcatctcctcgttctgcttcgtgcactatctcttctcgtctgtgaaggccgattaagttcctcctacctgcgaggagcgaccattgaattgagaggtgagtaagcatagtggagtgggcattggaaagagtttgtagtcatcatcacagtcctagttcatccatcccaacttttggtatacatgtcctgaataactatttgtatggtctaagtaggattcgcccgcggtgggctttatgatgaggtgcaggcagcttgcacgatgtaatagaatgaattggtttattcacatttactgccattttagctgatcaaaaaaaaaaaaaa

SEQ ID NO: 36148 - DNA, 410 bp, Triticum aestivum
  unsure (1)..(410): unsure at all n locations
  Clone ID: PAT_TA_36148
ttcgagcggccgccccgggcaggtactgttctcaacccattagcttcagataagttcaattttttgctctgccacccaggattnttttggacccagttgtacgtatcctagaatttgggtatcttcgacatgggagccctgctgtaaacgaattgataggtaaaaagctgaaacaaaagagagagccttttatttcttttttaaacaaagaataaatggatgattcaactctgaagacaaaaaaggcacgtttgtatccagtatagctgttgctgtttaatgaagaatggagtgcttgcccggtgaaaacttagagtaaacaggcaacacatggtttgtaaaaaggtttattgtatttgtaaaacatacgacgatgtaacaatcaattgaatatagtatgcttctttcat

SEQ ID NO: 36149 - DNA, 768 bp, Triticum aestivum
  Clone ID: PAT_TA_36149
cggcacgagggcgaactcccggcccctttcctcccatccccttcccttccccaaggacgggacgcaggtaggactgtagcaccggcagacgggcggcggagctcccctttgtccgtggaggtctctctctgaaaagacatgacctaggcctccacattgggaaggtgagtagcaaccaagcatggcgtcaagggcgatcattaggagaagaaagtatctcttggatcatgttaacacacctatcctctcgtcttcctcctcttcattccgccatggaacatttggtttcaagcctgagccaagaatagcacaaccatttcttgagcaaagcttaggggactcgaagtctgagaaggagaaggagcaatatagtgtcgatttgacaaaggggggtctgctaggtcctgataacgggcttctgcgacgtccagctcacgtgatttctcactatggctatggaattggaaggaatgaattcacattgcctttcggagctagaggtttgttgcagtcagttcgcaaagcatcaactgcaactgctgggcaacctaaattggatattgaagaacagggtgatgaaaaccagaataaaaggaaaaaagaggcatccccagaagaatgtgatcaggctgtggaagggctaagcacggcaaaagctaaagccaaagctaagcaggtgcaagattcgctaaaggctgaccagtcaatcgtaaagaagttctgggcaaggcttctgggtattggtccggctcttcgagctgttgcttc

SEQ ID NO: 36150 - DNA, 990 bp, Triticum aestivum
  Clone ID: PAT_TA_36150
cccacgcgtccggaagatttggctttaaaggaaatgactgagcctactgctagggaagaagaagaactgatagaggcaaaacaacatgacaaggaacagctctgtaatatcagtcgagcattggctgtgctggcatctgcatcgtctgttagcaaggagcgtcaagagttcctgaaccttgtcaacaaggagataaaactatataactccatgcttgaaagagaagacacagagggggcagaagaagctaagaaggcatatatggctgctagagaggagtcagacgacaccacagaggttgcttcagaggaaaaggtctcgtcagcgctgattgacaaggttgatgctatgcttcaggagttagaaaaggagattgatgacgtggatgcacaaatcggaaaccgctggcaactgcttgatagggatcatgatggcaaagtgactcctgaagaagtagcagcggcagcagcttatctcaaggacaccatagggaaagaaggcgtccaagagcttatcagcaagctttctaaagacaaagaaggaaagatccgtgtggaagacatcgtgaagctggcgtctcaagccgaggaaaacaatgaagatgatgaagaagaagcacggcattagtcgggaacacacttgatgacttttttgcgtgttgagatgggtattccagttcaggcaggaactttgagtatctcagttactccgtagcagtgcggcatgtatagatcagaaggcaagacggccattcttgcttccctcttggcagacctcgataagaaccaccagtaattcgtaaggataacttactgtgaagatgacaacttgcatatagtttgggttcggcctaatggatccgcaggtaaatggcaaccgaaatttcaactggttgccatgggagagaaaatactgtttttggttggtcacgggattcgccactctactcaacaatctgagaatttaataagatatacttcaacttctgag

SEQ ID NO: 36151 - DNA, 474 bp, Triticum aestivum
  Clone ID: PAT_TA_36151
gcggccgcccgggcaggtttttttttttcaacactctttagttattgctaccaacagtcaaaactcacatcaaaatggtatgcagcgaccagccaaaattacattggcaaagatgctaagtatctattcacgcactctacagaacggccgagaatttacaaggcaaaactgacgcaacagaaggatcatactgttgctcagcaagtctacgcgttcccactttatctctgactatacgagcagttggatacagtatacgacctagcctaactcgcaacgcctattgctttttcgtttgtacatatgacatattccacccatttgcttcagtacctcggccgcccgggcaggtttcttgtcctgtgatccgggtgtgtgtctggtgcttctgtttgttggtgttgatatgatgtatcgtgatgcttgactgaaattgcaatggaaaagttcagttatcatgctaaaaaaaaaaaa

SEQ ID NO: 36152 - DNA, 572 bp, Triticum aestivum
  Clone ID: PAT_TA_36152
gcaccaccggagccggaggaagagaggaagggagaagccaacaggtaacgatggtgtccggctccggtgtgtccgcgcgtcgcgtggtggtggatgcgcgccaccacatgctgggtcgccttgcgtcgatcgtggccaaggagctgctcaacgggcagcgcgtggtggtggtccggtgcgaggagatgtgcatctccggcgggctggtccgtcagaagatgaagtacctccgcttcctccgcaagcggatggaactaccatgaaactatcaaggaactggaggagaagagaaaggagaaggctaaggtgtcgtacgacaggcaggaagcaactggccaagctgcgcgtcaaggctgagaaggctgccgaggagaagctgggttctcagttggacatcctggcaccaatcaaatactagtgtgccccgcagtcatgcatcgtctgttttgctggataatggtggttattgtttacgttattagtagcctgagagtgtcgttgagatttgaaacctctgaatatctatactcttccaatctttgtagcaaatggattgtttggtaaaaaaaaaa

SEQ ID NO: 36153 - DNA, 614 bp, Triticum aestivum
  Clone ID: PAT_TA_36153
ttcggcacgaggctcccagctcgcgctccctcgcccagctgccgccgccgccgcctcgtcggagttcttcctacccctttcgccaacatgggtaagacacgtggtatgggagctgggcgcaagctcaagacccaccgcaggaaccagaggtgggctgacaaggcatacaagaagagccacttgggtaacgagtggaagaaacccttcgccgggtcatctcacgccaagggcattgttttggagaagatcggtattgaggccaagcagcctaactctgccatccgtaagtgtgctcgtgtgcagcttgtgaagaacggaaagaagattgctggattcggtcgtaaggggcatgccgtgggagatattcccggtgtccggttcaaggtcgtcaaggtgtctggtgtgtctctgcttgccctcttcaaagagaagaaggagaagcccaggtcttagattgccgttgcatggagtagacagtatgtcggcctttagatgttgaaggaggaggggtggttcctttgtgtttacagcacttttaagttgataacttatgatcgtgttggtgaaaactatgcctttgtcacattttgctcctgttaagggaaagtgctact

SEQ ID NO: 36154 - DNA, 630 bp, Triticum aestivum
  Clone ID: PAT_TA_36154
agcacataataagaatcaaacaacgcaacctctgcgcgcgagagatcgacacatccatcggaatcacaagacagagatgagctcgtcggcggccaagaagggggcgtcgctggtggcggcgacgagcatggcggccgtggaggcgctcaaggaccaggcggggattgtgccgctgggactacgcgctccgctcgctctaccaccgcgccgtcccggcgtccctatcctcctcctcccagcacgccgggagcggcagcgcggcggccgtcggcagggctgcgcggcccaggcgatccgaggaggagaagctgcacaaggcgtaccacatcgtctgctggggacccaactgaactgattgtaatagccaaactgattagcactaataagcacattcgtgttctgcttctccatttctattccttcccatcttggttatccgtgaacggtgtgtaaaccgagatataagcatccacggtttgtaaatcgagatatatgtttcaaggtgtgtcatgcactcggccctctgatctgaggcgagctgccaagtgatagatgaggcaaatataaggaaatggcattgttcctgttctgcacaaggaacaactacctcttcgctctaaaaaaaaaaaa

SEQ ID NO: 36155 - DNA, 960 bp, Triticum aestivum
  Clone ID: PAT_TA_36155
aaacagccaaaataaggatagtccatacctttaacaacaaatccaccaaattatgaatgtcaagatggaaatcaatttacaatttgaccaaactattgaattccccaatcaacaacatatcaaagcaaaaattggcctctcaccaaagcaataacatttcgatatgccagcaagtcaccatatacaacaacattgttacacatatcctacaaatcatttctattgtatactgctccccgatatccatcacatggtcatgcttcttacggtcatctttttcaaagtgctaacagatctgtaaaacaacttgaaattacgtccaactttgtcctcttttaaatgctctaccctctccaataaagggagtagttcatcggaaaatgaaaacaagtcttctgcacaagcttgctatgcaggagttcatgatccttcctactggagctacctcattcaaggaggcaatgaagatgggcgttgaagtgtaccacaacttgaagtctgttatcaagaagaagtatgggcaagatgccaccaatgttggagatgaaggtggttttgctcctaacattcaggagaacaaggagggccttgagctcttgaagactgcaattgaaaaggctggatacaccggcaaggttgtcattggaatggatgttgctgcttcagagttctacaaaaacaagtgcagagtggtgatcatgtctcggatgcagatcccatctagtatggctccaccggtgcacggaacttgaggccggcatacacagcggcagcgcccagctcctcctcgatcctcagaagctggttgtacttggcaagccgctctgagcggcagggagccccagtcttgatctggcccgtggacaaaccgacagccaaatcagcaatgaatgtgtcctcagtctcaccactcctgtgactggtcatcacaccccaaccagcatgttttgacatcttcac

SEQ ID NO: 36156 - DNA, 761 bp, Triticum aestivum
  unsure (1)..(761): unsure at all n locations
  Clone ID: PAT_TA_36156
taccacaacgccatgctccgcatcgcgctcgaccagcctccagcgccgccgcccggacgcccgcatcatctacgccgactactacaccccctacatccagttcgcccgcacgcctcacctctacgggtacaagaggggcgccctgagggcgtgctgcggcggcggcggcccgtacaactacaacatgagctcgtcgtgcgggctgcccggcgccacggtgtgcgacgaccccgacgcgcacgtcagctgggacggcatccacctcaccgaggcgccctaccgcttcatcgccaacacctggctcaagggaccctacgcgtacccgcctctcgccagcgtcgtccgcgacgacatggtctattaacttaactactgttattaacacacacacatgatgatcctccatgactaaactacaccatacgtccgtccgctttctctctctacgtgtgaaccacgccttcatacaattccgtgtgcgtgtgtgcctgcgtgttttggtatgtaatatgcttagtaagttacataggccgtgtcacgggaaggtgacctccaatctttttgacgccgtgtgtgcctgtcttgatctgagttggggacattgtaatccttgggttgtacattgggcaagtaaatcgattaagttttttgctgttgttgttgtgtttggctgtaaattgtgagatgtgttctccgtgttaccgatgaaacaatcccttcttcgaaacaatataacaaacatttcngngaaaaaaaaaaaa

SEQ ID NO: 36157 - DNA, 370 bp, Triticum aestivum
  Clone ID: PAT_TA_36157
ccaaggtgcgtggtgtggccatgaaccctgtggagcatccccacggaggaggtaaccaccaacacatcggtgacgcctgtactgtccgccgagacgctccccctggccagaaggttggtctcattgccgctaggaggactggaaggctcaggggtcaagctgctgccacagcctccaaggctgacaaggccacctagagttattgtcgttgtttatctgtctactgtgctttagattgttaaaggacatgtgtttcagaacggatgtgttgttgcctcgtactatggtgaaacattgtctcagtttttgtggtcgctgtcaggattttgcattatgcctaaagatgtttactttggataaaaaaaaaaaa

SEQ ID NO: 36158 - DNA, 771 bp, Triticum aestivum
  Clone ID: PAT_TA_36158
atccacatcaatccccaatcctcaatcccccaaacaatccaccaagcaaacccgatggcccgcacgaagcagacggcgaggaagtccactggcggcaaggcgccgcggaagcagctggccaccaaggcggcgcgcaagtcggccccggccaccggcggcgtgaagaagccgcaccgcttccgccccggcaccgtggcgctccgggagatccgcaagtaccagaagagcacggagctgctcatccgcaagctgcccttccagcgcctcgtcagggagatcgcgcaggacttcaagaccgacctgaggttccagtcctccgctgtgtcggcgctgcaggaggccgccgaggcatacctggtggggccgttcgaggacaccaacctctgcgccatccacgccaagcgcgtcaccatcatgcccaaggacatccagctcgcaagacgcatcaggggcgagagggcctaagattcgtctgcttccttcccagtgtcagtactctgatctgcaggtgtagagatcttgtgttagcttcttcttctcagcatgtattgcgtggtgaactggtctggtgtcgtggtaggaagattcctcgttccagctaatgttatgttgtagtgtctgatgttaccatcttgttgtcatcagcaatctgaatgaaagttgtctatcagatctatgtccattttgtgttcttgtgacagcgttttgttgttcgtaatcctgaaatgtcaacgaatggtttcttgctgaatctacggtgatttaagcccg

SEQ ID NO: 36159 - DNA, 650 bp, Triticum aestivum
  unsure (1)..(650): unsure at all n locations
  Clone ID: PAT_TA_36159
cctctcgccctcctctcgattcgatctcggcttcctctccaagccacgcgagaccagagctccggccatggccgccacgatccagtccgtcaaggcccgccagatcttcgacagccgcggcaaccccaccgtcgaggttgatgtgtgctgctcagatggaaccttcgccagggccgctgttcccagcggtgcatcaactggtgtctatgaagctttggagctgagggacggtggatctgactacttgggcaagggtgtttccaaggctgttaacaatgtgaactccattattgcacctgctttggtcggcaaggaccctaccgctcaaactgagctcgacaactttatggttcagcagcttgatggaaccaagaatgagtggggttggtgcaagcaaaagcttggtgctaatgcaatcctggctgtgtcactagctgtttgcaaagctggagccagcgtcaagaagattccactgtaccagcacattgccaaccttgctggcaacaagcaattggttntgcctgttcctgcattcaatgtcatcaatgggggatcccatgctggaaacaagcttgccatgccagagttcatgatcctttctactggagctgcctcattcaaagaggccatggaaaaatggggttgagtgt

SEQ ID NO: 36160 - DNA, 490 bp, Triticum aestivum
  Clone ID: PAT_TA_36160
caagcacacccgcccccggtgtgctctccatggccaacgccgggcccaacaccaacggctcccagttcttcatttgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttcatgcttctt

SEQ ID NO: 36161 - DNA, 1347 bp, Triticum aestivum
  Clone ID: PAT_TA_36161
cacccttgatggctcgggcttattgttgtacaagattggatgaagttctcatcatacaaggagcgcctacttggtctttcattgggtttgctttcaaccaggcaccatgatttatcttacaaccttacatggcgttccttgactgatccgtcacgccttgcgtcaacgtccataagaaggcagttagggcataaccttctatctgcattgaaatacacatacaagattgatgaaagggattcacatatcaggccaacaaaaggatatgcatttctctcgtcctctcaagttggtggtctttgggataacaaaggattgaaattttttcgccaggagtttgatgttcgtgctgccgtgccttttggattctggaacgctgctctcaacgttggtgtaggagcgggtgttgttttaccgctggcaagaggatttatgaattcgtctacacctgtgactgatagatttaacctgggaggtcacaattctccagtttgcagcctgggtggaatatcatccttgctcggtttcagaacaagaggagttggcccaacagaaccacggaggcttgtccctggcgagtcggaagatggttctcctgctgttccagggagggattacttgggtggcgatcttgctgtttccgcctttgctgacctttcctttgacctgcctctgaaggtgcttagagacgctggaatacatggtcacgcgtttctcaccgctgggaatcttgcgaaactgtcggagggccagtacaagaacttctcgcttgatgaattccgtcgttcgtttaggagcactgctggggtcggcattattttgccaactaaactgttccgggtcgaggtgaactactgctacattctgaagcaatcccagcacgacagcgggaagacgggaatccagttcagcttctcctcgccctagtagagacctgccaccaagtgtcctgcactccacgtggcatcccttttgcctcgtcgacccccttctgctcttttctttctcgacgagtacctactggacaagcgtatttgtgttttcagccttgttttgggcaccgaggagcctggaatatcttacgtgctgtgctgctcggcgtttttgcacatcttccggaagagttcagttcgcttcccttgttaacactagtgattgtcgtggagatgactgtttaactgaaataccgatgctgcgatggtggatagaacaataatttatgcggatgagaaatattggcgctactgtgactgtgtatcacccacttatcttgtgatttgcgagcctatttggcaattggaaaaaaaaaagcaagcaaatcaccgaaccatccgaacgtcacgaacg

SEQ ID NO: 36162 - DNA, 768 bp, Triticum aestivum
  Clone ID: PAT_TA_36162
gccggccggtccgggatccactccaatctccaatccccgacgcaatccaccaagcaaaccccagcctcgcccagcccccccgccccgatggcccgcacgaagcagacggcgaggaagtccaccggcggcaaggcgccgcggaagcagctggccaccaaggcggcgcgcaagtcggcgccggccacgggcggcgtgaagaagccacaccgcttccgcccgggcaccgtggcgctccgggagatccgcaagtaccagaagagcacggagctgctcatccgcaagctgcccttccagcgcctggtgcgggagatcgcgcaggacttcaagaccgacctccgcttccagagctccgccgtctccgccctgcaggaggccgccgaggcgtacctggtggggctgttcggggacaccaacctctgcgccatccacgccaagcgcgtcaccatcatgcccaaggacatccagctcgcaagacgcatcaggggcgagagggcctaagatggtgtctgcttccttcccggtgtctgtactctgatctgcaggcgtagagatcttgttgttagcttcttcttctcagcatgtgttgcgtggtgaactgatctggtttcgtggtaggaacattcctcgtcccagctaatgttatgttgtagtgtctgatgttaccatcttgttgtcatcagcaatctgaatgaaagttgtctatcagatctctctccattttctgcttttgttgtttgtcaaccttgaaaatcagcgaaaaaaaaaaaa

SEQ ID NO: 36163 - DNA, 570 bp, Triticum aestivum
  unsure (1)..(570): unsure at all n locations
  Clone ID: PAT_TA_36163
tcgcgctcccctcgccgcttccagctcgcgctcccctcgccgccgcagccgccgccgcctcgcctcctcggagatcttcgctgcccttccgtcaacatggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaaaggggcattgtcctggagaagattggtattgaggccaagcagcccaactccgctatccgtaagtgtgctcgtgttcagcttgttaagaatggcaagaagattgctgcctttccntgccaaatgacggttgtttttaactacattgaggaaaatgatgaggtcttgattgctggatttggtcgtaaggggcacgctgtgggagatattcctggtgtccgttcaangtcgtcaaagtttcccgtgtgtctctgcttgcccttttcaangagaagaaagagaagccaaggtcttagattgctcttgctaccaaaaatcagcaagcgtggagttgaaa

SEQ ID NO: 36164 - DNA, 511 bp, Triticum aestivum
  Clone ID: PAT_TA_36164
ggaaacacaaagttgatgttgattctgaaggggcccttttaacaatgactactcatacaagcgacccacagatcaatcaagggaatgaaggtagtgctagcatagatgaaggtccactaacaagtcctcctaacccagaaatagggcagagctctgacgtccctgccgaatgaacgtaacggtcatcatcgagtatttcttgcatcggtgatatcagcgcattgctgagatcgctgctgatgccttcctcataagattaggtttgtacaagtttttgtggttgtgctaatattagtgctgtaatgggtgttggtacgtgtaatgtatatgactgtatatatatcccacaacgaccgcctgccgcctgtgtatcggccagtatcaaccttatcgccaaggtttaagtcctgtgttaaccgtatctatgggtaacccggtaattgtatgccactcgctgtttgggacgagaattatggtttaagaaaaacctaccatctcgcactggaaaaaa

SEQ ID NO: 36165 - DNA, 686 bp, Triticum aestivum
  Clone ID: PAT_TA_36165
ggtccggattcccggtcgacccacgcgtccgcccacgcgtccgccccgcgtccgctcatcttcccctccgaccaccagagcgagcagccagatccgcagcccctccatcccaatggcccgcaccaagcagacggcccgcaagtccaccggcggcaaggcgccgaggaagcagctggccaccaaggcggcgcgcaagtcggcgccggcgaccggcggcgtcaagaagccgcacaggttcaggccgggaaccgtcgccctccgggagatccgcaagtaccagaagagcacggagctgctcatccgcaagctccccttccagcgcctggtgcgggagatcgcgcaggacttcaagaccgacctccgcttccagtcctccgccgtctccgcgctccaggaggccgccgaggcctacctcgtcggactgttcgaggacaccaacctgtgcgccatccacgccaagcgcgtcaccatcatgcccaaggacatccagctcgcacgccgcatccgaggggagcgcgcctaggctgttcgtcgtggtcgccggtaatactggctagtagctgttcttgtcctgtgatccgggtgtgtgtccggtgcttctgtttgtcggtgttgatatgatgtgtcgtctggtcctatgtatcgtcatgctcgaatgaaatggcaatggaaaagttcagttatcg

SEQ ID NO: 36166 - DNA, 988 bp, Triticum aestivum
  Clone ID: PAT_TA_36166
atgtatgcatccagttctttctccgaaacagaggagatagacaaaaaagaaaagttttgattgattcattctgacctcacctatccctactcatcatcatcatatttctacgtaccgcatcggccctgtgctacccacaaggccacaaactcaactagattacaggcagaccagaccaaaccccacaacaaggaaaaaaagaaacaccagcaccaacgagagtcaccaaacagaatacacagggagggagggcacgctgcccgtgcgttttccgaactttttgcctcggaagaagaagaaaaactgctccacgaaccaaccggggatgtacgacggcctatcgatcagatccaacggctatgccggcggcgaggtgaggtgtggtccggccgcttcagccctgcgactctatgggcgacatcatcgccgagaaccggcgcttctggatgcgcggggggaggtgcttgttgtacctcttgggcccaaccgtccacggcaggaacacgccggtgccgccgcgccccatcctcttgttgatgttgctggagggcgccatcaccattggcctcgccggcgcggcgaccatcatgacaggcgccgcgcgcacggccatgccccacgcaggggcgagcatggcctgtggcgccgggcagtagccaatgatggcgccgttgctgccatggggtggtttctgcatgccggccgttgccgcagtcgggggaggctgccagagcgtcatggccttggtgggcgacgggagcgggctgaggtccaccggcgtcgacggcctcaccctcacgaacgtgatgctcacgcggcggttggacgacgggcacacaacgtggcgcgccatgtccgcactgttcccgcgcatcaccagaagtgacccttgcttcagtgagagtgtgaggggtcccttgtagttgccattgctgtcagtgacaagtgaccttccaaatgccattgaggtctcagacagcctcgtgcc

SEQ ID NO: 36167 - DNA, 540 bp, Triticum aestivum
  Clone ID: PAT_TA_36167
tcggcacgaggggagatgcagtattcctagcatcctgctgatgctttcactgggggcagccctcctcatcgccggccacccctccgtcgccgacgaggcgagcgccattctcctgccaagccaagacaaagaccaagtggtcatggaagtcgaaatccgctaaggagtgtgtaacaactcacctgccgaatcaactgtgctccaacctgcgaggactgcaatggttatgtgcacccaccccgccgcgtttgcctagaccgttacaccggcgaccccgggcccaggtgcacggacgccggcgccggcggtaactgaactctacgtactactctacgcgcaccggttggacctaccggtatgcgaacgtacgccgtcgacgtgtgttactacatgaatggataattatgttgtgtgtggtcctgcatgcctagctgcttgctgtgcatgctgcctgtgtgtgtaataagaacgggtggcctttcatcaaaaaaataaaacaggtggcgtcggcctacgtacgaaaaaaaaaaaaaaaaaaaa

SEQ ID NO: 36168 - DNA, 591 bp, Triticum aestivum
  Clone ID: PAT_TA_36168
aagctcactgccatccgcactatctgatacgctcattcatcgctgcgttgctcgccggctcagatggctcttcaggcggccacttccttcctcccgtcggccctctccgcgcgcaaggagggagcggccaaggactcggccttcttcggcgttcgtctcgccgatggcctcaaattcgacaccacctccctgggcctgcgcaccaagagggtgaacacgtcgtcagttgccatccgcgcgcaggccgcggcggtgtccgcgccgaccgcgaccccggcgtcgccgtccggcaagaagaccgtccgcacggggcaacgcggtcatcacgggcgcgtcgtcgggcctcggcctcgccacggccaaggccctggcggagtcaggcaagtgggcacgtcatcatggcgtgccgcgactacctcaagaccgcgcgcgccggccagggcggtccggcatgcccaagggcaactacaccatcgtgcaccctggaccttggcctccctcgacagcgtccgccagttcgtcaagaacgtgcgccagctcgacatgcccatcgacgtcgtcgtctgcaacgccgccgtgtaccagcccacc

SEQ ID NO: 36169 - DNA, 1031 bp, Triticum aestivum
  Clone ID: PAT_TA_36169
aacttttggggattataccgcatcaaccactacatcatagaaacttaaagctttcttcgaaacaggagtgccatcacaatttgggtacatccccaatgatgttgcattagcgaggatcgtcccttcttcaggcctgaaattttccaggtcggctaacctcagggcctggccaccaactgcattggcaagagtaactgccttttcataggtacgatttgctactacaactcttgcacccttcttctttgctccataggcaattgccttagcagcaccaccagcacctacaacaacaataagcctgccagacaatggtgacatagcagcatcctttgaccccagacctcctatgccatcttcaatcttgaaatatgtaagaagcccttgtcgcttaattggacgtgggcattcgaatgtatcaacactagtgggccatttttggtaagcagaactggcgatgcgggatgaaccgaacgcgaggttaaggtgccagagtagacgctcatcagacaccacaaaaggtgttagtacatcttgacagcaggacggtggccatggaagtcggaatccgctaaggagtgtgtaacaactcacctgccgaatgaactagccccgcagaaggttcaagaggggtctcaagaggaagcccatggcgctcgtcaagaagctgcgcaaggcgaaaaaggatgctcctgctggtgagaagcctgagccagtgaggacacatctccgcaacatgatcattgtccctgagatgattggcagccttatcggtgtctacaatggcaagaccttcaaccaggttgagattaagcctgagatgattggccattaccttgcagagttctctatctcctacaagccagtgaagcacggtaggcccggtatcggtgccacacactcttcccggttcatccctcttaaatgagttgtgccgctttctactttgaaagaaatcagtacggaccatctgatggcatgtccatcgagctgtctcccttgttttgaaccagttatatatctagtatttg

SEQ ID NO: 36170 - DNA, 979 bp, Triticum aestivum
  unsure (1)..(979): unsure at all n locations
  Clone ID: PAT_TA_36170
aaaccctcgttccccactctcctctggattgccctcctcctccctcggcggtttgttcatcgcctctgctgaaaaatcaaacccaaaaccaagaaaggggggaaaatggctgaagccaactcgtacgaggagcagcgcaggaggcaggtggaggagaacaagcggaagctggaggagctgcgcctgcaccacctctccgccgccgtccgcgaggccgccgtcaagcccaggctgaagaggaaggccccgaagccacgggacgccgccgatgacgccccgccccggcgttccggccgtatcgccaccctccccgagcagcccgactatcgcgacaatgtaaagctgggcaccaggaaaccatggcagcagaaggaagtaaagcctgatcatgcgtacgccatcgccaaggccgaagagctacaggatgagctaggctccgactaccccacctttgtcaaacccatgccccagtctcttacctcgctgcatatcccggcacagttcagcatggagcatctccccgaccatggcatgagaatggttttggtggatgaggaggaggaggagtttaaggtgcgctaccgtccacacagtagcagtcttgtcgccgggtggagtgagtttgccgtcgacaatgagctggttgaaggtgattgcttggtgttccagctgatcaagagggcattgttcaaggtctacatattcagggcaagttcgtactatgaaaatgaccattaatgaagcagccggcaggctcctggttgcttcatgtcaacttctcttgaacttccacagttcagaaatccgcactatgtcaggggttagttatgtatgtatggcaactgtcaggcattattagaatctctcgtgtggctgcaagtcgtatggtaactgccggcatcttgtaaagtttgtcctgtgacggcaggtgcgaaacttgacatgtgatctccatcagattatatcccntcgattcctt

SEQ ID NO: 36171 - DNA, 241 bp, Triticum aestivum
  Clone ID: PAT_TA_36171
ttcggcacgagggtggaaatgtgcgtgctagtgtttgttcgtgtcgtggtcgatgtagtgtgtctgttctggagactggtgtagagatgttagcttcgtctcgttagcatgtgtctgatcttgcatcgtggtagggagatccctcgttcgtgccagtatggctgtgttatgttctagtgtgtactgtctgatgttaccctcttgttgccatcagcaatgtgaaagttggctcgcagatcat

SEQ ID NO: 36172 - DNA, 553 bp, Triticum aestivum
  Clone ID: PAT_TA_36172
agtattcctagcatcctgctgatgctttcactgggggcagctctcctcgtcgccgacgacgtgggcgccattctcctgccaagccaagataaagaccaagtggccatggcggcgcccaggccgtggaagtgctgcgacgtgaccatctgcaccaggtcgatcccgccgacgtgcagctgccaggacgtggtcgacaactgtgctccaacctgcgaggactgcaatggttatgtacacccaccccgccgtgtttgcctagaccgctacaccggcgaccccgggcctaggtgcacgggcgccggcaccggcggtaactgaactctacgtactactatactactctacgcgcaccggttggatcgtctacggttatgcgaacgtacaccgtcgacgtgtgttactacatgaatggctacttatgttgtgtgtggtccggcatgcctagctgcttgctgtgcatgctgcctgtgtgtaataaaaacgggtggcctttcatcaaaaaaataaaacgggtggggtcgggctaaaaaaaaaaaaaaaaaaaaaaaaaaaa

SEQ ID NO: 36173 - DNA, 984 bp, Triticum aestivum
  unsure (1)..(984): unsure at all n locations
  Clone ID: PAT_TA_36173
gacaaaaaagaaaaagttttgattgattcattctgacctcacctatccctactcatcatcatcatatttctacgtaccgcatcggccctgtgctacccacaaggccacaaactcaactagattacaggcagaccagaccaaaccccacgacaaggaaaaaaagaaacaccagcaccaacgagagtcaccaaacagaatacacagggagggcacgctgcccgtgcgttttccgaactttttgcctcggaagaagaaaaactgctccacgaaccaaccggggatgtacgacggcctatccatcagatccaacggctatgccggcggcgaggtgaggtgcggtccggccgcttcagccctgcgactctatgggcgacatcatcgccgagaaccggcgcttctggatgcgcggggggaggtgcttgttgtacctcttgggccccaccgtccacggcaggaacacgccggtgccgccgcgccccatcctcttgttgatgttgctggagggcgccatcaccattggcctcgccggcgcggcgaccatcatgacgggtgccgcgcgcacggccatgccccaagccggggcgagcatggcctgtggcgccgggcagtagccgatgatggcgccgttgctgccgtgaggcggtttctgcatgccggccgttgccgcagtcgggggaggctgccagagcgtcatggccttggtgggcgacgggagcgggctgaggtccaccggagttgatggcctcaccctcacgaacgtgatgctcacgcggcggttggacgacgggcacacgacgtggcgcgccatgtccgcgctgttcccgcgcatcaccagaagtgacccttgcttcagtgagagtgtgaggggtcccttgtagttgccgttgctgtcagtgacaagtgaccttccaaatgccattgaggtttccgganccggcgtggggtcgaccnccgggaattnnccggcaccggggtancctgcag

SEQ ID NO: 36174 - DNA, 556 bp, Triticum aestivum
  unsure (1)..(556): unsure at all n locations
  Clone ID: PAT_TA_36174
ccgcttcctcccgttagactaggttaggctagggtgtcgaccagctcgcggaaatggtggccttcaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactacggcatctggctgcgctaccagagcagaaccggctaccacaacatgtacaaggagtaccgcgacacaaccctgaacggcgctgtagaacagatgtacaatgagatggcttctcgccaccgcgtgaggtccccctgcatccagatnatcaagaccgccacggtgcacttcaagctgtgcaagagggacaacacaaagcaattcacaacagtgagatnaagttccactcgtgtaccgcaaggtcaggccgccgacaagaactgagacacntcaag

SEQ ID NO: 36175 - DNA, 688 bp, Triticum aestivum
  unsure (1)..(688): unsure at all n locations
  Clone ID: PAT_TA_36175
gtcaacagcgtggccctctaccacaacgccatgctccgcatcgccctcgaccagctccagcgccgccgcccggacgcccgcatcatctacgccgactactacaccccctacatccagttcgcccgcacgcctcacctctacgggtataagaggggcgccctgagggcgtgctgcggcggcggcggcccgtacaactacaacatgagctcgtcgtgcgggctgcccggcgccaccgtgtgcgacgaccccgacgcgcatgtcagctgggacggcatccacctcaccgaggcgccctaccgcttcatcgccaacacctggctcaagggcccctacgcgcacccgcccctcgccagcgtcgtccgcgacgacatggtctattaactagtaactcttatgttattaacacacacacacacacacacanacacacacacgatgatcctccatgactaaacgtccgtccgctttctctacgtgtgaaccacgccacgccttcatacaattccgtgtgcgtgttttggtttgtaatattatgcttagcacgttacataggccggtgtcacggggaaggtgacctccgatctttctgacgccggtaccggagaggcgccagcctctactgtcttgatatgatgagttggggcacattgtaatcataggttgtatatggcaagtaaatcgnattagg

SEQ ID NO: 36176 - DNA, 800 bp, Triticum aestivum
  Clone ID: PAT_TA_36176
gaggttgttttaccgctggcaagaggatttatgaattcgtctacacctgtgactgatagatttaacctgggaggtcacaattctccagtttgcagcctgggtggaatatcatccttgctcggtttcagaacaagaggggttggcccgacagaaccacggaggcttgtccccggcgagtcggaagatggttctcctgctgttccagggagggattacttgggtggcgatcttgctgtttctgcctttgcggacctctcctttgatctgcctctgaaggtgtttagagacgctggaatacatggtcatgcgtttctcactgctgggaatcttgcgaaactgtcggagggccagtacaagaacttctcgcttgatgaattccgccgttcgtttaggagcactgctggcgtcggcattattttgccaactaaactgttccgggtggaggtgaactactgctacattctgaagcagtctcagcacgacagcgggaagacgggaatccagttcagcttctcctcgccctagtagagacctgccaccaagtgtcctgcagtcgacgtggcatcccttctgctcttttctttctcgacgagtacctgctggacaagcgcatttgtgttttcagccttgttttgggcaccgaggagcctggaatatctcacgtgctgttcggcgtttttgcacatcttcgggaagggttcagttcgcttcccttgttaacactagtgattgtcgtggacatgcctgtgtaactgaaataccgatgctgcgatggggatagaacaataatttaggcggac

SEQ ID NO: 36177 - DNA, 1600 bp, Triticum aestivum
  Clone ID: PAT_TA_36177
gccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctcctacgacaggagaaagcaactggccaagctccgcgtcaaggccgagaaggcagccgaggagaagttgggaactcagctggagatcctggctccgatcaaatactaagagatatcagagctttcgtgcgccatcagttttgggaaacctctgtcgtattttaagtagtttggtaactctgatagtacaatctggttggtaaacctttgttatgcatgcagttctgcgacactcatttgaaattttctacatggtgaactgtttcgtttatcaaatgtgtgcatttggaaattctagtgaacgtcgtttttctctttgctacggcctttgcagtcccttgttatgacctatcgtgggaaatttttaagcgtgttttccctttgtacatgtcgttttgggccatcatagttgtctctacaccaagttggtaaagtctactgtcactgcggcaagttccatctatagaagcgggtctagtaatgtgtttttgctgggtattccttggtttgagctctgtatgtttaatgtacgtcgtctgtgtgtttgatgttgatgtcgcttgtggttttgcagggttctgaggctgcagcctgggcacaggtactgcctcctcggccagctctccaaggaggtcggatggaactacgctcataccataagatctgtagaagctgccgccgccgccgctgccgctgccgctgttgcaggtggaacaggaagaagccctcatggctgccgcacatccgaagtggcgagcgccaccccatttttttgggctgcgacttgatggtcatgctgctgttttgctctgcttgataattccaatcagatcattgtcaacactatcatcatcaggatctaatgttgttgaggatgctggtgctatgacagaagatcaaggaagcctcgagatccgcaccacagttttagttgatgttgctagtttgccaccatgttttgaatatttgatgttgttgatgttgctagtttgccaccgtgcatatgctattggacatgcaaacatgtatgtgatgttgtgaatatttgagcgaatgattctgtatttaataatttaatagagaatttttttctgttgaaaaaaaaaaaaaaaaa

SEQ ID NO: 36178 - DNA, 886 bp, Triticum aestivum
  Clone ID: PAT_TA_36178
cgtgcgctcctccctcctcctcctcctccgcgccgacccgccgccgtcgacagcgcgccccgacgcgatggcccgcaccaagcacccggccgtcaggaagaccaaggcgctgcccaagaagcagctcgggacgcgcccctcggccgggacgccgcggcggcaggagacagatggcgcgggcacgtcggcgactccgaggcgagccgggcgggcggcggccccaggggcggctgaaggggcaactgggcaacccaagcagaggaagccacaccggttcaggccaggcacggtggcactgcgggagatcaggaagtaccagaaatcggtcgactttctcatcccgtttgcaccatttgttcgtctgatcaaggaggtcaccgacttcttctgtcctgaaatcagccgctggactccccaagcgctcgttgcaattcaagaggctgcagagtatcacctcgtcgacgtatttgaaagggcaaatcactgtgccatccatgcaaagcgtgttaccgtcatgcaaaaggacatacagctcgcgaggcgtatcggcgggaggaggctttggtgatacttctggaagacgttttctgcatcataggggggaaagactctggtgatactaatgggagatgttttatgtattgggggtgcaaaggcagtgttcatagtggtccaatatgtttgactgtatcgttagaaagtattgtaggtgtatcttcatttagttagctttgtcttcgaagttgatctgattcgttacatgtttgggatcattcgacttcttcattcaggcattgttccatttgaattgattgtggatatgggattttaaatgacttggaatcggttgtggattttccgcattattaaggagcaaaccagaatt

SEQ ID NO: 36179 - DNA, 1014 bp, Triticum aestivum
  Clone ID: PAT_TA_36179
ttttttttttttttttcaccagagagttcaccttcatatgctccaccaacagaggcgaagcagggcacaaacatagctcccaaagctcggttatgatagccacgagcacggtgataaactcgccctcaaagatatacttcctccgttctaaaataagttactcaacttatttgggatggagagagtacgacacaaggaagacaacgacatgcacatcagtgtgctcaatctttctggctatacatctaaataaacccttggaatccgaggtccatgggcccctgtgatcatacatacatactacagtggcgtatcgcgtatacaaaccaaaagaatatctacaactacaagtgtgtaacatctagctagctccttccttgtatagttaattaactgctccaatcactactaactagcaccgccatatatagcaatcagattcgcgctcagagcatggtcaccatggccgcaagaaccaaggccagcagggccgtcgtcaagagaactgtcggccgccccgccgccgcggaggtggtctcgagctgtatggtgaagttgcaggtgcccgtggaggggtcctggcgcgtgctcacggcgagcccgtcgaagccgcacgccacctcgtcctggtcctgcacctggaagtaggcattgaaggcgtaggaggcgttccccgcggcgtccacgccgttgcacgtggacccgaggctgagcgaggtgcagtcggcgttggtgcacgcgtagcacacgctgtccgcgagcttgctcatgttggccgcgttggcgttgagcacgcaccacacccgtgggaggtactgcacgcctcgggcccccacgagcgccgtgttccggccctgcccggtcgggtccatggcgtacttgggctggccatcgtaccgcatcacgccccagtgccgctcgaagtagcccggatccacgctcttgacgtcctcgtcgatgaggctgaagaggtagatctcgatgtactggttgggccgcagaggtgtgccggcg

SEQ ID NO: 36180 - DNA, 811 bp, Triticum aestivum
  Clone ID: PAT_TA_36180
gcatgtgcaagtatgaaccaatttgaactgtgaaactgcgaatggctcattaaatcagttatagtttgtttgatggtacgtgctactcggataaccgtagtaattctagagctaatacgtgcaacaaaccctgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaagaccttcaaccaggttgagattaagcctgagatgattggccattaccttgcagagttctctatctcctacaagccagtgaagcacggtaggcccggtatcggtgccacacactcctcccggttcattcctcttaaatgagttatgccgctttctactttgaaagaattcagtacgggccatctggtggcatgtccatctagctgtctcccttgttttgaaccagttatatatctagtatttgggttctgtttagctataatttccgttatgcacaatgagctgttctacctaaatgctgtgagaatcttgtttccattgtgaaggttgattttgattcatgctgtgcttgtcatttggtggagattttttttaaataaaatccacactttttggattgggcaaaaaaaaaaaa

SEQ ID NO: 36181 - DNA, 1459 bp, Triticum aestivum
  unsure (1)..(1459): unsure at all n locations
  Clone ID: PAT_TA_36181
caacagtcctgcccttgcaatacgaagccacaactacaaggatgcttcgccactcttcggccggcctccactagaccaccccttccctcgccgtcgccggaggaggccgccgggcgaagccccgcggcggacggcggcggcgaggttgcgtgcagcctcctctccagcctgctgcgttctctccttctccctcagatccaaaatcctcccacgcctcctgcttccatgcttgcttggctacggctgccggccatctaaatgcatcggctgcccctgctctggccccatggctgccggatgtggctgctggtccttgtggacggggcgctgaccagtaaaatttcgagctgacggcttgtgtggacgactgctcggcgcggcgctgtgggggcgcggctgggtggccggcggtggccgtcgcggtgggcctgcgggttcgatggcggggggttgcgggcacgggcgtgctggcgcggggcgtcctcgtcctgggtgcgcgtggccctgggcgtgtggcgcggtcgtggtggcgcctggtgctggtgcgggcggccacggacgcgcgtcgagtcaggggagctgcgggcgaggtggatccagagcggccggcgcgccggctccagatctggcagtggtcggagcttgccgagatccccgtccccgatctggcgatcttcgaggcgatcggtcatgggatggtgctcggcggcttggttggcgctgccggcagtgttggtgaatgcgtggcttgcttctggctcggggcatgccggtcgtgatggcggctggcctggcggcgatctcgggctggatctgaactgcagtggtccgaatcgggtcctgtacggcggtgctctgggagaaatccctgctcacccattgtgtgagccgaccatgacggtgcctccccggcgtcgtataccttcctagaggcgtggtcttcgagctgttccgtgtggatctgcttcggcgtggtttaggccgtcttgctgtagggatgtgctcaaactccgggtgagaacctttcatcgactatgtcgatgtcggcggcagcggcgtctatggacgtagtcttcctcgcaggaggtgctgctgtggagctccagcacctatggtattttgctttgtggtctccgggtgaaaacctgagatctggctcgccggatcggatgatggtgttgtgtcttcgacaacactacctccttggaggcgtcatcttggaggcccaacgacggctccggttgctgtgcgtggtggtgggtggtgcggccagcttanggccgacggtggtgtgtttctttttcaggtgtttctcttggctgtccttcgcgtggtctccgtcctgttgctgtgcatgctcaagaccctcccatggttgccattgtgctacggtgagctttgggctcttggtgttgtcttggttcacctttgctcaatgatgacacaatgatgcctcccc

SEQ ID NO: 36182 - DNA, 1275 bp, Triticum aestivum
  Clone ID: PAT_TA_36182
attcggacgaggcccggccggcggcggcgccgctccgaccggcgtccctccgcaccgccgccctcgccttcgccccctccccgcgccgggccaccgtctccgttgccgggcgagccaggagccccatcattgcgatggcttctgccaaggaaggaaatggtgctccgaccaagaagaccgcgcttcatgatctctacgagctccagggcctgtccccgtggtacgacaacctctgccgccctgtcactgacttgctgccccttatcgccagcggtgttcgtggagtcaccagcaaccctacgattttccaaaaggctatttcatcgtccagcgcatatgatgatcagttcaagcagctcatttcgggtggaaaggacgcggagagtgcttactgggaactcgttataaaggatattcaagacgcgtgcaaactttttgagcctatctacaatgagactgatggggctgatgggtatgtctctgtggaggtgtctcctaggttggcaaatgacactcaaggaactgttgaagcggcaaagtggttgcacaaagtggtcaaccgccctaatgtctacataaagatccctgctactgcagaatgcgttccttccatccaggaagttattgctaatggcattagcgtcaatgtcacgcttattttctcgattgcaagatatgaggctgtgattgatgcttaccttgatggacttgaggcttctggcttgagtgacttatcacgagttaccagtgttgcatccttctttgtcagccgagtcgacagccttattgacaaaatgctcgagaagattggaacacctgaggcacttgccttgagaggaaaggctgctgttgcacaggccaaactagcaaatcagctctaccagaagaaattctctggaccaaggtgggaggcgttggccaagaaaggtgccaagaaacagaggttgttgtgggcatccaccggtgtcaaaaacccagcttatcctgacactctttatgtggacagtctcattggacctgacacggtcaacacgatgcccgaccaagctttgcaggcattcatagaccatggcactgtttcaaggacagttgatgcgaatgtgtccgaggcggaaggtgtatacagcgccttggagaagcttggcatcgactgggacgcggttggaaagcagcttgagctggaaggtgtggactcctttaagaagagctttgacagcctacttgtgagcctgcaggagaagggcaacagcctcaagacggcaagtgtgtaaaact

SEQ ID NO: 36183 - DNA, 1021 bp, Triticum aestivum
  unsure (1)..(1021): unsure at all n locations
  Clone ID: PAT_TA_36183
gcatgtgcaagtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtgcggctccgtcaccgtgcgcatggtgcccgcccccaggggttctggaatcgtcgccgcccgcgtccccaagaaggtgctgcagttcgccgggatcgatgatgtcttcacttcctcgcgtggatccaccaagacccttggcaacttcgtcaaggcaaccttcgactgcctgatgaagacctatggattcctcacccctgacttctggagggagacaaccttcaccaaggcgccgtaccaggagttcaccgacatcttgggcgaagccgaccaaggccctgatgcttgatgcaccagcccgagaagatagaagcttaggatgtttgccatgaaagggttttactagctgggagctgtctgttgcactttggctttattatagtcgagaacaaggtgtctttgaattgtgctacttgtggaagtctctgtttgctgtcaaagttttggattatggtgcaatgctactctctgttatcggcaaaggatgctacataattatgcaatccaanncaaa

SEQ ID NO: 36184 - DNA, 326 bp, Triticum aestivum
  Clone ID: PAT_TA_36184
caaacacttgcgccgccgctgcctcacaggtaaggccgccatggtctccggttcgggcgtgtgcgcgaagcgcatcgtggtcgacgcgcgccaccacatgctgggccgtctctcctcgatcatagccaaggagctgctcaatgggcagaaggtggtcgtccgtccgctgcgaggagatctgcatgtccgggcgggctccgtccgtcagaagatgaagtacctccgcttcctcccgcaagcgggatgaacaccaagccgttcccacgggccatccacttccgcgcccccgccaagattctgtggcgcaccatccgcgggatgatcca

SEQ ID NO: 36185 - DNA, 602 bp, Triticum aestivum
  unsure (1)..(602): unsure at all n locations
  Clone ID: PAT_TA_36185
ccctgggctccagcgccctcgccgtcggtcgcagccaagcccccgcttcgagtttcccgacctccctcgccgacccaacatgggtaagacacgtggtatgggagctgggcgcaagctcaagacccacaggaggaaccagaggtgggctgacaaggcctacaagaagagccatctggggaacgagtggaagaaaccctttgcaggttcatcccacgcaaaggggattgtccttgaaaagattggcattgaggccaagcagcccaactctgccatccgtaagtgcgctcgtgtccagctggtgaagaatggaaagaagattgccgcctttgtgccgaacgacggttgcctgaacttcatcgaggagaatgacgaggtgctcattgctgggttcggtcggaagggggcatgccgtgggagacatcccccggtgtcccggttcaaggtggtgaaggtgtcgggcgtgtccctcctcgcactcttcaaggagaagaaggagaagcccagatcctaaaacggctcctccccattcttacaagatcatcgcggcagctatgaaaacttgcatcctgctggttacnancaatgtttttgagcctgtggat

SEQ ID NO: 36186 - DNA, 950 bp, Triticum aestivum
  unsure (1)..(950): unsure at all n locations
  Clone ID: PAT_TA_36186
ccgggctgaggaattcggacgaggctcgtgtgattggcgggtgcgtctcttcctttctttcttgcttctccctttccccctcctcctcattgactccgccgccgtctcactcgcaagtcacagcatcccccgtctgctatctcttgggagagttgggagcggaggagcgacgcaggccgacgcagcggcgcaggcgagactcttttgagtttctgtaaaccatggggcagaggctcctattactggtgaccacttgtctgtgggctctttcatgcgccgtgccgcacgatgcttcctcgcctgatggactgctaaggatcaacctgaacaagaagagcttgacctatgaatctctggctgcagcaaaggccgcgaggcagcaaggcgccctccggctgaagagcagcgattcagacagcgacatcgtgcctcttgtcgactatctcaacacccagtactatggggtcatcggcctcggcacgccgccgcagaatttcacggtgatattcgacaccgggagctccaacctgtgggttccctcgtcgaaatgctatttctcgatagcatgctacctccaccccaaatacaagtcgagcaagtcaagcacttacaaagcagatggtgagatttgcaaaatcacatatggttctggtgcaatctctggatttttcagcaatgataatgtgttggttggggaccttgttgtgaaaaatcagaaattcattgagacaacacgtgaaacaagtgttagttttatcgtcgggaaatttgatggcatccttggcctggtacctganatctccgttgggaaagcctccagttggctgacatgcaagacaaaattgcncgctgacgactatccatttgggtaacgggatctgancanttcngggggtactgtctcngggaaggnncggtnacatnggaacaacnntgtcttgagcnanagg

SEQ ID NO: 36187 - DNA, 774 bp, Triticum aestivum
  unsure (1)..(774): unsure at all n locations
  Clone ID: PAT_TA_36187
cacgtctccctcccctccagcctcgctcaccgaaatggcgaaaccctcccaatcccgccccctcttcgtcttccccgtcgccgccgtcctcgccgcggccttcctcctcccgctcgcccgctccgacgcctccgggcccacccccaccgccaccgcctacgacgagctccgcctccgtggcttcccgcgcggcctactcccggccaacgttcgcgggtacacgctcgacgccggctcgggggacttcgccgtcgacctggactccagctgccgcatcgtgctgccggcggggagctacctcgccaacttcaacgaccacctcaccggccacctcgacgaccgtcgcatctccggcctcagcggcatccgcgtcagggctttcttccgctggtggtccatcaccgggatccgcgccgatggagacgagcttgtcttcgaggtgggctccgtctccgccaagttccccgcccggccacttcaacgccagcctcgaatgccccgccaaggccgactccgtaagtactataacaaggaactcttggcgtgcctcatgacactgggcataccatcaaatcgccttgacgtccgaagcactatgattgtttttaaatctctcaactgcctttggtaattactacttgtgtacaaatccgggttcctaagccacactcaactttcggacacaagaaagcgggataatgtaaagtctccttgccctttggttggatggttgnctaataacccnggaacgggtaatggtttaattcatttgta

SEQ ID NO: 36188 - DNA, 586 bp, Triticum aestivum
  unsure (1)..(586): unsure at all n locations
  Clone ID: PAT_TA_36188
cgccgctccgccgccgctccgcctcagcgcatcgccctccgccacagcgtaccgcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaagctgcgcaaggcgaaaaaagatgctcctgctggtgagaaaccagagccagtcaagacacatctccgtaacatgatcattgtccctggagatgattggaagcattgttggtgtctacaacggcaagaccttcaaccaggttgagatcaagcctgagatgatcggcactacttgctgattccatctccataagccggtcaaagcacggaaggcccggtatcggtgcaaccaccctcgcggttatctcnaaatgactgtaccgntcttatctcaagatcantgnatgtcttanctttcactttt

SEQ ID NO: 36189 - DNA, 479 bp, Triticum aestivum
  unsure (1)..(479): unsure at all n locations
  Clone ID: PAT_TA_36189
ctcactgccatccgcaccgcactatctgatacactcactcatcgcggcgttgctcgcggctcagatggctcttcaggcggccacttccttcctcccgtcggccctctctgcgcgcaaagagggagcggccaaagactcggccttcttcggcgctcgtctcgccgatggcctcaaattcgacaccacctccctgggcttgcgcaccaagagagtgaacacgtcgtcggtggccatccgcgcgcaggcagcggcggtgtccgcgccgaccgcgaccccggcgtcgccgtccggcaaaaagaccgtccgcacgggcaacgcgatcattacgggcgcgtcgtccgggcctcggcctcgccacggccaaggccctggcggagtcaggcaagtggcacgtcatcatggcgtgccgcgactacctcaaagancgcgcgcgcagccaaggcgggcggcaatgcccaagggcaactacacatcttaca

SEQ ID NO: 36190 - DNA, 614 bp, Triticum aestivum
  Clone ID: PAT_TA_36190
cccacctcccaagccgccactctcaagcctctcgctcatccgcgtgcagcatctctctagctcccccctagagagatctcacagccgaataagcagcagcgagaccccctccggcctcctctcccagcaccaggaaccaagtcaagtcgccaatggccggtctcaggatgaagttcgtcgccgtcgccgccatggccgccgcgctcgtcgcctccgcggccgccgccgaggccccggccccggcgcccgcctccgacgccgcggccgccgtgcccctcgccgcggcctccttcgccgccgccgccttcggctacctcttctgctagatccgtcccggtggcgtgtgatgagatgagatgacccttctccgtctgtccggcttggtttgctcgtcgtcttggtgtgtgtgcgtgtgttcttgttggggtgtgaggtctgggcgcgtgcgtgtgtgtatgtatgggtcgcggtggtgtgggaggtgtccagtacgtgcgccggcgtgccattctttgtgttggtgatcatgtacttactctcttgttcttgctatgaatgagaccatttatttgttctttcttcccaaaaaaaaaaaaaagtcgacgcggccgcga

SEQ ID NO: 36191 - DNA, 653 bp, Triticum aestivum
  Clone ID: PAT_TA_36191
caatctccaaagccagatccccagcccctccatcccaatggcccgcacgaagcagacggcgcgcaagtccaccggcggcaaggcgccgcggaagcagctcgccaccaaggcggcccgcaagtcggcgccggcgaccggcggcgtgaagaagccccaccgcttcaggccgggaaccgtcgccctccgggagatccgcaagtaccagaagagcacggagctgctcatccgcaagctccccttccagcgcctcgtccgtgagatcgcgcaggacttcaagaccgacctccgcttccagtcctccgccgtctccgcgctccaggaggccgccgaggcctacctcgtcgggctcttcgaggacaccaacctgtgcgccatccacgccaagcgcgtcaccattatgcccaaggacatccagctcgcccgccgcatccgaggggagcgcgcctaggttcgtcttggtcgccggtaatactggccagtagctgttcttgtcctgtgatccgggtgtgtgtccggtgcttctgtttgtttgtgttgatatgatgtgtcgtctggtcctatgtatctcgatgctcgaatgaaatcgcaatggcaacggaaagatcagttattgatctgatgcaatttttttactgcagtgtcagtgtttgatt

SEQ ID NO: 36192 - DNA, 721 bp, Triticum aestivum
  Clone ID: PAT_TA_36192
gtgccctgcctggctgcctcctccgcgtccgagctcctccaccggcgacataagcgacgccctcaaccccctccgtctgttgctcaggatccaagctccgcccctccagcaacggtgatggaccgcggccgtcaccgtcctccttcccggatctctactccgcctctaagctctggcctcctctggtgaccgcgacgacgacggttctctgttcgttttctacctcctccggtcaagatccaggaaagtgagcacagcctcctctcagatcattttcaccatcgtcaatctcaggtacgtgcttcaatgtcaacttatcgaaggcagcaagtgcccctaaaacatcgagctgtggtacctgatgtcgacgtggagtggggaacgagctgagcaaaactattgaccatcaccttgcagctcatcttcttcagtagtgtgtccgcctcaaacatgacaacttgggaatttagagttttttgtattgtacaactcattagctcctatgcttctgctatagctaaccttttgccttagttgtaatggtgcagtcctaaaaattgagtaccaatcttaacaatgatgggtcatattaggtgtaatgtattgcacacgaaaacgatttaggctatcacttgatcgcggtgaaatgtagaccaatatcttaaccttgataaagtgatcaaatatcagttgtattatttttggaaatttaaaaaaaaaa

SEQ ID NO: 36193 - DNA, 661 bp, Triticum aestivum
  Clone ID: PAT_TA_36193
gccggccgggttctcggaccagagccaagtgaaatcccaatctccaaactcctcagcgcagcagcagccagatccttccccatccatcccaatggcccgcacgaagcagacggcgcgcaagtccaccggcggcaaggcgccgaggaagcagctggccaccaaggctgctcgcaagtcggccccggccaccggcggcgtgaagaagccccaccgcttccgccccggcaccgtcgccctccgcgaaatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctcgtcgggctgttcgaggacaccaacctgtgcgccatccacgccaagcgcgttaccatcatgcccaaggacatccagctcgcccgccgcatccgtggggagagggcctaggtttggggtcgctgctggctagtagctgttcttgtcctatgatctgaatgtgttcagggcgcttctgtttgttggtgttgatatgatgtatcgtgatgcttgaatgaaattgcaattaaaaagttcagttatcaaaaaaaaaaaaaaaaaaggccccta

SEQ ID NO: 36194 - DNA, 1203 bp, Triticum aestivum
  Clone ID: PAT_TA_36194
cgtccgggaagcctccctgctactgcctctgccacggcgagcgcgagaggggccgcccatggctgcgcccttcctctacacccgcagctccggcaacggcacaagtcaggacgcggccatgcgagcggcgttcgacggcgacctccggcgcctcagaggtactgtaaagagcctcgacgacccaagggtgatcttctctttcgacatgggttatggccttggtgtgctgcacatcgcagccgccggagggcatcttgaggtttgcaaatacttggtggaggaactcgggggagatgtgaatgctcctgctcctggagtagtagactttgcaggcgtgacaccctttatgttatctgctcagtctggcgatgtttctactgtgaagtatttgcttgatcatggtggtgatctaataaaagcagatgctaaaggacgcacagttctccaccatgcggcaggcataggaagctgtaaggttactgagttcctactctcaaaaggagtacccgttgacatatactgtggccgtggtacaccactccatcaagctgctaccaatgaacatgataaaacagtgaagattttgttggaacaccatgcagatcctaacaccactgtcatcggattgggtactgccctgatgggtgctttattgtatcgttctttgaagtgcatgaagctgctgattaaggctggtgcggatgttaattgcaagggttgtgctatgactcctttggtgtttgctacgggacgaggaggttatacgaactacattcagttcctattgaaagctggagcagatcctaatattccagatgatttaggtaggttgccaatagagtttgctgcggtgcgtgattgcaaggaagaggttgaaatgttgtttcctttgactaacccaattccaaatgtccgaaactggagtattgagggagtaatttcttatgcaaaaattcaagataaaaagccgatggagcaaaagcacgttgaaaaaagaaaggctttcttaaagttacaggctaatacggcattcaagcagaaggagtataagttggcatcacagttgtatggtttggcaatagatcatgcagagagtgcagcactgtatgcaaacaggagtgtttgtaaactgctcatgggtgatggtgaaagtgctttgtcggatgctctcaggtgcagaatgctgcgacctgattgggccaa

SEQ ID NO: 36195 - DNA, 1254 bp, Triticum aestivum
  unsure (1)..(1254): unsure at all n locations
  Clone ID: PAT_TA_36195
cccgatactttatagccggcgacaacaaacccagcaaaatcccatctctcaacccagtgaatctgcttcccctttcccttgtctgagatctcagcccgagcctgcacgccgcaacttccaccgaaatcctcccctcctagccgcagcgtcgccggattgattcagaaggcattcttggtggccggagaagcagtctttggtcctctgctcgagaagaatataactgttattcagatcatcatcaaacatgtcgctgctatcgaagttacggttggtcactgtggatgtgactggtactctgcttgcttacaaaggacggcttggtgattactactgcatggctgctaaggctgccggaaagccatgccctgattatgatcgaatgcatgaaggcttcaagcttgcatacactgagatggcaaggaaatacccatgctttggatttgcggcaaagatgccaacgatcgaatggtggaggatttgcgttaaggattcatttgttaaggctggctatgattacgatgatgagacatttgagaaagtgttcaagcgtatttattctgccttcggctcctctgcgccatactcagtgtttcctgatgcacagcccttcatgagagggctgagggagaagggtatcacagttggcatcgtcagcaatgcagagtaccgttacaaagaggtcatcttgcctgcgttagggctgaatcagggctcggagtgggacttcggggtgttctcaggcatcgtcggcgtcgagaagcccgacccaacgatctacaagatcgcgctagagatggcggggaacgtcgcaccagaagaggcgctccacattggcgacagctaccgcaaggactatgtccccgcacgaagcatcgggatgcacgcgctgctcctggaccggttcaagaccgccgaagccgagagctggaggaagtctggcgcaccggtcctccctgacctcgaggccgcgcaggcatggctcaccaagaacccgaccgaggaacccgctgaggagccactaggggccgcgctgctgcgcaggatggccgagaagctctgaatctcgcccctgggatagttcctgttgtgctcttgctgggcagtgagggagccaaggagaagggatgtgttgtagtgatggttcactggcctgtttagctagctggagctacttgaactctggtagtagcttcgggtactgttgctgactgctgaatgggcaagnattcagtcgtgcgaccaacgacgaat

SEQ ID NO: 36196 - DNA, 706 bp, Triticum aestivum
  Clone ID: PAT_TA_36196
ccccgggctgaggaattcggacgaggctgccctccccatctgcttaggttggttggctaggggcttcgcagagctcgcggaaatggtggccttcaggttccatcagtaccaggtggtgggtcgcgcgctgccgacgcccggcgatgagcagcctaagatctaccgcatgaagctctgggccaccaatgaggtgcgcgccaagagcaagttctggtatttcctgaggaagctgaagaaggtgaagaagagcaacggccagatgctcgccatcaacgagatctttgagaagaacccaaccacgatcaagaactatggcatttgggctgcgttaccaagagcaaaaccggctaccacaacatgtacaaggagtaccgcgactgtcaacttcaagctatgcaagagagacaacaccaagcagttccacaactccaagatcaagttcccccttgtgtaccaaaaggtcaggccaccaaccaggaagctgaagaccacctacaaggcgacgaggccgaacctgttcatgtgattgggcttgtggtggatgctggtatttttgttgggcagaagcacaaaagttgaaatgttctcttagtatgttggatcttctaatgcatgaagactagtgttttgttgcttatttatcatttaaagacatggtcggtgaaccttggattgtgttcttatcagtaatctgcatacaatctat

SEQ ID NO: 36197 - DNA, 1588 bp, Triticum aestivum
  Clone ID: PAT_TA_36197
ggatcaacagaggaaattcaatgcataatccttctacctgtatatagacctgcaagcccaaactcggcagaacatgaacggcaacatctatgtatgtatgcatccagttctttctccgaaccagaggaggagatacacaaaaaagaaaagttttgattgattcattctgacctcacctatccctactcatcataatcatatttctacgtaccgcatcggccctgtgctacccacaaggccacaaactcaactagattacaggcagaccagaccaaaccccacaacagggaaaaaaagaaacaccagcaccaacgagagtcaccaaacagaatacacagggagggagggagggcacgctgcccgtgcgttttccgaactttttgcctcggaagaagaaaaactgctccacgaaccaaccggggatgtacgacggcctatcgatcagatccaacggctatgccggcggcgaggtgaggtgcggtccggccgtttcagccctgcgactctatgggcgacatcatcgccgagaaccggcgcttctggatgcgcggggggaggtgcttgttgtacctcttgggcccaaccgtccacggcaggaacacgccggtgcctccgcgccccatcctcttgttgatgttgctggagggcgccatcaccattggcctcgccggcgcggcgaccatcatgacaggcgccgcgcgcacggccatgccccaagccggggcgagcatggcctgcggcgcggggcagtagccaatgattgcgccgttgctgccatggggtggtttctgcatgccggccgttgccgcagtcgggggaggctgccagagcgtcatggccttggtgggcgacgggagcgggctgaggtccaccggagtcgatggcctcaccctcacgaacgtgatgctcacgcggcggttggacgacgggcacacgacatggcgcgccatgtccgcgctgttcccgcgcatcaccagaagtgacccttgcttcagtgagagtgtgagcggtcccttgtagttgccgttgctgtcagtgacaagtgaccttccaaatgccatcgaggtttcagacagcaggagagtggaaatggggttgtccaggtggggaggcttgaagtagggctgcgagtgctcgtcctcatcgaagaaattgatgatgacactgtttggtttcctgctttcttggtattaagcgcccaaagaacaaggtggtcgatgacagcctgcaggacaactgggattggttctatatgacaattggtttcctctgtggtatgttgaaatagtgggacaccgagctgaatgatctctctcttattccctttgatctgcttgttgaagaatatgaaggtttcacctgaaagttccccatttctaccagcctggcgaatttcattgatgaaatcagcaaccttcatgagctccattgttgtgaacacgtcttcatatatcttcaggcctttcacaacgttaaccatgtgccccttcacggactctttcgccatgaaacctttctggatcttgatcctctctgggcggacgatgcactcgtcgtggtcagagcagatagggtagctctctggtag

SEQ ID NO: 36198 - DNA, 653 bp, Triticum aestivum
  unsure (1)..(653): unsure at all n locations
  Clone ID: PAT_TA_36198
ccacatttcccctgagcaaagagaagcaaatcacaagaaagcgaagcaaatcggcgggatggccggccaagctagggcgttcatgtgcgtggcgctcgtcgtcctcctgctcctcgtcgagaccaccgccccgagtggacaagctcacgccgtcgattgcggcagcgcgtgctcgtaccggtgcagcaagtcgagccggccgaatttgtgcaacagggcgtgcaacacgtgctgccggcgatgcgactgcgtgccgcccggcaccgccggcaacgaggacgtctgcccctgctacgcccacatgaccacgcacgacggccgccacaagtgcccatgattcaaccgccttctcgacggccggtcgaggctaatgcatactagatcatggcgtctcagtaaatatcccatcaagctagctacagccaacgataactagactaccaggggcacgatcgatatgatatcatgtactcaagctagtgctgctgcctatgtaccttgtgctcatccatccgtgatcgatccatcgtgtaagcatgtttgctatctcgttctcacgcagtggtaattgccgtcaattgcactaaaacaattagtgcgtatggtattgaatttatactccagccaactcatgtanangtctgaactgatga

SEQ ID NO: 36199 - DNA, 1264 bp, Triticum aestivum
  unsure (1)..(1264): unsure at all n locations
  Clone ID: PAT_TA_36199
tgcaactccgtttatgatgtcagctcagtctggtgatgttcccactgtcaagtatttccttgatcatggtggtgatctaatgaaagcagatgacaagggacgcacaattctccaccatgctgtctcggcaggatgctgcaaggtaacagagttcctcctttcaaaaggggtgccagtcgacatagactgtggccgtggaccaccactcttcatggctgctacaaatgagcaggataagacgctgaagattttattggaccaccatgcaaatcctaacatcattatcagcggtgctactactcccctgctgagtgctcttatttaccgttcattgaagtgcatgaagctactcattaaggctggtgccgatgttaattgcaaggcttccactatgacacttttggtgtttgctacaatgcaaggaggttataccaacttcattaagtttctgttgaaggctggagctgatcctaatattcccgatgatttgggtaggttaccaatagagcttgctgcattacgagattgcaaggaagaggttgaaatgttgcttcctttgactacgccaattccaactgtcccaaactggagtattgagggggtaatttcccatgtgaaaaatgaagataaaaaaccaatggagcaacggcaccgtgaaagaagacaacgtttgctcaagtcacaggctgatacagcattcaagctgaaggagtataagatggcatcagagtgttatggtctggcaatagatcatggagagagtgcaacactgtatgcaaacagaagtgtttgtaaactgctcttgggcgatggtgaagggtctttgtcagatgctctcaggtgcagaatgctccggcctgattgggcaaaagcttgctaccgtcaagctgcagctcatatgctactcaaggagtataagcaagcctgtgatgctctcttggatgcacaaaacttggatcctgggaatgctgagattgaacgtgaactacggaaggctagggaactcatgaagaatcctcctgccgaaggtgagcagtgaggcgcgggcgtgtgcaggctggaacatgttccacctttcactaaagtagaactatggcaggaacttctgatccttgtgttgtgctacgaaattcatgcggaaaaactcgtgactgcagactgctaaaacacgactttgtctggaattatctcgtcttgccaaaaaaaaaaaaaaaaaaaaaaaaaaaaaaaaaaaaaaaaaaaaaaaaaanaaanaacanaaaca

SEQ ID NO: 36200 - DNA, 1145 bp, Triticum aestivum
  Clone ID: PAT_TA_36200
cggcacgaggcgcctctcgcctccttccttcgtcctccggttccaagtccaccgtgctccctctcctctccgcctgcggggccgcgccgctccccgggggcgtggggcgcggccaagtggcgggggcaccggcggcgtgcgccagctgcgcgagctcgtccttgactcgtgcctctcctcccctcgcgtctggggaggcgattcgtccccggttcttgcctctcctgggctcgcgtctgatccatatcgacacgcccacgctgtttgacgaggataaagatgttatgaaaaaatggggtgctccaaacaagactgccttcctctctttctcatacaaggcatgcagaatatttgcggcaaaagtctgctctgcacaagtacacatggctggaaaccttggtgctgagactcttcgtgggttgtatccagttgagagtatttcaaaggctgagaaggtcttcaaccaggatttctacttcaagcgaaccatgaaatacgtgggagaacccatgatccacttggagtctattacttcctctccggtgcgggctgctattaaagttcaggcttcggtcatcatttgcttcacctcatctggataggagaaaagggagtatttcttcttataggggcttcacctcatcttgtagtttaatagaaattgattcatatattatgccgtatcgagtatctgcaggataattgccaagtacaggcccaccatgccattcctcatctaaaaacaaatcaattgaagtggagcttcacaagcgcatctgaagcaagacaatcactcatagttagagtcctctttcccatgcttgccgatccacatcacccggctgaatctactagcactagaaatgaatcagtgttgaaggttgctcttgaccacggcaaagcatccggtgtgatcaagtcgcatggcttaccttagccagaatttctataagaatgttgctgatgttacatgccctgctttctctagaacgaagatctggatcaccctcgcccctctagagaaagttctggaaattctttatagctttttgagtttacttcggtcttgcatgtattacctttctgtttgtgcccctatctatgttgtttcttgtgtgcaaaaaaaaaaaaaaaaaaaaaaaaaa

SEQ ID NO: 36201 - DNA, 639 bp, Triticum aestivum
  Clone ID: PAT_TA_36201
ggagaaggagaaagatggccggaaggaagggcggcgacaggaagaaggcggtgacccgctccgtcaaggccgggctccagttccccgtcggccgcatcgggcgctacctgaagaagggccgctacgcacagcgcgtcggctccggcgcccccgtctacctcgccgccgtcctcgagtacctcgccgccgaggtcctggagcttgcaggcaacgctgccaaggacaacaagaagacgcgcatcatcccgcgccacctgcttcttgccgtccgcaacgaccaggagctcggcaggctgctcgccggcgtgaccatcgcccacggcggcgtgatccccaacatcaactccgtgctgctccccaagaagtccgccgccgccgagaaggaggccaagtcgcccaagaagaaggccgccaccaagtcccccaagaagaaggccgccgccgccaaggagtaggcgccccatagcctagctccacaatcagggagaagatgacgagacttttgattttttttgcgggattgggtcttgtaattgcctagtctgtagtggctctttcattacctcgatgagcaagccattaagggctgtgttttgtagtacctgattaatgtcgagaatggctaaatcctttgcaatc

SEQ ID NO: 36202 - DNA, 575 bp, Triticum aestivum
  Clone ID: PAT_TA_36202
tggggatgaagagatgcagtactcctagcatcctgctgatgctttcactggcggcagccctcctcatcgccggccacccctccgtcgccgacgacgtgggcaccattctcctgccaagccaggacaaagaccaggaggtggtcatggcggcacccaggccgtggaagtgctgcgacgtgaccgtctgcaccaggtccatcccgccgacgtgcagctgccaggacgtggtggacaactgcgctccaacctgcgaggactgcaatggttatgtgcacccaccccgccgtgtttgcctcgaccgctacaccggcgaccccgggcccaagtgcacgggcgcccggcgccggcggtaactgaactctacgtactactctagcacgtgtatctactcgcacccgttcgatctaccggtaagcggacgtacgccgtcgacgtgtgttcctacatgaatggctactagtaatgttgtgtgtggtcctgcatgcctagctgcttgctgcctgtgtgtaataaaaacgggtggcctttcatcaaaaaaataaaacgggtggcgttgggtacgtaaaaaaaaaaaa

SEQ ID NO: 36203 - DNA, 724 bp, Triticum aestivum
  unsure (1)..(724): unsure at all n locations
  Clone ID: PAT_TA_36203
ccgtcgtctaagttaggctagggttcgaccagctagcggaaatggtggccttcaggttccatcagtaccaggtggtggggcgcgcgctgccgacgcccggcgatgagcaccccaagatctaccgcatgaagctctgggccaccaacgaggtccgcgccaagagcaagttctggtacttcttgaggaagttgaagaaggttaagaagagcaacggccaggtcctgggccatcaacgagatctttgagcgtaacccgacgacaatcaagaactacggcatctgggctgcgctaccagagcagaaccggctaccacaacatgtacaaggagtaccgcgacacaaccctgaatggcgctgtggagcagatgtacaacgagatggcctctcgccaccgcgtgaggtccccctgcatccagatcatcaagactgcgacggtgcacttcaagctctgcaagagggacaacactaagcagttccacaacagtgagatcaagttcccgctcgtgcaccgcaaggtcagggccgccgaccaggaagctgaggaccacgttcaaggcttcgaggcccaacctgttcatgtgatttagctgtggtcagtgtatgcgatcataagagtcacaagtgtttctgtttttttttaagttttgacttcctaatagtaatacttaatcggtttgatgattcaactcgttttgaagcgagcttngtgaaccaaaaaaaaaaaa

SEQ ID NO: 36204 - DNA, 809 bp, Triticum aestivum
  Clone ID: PAT_TA_36204
ggtggtcatggcaagtcgaaatccgctaaggagtgtgtaacaactcacctgccgaatcaactagccccgaaatggatggcgcgctgccgacgcccggcgatgagcagcctaagatctaccgcatgaagctctgggccaccaatgaggtgcgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcagaaccggctaccacaacatgtacaaggagtaccgtgacaccacactgaatggtgccgtggagcagatgtacactgagatggcctctcgccaccgtgtgagatccccctgcattcagatcatcaagaccgcgactgtcaacttcaagctatgcaagagagacaacaccaagcagttccacaactccaagatcaagttcccccttgtgtaccaaaaggtcaggccaccaaccaggaagctgaagaccacctacaaggcgacgaggccgaacctgttcatgtgattgggctgtggtggatgctggtattttggttgggcagaagcacaaaagttgaaatgttctcttagtatgttggatcttctaatgcattaagacgagtgttttgttgcttatttatcgtttaaagacatggtcggtgaaccttgtgattgtgttcttatcagtaatctgcatacaatctattggtatctgatatagatctgtttggaggcggttctgttttgtaaaaaaaaaaaa

SEQ ID NO: 36205 - DNA, 747 bp, Triticum aestivum
  Clone ID: PAT_TA_36205
gcacgaggaacccttcgcccacctgcccacctacccacctccaagtctccaaccaagagaccttttccgccgccgccgccgcccctagctccagcgccctcgccgtcggtcgcagccaagcccccgcttcgagcttcgcgacctccctcgccgatccaacatgggtaagacacgtggtatgggagctgggcgcaagctcaagacccacaggaggaaccagcggtgggctgacaaagcctacaagaagagccatctggggaacgagtggaagaaaccctttgctggttcatcccacgcaaaggggattgtccttgaaaagattggcattgaagccaagcagcccaactctgctatccgcaagtgcgctcgtgtccagctggtgaagaacggaaagaagattgccgcctttgtgccaaacgatggttgcctgaacttcatcgaagagaatgacgaggtgctcatcgctgggttcggtcggaaggggcatgctgtgggagacatccctggtgtccggttcaaggtggtgaaggtgtcgggcgtgtccctccttgcactcttcaaggagaagaaggagaagcccagatcctaaaacagctcctccccattcttccaaagttccaagatcatggtggcagccatgaaaacttgcatcctgctggttactcgcaatgtttttaagcgtgtggatcttagttcttgtcgaggaaacatctgaattttaagctgccaagtttcagtttttccagt

SEQ ID NO: 36206 - DNA, 568 bp, Triticum aestivum
  Clone ID: PAT_TA_36206
agtccaccggcggcaaggcgccgcggaagcagctcgcgaccaaggcggcgcgcaagtccgccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtctccgcgctccaggaggccgccgaggcctacctcgtggggctgttcgaggacaccaacctctgcgccatccacgccaagcgcgtcaccatcatgcccaaggacatccagctcgcccgccgcatccgtggcgagagggcgtaggttgcctcgtatttgtctgatctggaggtgtagagatgttagcttcatcatagcatgtgtctgatcttgtatcgtggtaggaaggtccctcgttcgtggtagcttggccgtgttatgttctagtgtactgtctgatgttaccctcttgttgccatcagcaatgtgaaagttggctctcagatctt

SEQ ID NO: 36207 - DNA, 676 bp, Triticum aestivum
  Clone ID: PAT_TA_36207
gcatgcgtgcgagtcgacgggttctgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaaagactaatccgaaccatctagtagctggttccctccgaagtttccctcaaggatagctggagcccattacgattctaatcaaggtaaagccaatgattagaggcatttggggaagcaactccctccgactatcctcaaacttttaaataagtaaggatggcgccgctgcttcggtgagccggtccgcacaaaccagatcccgcgcgagatccccgcccagaagtacccgtcctggctgctggtcctcggcgccggcacgctgcccttcggcaccctgttcatcgagctcttcttcatcatgtcaagcatctggatggggcgcgtgtactacgtcttcgggttcctcttcatcgtgatgctgctcctggtcatcgtctgcgccgaggtctccctggtcctgacctacatgcacctctgcgtggaggac

SEQ ID NO: 36208 - DNA, 574 bp, Triticum aestivum
  unsure (1)..(574): unsure at all n locations
  Clone ID: PAT_TA_36208
ccttcttaggtttcagttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaacgaggtccgcgccaagtccaagttctggtacttcctcaggaagctcaagaaggtgaagaaggccaacggccagatgctcgccatcaacgagatctttgagaagaaccccaccaccatcaagaactacggcatctgggctgcgctaccagagcaggaccggttaccacaacatgtacaaggagtaccgcgacacgaccctgaacggcggcgtggagcagatgtacacggagatggcgtcgcggcaccgcgtgcgtgccccctgcatccagttatcaagactgcgacggtggacttcaagctgtgcaagagggacaacacgaagcattccacaactcccaaatcaaattcccgctggtttacagaaggtgcgccaccacccgcaactcaagacacctacaagngacaagccaactttcagt

SEQ ID NO: 36209 - DNA, 649 bp, Triticum aestivum
  Clone ID: PAT_TA_36209
tcggcacgagggtgaaatcccaatctccaaagccgcagcgcacgagcagccagatccccatcccctccaccacgatggcccgcacgaagcagacggcccgcaagtccaccggcggcaaggcgccgaggaagcagctcgccaccaaggcggcgcgcaagtcggcgccggccaccggcggcgtgaagaagccccaccgcttcaggccgggaacctgtcgccctccgcgagatccgcaagtaccagaagagcacggagctgctcatccgcaagctccccttccagcgcctcgtccgtgagatcgcgcaggacttcaagaccgacctccgcttccagagctccgccgtctccgccctgcaggaggccgccgaggcctacctcgtcgggctgttcgaggacaccaacctctgcgccatccacgccaagcgcgtcaccatcatgcccaaggacatccagctcgcccgccgcatccgaggggagagggcctaggttctgggtcgccggtaatactggctagtagctgttcttgtcttgtgatccggatgtgtgtcgggtgcttctgtttgttggtgttgatatgatgtgtcgtcttatcctaatgtattgtgatgcttgaatgcaaattgcaatggaaaagttcagttatcgtgcc

SEQ ID NO: 36210 - DNA, 1052 bp, Triticum aestivum
  unsure (1)..(1052): unsure at all n locations
  Clone ID: PAT_TA_36210
cctcgtccctttcttctttgccctccagaggatttttaggatcaggatccttattgagagtcttgctacctttgagacctttcactgaaacaccagcgatggaagcactgaaataagtgtagatntagaacaccacgtacaagatttatcccggaggatattattatcaagcactgactggctatctacatgtagggcccaggaagaagctaaatcttaattacacaaagcctcatttttgttcggcgagagctaaaacccatggacaggaaccggtgttttgcagagttttcggataccgagtttataccgaatcaacctcttcaacctgctgacgagcaagatatctctctcttcgttccttccattcatcaatcacaagcccttcaccaacgataggggggctagtgtcttctggaggcttcttgcgtgcctcaagagctgcttcagcttcagcgagctgacgcttgagtctgtccagttgtgcgctaggacgctcagcatccaagaaaataacccgcagaatttgctcaactgcaacctgatctttctgctcatcgaactgtgacatatgagaatataggtaaaacttagagaaaaaaaagaaactacaacaataagactttaggcgattggacggtctcaaggggcaaaaggacataccaattctggaacatactccacaggccctttaactttcaggctaacaatcttgaacttgaccttgcacttctgatctaaaggcttctcgttgttctcaggatgctccacaaacttgaacactgtagctatgatggtttctcctggagcaagtatgccgccgggaggcctcatgaagcagctctttggtgctgttgtttggaactaaaaaacagataggacatgcgttccattagtactacaccttattattgttacgtcaaaccaacctagtactacaaggaaaatttgtaaaaccactagcattcaaggtcaagttatgggatttaattcattgaaggaaggacttaattaatttatcccctaatttaatgaatagattagtggcccgc

SEQ ID NO: 36211 - DNA, 649 bp, Triticum aestivum
  unsure (1)..(649): unsure at all n locations
  Clone ID: PAT_TA_36211
cacacctagaccacaagcatcaaaggcaagcaagcagtagtaaccacaaatccaacatgaagaccttcctcatctttgtcctccttgccatggcgatgaacatcgccactgctgctaggcagctaaaccctagcaacaaagagctacaatcacctcaacaatcattttcccatcaacaacaaccatttccacagcaaccatatccacaacaaccatatccatcacaacaaccatatccatcgcaacaaccatttcccacaccccaaccacaatttccccagcaatcacaacaaccatttccccagccccaacaaccgatccccctacaaccacaacaaccattcccccagcaaccccaacaaccacaacaaccttttccacagccgcaacaaccatttccctggcaaccacaacaaccatttccccagacccaacaatctttccctctgcaaccacaacaaccattcccccagcaaccccaacaaccattttcccagccccaactacaattcccccagcaaccagaacaaataattccccagcaaccccaacaaccattcctcctggaatcgcaacaaccattcccccagcaaccccaacaaccattttcccagccccaacaactgatccccatgcaacnnnaacaacc

SEQ ID NO: 36212 - DNA, 1147 bp, Triticum aestivum
  Clone ID: PAT_TA_36212
cgcggccgcgtcgacctctgaagaagcttggaattgacgacttagtgcattttgacttcatggatcctcctgcacccgaaactctaatgagggccttggaagttctgaactatttgggggcactcgacgatgaaggcaacctaacatctttaggtgaaatgatgagtgagttccccttagacccacagatgtcaaagatgcttgtcatcagtccaaggtacaactgttcaaatgagatcctctcaatatctgccatgctatcagtacccaattgctttctccggcctagggaggcacaaaaggctgctgatgaggcgaaggctcgatttgggcacatcgatggggatcatctgacacttttgaacgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgtgagtactatgtcaacatcaggaaagcaatgctttcagggtactttatgcaggttgctcatctggagcgaactgggcattacttaaccgtaaaggataatcaggttgtccatcttcatccctcgaattgcatggaccataagccggagtgggtcatctacaatgaatatgttttgaccaccaggaatttcatccgcacagtcaccgatatccgtggagagtggcttatcgatatagctccacagtactatgatctgaccaatttcccatcatgcgaggccaagcgtgttcttgagaggctacacaataagagggagagggaaagtgctgctagtaggaactgaattgatgtcattcttctggtcccttggatggcagcgctgccaaaggctttggacatcactgttggcctccaccattgtcatgatatcttccatgtcgtagtttttcagtattgtggacggtgaaatcactatatacgacatatgtcaaatgtccctctgctactgcattacgaattagatgcttgttttccctctgttttagaaggtgtaggttatcatacattaattatgtgtcggtctccatatttttggtgtatcaaacgctgttgttactttgt

SEQ ID NO: 36213 - DNA, 818 bp, Triticum aestivum
  Clone ID: PAT_TA_36213
cgaggccagtacggagagatcatcctcgaattgttaatagcacagacacagccacagaaagtatgcagtcagattggtctgtgtttgtttgatggtactcactctgtcagcaacgggattgaatccgttgtcggtaaagaaaatgttggctcggatgttatgtgcacagcctgtgagatggctgttgtgtggatagagaaccagctccgtgaaaacaaaacaaaggagctgatattgcaatatgctaaccagctgtgtgagcgtctaccgagccccaatggagagtcaacagtcagctgccatgagatgtcaaagatgccgaatcttgctttcaccatcgcaaataagactttcgtgctaacaccagagcagtacgttgtgaaactggagcaatcagggcaaaccgtctgcatcagtgggttcatggcattcgacataccgcccccacgtggtcctctctggatcctcggggatgtcttcatgggcacttaccacaccgtgttcgacttcggcaaggacagaatcgggttcgcagaatcagcttgaggagtcgagagcactatgaagtttccgaaggtctccacgtacgtatcctagaatagtttgggtatcttcgatcataggagccctgctgtaaaccattgataggtaaaaagctgaaacaaaagagagaactttttatttctttcttataaacaaataataactggatgcttcaactctgaagaaagaaagtacatttgtatccattatggctggtgctatgtaatgaagaatggagtgcttgcacggtgagaaccgagagtaaaaaggggggg

SEQ ID NO: 36214 - DNA, 668 bp, Triticum aestivum
  Clone ID: PAT_TA_36214
gccggccgggttcgggacagccaactgaaatcccaatctccaaacgccacagcgcagcagcagccagatccccagcccctccatcccaatggcccgcacgaagcagacggcccgcaagtccaccggcggcaaggcgccgaggaagcagctggccaccaaggctgctcgcaagtcggccccggccaccggcggcgtgaagaagccccaccgcttccgccccggcaccgtcgccctccgcgaaatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcgtacctcgtcgggctcttcgaggacaccaacctgtgcgccatccacgccaagcgcgtcaccatcatgcccaaggacatccagctcgcccgccgcatccgtggggagagggcctaggtcttggttcgccggcagtaccgggtagtagctgttcttgtcctgtgatccgggtgtgtgtctggtgcttctgtttgttggtgttgatatgatgtatcgtgatgcttgactgaaattgcaatggaaaagttcagttatcatgctaaaaaaaaaaaaaaaaaggccccta

SEQ ID NO: 36215 - DNA, 802 bp, Triticum aestivum
  unsure (1)..(802): unsure at all n locations
  Clone ID: PAT_TA_36215
aagctctgggccaccaatgaggtccgcgccaagtccaagttctggtcagtctcctcccccgnaccgacctcgcggcgccatggcctcgatcttcctcgcgcgttggtttcgtgggtgcttatgtgtttgattatttgcgcgcaggtacttcctgaggaagctcaagaaggtgaagaaggccaacggccagatgctcgccatcaacgagatctttgagaagaaccccaccacaatcaagaactacggcatctggctgaggtaccagagcaggaccggttaccacaacatgtacaaggagtaccgtgacacgaccctcaacggcggggtggagcagatgtacacggagatggcgtcgcggcaccgcgtgcgtgccccctgcatccagatcatcaagactgcgacggtggacttcaagctgtgcaagagggacaacacgaagcagttccacaactcgaagatcaagttcccgctggtgtaccagaaggttcgcccacccacccgcaagctcaagaccacctacaaggcgacgaggcccaacctcttcatgtgagcgggtccctactctactggcctgtgtgttttagcgtgtaagagtttgaagatttttgcatgtggaagttttggttaagcactttgatgatgttttcggtcgctaagatgctgctgctttgatgcaactcttgactttgtttggtattagtaatgcgcagcagatccatcaaaaaaaaaaaaaaaaaaaaaaaaaaaaaaaaaaaaaaaaaaccattttgaggaactanaaancnaaattccttcatctttt

SEQ ID NO: 36216 - DNA, 704 bp, Triticum aestivum
  Clone ID: PAT_TA_36216
ttttcacaacaatctcagagtactcacgattttatttgccaaataagtatactagtagtggtagtcaggatgatgaactgcaggagtgacggccaaaccacgcgactcatttattggcagcactagtggtactactacaaaggacgggcggacgagattaaccggagcggacgcggtcgccggccgcggatcgacgcgcgccggagggggagcggatcagttggccgccggcttgaaggaggtgagctggcgggtcttggtccaggactgctcgtagacctcggcgaggtagggcgcgctcctgccggagccgtcggccgcgtcgacgaagaggcggtagttcatgccggagaccacctgctgctcgccgcgcgtgacccggcggaaccgcagcccgtcgctggccagcctcgcgtgctgctccaccgcccacccgcccagctcctggatgtgcgcgtccctcacgtccgggatggggccccacccgccgacccgcgcgccgcggccgcccagcgccgccgccggggtggccgcggcgagggccgcggcgaggagggcgagcaggaggaggacgggtgcccgcgccatggaggagatggctggtgttgggggttgggaattgggagcggtggtggatctgctcgaagcgtcgacggaagtgattgcgtgaaggcggtttgtttttttttcgcggcccggccggc

SEQ ID NO: 36217 - DNA, 1003 bp, Triticum aestivum
  Clone ID: PAT_TA_36217
cctgcttcttacctggcatcgccttcctgatcctcaccacactcaacttcctgctgtggggaagccagagcaccggcgccatccccttctcgctgtttgttgtgctgatcctgctctggttctgcatctctgtgccgcttacactcgtcggcgggttccttggtgccaaggcgccgcacatcgagtacccggtccgcacaaaccagatcccgcgcgagatccccgcccagaagtacccgtcctggctgctggtcctcggcgccggcacgctgcccttcggcaccctgttcatcgagctcttcttcatcatgtcaagcatctggatggggcgcgtgtactacgtcttcgggttcctcttcatcgtgatgctgctcctggtcatcgtctgcgccgaggtctccctggtcctgacctacatgcacctctgcgtggaggactggaagtggtggtggaagtcattcttctcgtccgggtccgtggccatctacatcttcctctactcgatcaactacctggtgttcgacctcaagagcctgagcggggccggtgtcggcgaccctctacctcggctactcactcttcatggtcatcgccatcatgctggccaccggcacggtcgggttcatctcctcgttctgcttcgtgcactatctcttctcgtctgtgaaggccgattaagtttctccttgcgtggaatgatcattgaattgagaggtgagtaagcatagtggggagtgggcattgaaaaagtttgtagtcatcacagtcggtagttcatcccaacttttggtatacatgtcctgaataactatttgtatggtctagggaggattcgccagtgggctttatgatgaggtgcaggcagcttgcacgatgtaatagaatgaattggtttattcacatttaccgccattttagctgatcattctgccatttagtactctatatcaacgtgcaagcttagtagtgctcttctctgtgctgcagtttattttcagtcatt

SEQ ID NO: 36218 - DNA, 1537 bp, Triticum aestivum
  Clone ID: PAT_TA_36218
cctgtaggcatatgctcacaactcggggtcagaacctttcatcacctatgttgatgtcgccgacagcggtgtctatgcacatcgtcttcctcgcagcaggtgccgctgtgtagctccagcacctatggtatttttatttgtggtctccgggtgaaaacccaagatcgggcttgccggatcggatgatggtgttgtgtcttcgacagcactacctccttggaggcgtcatcttggaggcccaaaccatggcccctgttgctgttgtgtggttcaggctggtgcgtttggtggtggtgatgcggccagcttggggccgacggtggtgtatttctttttcaggtgtttctcttggctgtccttcgtgtggtctccgtcttgttgctgtgcatgctcaagaccctcccatggttgccgttgtgctgcggtgagctctgggctcttggtgttgtcttggttcacctttgctcaatgacgacgcaatgatgcctccccaacctgctaattgttctgaccgcccgtggcggatcttccagtcaaggttcgtgttacggtttggcactcgttgattgtggttgatcctctgttgtgccgtggggctcggtacgcacgccggtgcggtgcgttaggttgtttgcagagtcttggtattgtgatccctcgacagaaccccacatctacttgtgtctcttgtggtgttggtctttctgcctgctagctaggtcatgccctctcctgggtggcacttttttctcatcttctgtaaccttgttacctgtatggttttcggcccggttttcctcataaatggggtcaacttgtttagatttttgatccggttttccttataaactggatcagccaaagcttaaggggtcactcttggctttggcaactttttgagcaatatattcaggtggggatcctctcccccccggtgaccgttcaaaaaaaaactacaaggatgcttcttgaggcacaagaccaagaacagatgctaccgagccagacgatggtggtgcgcgcaagataactcgtatcaccagagaggaggggggcagcgagcattgcttaaatcatggtgtgccactaggaggcataccaagctcctggaagacaaggacgatgggtctccacctcgaccttccaataccccttcctttactttgtggagggtcctcgtggagtggttggcctcagggataatgccgagaacatcttattggacgagacaaaagatgtgtgcagtgggtatgagagtggagaagttgtaccagagggacccggccaacaatgatcgtctcatagtggtgtatccagttaagatgcataaaattcaagaatgtgagaaaagaacagagcaaatttctaagcccaatagatttttgtgtagaaagatgcttttgcatccacatattattgcaactcttcgtttcagcccgggcaacgatgaactaggtcgtagtcgtgtagcccggacacaagcaaagcaacatctgttcaagcttatcttttcagaaccgcaatatattctccagac

SEQ ID NO: 36219 - DNA, 1115 bp, Triticum aestivum
  Clone ID: PAT_TA_36219
cgaaagcttgccgcgctcttgccggccgatggcgtcggtgtctgtgggcgtcgtttcaccttcttggaggcgccgccgtggagtccacccttcacgcacccttggatccagttcttcgggcgaaagcctaagacccagtcaggtcgggcgacggcgtcggcatcgttgcttccctctttggggcgtcgcctggaagaactttggatcttgtttgcacgctccatgggttggtcatggtggtgcggcctgctcaggaccgagggtggtgtgttcttcttcaggtgtttctcttcggttgtcctacgtgtggtctctggcctgctctatgcatgctcatgcccatgctctgttgaggcgagcctcaggctcttgggtctcgtcttggttcatctttgcttaatgacgacgcaatgacgcctccccgacttgctaatcgtcttgaacttccgtggcggagcgctcagtcaaggactgttggcatcgacatggcttgggcgaattaatttggcgattaagaagacatggtggtgttatctcattgttagaacaggattgtatttcgatgacagaagccagttcatgagtcaattggccaacgacaccctgaataagttgagagtactcaatggagtgaaatttgaatacagctactggaatatccatacacacggattcgccggtcagcaaaatacgcaggttgatgccttggccatggacatacttttggaatctaggccaaaagatgaccaaggtaatgcatttgtagagctcatgcagatgaaacccgaggctataacaaaagaatgtctaaagtttctgactgaaaatgatcacctcctctttattgatgagatggagtccaccgcagaatgggactcgattaaaaaacacctgttatgtgagtctactagagcttatatcgttgttcttacaagaagtaaaaatgtggccacatattgtgtagatcataaagaatatcagctgctcaacctcagagatctgatgatcaagatatgcacgtatcatactactatgtgtaattacaataataattaattaatgcttctatgtgattctacgagaagccaattaaaaaaaaaaaaaaaaaactcgag

SEQ ID NO: 36220 - DNA, 533 bp, Triticum aestivum
  Clone ID: PAT_TA_36220
cccacgcgtccgacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaaggtctcctacgacaggagaaagcaactggccaagctccgcgtcaaggccgagaaggcagccgaggagaagttgggaactcagctggagatcctggctccgatcaaatactaagagatatcagagctttcgtgcgccatcagttttgggaaacctctgtcgtattttaagtagtttggtaactctgatagtacaatctggttggtaaacctttgttatgcatgcagttctgctaccctcatttgaaattttctacctggtgaactgttccgtttatcaaatgtgtgcatttggagattctagtgaatgtctatcaggtgattatatgttgctgaagccgggttttttaatttaaaaaaaaaa

SEQ ID NO: 36221 - DNA, 1622 bp, Triticum aestivum
  Clone ID: PAT_TA_36221
ggaattcggcacgagggagaggggccgcccatggctgcgcccttcgtctacacccgcagctccggcggcggcaccagtcaggacgcggccatgcgggcggcgttcgacggcgacctccggcgcctccgaggtactgtaaagagtctcgatgacccaagggtgatcttctctttcgacatgggtggtggcattggtgtgctgcacatcgcagctgtcggagggcatcttgaggtttgcaaatacttggtggaggaactcgggggagatgtgaatgctcctgctcctggagtaggagactttgcaggtgtgacaccctttatgtcatctgctcagtctggcgatgtttctactgtgaagtatttgcttgatcatggcggtgatctaacaaagtcagatgctaaagggcgcacagttctccaccatgcggcatgcataggaagctgtacggtcaccgagttcctactttcaaaaggagtacctgttgacatagactgtggccgtggtacaccactccatcaagctgctactaatgaacaagataaaacagtgaagattttgttggaacaccatgcagatcctaacgccactgtcgtcggaattggtactgccctgatgggtgcccttctttaccgttctttgaagtgcatgaagctgctgatcaagggtggtgctgatgtcaaccgagggagctcccttccgatgactcccttagtgttcactacagggtggggaggctatacaaactttgtgaagtttctgttaaaggcaggagcggatcctaatattcctgatgcttatggtaacttaccaatagagcttgctgctaaacgtgactgcatggaagaagttgaaatgttgtttcctttgacttccccaataccaactatcccaaactggagtatagatggaatcatctcgcatgcaaaatttgaaagtgcaaagccactggatggaaggcagcttgaacaaacaaaagctacactcaaggcacatgcagatcatttattcaggctgaaggactacaaggtggcatcaaaaagcatatggtgtggcaatagatgtcgcgccgagtgcaacattgtacgcgaacaggagtctttgcaaactgctgctggatgatggtgaaggtgctctgtcagatgctctcagatgcagaatgctgcgacctaactgggtgaaagcttgctaccgtcaggctgcagctcacatgctactcaaagagtataaacaagcttgtgatgctctcctggacgctcaaaagttggatcctggaaacacagaggtcgagagagagctacggaaggccagggaattaatgaaagctcatggtgaggctgacaagtgaagcatgttttgttagggaaacactctttttggcttggattagagtagttgatcaactgaatgtgatggtactcatgtgaccagaaggctggtggtacccaacttaagagtctaactctagagtcgttgaatttctagagttcttactactgctacttgttgattgcatgctgagaggatttggtgtgaaaaatgtgctgtacctaacttaaaatctaactctagactcgttggatctagcacaaatggcctacctgttgaatatttgctgatttttc

SEQ ID NO: 36222 - DNA, 1670 bp, Triticum aestivum
  Clone ID: PAT_TA_36222
gccaggcccaacccaaactgaactcttctccccccgacccaaaccccagccccgccgccggccaactccagtcccttcgccgccgccgccgccgccgccgcgtagacgcgaggacgcacacgcatccgctaccaccgcggccatggtcctctcccaccgccgcttcctccttccaccccggcctctttgccatcggcgccgtcgcaccactgccggcccctgctcgagctggtcaggcggcgtgcagatccgccactgccacagcgtcgtcgtcctccacaaccacgcagcggctcctcgcccgcgaccctcttctccagtttgggggcaaggaaggagaagcctttctcgctcgatctggcgaggatggatgcgcagcaaggtcaggtgcaccaccgtgatgatggggattcattcttgctgccacgattcgtctcgtcgtcctccccggcattcgcataggtcaggctcgtggggacggtgagtggcaaggcggggaggaacacggatatgtcacttcatcagatggcaggtaggaggtacaacggccagcgaccgggacgacaccaacagccaaaggaagcttgaggtctgctccttctccaccagtagagaggagcctcctttttgggttccgcgtgtctgctccgagcctaccagcgccgatgccatggaagatttactcaggcacgcgaagcgtaatgaggagcagctgctgggcgtgatgttgatcgatcctagcctgtcttccggctctcagtgatttgctcctcgaggtgtatgccgtgctgcacctgaatcctgttgactacgagcagcggaacgccttgtttgatgtattcagcaacatggcaactaaaatctttggtaagagatgatatagtttgcctttgttactaataatgtgatcactgaatagcatgatgaacttgtcgcagagtagagaaagataacatcgtcatgaatattatctctcttccagttatactccctccgtaacttaatataagatgctttttgacactatgccagtgtcagaaaacatattatatgaagttacggagggagtagtaatcagcggttttactctttgtatttgagatttgctcaaaaactctcgttacttatgttatctatctacttacggagggagtagtaaaactaataagaagaataccattcttaatatgtttgattctggttatttgttatctatctacttatgttatctagcatctacacgatacttttgtggaaggtggactgtcgctgtcagaaatcagaaatactattttcttggctttggtcttttggacagttgaagtttgtgaataatcatgctgtgttgttagttgttactttaagtatggtccctgaactgctagtggcccttgaattgtactccctccattcctaaatataagtctttctagagatttcaatagggactacattcattttcctccgtatgtagtctcttttggaatctgtagaaagacttgtatttaagagtggagggagaatttgggttaaccaataccaagtttgtgtcccatttagcgatatttgtctttctttttttttctccctgaaacgctagggggctatatttgagaccattgaatttatatgaccgtttcatgtgtttcaaaaaaaaaaaaaaaaaaaaa

SEQ ID NO: 36223 - DNA, 1500 bp, Triticum aestivum
  unsure (1)..(1500): unsure at all n locations
  Clone ID: PAT_TA_36223
aactcgtgtgccgctgcctcgtctcgtctcgtcttctcgaccaagtttctccctttctcctctctctctttctctccgcgttgtggctgtggcctgcggggcgcgggccggcggcggttgctcgttcttcttggcgtatggtcggccggatggagcggcagacggtgtcgacgtcctccgcgtcctgctccccctccgccgcctcctcatcctcttcctcgtcatgcggcggacggaagcggcccgacatactcaacatgatccggagtgcagcatgtctgaattcatcatctactgatactggcaaggggcggagtaagcaatcaagcaccaaggtgacacacggattccacctggttgaagggaaatctggccatgacatggaggactaccatgtagcagagtacaagtgcgataagaaccatgagcttggcctctttgccattttcgacggccatctgggggaccgtgtgcccagttacttgagagctaaccttttctccaacatactcaaagagcctctcttctggactgaccctcaggaagcgattaaaaatgcatatggctctacaaacaaatatattctggaaaatgccaagcaacttgggccaggcggttcaacagcagttactgctattgtagttgatggcaaggatatgtggatagcaaacgtaggcgactcgagggccgttttatgtgaacggngtgctgctaatcagatcaccgtggaccatgaaccccatatatccaatgaaaggcagaggattgaacagcagggtggctttgtcacaacatttcctggcgatgtccctcgcgtaaatggccaactcgctgtcgcaagggcgttcggtgaccatagcctcaagacgcacttgagttcggaacctgacattaggcatgtacccataaactcaagtatagagttcgtcatacttgccagcgatggattatggaaggtgatgaagaaccaggaagctgtggacctcgtgaagtcgacaaaggacccccaggcagcagcaaagcggctgacgaccgaggcgctcgcgaggaagagcaaggacgacatctcctgcatcgtcatccgcttccgctgctgaatcgacctcattctccgatcatttcaatttctcgatccatgactgagatggcgtcgtgatctgattctctgctccgattgaaattatgtagtggctgttattgtttgtacctatagtagctgtgaacaggcttgaggttagaacatttcatgggaagacggtggagagtctgaggcttggggctagtagtgagtagtggctagtgtgtgcagggtgtgtcattcatctgtgcatatgttacaccgccataagttccccgccaatctgtggaacatctcgtttgtgtacttggttgattgtgatggtaaattggtaatggaccaatcatgttaaggttgcgctttgaacttatttaaaaagattgtttaaaaaaccagaaggttgtgtgcaaaaaaaaaaaaaa

SEQ ID NO: 36224 - DNA, 780 bp, Triticum aestivum
  Clone ID: PAT_TA_36224
tgaggggcctggcggccgggctgaacggcgtgggcagtgccgccatgattgacggcgcggagttcgacggcgccaaggcatacaaggacagcaaggtgtgcaacatgctgaccatgcaggaattccaccggcggtaccacgaggagaccggcgtgaccttcgcgtcgctctacccggggtgcatcgccaccactgggctcttccgtgagcacatcccgctgttccgccttctcttcccgccgttccagaagtacatcaccaaggggtacgtgtccgaggaggaggccggcaagaggctggcgcaggtcgtcagcgagcccagcctcaccaagtctggcgtctactggagctggaacaagaactcggcgtccttcgagaaccagctttccgaggaggccagcgacaccgagaaggcaaggaaggtatgggagctcagcgagaagctcgtcggactcgcatgatcaccaaatggccggccctcccggcgaggacgcaatccccgatcgatcgtcatccgcaccaagtggcgaaattttgtgcttcttttctcaagccaaaaaatggaaaaataattgtaggacacgtttcgcacaaactgctagattaagtacgcggtgcgcccgattaagtccgaagtggttacagttcgcaaggagtttaagcctgtaaaactagttctttttgctttgatttggtataatagtgccaataaagtgtcttgggcggccaaaaagtggaagtacagttcgacttttttagattcatccggtaacccccccc

SEQ ID NO: 36225 - DNA, 1375 bp, Triticum aestivum
  Clone ID: PAT_TA_36225
cgctctggtcattgcgttcctcgccggcatcgtcttcgtcatactgctacagcaccgtcaggcgcgatctcacgaggtacgaggagctcgacagtgaggcgcaggcccagatgaacgaggagctgtccgggtggaagctcgtggtcagcgatgtcttccgtgcgcccagcaacccaatgctgctctgcatgatggttggggatggggttcagatcctgggaatggccgtggtcaccatcctgtttgccgcgcttgggttcatgtcgccggcctcccgtggtaccctgatcacaggcatgctcttcttctacctggtcctcgggatcctggcaggatacgccagtgtccgcgtctggaagacaatcaggtgtggagatcactcgggctgggtgggtgtttcgtggaggacagcctgcttcttccctggcatcgccttcctgatcctcaccacactcaacttcctgctgtggggaagccagagcaccggcgccatcctcttctcgctgtttgttgtgctgatcctgctctggttctgcatctctgtgccgcttacgcttgtcggcgggttcctcggtgccaaggcgccgcacatcgagtaccctgtccgcacgaaccagatcccgcgtgagatccctgcccagaagtacccgtcctggctgctggttctcggcgccggcacactgcccttcggcaccctgttcatcgagctcttcttcatcatgtcaagcatctggatggggcgcgtgtactacgtcttcgggttcctcttcatcgtgatgctgctcttggtcatcgtctgcgccgaggtctccctggtcctgacctacatgcacctctgcgtggaggactggaagtggtggtggaagtcattcttctcatccggatccgtggccatctacatcttcctctactcgatcaactacctggtgttcgacctcaagagcctgagcgggccggtgtcggccaccctctacctcggctactcgctcttcatggtcatcgccatcatgctggccaccggcacggtcgggttcatctcctcgttctgcttcgtgcactatctcttctcgtctgtgaaggccgattaagttcttcctccctgcgaggagtgaccattgaattgagaggtgagtaagcatagtggagtgggcattggaaagagtttgtagccatcacagtcggtagtccatcccaacttttggtatacatgtcctgaataactatttgtatggtctagtaggattcgcccggtgggctttatgatgaggtgcaggcagcttgcacgatgtaatagaatgaattggtttattcacatttcactgccattttagctaatcgttctgccatttagttttccaaaaaaaaaaaaaaaaaa

SEQ ID NO: 36226 - DNA, 671 bp, Triticum aestivum
  unsure (1)..(671): unsure at all n locations
  Clone ID: PAT_TA_36226
attcactccaatcccccaagcaatccaccaagcaaacccgatggcccgcacgaagcagacggcgaggaagtccaccggcggcaaggcgccgaggaagcagctggccaccaaggcggcgcgcaagtcggcgccggccaccggcggcgtgaagaagccgcaccgcttccgccccggcaccgtggcgctccgggagatccgcaagtaccagaagagcaccgagctgctcatccgcaagctgcccttccagcgcctcgtcagggagatcgcgcaggacttcaagaccgacctgaggttacagtcctccgctgtgtcggcgctgcaggaggccgccgaggcatacctggtggggctgttcgaggacaccaacctctgcgccatccacgccaagcgcgtcaccatcatgcccaaggacatccagctcgcaagacgcatcaggggagaaagggcctagattcgtctgcttccttcccagtgtctgtactctgatctgcaggtgtagagatcttgttgtgattccccgttccagataatgttatgttctagtgtctgatgttaccatcttgttgtcatcagcaatctgaatcaactntgacaatcaccttagattcagcaaagaagccattttgtgttcttgtgaagccaatgagtctgatgaacatgggtgaccttca

SEQ ID NO: 36227 - DNA, 737 bp, Triticum aestivum
  Clone ID: PAT_TA_36227
cgtccgcccacttccgcaaaggagatcgataaggccgagaggaggaggaagaagctccagagttcaggcgaggagagggatcgcgttgcgcgtcggcgtggcgatggatcgggtccgcggctccgcgctgctgctcggcgtcctgctcgcaggatcgctgtttgcgctttgtgctgcaaaggaggaggccaagaagctcggtaccgtgatcggtatcgatctcggtaccacctactcatgtgttggtgtgtacaagaacggtcatgtcgagattatcgccaatgaccagggtaaccgtatcacgccctcatgggttgggttcaccgatggggagaggctcatcggtgaggctgccaagaaccaggcggctgtcaaccctgagaggaccgtctttgacgtcaagcgtctcattggaagaaagtttgaggacaaggaggtgcagagggacatgaaacttgtcccctacaagattgtgaacaaggaggggaagccttacatccaggtcaagatcaaggatggagagaccaaggtcttcagccctgaggagatcagtgctatgattcttggaaagatgaaggagaccgctgaggcataccttggcaagaagatcaatgacgccgtcgtcactgttcctgcgtacttcaatgatgcacagagacaggcgaccaaggatgctggtgtgattgctggcctcaatgtggctaggatcatcaatgagcccactgctgctgctatcg

SEQ ID NO: 36228 - DNA, 898 bp, Triticum aestivum
  Clone ID: PAT_TA_36228
gcgggatggcggggggcaggcacaaatcatttcggccgctgcgtcgtccctccgccttggccttggcactggcaccggtgctgctggactagtactactactactgctatctcgttgcgtcccgacaaccagaaaggagaggagagagggggagagaggaaagggcaagccaacccagctgcaacacaggggcggagcgagcggagaatcgagggatctctctgccaaggaagaggaggaggagatacaccaaaacacctactgcttctctgatttcatgcgctgctgaatcggcgtctcttggcttccgtagcagatggcttcagtaggcgttgctccctctgggcacaagaacagcagcggcaccagcatgggtgctgagaagctaccagatcagatgaacgatttgaagataagagatgataaggaagtggaagctactattattaatggcaagggaacagagactggacacataattgtcacaactactggtggcaaaaatggtcagccgaaacagaccgtgagctacatggctgagcggattgttggtcaaggttcatttggtattgtattccaggctaaatgtttggagacaggggaaactgttgccattaagaaggtccttcaggataagcgctacaagaaccgtgagctacagaccatgcgcctgcttgaccacccaaatgttgtagctctgaagcattgtttcttttctacaactgagaaggatgaactgtatctaaacttggttcttgagtatgtgcctgagactgtccatcgtgttgtcaagcattacaacaagatgaaccagcgcatgccactaatctatgttaagctgtatacgtaccaaaaatttaggggttttggcttacattcatggcagccatggaagttg

SEQ ID NO: 36229 - DNA, 824 bp, Triticum aestivum
  Clone ID: PAT_TA_36229
ggcaccagatcgtacacaacaggaaagggagtatgcgctgagatccttcaagagtggagcaactcccatcctggttgcaactgacgttgctgctcgtgggcttgacattccagatgtcgcccacgtcatcaattttgatctgccaaatgacattgatgactatgttcaccgcattggaagaactggaagagctgggaagtctggtctggcaactgcatttttcaatgagggcaacatgtcactggccaggccgttatgtgaactgatgcaggaagccaatcaggaggttcctcagtggctggagcgctattctgcccgttcctcattcggaggcggcggaggaggcagaaaccgcaggtcaggaggcggcggtggtgctcgatttggtggacgtgacttccgtcgcgacacgaggggcggtggcggtggaggaggtggcggttacggcggtggtggtggtggcgggtacggtggtggtggaggttatggtggaggtgcgtctagctcgtgggactgatggattggtaatgttgagaattgaaatgaaaccgatggatggatggtattctattgacttagctgaaaacagatattggggtttgtagtcaccgtggtgtgggtatggtgcccttgcccccatttaccttattttgtgcctggttgttgtcaccgcacttgtgtttcccctgtactggttattttctgactggcatcaaagtccgggtgggctaatttcctgttgctgctgctgtagtttttggatgatgtttattgttgggtgggttggtcggtggtcattgttgcgcttctgcttctttcccagc

SEQ ID NO: 36230 - DNA, 957 bp, Triticum aestivum
  unsure (1)..(957): unsure at all n locations
  Clone ID: PAT_TA_36230
gccggccgggttccgccagactcttccacagttccacgtctcccttccgtccaggcttcgctcaccgaaatggcgaaaccctcccaatcccgcctcctcctcgtcttccccgtcgccgccgtcctcgccgcggccttcctcctcccgctcgcccgctccgacgcctccgggcccaaccccaccgcctacgacgagctccgcctccgcggcttcccgcgcggcctgctcccggccaacgttcgcgggtacacgctcgacgccggctcgggggacttcgccgtcgacctcgactccagctgccgcatcgtgctgccggcggggagctacctcgccaacttcaacgaccacctcaccggccacctcgacgaccgtcgcatctccggcctcagcggcatccgcgtcagggctttcttccgctggtggtccatcaccgggatccgcgccgatggagacgagctcgtcttcgaggtgggctccgtctccgccaagttccccgcccgccacttcaacgccagcctcgaatgccccgccaaggccgactcttagtactataacaaggaactgttgcgtgcctcatgacactggcataccatcaagtcgccttgacgtcgagcactatgattgtttttaatctctcactgcctttgtaattactacttgtgtataaggctggatccctaagccaccactccactttcgacaccaagaaagcgggataatgtaaaggttcttctttgctcttttgttggatggcttgtcgtaataatcctgggaactgggaaatggggttttatttcagtttgtaatctatacaacttctgggtttggcgagtataccacctaacgtttctctttgntaattttaaagtagaaacgagagatgtaaatgaacatgtgtatgtcgttantggatgaagttgatatttataaaanaaaanaaaannaccccaggggggg

SEQ ID NO: 36231 - DNA, 1157 bp, Triticum aestivum
  Clone ID: PAT_TA_36231
gcacgagggaaccaacaacagcacccccacttccccaaccgtctcctcgtcgagaagaatctttcgggaagcctctccggtctcccatccccccccgccgcgactcctcgccagcaatgcagctgtatcaccatccatattcactggacagtcagaaggtccggatagccctggaagagaagggtattgactacacatcatatcatgtcaatccactaacagggaaaaacatgaatgtgaccttcttccgaatgaacccttcagcgaagctccctgtcttccaaaatggcgctcatgtcattttccgcgccatcgatatcattcagtacatagacagactcgcggtgcacttaagcggcgaaatccagcctgtgaatactgaggttctccaatggatgcagaaagttgatggttggaatcctaagatgttcacactaactcacaccccactaaagtgccgtgcatttgtctccaagttcatacgccgggtgctgattgctcggatggctgaagccccagatttagctagcatgtaccatgtcaagctccgtgatggttatgagaccgaagacagactgaaggaccccgagactatgcggcaaagtgaggaagagctgagcaaactcctggatgatgttgaggcacagcttaacaagaccaaatatctcgctggcgatgaattctcaccggctgattcgatgttcattcccattcttgcacgaatagccccttcttgatctgcatgaggagatacatcagtagcaggcccagggtcctagagtaccacacattggtcaagcagaggccaagctacaaggttgtaattgggaagtacttcaatgggtggaagaagtaccatactctcttcaggacctcgttcttcctttgtgttcgaaccttgttccgaaaatactaagtggttcagcgtgttgcgtagacgatccatgctgaaccaatgtgtagagtgagtttaggctgaatatatgaccagtataccatcatgtgtttttcctccaaggccaggctgatggttcctgagagttttgttttctatagacctgtctgctccaatgtcgctgtttagagcctacagaatttagatgttgaattacttacagaataataggcctatatatatacagtttgggtttttttcc

SEQ ID NO: 36232 - DNA, 1144 bp, Triticum aestivum
  unsure (1)..(1144): unsure at all n locations
  Clone ID: PAT_TA_36232
accggtccggatttccgggtcgacccacgcgtccgaaaacacgattctgccagtaataacaatgtaagagatagcacagatcacggtccataattgtcctaagcagagcacacagcagcagcacccacacaaggcaggtaccgcacatgcaatcacaaaagtcacgcattttgtatcaccgtccgctaattctctcaattctgatattctcctagtgctgcaagttacatgacaatatatgaaagacttttaacacccttggtctacaactgctgcgcgccaaattaacccaatggaagacacccatttgtatttttaaccagaaggtggcggtggaggaggtggcatggacattggaggtggcggcattccaccaccttgttgtgggggtgggggtggcctccacataggtggagcttgcatattgggaggtggcggcggcggcctggccatgtgatgaggtggcggcatcatgttttgcggtgggggcatcatgttttgcggcggcgggggcatccctggaagcctgtattgaagctgctgttgcatcggaggtggtacttgttgcatattctgtggaggaccaggccaggcaggctgtccatgcatctgcatgggagggtattgaccaacaggtggcggcggcggtctgacatgttgcatctgtcctgggacattcccattggcaaaaggccgtggcacaggtgcaccaacaccaccgttttgaagcccttgggttggcggagcagttgcaaacattgtgtgtggcctatgcttctgagatcctgggttgttcgccgcaagcaacctctctgctggtgtgccatggcgctctcctttcgtgtctttcttgtaagcatatgagacagtgattggccgattacataaatgctggttgttcatggcctctatagcttgatcagatgattcaaaggagtcatagctcacaaagccaaaccctcgagaatttccagtttcagggtcccgcattatcttagggttggtcacaatcacaccaaatgcactgaaggtgtcatagagaagcttctcatcgacttccggatcaagattgccaataaaaagattcgcacccacatccaagctcttctntctnggaactcgtccgaattcctcagcccggggg

SEQ ID NO: 36233 - DNA, 899 bp, Triticum aestivum
  Clone ID: PAT_TA_36233
taggggccttttttttttttttttttgtcattatgatttgatttgaacctgaattttctctttattcgtgtgcccctttttactacttatacgttgataacaagacgaatgcaacactttttatttagatctctatatcaggtgacaagtaggtgatacttgacattacactaagcccccacagtggaaaaatgggtaggcgtcaaaatttgatatccactcatcttgaagaatctttgggctaatttgtccaagccagttatttcaccatcagcctgtacgatgaagatgccaaaagatggacaaaggaacctgctaggtatactgtgctgctatctcgcgcatcaggctttcaggagcttctataccaccagtgaaatgctcaaattggcccatggcttgtctaacaaacatttttacaccgctaacaactttcactccatgttcttttgcttctcgtagaagccgggtaacttttggggcatataccgcatcaaacactacatcatagaaccttaaagctttcttcggaacaggagtgccatcaacatttgggtacatccccaatgatgttgcattagcgaggattgtcccttcttcaggcctgaaattttccaggtcggctaacctcagggcctggccaccaactgcattggcaagagtaactgccttttcataggtacgatttgctactacaactcttgcacccttcttctttgccccataggcaattgccttagcagcaccaccagcacctacaacaacaataagcctgccagacaatggtgacatagcagcatcctttgaccccagaccatcctcaatagcagaaattgctccaatgtagtctgtattgtagcccactaatttgccgtctgatttcctaactatagtgttta

SEQ ID NO: 36234 - DNA, 1196 bp, Triticum aestivum
  Clone ID: PAT_TA_36234
cgccttccagttcgagttccaccgcccgcagcaaccaaagccaagtttcgaagccgccgccgccgaggagcaggagaaggcgagaagccatggcccgtaccaagcagaccgcccgcaagtccaccggcggcaaggcgccccgcaagcagctcgccaccaaggcggcgaggaagtcggcgccgaccaccggcggcgtgaagaagccccaccgctacaggccaggtaccgtggcgctccgtgagatccgcaagtaccagaagtccacggagctgctgatccgcaagctgccgttccagcgcctggtccgcgagatcgcgcaggacttcaagacggacctccgcttccagtcccacgccgtgctggccctccaggaggccgccgaggcgtacctggtggggctgttcgaggacaccaacctgtgcgccatccacgccaagcgcgtcaccatcatgcccaaggacatccagctcgcccgccgcatccgcggggagcgcgcctaagcgagcgaggcaagtccagccccccgtcaccaccgtggcgacgttcgccggcattactagtactagttgattagcttcccctgtcgagataatgcatcttgtggtccgttgtagaaaacctggtgtgattagttatcctagttacggagactcttgtctgcttaattggttttagtttgcctggctgcctcctccgcgtccgagctcctccaccggcgacataagcgacgccctcaaccccctccgtctgttgctcaggatccaagctccgcccctccagcaacggtgatggaccgcggccgtcaccgtcctccttcccggatctctactccgcctctaagctctggcctcctctggtgaccgcgacgacgacggttctctgttcgttttctacctcctccggtcaagatccaggaaagtgagcacagcctcctctcagatcattttcaccatcgtcaatctcaggtactcgaggacggcggcgaggtagacgggggcgccagagccgacgcgctgcgcgtagcggcccttcttgaggtagcgcccgatgcggccgacggggaactggagcccagccttgacggacctggtcaccgacttcttcctgtcgccgcccttccttccggccatcctgcttgctgcttctccggcgagctggaaactactcgagatgcgacctcggccgcgaccacgcta

SEQ ID NO: 36235 - DNA, 2012 bp, Triticum aestivum
  Clone ID: PAT_TA_36235
ggtcgacccacgcgtccggcgtctcttcctttctttcttgcttctccctttccccctcctcctccttgactccgccgccgtctcactcgcaacacccccgtctgctatctcttgggagaggtgggagtggaggaggctagccgacgccgcgacgcaggcgaggttcttttgagtttctttctgataccatggggcagaggctcctcttattggtgaccacttgtctgtgggctctttcatgcgccgtgccgcaccatgcttcctcgcttgatggactgcttaggatcaacctgaacaagaggagcttgacctatgaatctctggccgcggcaaaggcagcgaggcagcacggcgccctccgactgaagagcagcgatttagacagcgacatcgtgcctcttgtcgactacctcaacacccagtactatggggtcatcggcctcggcacgccgccgcagaatttcacggtgatattcgacaccgggagctccaacctctgggttccctcgtcgaaatgctatttctcgatagcatgctacctccacgccaaatacaagtcgagcaagtcaagcacttacaaagcagatggtgagacttgcaaaattacatatggctctggtgcaatctctggatttttcagcaatgataatgtgttggttggggatcttgttgtgaaaaatcagaaattcatcgagacaacacgtgaaacaagtgttagttttatcgtcgggaagtttgatggcatccttggccttggctaccctgacatctccgttggggaagcccctccagtatggctgagcatgcaagagcagaagttgctcgctgacgacgtattctcattttggcttaaccgggattctgatgcactttctggtggtgagcttgtctttggtggcatggacccagatcactataaggaaaaccacacctatgtccccgtgagccgcaaaggttactggcagtttaacatgggtgatctcttgattgatggccactctactggcttctgtgccaaaggctgtgctgctattgtggattctgggacttcccttctggctggcccaacagctatagttgctcaggtgaaccatgcaattggagctgagggaattatcagcatggaatgtaaagaggtggtgagccagtacggagagatgatccttgaattgttaatagcacagacacagccacagaaagtatgcagtcagattggtctgtgtttgtttgatggtactcactctgtcagcaacgggattgaatccgttgtcggtaaagaaaatgttggctcggatgttatgtgcacagcctgtgaaatggctgttgtgtggatagagaaccaactccgtgaaaacaaaacaaaggagctaatattgcaatacgctaaccagctgtgcgagcgtctaccaagccccaatggagagtcaacagtcagctgccatgagatgtcaaagatgccgaatcttgctttcaccatcgcaaacaagactttcgtgctaacaccagagcagtacgttgtgaaacttgagcaatcagggcaaaccgtctgcatcagtgggttcatggcattcgacataccgcccccacgtggtcctctctggattctcggggatgtcttcatgggcgcttaccacaccgtgttcgacttcggcaaggacagaatcgggttcgcagaatcggcttgaggagtcgagagcactatgacgtttccgaagatctccacgtacgtatcctagaatttgggtatcttcgacatgggagccctgctgtaaacgaattgataggtaaaaagctgaaacaaaagagagagccttttatttctttcttaaacaaagaataaatggatgattcaactctgaagacaaaaaaggcacgtttgtatccagtatagctgttgctgtctaatgaagaatggagtgcttgcacggtgaaaacttagagtaaacaggcaacacatggtttgtaaaaaggtttattgtatttgtaaaacatacgacgatgtaacaatcaat

SEQ ID NO: 36236 - DNA, 1237 bp, Triticum aestivum
  Clone ID: PAT_TA_36236
ctactaaagggaacaaaagctggagctccaccgcggtggcggccgctctagaactagtggatcccccgggctgcaggaattcggcacgaggcgccacagcctccaagccctcgatctcccccatcggagctccctgcccacaaccccccacccccacccaaccatggcggaccgcggcggcgagcgtggtggcgaccgcggaggcgagcgcggcgggttcggccgcggcttcgggcgcggcgggcgcggggaccgtggcgggcgccgcggcggtcgtcgtggcccccgccaggaggaggagaagtgggtgcccgtcaccaagctcggccgcctcgtcaaggagggccgcttcaccaagatggaggagctctacctccactcgctccccatcaaggagcaccagatcgtggagcagctctgcccggggctcaaggacgaggtgatgaagatcacccccgtgcagaagcagacccgcgccggccagcggacccgcttcaaggcgttcgtcgtcgtcggcgacagcaacggccacgtcgggctcggcgtcaagtgcgccaaggaggtggccacggccatccgcggcgccatcatcctcgccaagctctccatcgtgcccgtcaggaggggctactgggggaacaagatcggcctgccccacaccggtgccctgcaaggtcaccggcaagtgcggctctgtcaccgtgcgcatggtgcccgccccgaggggttccgggatcgtcgccgcgcgcgtccccaagaaggtgctccagttcgctggtattgatgatgtcttcacttcctcgcgtggatccaccaagacccttggcaacttcgtcaaggcaaccttcgactgcctgatgaagacctatggattcctcacccctgacttctggagggagacgaccttcaccaaggcgccataccaggagttcaccgacattttggtgaagccgaccaaggccctgatgcttgatgcaccagccgagaagatcgaagcttaggatgtcggtgtaaagggtttttacaagctgagagctgtctaatgcactttgctttatttagttattaatactttgaatcgtgctgtttcaggatgtctctttttgccgtcaagtgttggtttgtggaactatgctactctcttttatcgtcaatggaagctacataattatggcaaaaaaaaaaaaaaaaaaaaaaaaaaaaaaaaaaaaaaaaaaaaaactcgcgtctagttctc

SEQ ID NO: 36237 - DNA, 709 bp, Triticum aestivum
  Clone ID: PAT_TA_36237
gccggccgggcctggaccaccgcgaagaaagatctcatcttccaaacaccagagcgccagatccccatcccctccaccacgatggcccgcacgaagcagacggcccgcaagtccaccggcggcaaggcgcccaggaagcagctggccaccaaggcggcgcgcaagtccgccccggccaccggcggcgtcaagaagccgcacaggttccgccccggcaccgtcgcgctccgggagatccgcaagtaccagaagagcacggagctgctcatccgcaagctccccttccagcgcctcgtccgggagatcgcgcaggacttcaagaccgacctccgcttccagtcctccgccgtctccgccctgcaggaggccgccgaggcctacctcgtcgggctgttcgaggacaccaacctgtgcgccatccacgccaagcgcgtcaccatcatgcccaaggacatccagctcgcccgccgcatccgcggggagcgcgcctaggtcttggttcgccggtaatactgctgggtagtagctgttcttgtctcgtgatctggatgtgtgtcgggtgcctctgtttgttggtgttgatatgatgtgtcgtctggtcctatgtatcgtcatgctcgaatgaaattgcaacggaaaagttcagtcatcgatctgatgctcgaatgaatttaattttgcttgaaaaaaaaaaaaaaaaaggccccta

SEQ ID NO: 36238 - DNA, 636 bp, Triticum aestivum
  Clone ID: PAT_TA_36238
attcggcacgagggtgaaatcccaatctccaaactcctcagcgcagcagcagccagatccttccccatccatcccaatggcccgcacgaagcagacggcgcgcaagtccaccggcggcaaggcgccgaggaagcagctcgccaccaaggcggctcgcaagtcggccccggccacaggcggcgtgaagaagccccaccgtttccgccccggcaccgtggcgctccgggagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctcgtcggcctcttcgaggacaccaacctctgcgccatccacgccaagcgcgtcaccatcatgcccaaggacatccagctcgcccgccgcatccgtggggagagggcctaggtttggggtcgctgctggctagtagctgttcttgtcctatgatctgaatgtgttcagggcgcttctgtttgttggtgttgatatgatgtatcgtgatgcttgaatgaaattgcaattaaaaagttcagttatcatgcttaaaaaaaaaa

SEQ ID NO: 36239 - DNA, 676 bp, Triticum aestivum
  unsure (1)..(676): unsure at all n locations
  Clone ID: PAT_TA_36239
ccgcagcttcccattcctcgccgccgccgctccgtacccgctcgaagccaacccgaccatggcggacgtcgacgttgacacggaggtggccgcgggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaaagaggaagcccatgggcgctccgtcaagaagctgcgcaaaggcgaaaaaggacgctccctgctgggtgaagaagcctgagccagtgagggacacatctcccgtaacatgatcattgtccctggagatgattggcaaccttatcggtgtctacaatgggcaagacttcaaccaagttgagattaagcctgagatgattgggcattaccttgcagagttctctatctcctacaaaccaatgaagcacggtaggcccggtatccggtgccacacactcctcccggtcatccctcccttaaatgatttatccgcttccacttttnaagattcattacggcatctggggattccaccactgtccccttgtttgaacattaaaccatatttgtccgttaactaattccttatcanatgacntccactaaancgtgaaactgttcatgt

SEQ ID NO: 36240 - DNA, 2017 bp, Triticum aestivum
  Clone ID: PAT_TA_36240
cacagggagcagaagggttcggcagcggtcacccacgccactgaggacaggggcaaggagggcgactcggcagccgcctctgcgcgcggcgccaaggacgcggccatgcacgcgctcggcatcacgggagaacaaactgtggccaagggcgccggaacgaaggacgccggcgcgcatggcgcgcaggcccgtgggcatcgtacgggccacaaggagcagaagagctcagactcagccgcgcgcacgctcggctccactggagactacgctgcggccaagggagcccaagccaaggacgccggcgcgcatggcgcgcaggccaccgcggaagggacggaggaggccacggctaccgccgcagagtacgccaaacaggcggcagcaaaggcgaaggaggtcacgctcaccacgggcgagatgacggcggagtacgcgaagcaggccgccgtgaaggccagggacgtcacggtgagcaccggcgggacggccgcggagtacgccaagacggccgccgagaaaggcgagagaggcggcgctggcggcccggcaagacgacggccgagtacacgcaacaggcggcggtgaagggcaaggacgtcacagtctccaccggcgggacggccgcggagtacgccaagacggccgccgagaaggccaaggataccgcgctggcggccggcaagacgacggcagattacactcagcaggcggcggtgaaaaccaaggacgtgacgctgtcgacagccgcgcaagcggcgcagaaggccaaggaggtgaccgcggtcacggcgcagaaggtggcggagtacacgaaggagatggcggagcaagggaacgccacggccgcccaggccgaggagaaggcgaaggaggccgcagcccgcgccgccgacaaggcggaggagccgagcttcgacacggacacacaggccacggacaaagccaagagcacagccgcaggggcggcggacaagacccgcgacacggccgagcaaaccatggacaaggccaaggacgtaactggagacacggggaacaggaccggaagcatggctgcgcaggtgaaggacacgaccggagccatggcgcagaaggccactgatacggccgcgtacatcaaggactcggtaacgggcgcagcaggaggcacggcggacaaggcccgcgacaccaccgagcaaacaatgggcagggccaaggacgccaccggagacacggggaacaggaccgggagcatggccgcccaggtgaaggacgcgacaggagccatggtgcagaaggccggcgacacggccgcgtacatcaaggactcggtgacgggcgcggcgggaggcgccgtggacaagacccgggacgccacgtcgcaggtcgcgcagaaggcaggggaggcgacgaacagggcggtggagaccggcaaaagcgccaccggcggcggcacgaccaaggcgaagggtgaaggcaccgaagacaccaagatcgtggaagacgtgctggaggtggtgggcgcgaccgtggaggcggtgggcgcgaccgtgaccgggctagcgcagcacaccaagggcatcgtcgccggcgaagaggagctcatcccggtcgagggggaggccgggaaggtcgccggagccggcgagggcagggtgaaatccgagtgagcagatccacacgtacgtcgcagcaaaaatgttgagagaatgttggttgtgcagtcactttgatcagacacgtttaaaagggtgctgtatatagttgtaataataagtagtgcactatatggagtgctcaggtgagccgaataatggtcgtttataggtaagaggactatgtcccagatgtttaagcttgctactagacgtttggaagggctcaggctagtcgaatctcatatcttatgaaatgaaatggctatctagtggatgtgaagtttttgcacccgagctcatccattgtaaaatcgaattaaaaaaaactgaaatttttaggccaactttcacaaatatagctgcaaagtttcatcaat

SEQ ID NO: 36241 - DNA, 798 bp, Triticum aestivum
  Clone ID: PAT_TA_36241
gaggagaggactcccggcggcggcgcgaagcggagagagagagaggggcagagagatgtcgaagcgagctggtcccccgaagcaccagaacacctacgcatggaagcccaacctcggccggaagatcaacgagaccgagcccgggggcaggttccggcctctgtcggagatcaccggcgtctgccagcgctgccgggaccaaatcgactggaagcgcaaatacggcaagtacaagccaattgttgagcctgcaaaatgccagaagtgcagtaaaagaaacgtccggcaggcataccacaacgtctgcactggttgctccaaggagcttgggatttgtgccaagtgctgcacctctgttaagcagcttgttggaagggatgctgaggaagcaaacagtgagcgcaaagaactagaggaggccatcagatatgctagggagagggaacgacggacacttcttcgccttatgaacaaaaacaaggatgagagcgggccatcagtcccaaagattgcagaccgagatcgggaaggcgaccttttccctgttgcatccctggacgaatatgctgaacaggctgtacagaaggatgagtctgatgaagaagatgccagggattttgtgaaagattaacttggcaaggtttggcactgtataaggatatttagttttgtgcacagacgctctttgccaggtgttccaactcaccggagaaatgctgatacttgttttaccagatatatatatttctgtttatcagatcttattttgaccagtgagcttacgacgccttcccagtt

SEQ ID NO: 36242 - DNA, 1503 bp, Triticum aestivum
  unsure (1)..(1503): unsure at all n locations
  Clone ID: PAT_TA_36242
ggcacgaggccctctctccctctctcttctttctcccgcacgcacgcgcgctgtttggtgagaggccaactttggtggtgaccatggagaggacgccgtcgtcgtggtgcatcctcctgtgtctggccgccgcttcggcggcggcggcggccccgctgccgcagtactacaacgccatattcagcttcggcgactccttctccgacacgggcaacttcgtcatcatcaactccggcaagctgcccaacatgcccaagttcccgccgccctacgcccgctgctccaacggccgcctcgtcatcgacttcctggccgaggcgctgggagtgccgctgctgccgccgtcggcgaacaagggcaccaacttcagccagggcgccaacttcgcggtgatgggcgccacggctctggagctcaagtacttccgggacaacaacgtgtggagcatcccgcccttcaacacctccatgaagtgccagctcgagtggttccaggaggtcaaggagaccgtctgctcctccccgcaagagtgcaaggagtttttcggcaaggcgctgttcgtgttcggcgagttcggcggcaacgactacagcttcgcgtggaaggcggagtggagcctggacaaggtgaagacggagatggtgcccaaggtggtggagtcgatgatcgacggcgtcgaggcggtcctcgacgagggcgcgcggcacgtggtggtgccgggcaacctccccgccggctgcatccccatcacgctcaccatgtacgcgtccgaggaccgcagcgactacgacccgcgcaccggctgcctcaagaagttcaacagcgtggccctctaccacaacgccatgctccgcatcgccctcgaccagctccagcgccgccgcccggacgcccgcatcatctacgccgactactacaccccctacatccagttcgcccgcacgcctcacctctacgggtacaagaggggagccctaagggcgtgctgcggcggcggaggcccgtacaactacaacatgagctcgtcgtgcgggctgcccggtgccacggtgtgcgacgatcccgacgcgcacgtcagctgggacggcatccacctcaccgaggcgccctaccgcttcatcgccaacacctgggctcaagggcccttacgcgtacccgcccctcgccagtgtcgtccgcgacgacatggtctattaacttaactactgttattaacacaaacacacacgatgatccttcatccatgactaaactacaccatacgtccgtccgctttctctctctacgtgtgaaccacgccttcatacaatcccgtgtgcgtgttttggtttgtaatatgcttagcaagttatacattggccgtgtcacgggaaggtgacctccaatctttttgacgccggattggctggcgcctctactgtcttgatctgagttggggacattgtatcgttggtgtatattggaagtaatcgattagttttnctgtnanaanaatctcccttt

SEQ ID NO: 36243 - DNA, 1385 bp, Triticum aestivum
  Clone ID: PAT_TA_36243
gcaaaaccgtggacgagcaccgccggtattccgctcccgaattccacagatttccactccccgctcccaaagccccgagactttatagccggcgagaacaaacccagcaaaatcccatctcccaacccagaaatcctcccacacccagaaatgaatcagcctctccttccccttctctgagatctcagcctgagcctgcgcgccggcgacttccaccggaatcctcctctcccagccgcagcgtcgccggattgattcaggaggcattcttgccggccggagaagcagtctttggtcatctgctcgagaagaatataacagaggctctagttcagatcatcatcagacatgtcgctgctatcgaagttacggttggtcactgtggatgtgactggtactctgcttgcttacaaaggacggcttggtgattactactgcatggctgctaagtctgccggaaagccatgccctgactatgatcgaatgcacgaaggcttcaagcttgcatacactgagatggcgaggaaatacccatgctttggatttgcggcaaagatgccaacgattgaatggtggaggatttgtgtcaaggattcatttgttaaggctggctatgattacgatgatgagacatttgacaaagtgttcaagcgtatttattccgccttcggctcctccgcaccatactcggtgtttcctgatgcacagcccttcatgagagggctgagggagaagggtatcacagttggcatcgtcagcaatgcagagtaccgttacaaagaggtcatcttgcctgcgttagggctgaatcagggctcggagtgggacttcggggtgttctcaggcatcgtcggcgttgagaaacctgacccaaaaatctacaagatcgcgctggagatggcggggaacgtcgcaccggaagaggcgctccacatcggcgacagctaccgcaaggactacgtccccgcacggagcatcgggatgcacgcgctgctcctggaccggttcaagaccgccgacgccgagagctggaggaagtccggcgcgccggtgctccctgacctcgaggccgcgcaggcatggctcaccaagaacccgaccgaggagccactaggggccgcgctgctgcgcaggatggccgagaagctctgaatctcgccccctgggatagttcctgttgtgctcttgctggggagtgagggagccaaggagaagggatgtgttgtagtgatggttcactggccagtttagctagctggagctacttgaactctggtagtaggcttccggtgctgtggtgactgctgaatgtggcaagtgattcagccgtgcgacgaacatcttgcaatgacgaataattctaatcatgtttcgcaaaaaaaaaa

SEQ ID NO: 36244 - DNA, 1774 bp, Triticum aestivum
  Clone ID: PAT_TA_36244
gaggaataggggctgcagccgccccatgcagatacaactgataaaaaaacttagtccaacacctttcaacactctttaattattgctgccaacagtcaaaactcacatcaaaatggtatgcagcgaccagccaaaattacattggcaaagatgctaagtatctattcacgcactctacagaacggccgagaatttacaaggcaaaactgacgcaacagaaggatcatactgttgctcagcaagtctacgcgttccctctttatctctgactatacgaccagttggatacagtatacgacctagcctaactcgcaacgcctattgcttttttcgtttgtacatatgacatattccacccatttgcttcagtaccctgctcctacctatgctaacgaatgggcgtcaccaatctataagcaagtaatgacttataacatcgatggctttctcatgactgaagaagtccgtcaccttcccagccaaggcggagcatctgatccactaccttcaggctcaaagcaggatcagtgaaaaccattaggcccttatcggcagtagaaactagaagattagtgttctcttcgtttaatgcaattgctgtgatgtcctggccctttccaagctccagtgtatgaaacaccttaagtttatgcagatcaacaaagcagatcgaaggcacgttaacagattgcctgatttcagtttgctcagatatatcaaccttgcgacttgatttgttgggctcacgatctgctacctcagtattgtcctcacacttgtaattgctggacgaacaagttccaatcagggcaaaataaccatccatagaaatctcaatgcaactaactcccccagaaaaaggtgatagaactgaggtagcaatagggactccattgactgtgaagctagataatcttttctttgattcactccaaaccaatatgattccctgagaagacaaggatacagcatgcgcctccgctacatgaatcttccttatcagccgacctgttcgcaaagaatgtagcaccacaccagacatgtttgacgaggatacaacaagtcccaagtctggaccaactgcacagctaattacttctccaaggtgtcctcttaacacatgcataggaccttcgattcgacacttcctggtttctaaaaggttgctcatgctactaggactagtaggaagagggctgcgtggtgtccttggtgttgcaggtggaggttcaggaggatttttcttatgtataaagcctgcctgatgaatcctccagagtataactgtagtatctcgagaccctgtcacaaggtagttgctatcaggggaaagtgcaaggcaggttactggagcaagatgcccagaagcactttcaattgtccttgctccgtctggggagatcaacttcaccgaacagtccgcatgcccaccagtgatgatgtctttgtcacatgtgacagcaacaatagctgaactacggattgcagaagcagcaaaccctatagctcttgggaactcataatcttctccagaactagtggatcctttgaacatacgcatgaatgcaccacttgttgaacttgcagcatttctaccatgatgaaaaaggaaaggtgtcccttggccatctggagtatttggttgccactggtgaagtgccacatgcgccgcgggcacatttatatctacaactacaatagaatcatttgatacaagcatggtacttgcagggacattgcagcgttctggattaggcagtacataagatttaag

SEQ ID NO: 36245 - DNA, 864 bp, Triticum aestivum
  Clone ID: PAT_TA_36245
ttttttttttgctgtcactggacatggcgatttattatttgctatcgacagagtacagcattactagtcattacagtagacacgagcaaggatgccactactcgcggacgtggctcccaaggcgcacggtgatcccgtcaaaatccctgacgtagccgaccttctgcccccagttcttctgctccggcgcgcttaccggcaccgcccccgttctccacggcccgccggtacgcggcgtcgacatcgtcgtagtcgaagcagatctccacgggccctcgctcacggggcgacttgggcagctgcacctcgcccgtgagcgcgtccgtctccctctggtgccgcggcgtgaacgcgatggtcgtcgagccggtgtccagctccgcccacttgtgcgagtcgtcgacgcggcggacgctgtagccgaaagcgtcggcgtagaaggcggccgccttgaccacgtcgtcgacgtaacagacgatgtacgcgagcttaggtctcaccgccccagacgccatggctcgtcccttccgtgcgtacgggtgctactgctgaccactttgagatggcgcggtgtttgccttgagctgttgtgccttccttgcctgtcgtacaagccggtgaagcacgggaggcctggtatcggtgccacccactcgtcgaggttcattcctctcaagtgagaatatggtcaggaaaattgtctgagatgtctggaatccagtgttcttatcctagtcaaatgtagcacctgatataccgtctgtcagtctagtggtggagcagctccctttgaaccttgaactaatccagttccagattttgaagttatcatgaggaggatcgaacaaaaaaaaaaaaaaaaaa

SEQ ID NO: 36246 - DNA, 1391 bp, Triticum aestivum
  Clone ID: PAT_TA_36246
cgtccgcccacgcgtccggccgctccctcgtctcgtcttctcgaccaagtttctccctttctcctctctctttctctccgcgttgtggctgtggcctgcggggcgcgggcaggcggcggttgctcgttctgcttggcgtatggtcggccggatggagcggcagacggtgtcgacgtcctccgcgtcctgctccccctccggcgcctcgtcctcatcctcctcctcctgcggcggacggaagcggcccgacatactcaacatgatccggagtgcagcatgtcttaattcatcatctactgatactggcaaggggcggagtaagcaatcaagcaccaaggtgacgcatggattccacttggttgaagggaaatctggccatgacatggaggactaccatgtagcagagtacaagtgtgataagaatcatgagcttggcctcttcgccatattcgacggccatctgggtgatcgtgtgcccagttacttgagagctaaccttttctccaacatactcaaagagcctctcttctggaccgaccctcaagaagcgattaaaaatgcatatggctctacaaacaaatatattctggaaaatgccaagcaacttggaccaggcggctcaacagcagttactgctattgtggttgatggcaaggatatgtggatagcaaacgtaggtgactcgagggccgttttatgtgaacggggtgctgctaatcagatcaccgtggaccatgaaccccatatatctaatgaaaggcagaggattgaacagcagggcggctttgtcacaacatttcctggcgatgtccctcgcgtaaatggccaactcgctgtcgcaagggcgttcggtgaccatagcctcaagacgcacttgagttcagaacctgacattaggcatgtacctataaactcaagtatagagttcgtcatacttgccagcgatggattatggaaggtgatgaagaaccaggaagccgtggacctcgtgaagtcgacaaaggacccccaggcagcagcaaagcggctgacgaccgaggcgctcgcgaggaagagcaaggatgacatctcctgcattgtcatccgcttccgctgctgaatcgatcccattctccgatcatttcaatttctcgatccatgactgatgtggcgtcgtgacctgattctcgctgctccagattgaaattatgtagttgctgttattgtttgtacctatagtagctgtgaacatgcttgagattagaacattgcatgggaagacggtggagagtctgaggcttggggctagtagtgagtagtggctagtgtgtgcagggtgtgtcattcatctgtgcatatgttacaccgccataagttccccgccaatctgtggaacatctcgtttgtgtact

SEQ ID NO: 36247 - DNA, 1683 bp, Triticum aestivum
  Clone ID: PAT_TA_36247
gcttctgcaagatactgcaaaagaaatggcaaaggaagtccaaacatcacgtagtggataaactaaacagaccgctgaagatctggacgaatttttaaacaaggttaggaaagttgaacgtgtatgcaatgatgaaatcttgaacttcgcgaagctgtttaatgatgaactgactttggataacatgagcagaccacgctttgtaaatatgtgcaaatatatgggcattcggccttttggtacggaccattactttgaggttcatgcttcgcaaaaaactgcgcgacattaagaatgatgataaggtgattcaagctgagggggtggagtctctttctgaagaggagctccggcaagcctgccgtgaacgcggccacctaggcctgctgtcaacggaagaaatgcgtcaacagctacgagactggttggacctctcactcaaccatgctatgccatcgtcccttctcatactttcaagagcttttatcgtatctgggagaatgaaacctgaggaggctgttgtagcaacattgtcttctctaccagatgaagttgtggatacagttggtacagtattgccatctgaagattcagtttctgagagaaggaaaaaactggaattccttgagatgcaggaagaacttatcaaggaggaagagaagaagaaagagaaagaagaaaaggcaaaacaaaagaaggaagagaaggcaaagctcaaagaaccagaggctgatgaacaagatttagctttaaatgaaatgaccgagcctactgctagggaagaagaagaactgagagaaggaaaacagcgtgacaaggaacaactctgtaatatcagtcgagccttggctgtgctagcatctgcatcgtctgttagaaaggagcgtcaagagttcctgagccttgtcaaccaggagataggactgtataactccatgattgaaaaagaaggcacagatggtgaagaagctaagagggcatatatggctgctagagaggaggcagacgacgctgatgaggtcgctgcagaagaaaaggtctcgtcagcgttgattgagaaggttgatgctatgcttcagggattggaaaaggagatagatgatgtagatgcacaaatcggaaaccgctggcaactgcttgatagggatcatgatggcaaggtcactcctgaggaggtagcggcggctgcggcttatctcaaggataccattgggaaggaaggtgtccaagagttcatcagcaacctttctaaagacaaagaaggaaagatccttgtggaagacatcgtgaagctggcttctcaaactgacgagaacaatgaagaccaagaagaagaatcacggcagtagttgcgaacacacttgaaaatttattttccgtgttgagatggacaacctattatttcagatcaggagtaacccttcgagtatcagagctacgccatgggagtgcccgtgtgtagatcaaaaggcaggataaccatttttttgtgcctctctgggctgacttggatgtaacgatgagtggctggcaaggcaaacttgctgtaaaaatgatgggatgcatataggtaggttcagtgctgtggattcggctggtaaatggcaactgtgatttcgacaggttgctacggaagtggaaatacagatcgtttgaacttggatgcatgctacgttccatcct

SEQ ID NO: 36248 - DNA, 620 bp, Triticum aestivum
  Clone ID: PAT_TA_36248
ggtttcttccacatttccactgagcaaagagaagcaaatcggcagagagcgaagcaaaccggcggttcctggcccctcgccatggccggcaaagctagggtgttcatgtgcgtggcgctcgtcgtcctcctgctccttgtcgagaccaccgctccgagtggacaagctcacgccgtcgattgcggcagcgcgtgctcgtaccggtgcagcaagtcgagccggccgaatctgtgcaacagggcgtgcaacacgtgctgccggcgatgcgactgcgtgccgcccggcaccgccggcaacgaggacgtctgcccctgctacgcccacatgaccacgcacgacggccgccacaagtgcccatgatccaaccgccttctcgacgaccgatcgaggctaatgcatgctcgatcatggcgtctcagttaatatcccatcaagctagctacaaccaacgataactagactaccagtggcacgatcgatatgatatcatgtactcaagctagtgctgctacctatctaccttgtgctcatccattcgtgattgatccatcgtgtaagcatgtttgctatctcattctcacgcagtggtaattgctgtcaattgcactaaaaaaaaaaaa

SEQ ID NO: 36249 - DNA, 914 bp, Triticum aestivum
  Clone ID: PAT_TA_36249
cagaacgtacaacaaattctcaaacacttgataaaaacaaaccaggaaaggccaagaagttaatgtagagcaagaaaaggcacacatgacttcaggatgtttattacggtacaacactcaacgaaatatacacgcacatgggtccttcgcatcccaactagggtaataatatgcatcacacccggtacacgcgatgcaaggaggaaacttcacatttcactagttcatcagctggacctccattttaaaccacttgatagtctatttcacctcaccttgccaagactactgagcaatcagtcatagcatgcagagctcatgcatcattagcgtagacacgggtccactctttggctgtttccacagcttctgtctcgttggccttccagtgctttgccacattgtcagcaagcggatcgtcaggatttggagcgctgaggagtgcttgaatgctcaaaagaactgttcggatctgaagggcaggactccacttgtcctttaagatatcaaggcatatcctcccaagcttgtcaatgtttggatggtaaatttttgtgagaaagcgaacctttggcggagccattggatattcttcaggtaaaaacaactcaagtttgaatactcctccttcatatggcgactgagttgggccaaggatcatgacattgaagtagcgcatgttctcctctgatggtgaagcactgatgccaggagctggctcgctgagcagccgctgcgtctccttgatgatgcggcgggggaggttgctgttggccatggagaagatgggttgggctagggctagggtttcgtgctcttggggtcgatcgcggcggaggggaagggaggagaggaaagaccaaggaggcggcgtcagcgaacaatgatcttcggggttctgcgacccggccggc

SEQ ID NO: 36250 - DNA, 854 bp, Triticum aestivum
  Clone ID: PAT_TA_36250
caggaattcggcacgaggggatgtagagttggctgagctcacaccaactacggcagctctgaagaatccctgtgccaaaattgtgtacgatagagtataaccacgagaggtgtccaccttgttaacccccggcaagcgtgcctttgcctactttgtgttgagtggtgggagatttgtgtacgcatccttgttgcgtttgctcgtcttaaagtttgtcctgagtatgtcagcaagtaaggatgtgcttgccctcgcttcccttgaggttgacctgtcaagtattgagcccggtaccactgtgactgtaaagtgggcggggcaagccagttttcatcaggcgcaggactgaagatgatgtgaagctggccaacagcgttgatgttacatctctccgtgacccacaggaggatgcggtgcgtgtcaagaaccctgagtggcttgttgtcattggtgtctgcactcacttgggctgcattcccctccccaactctggggacttcggtggctggttctgcccatgtcatggctcacactacgacatctcaggtagaatcaggaagggcccagcaccatacaacctggaggtcccgacctacagtttcttggaagataacaaaatgcttattggctaagagcactggccgtaagattaatccctatggtgctgtgctgccattttgtgttggtttgaccattcgtcttcttgttgctcggatagtcctatgatggactgttatcttagtgcagtactcttactagcactggatagtaaagaataatctgctgctactttggtacttttaattaatttccaaatatggccgtgttttttggagctcactaaaaaaaaaaaa

SEQ ID NO: 36251 - DNA, 706 bp, Triticum aestivum
  Clone ID: PAT_TA_36251
cccacgcgtccgagttaagtcgcctttcgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagggcacggagctgctgatccgcaagctgcctttccagcgcctggtccgcgagatcgcgcaggacttcaagacggacctcaggttccagagccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgtggcgagagggcctaagctgcgccctccgccgacgccgttagtgagttggaatgagttgattctggttgtagtttgttcctaattgccgtgctaggtctctctgcttttgtgtagaagaaatatggttgttggtacaagcaagacgaacttgttatgtgatgatgttacttttggtttgcgatgaagcaaacgtatgtcgaagacctcagaactgctgttgttgttagc

SEQ ID NO: 36252 - DNA, 1944 bp, Triticum aestivum
  Clone ID: PAT_TA_36252
cgtccggaactcccggcccctttcctcccatccccttccctccccaaggacgggacgcaggtaggactgtagcaccggcagacgggcggcggagctcccctttgtccgtggagatcacttcagggctctatctgaaaagacatgacctaggcctccacattgggaaggtgagtagcaaccaagcatggcgtcaagggcgatcattaggagaagaaagtatctcttggatcatgttaacacacctatcctctcgtcttcctccccttcattccgccatggaacatatggcttcaagcctgagccaagaatagcacaaccatttcttgagcaaagcttaggggactcgaagtctgagaaggagaaggagcaatatagtgtcgatttgacaaaggggggtctgctaggtcctgataacgggcttctgcgacgtccagctcacgtgatttctcactatggctatggaattggaaggaatgaattcacattgcctttcggagctagaggtttgttgcagtcagttcgcaaagcatcaactgcaactgctgggcaacctaaattggatattgaagaacagggtgatgaaaaccagaataaaaggaaaaaagaggcatccccagaagaatgtgatcaggctgtggaagggctaagcacggcaaaagctaaagccaaagctaagcaggtgcaagattcgctaaaggctgaccagtcaatcgtaaagaagttctgggcaaggcttctgggtattggtccggctcttcgagctgttgcttcaatgagcagagctgattgggctgccaaactgaagcatgggaaagatgaatttatttccacactgcagcattactggctaggaacaaagctactctgggcagatgttaggatttcatcaagattgcttgtgaaacttgctggtggaaagagcctctcaagaagagagaggcaacagctcacccgtacaacagcagatatcttcaggctggtacctgttgctgtgttcattgttgtcccattcatggaattcctactaccagtgtttcttaagttgtttccaaatatgctgccatcaactttccaagacaagatgaaagaagaggaagcgttgaaaaggaaactgaaagcaaggatggagtatgcaaagtttctgcaagaacctgcaaaagaaatggcaaaggaagtcaaagcatcatatagtggagaaactaaacagaccgctggagatctggacgaatttttaaacaaggatgtcaccaatgttggagatgaaggtggttttgctcctaacattcaggagaacaaggatggccttgagctcttgaagactgcaattgaaaaggctggatacaccggcaaggttgtcattggaatggatgttgctgcttcagagttctacaatgacaaggacaaaacctatgacctcaacttcaaggaagagaacaacgatggttcccagaagatatctggagatagcctgaagaacgtatacaagtcattcgtgagcgagtaccccattgtgtcgattgaggacccgtttgaccaggatgactggggtgcactatgctaagatgactgaagaatgtggagtggaagttcagattgttggtgatgaccttctagtcaccaacccaactagagttgcaaaggcaatccaggagaagtcatgcaatgctcttctgctcaaggttaaccaaattggatccgtcactgagagtatcgaggccgtgaagatgtcaaaacatgccggctggggtgtgatgaccagtcacaggagtggtgagaccgaggacacattcattgctgatttggctgttggtctgtccacgggtcagattaagaccggggctccgtgccgctcagagcgtcttgccaagtacaaccagcttctgaggatcgaggaggaagcctttggggggggggggccccggggaaaaaatttttttggggggc

SEQ ID NO: 36253 - DNA, 633 bp, Triticum aestivum
  Clone ID: PAT_TA_36253
tcggcacgagggccactctcaagccctctccctcatccgcgtgcagcatctctctagctcccccctagagagatctcacagccgaataagcagcagcagcgagagaccccctccggcctcctcctcccagcaccaggaaccaccaagtcaagtcgccaatggccggtctcaggatgaagctcgtcgccgtcgccgccatggccgccgcgctcgtggcctccgcggccgccgccgaggccccggccccggcgcccgcctccgacgccgcggccgccgtgcccctcgccgcggcctcattcgccgccgccgccttcggatacctcttctgctaaatccgtcgtcgactctccgtagcgtggcgtgtgacccttcttggtcttgtccttcttggtttattgttcttggtgtgtgtgcgtgtgttcgtgccggggtgtgaggtgtgggcgcgtgcgtgcgtgtatgtatgggtcgcggtggtgtgggaggtgtcgagtacgtgcgtgcgccggcgtgccattctttgtgttggtgatcatgtacttactctcttgttcttgctatgaatgagaccatttatttgaaaaaaaaaaaaaaaaaataaaaaaaaaaaaaaaaaaaaaagaaattgataac

SEQ ID NO: 36254 - DNA, 711 bp, Triticum aestivum
  Clone ID: PAT_TA_36254
aagtcagagattccgaacaagcaccgccgctgacgcatctcgagtagtttccagttcgccggagaaggagcaagatggccggaaggaagggcggcgacaggaagaaggcggtgacccgctccgtaaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagcttgcaggcaacgctgccaaggacaacaagaagacgcgcatcatcccgcgccacctgctgctcgccgtccgcaacgaccaggagctcggcaggctgctcgctggcgtgaccatcgcccacggtggcgtgatccccaacatcaactctgtgctgctccccaagaagtccgccgcagccgagaaggaggccaagtcgcccaagaagaaggccgccaccaagtcccccaagaagaaggccgccgccaccaaggagtaggcgccccatagcctagttccataatcagcgagaagatgacgagccttttttttttttgcgggattggatcgtgtatgtaattgcctagtctgtagtggctcgttcattaccttgatgagcaagccattaagggctgtgttttgtacctgattaatgtcgagaatggctaaatcctttgcaatcatgtcctcttctg

SEQ ID NO: 36255 - DNA, 808 bp, Triticum aestivum
  Clone ID: PAT_TA_36255
acgctcgcccctcctatcccgtcatctctttcctccccacccccccctcggcgcagcaacagagagatggcggcggtggcgacgacgacggcgctccacgggagccaggcggcgggcgcgctggccgtcgccgcgcagaggctgctggttctcctcgctctcgcgatggaagctgtaaacaatggagcagatatcttcactgaggaccagcaagaaattatcaagcaatttggcaggatcaaatccgagactgttcctgagaacaaggatgcagggtctgatgacgacgacgatgatgatgaagacgaggatgatgaaactggtgatgctgatgatgatgatgctgatgctggggaggacttctcgggtgaagaaggtgaggacgatgacgaggacgaggaccctgaggcgaacggcgatgacgctggtgcggggagcgacgatgatgatggtgatgatgacgatgatgatggtgaagatggcgaggacgacgatgatgatgacgaggacgacgatgaggaggatgaggaagatgaggaccagccgccggccaagaagaagaaatgatctgctttcctgctgtcgtgtttcagtcccttagtttatctgctgtctagatgatgattgagcgggtctggtacacaccgacctatgtagcttctgtgtcgtggtggtttgatgtctcatagggtagaacattgaacttctaatgttgtttcctgcgttgtgcaagtagtcttaacatttcggtgttgatgtctgtgtttattggagctgtgataccattcaatctaattcttgttactcc

SEQ ID NO: 36256 - DNA, 1281 bp, Triticum aestivum
  Clone ID: PAT_TA_36256
acacctgaccgtatactagatcttaccaagaagggcatttgtatgctgaacgaatgttcaatgctcatcatggacgaggcagacaagctgttagctcctgagtttcagccttccgtggagcaactcattcgttaccttccagctagtcggcaactattgctgttttctgcaacctttcctgtaactgtcaaggattttaagcagaagtacctacctagaccttatgttattaatctgatggatgaactaacactgaaaggaatcacacaatactatgccttcgtagaagaaaggcaaaaggttcattgtctgaacacgcttttttcaaagcttcaaataaatcagtctattatattctgcaactctgttaatagagtcgagctactggcaaagaaaatcactgagcttggctattcgtgcttctacattcatgctaaaatgttgcaagaccaccgaaaccgggtgtttcatgattttcggaatggtgcttgcagaaaccttgtttgcacagatctttttactagaggaattgacattcaagctgttaatgttgtcatcaattttgacttccccaagactgctgaaacatatttgcatagggttggtcgttctggaagatttggacaccttggtttggcggtgaacttaatcacttatgaggaccgtttcaacatgtataggattgagcaagaacttgggacagaaataaaaacaatacctccacagattgacctggcggagtattgccaatgatcagtttaacagttttagaagcatatcttttatgaaaacatcattaggcaaatataccagatgtacatagcacctcatcaaggttttatttggtgccttggtgatgcatccaagcttctatttccatcagtggagcgagcgttctctgctggcaccggtgctaatcattcgactgtggagatgcacattcggctgctttgagattcaagaactattggcaacccaaacattatttcttgctgcatgcatctgcccaggattgccttgcatttgttttctagtttctgttctggttgtgtcatgctgggattctgttgcttgagattgtaccatcatactgcggcatttctctcattttactttacttcattctgttcgtacaaatagctatatttcctgtacttgattccttttgtgttaatttcggttctctatgtagaccattaacctcaattattttccttgtattctcaatatttgtcttctcggtgttgcagttgtacatgcttctgtttaatccattattgc

SEQ ID NO: 36257 - DNA, 1788 bp, Triticum aestivum
  Clone ID: PAT_TA_36257
ccgaattcgcggccgcgtcgacatcgtccacatcttctgagttctgatggaaggagagtctgatgaacacagcatgttgcatatgcttgcttcatctgacattagctccttccttccgcaaacgggatcgagacaaggccgagaggaggaggaagaaggctccgggaagctcgagaagaggcgaggaggagaggagagggatcgcgttgcgcgtcgtcgtggcgatggatcgggtccgcggctccgcgctgctgctcggcgtcctgctcgcaggatcactgtttgcactttgtgctgcaaaggaggaggccaagaagctcggtaccgtgatcggtatcgatctcggtaccacctactcatgtgttggtgtgtacaagaacggtcatgtcgagattatcgccaatgaccagggtaaccgtatcacgccctcatgggttgggttcaccgatggggagaggctcatcggtgaggctgccaagaatcaggcggctgtcaaccctgagaggaccgtctttgacgtcaagcgtctcattgggagaaagtttgaggacaaggaggtgcagagggacatgaaacttgtcccctacaagattgtgaacaaggaggggaagccttacattcaggtcaagatcaaggatggagagaccaaggtcttcagccctgaggagatcagtgctatgattcttggaaagatgaaggagactgctgaggcataccttggcaagaaaatcaatgacgccgtcgtcactgttcctgcgtacttcaatgatgcacagagacaggcgaccaaggatgccggctgagatcctgggttgttcgccgcaagcaacctctctgctggtgtgccatggcgctctcctttcgtgtctttcttgtaagcatatgagacagtgattggccgattacataaatgctggttgttcatggcctctatagcttgatcagatgattcaaaggagtcatagctcacaaagccaaaccctcgagaatttccagtttcagggtcccgcattatcttagggttggtcacaatcacaccaaatgcactgaaggtgtcatagagaagcttctcatcgacttccggatcaagattgccaataaaaagattcgcacccacatccaagctcttcttgtcttgggaagccttgtttactcttattggctttccgtacaatttgagcatgttcaaaatcttaatagcataatctgcatcttcctcactcctaaattctacaaacccatagccctggtgtagatttgtaactctgtctttcgggacatagacattaacaacagggcctgcttggacaaacaactcccacagtaattcctcagaaacctgcgggtcgaggttgccgacgtaggtggtggcgtcctggttgcgctccgccgagtgctgcccgaggaggttcgcgcccacgccgggcgcgatacgcgtcgtcatgcctggctcccggcggcgcgacgggctgcgacggcgagagtgctaagaaagcggagccgcgggggtggagtctccactaggacgaggacgagctggggagttggtgcagtatcttgaacggggcggcggcgttcgtgccgtccgtgcagggaccagcgctggcgagggtggcggggtggcggggtcgcgaccaacgcgccggtgaagaagcgggcggagggcagccctaggaagccagtcagtggggcaggggaggcgccggtgcagtggcggcggctagggttagctgttcgcaatctgcggcgagagatagaggtaatctttttttttcttctctctttttg

SEQ ID NO: 36258 - DNA, 1887 bp, Triticum aestivum
  unsure (1)..(1887): unsure at all n locations
  Clone ID: PAT_TA_36258
acgcgtccgtgctaggatactactactactcctgctatctcgttgcgtcccgacaaccagaaaggagaggagagaggggagaggaaagggggaagccaacccagctgcaacacacggcggagcgagcggggcaggggagaatccagcgatctctctgcgaggaggagatggcttcagtaggcgttgctccctctgggcacaagaacagcagcggcaccagcatgggtgctgagaagctaccagatcagatgaacgatttgaagataagagatgataaggaagtggaagctactattattaatggcaagggaacagagactggacacataattgtcacaactactggtggcaaaaatgggcagccgaaacagaccgtgagctacatggctgatcggatagttggtcaaggttcatttggtattgtattccaggctaaatgtttggagacaggggatactgttgccattaagaaggtccttcacgataagcgctacaagaaccgtgagctacagaccatgcgcctgcttgaccacccaaatgttcgagctctgaagcattgtttcttttctacaactgagaaagatgaactgtatctaaacttggttcttgagtatgtgcctgagactgtccatcgtgttgtcaagcattacaacaagatgaaccagcgcatgccactaatctatgttaagctgtatacgtaccagatatgtagggctctggcttacattcatggcagcattggagtttgccacagggatatcaagccgcaaaatcttctggtaaacccacacactcaccagctgaaactgtgtgactttgggagtgcaaaagttcttgttaagggagaaccgaacatatcatacatttgttcccgatactatagggctccagagctcatatttggtgctaccgagtacactacagccattgacatttggtctgctggatgtgttcttgctgagcttatgctagggcagcctctgtttcctggtgaaagtggtgtggaccagcttgttgaaatcatcaaggtccttggtactcctacaagggaagaaattaaatgcatgaaccccaattatacggagttcaaattcccacagattaaagcacacccatggcacaaggtattccataaaaggatgccacctgaagctgttgatctagtctctcggctcctccagtactcgcccaacctaagatgcactgctgtggaggcacttgttcaccccttctttgatgagcttcgggacccgggtacccgccttccgaatggccgctttctgcctcctctttttaacttcaagcctaacgaactgaaaggaatcccagcggatgttgcggcaaaattgatcccagaacacgcgagaaagcagagcccccatgcatgactatgagatgtttgtctcacgagtcgttggaattgcatcgacaagtgcgcatttctcctggggatgttggttgggcaggcatgcgagcgtgatgaactatattatggttgttggaagacgtgatgtatgaccagtccaccctgttgacctgtgtagctgagtagtagtatgctgcgatgcaagcttgacaatgtaaccggttcaccctcccctgtactaaccctcgcctgagaattgagattgccatggctgatctgtaatatgttctagagaagtatgaatgtatttatggtagttgtgatccttgtatgggtcctctcgattttcctagtttcttgatcgtcagactcgtgccaccttgttttagattcctgtcattgaaggtttacctgttgctattgcagtactatgtacctgtcgctggctcctattgagtggtttgttgcaaaaaaaaaaaaaaaaaaaaaaaaaaaaaaaaangaccccaaccgggacctag

SEQ ID NO: 36259 - DNA, 1148 bp, Triticum aestivum
  Clone ID: PAT_TA_36259
attcggcacgagccacagcctccaaaccctcgatctcccgcatcggagctccctgcccccaaccccccacccccacccaaccatggcggaccgcggcggcgagcgtggtggcgaccgcggaggcgagcgcggcgggttcggccgcggcttcgggcgcggcgggcgcggggaccgtggcgggcgccgcggcggccgtcgtggccctcgccaggaggaggagaagtgggtgcccgtcaccaaactcggccgcctcgtcaaggagggccgcttcaccaagatggaggagctctacctccactcgctacccatcaaggagcaccagatcgtggagcagctctgcccggggctcaaggacgaggtgatgaagatcacccccgtgcagaagcagacccgcgccggccagcggacccgcttcaaggcgttcgtcgtcgtcggcgacagcaacggccacgtcgggctcggcgtcaagtgcgccaaggaggtggccacggccatccgcggcgccatcatcctcgcaaagctctccatcgtgcccgttaggaggggctactgggggaacaagatcggcctgccccacaccgtgccctgcaaggtcaccggcaagtgcggctctgtcaccgtgcgcatggtgcccgccccgaggggttctggaatcgtcgccgcgcgcgtccccaagaaggtgctcccagttcgctggtattgatgacgtcttcacttcctcgcgtggatccaccaagaccctcggcaacttcgtcaaggcaaccttcgactgcctgatgaagacctatggattcctcacccctgacttctggagggagacgaccttcaccaaggcaccgtaccaggagttcactgacattttggcgaagccgacgaaggccctgatgcttgatgcaccagccgagaagatagaagcttaggatgtccgtgtaaagggtttttactagctgggagctgtctaatgcactttgctttattcagttattaatactttgaatcgtgctgtttcaggatgtctctgtttgccgtcaagtgttggtttgtggaactatgctactctcttttatcgtcaatggacgctacataattatggcaatcgatcttttttatctataaaaaaaaaaaaaaaaaaaaaaaaaaaaaaaaaa

SEQ ID NO: 36260 - DNA, 636 bp, Triticum aestivum
  Clone ID: PAT_TA_36260
gattcggcacgaggtggagatgaggagatgcagtattcctagcatcctgctgatgctttcactgggggcagccctcctcatcgccggccacccctccgtcgccgacgaggcgagcgccattctcctgccaagccaagacaaagggcttgcagaccaagtggtcatggcgacacccaggccgtggaagtgctgcgacgtgaccgtctgcaccaggtcgatcccgccgacgtgcagctgccaggacgtggtcgacaactgtgctccaacctgcgaggactgcaatggttatgttgcacccaccccgccgcgtttgcctagaccgttacaccgggcgaccccgggcccaggtgcacggacgcccgggcgccggcggtaactgaactctacgtactactctacgcgcaccggttggacctaccgggtatgcgaacgtacgccgtcgacgtgtgttactacatgaatgggataattatgttgtgtgtggtcctgcatgcctagctgcttgctgtgcatgctgcctgtgtgtgtaataagaacgggtggcctttcatcaaaaaaataaaacaggtggcgtcggcctacgtacaatggatgggtggtccagtaatttaatcaatttctttcaaaaaaaaaaaa

SEQ ID NO: 36261 - DNA, 1623 bp, Triticum aestivum
  unsure (1)..(1623): unsure at all n locations
  Clone ID: PAT_TA_36261
aagagttttaatggtgatttacagcctcagacctacccagaaattcttcggtcaaacctggcgaatacagttcttactctgaagaagcttggaattgatgatttggtgcattttgacttcatggatcctcctgcacccgaaactctaatgagggccttggaagttctgaactacttgggggcactcgacgatgaaggcaacttaacatctttaggtgaaatgatgagtgagttccccttagacccacagatgtcaaagatgcttgtcatcagtccaaggtacaactgttcaaatgagatcctctcaatatctgccatgctatcaggtatgtcgaactaacaattcctctctccaaattgcatttctgcaactacattatcatgttgttatgcacgtgcactgttttgcttgcaccagtatgtgcaagcaagttgccatggttctagcatgcaggctagtgcatgttttctattttctcttgtttgtatatattgtgtattgtcatcagcaactgtcatgcacctggcttctagagctattgatcaaaatgatcatacagtttaggctgatgcagatagttgctgtatgttgagttattctgacaaagcaaatggtatcgtctcgcctctttgcatctgctgaccaaccgtgggcttcgtctgttattaccatatcctttgtctagtacccaattgctttctgcgggctagggatgcacaaaaggctgctgatgaggcgaaggctcgatttgggcacatcgatggggatcatctgacacttttgaacgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgcgagtactatgtcaacatcaggaaagcaatgctttcagggtactttatgcaggttgctcatctggagcgaactgggcattacttgaccgttaaggataatcaggttgtccatcttcatccctcgaattgcatggaccataagccggagtgggtcatctacaatgaatatgttttgaccaccaggaatttcatccgcacagtcaccgatatccgtggagagtggctgatcgatatagctccacagtactatgatctgaccaatttcccatcatgtgaggccaagcgtgttcttgagaggctacacaataagagggagagggaaagagctgctagtaggaactgaattgatgtcattcttctggtcccttggatggcagcgccgccaaaggctttggacatcactgttgttggcctccaccattgtcatgatatcttccatgtcgtagttttccagtattgtggacggtgaaatcactatatacgacatatgtcaaatgtccctctgctactgcattatgaattagatgcttgttttccctcttttagaaggtgtaggtcatcatacattaattatgtgtcgatcttcatatttttggtgtatcaaacgctgttgtttactttgtacttcagcatccttttggctaaaaaaaaaaaaaaaaaaaaaaaaaaanaaaaa

SEQ ID NO: 36262 - DNA, 730 bp, Triticum aestivum
  Clone ID: PAT_TA_36262
ccgggccgggttcttcttcccagcccccaagcagttcccctccttcaccccccgagagtccgccgcgcccacccccaagccccgatggcccgcacgaagcagacggcgaggaagtccaccggcggcaaggcgccgcggaagcagctggcgaccaaggcggcgcgcaagtcggccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtgtccgcgctccaggaggccgccgaggcctacctcgtggggctgttcgaggacaccaacctctgcgccatccacgccaagcgcgtcaccatcatgcccaaggacatccagctcgcccgccgcatccgtggcgagagggcctaggttgcctcgtggttgtctgatctggagactggtgtagagatgttagcttcgtctcgttagcatgtgtctgatcttgcatcgtggtaggaagatccctcgttcgtgccagtatggctgtgttatgttctagtgtgtactgtctgatgttaccctcttgttgccatcagcaatgtgaaagttggctcgcagatcttaaaaaaaaaaaaaaacgcccctctttgcatcgagcggccgc

SEQ ID NO: 36263 - DNA, 1923 bp, Triticum aestivum
  unsure (1)..(1923): unsure at all n locations
  Clone ID: PAT_TA_36263
cgtccgttaagttgtttccaaatatgctgccatcaactttccaagacaagatgaaagaagaggaagcgttgaaaaggaaactgaaagcaaggatggagtatgcaaagtttctgcaagatactgcaaaagaaatggcaaaggaagttcaaacatcacgtagtggagaaacaaaacagacagctgaagatctggacgaatttttaaacaaggttaggaaaggtgaacgtgtatccaatgatgaaatcttgagcttcgcgaagctttttaatgatgaattgaccttggataacatgagcagagcacgcttggtaaatatgtgcaaatatatgggtattcgaccttttggtacagaccattacttgagattcatgcttcggaaaaaactacgagacattaagaatgatgataaaatgattcaagctgagggtgttgattctctttctgaagaggagctccggcaagcctgccgtgatcgcggtcaccttggtctgcggtcaacagaagaaatgcgtcaacagctacgagactggttggatctatcacttaatcatgctgtgccatcttctcttctcatactttcaagagcttttaccctggctgggagaatgaaacccgaggatgctgtggtagcaacattgtcttctttgccagatgaagttgtggatacaattgggacagtattgccatctgaagattcagtttctgagaggaggagaaaactggaattccttgagatgcaggaagaacttatcaaggaggaagagaagaagaaagagaaagaagagaaggcaaaacaaaagaaggaagaaaaggcaaatctcacagaacaggaggctgctgaagaagatttggctttaaaggaaatgactgagcctactgctagggaagaagaagaactgatagaagcaaaacaacatgacaaggaacagctctgtaatatcagtcgagcattggctgtgcttgcatctgcatcgtctgttagcaaggagcgtcaagagttcctgagccttgtcaacaaggagataaaactatataactccatgcttgaaagagaagacacagagggggcagaagaagctaagaaggcatatatggctgctagagaggagtcagacgacaccacagaggttgcttcagaggaaaaggtctcgtcagcgctgattgacaaggttgatgctatgcttcaggaattagaaaaggagattgatgatgtggatgcacaaatcggaaaccgctggcaactgcttgatagggatcatgatggcaaagtgactcctgaggaagtagcagcggcagcagcttatctcaaggacaccatagggaaagaaggcgtccaagagcttatcagcaagctttctaaagacaaagaaggaaagatccgtgtggaagacatcgtgaagctggcgtctcaatccgaggaaaacaatgaagatgatgaagaagaagcacggcattagtcgggaacacacttgacgacttttgtgtgtgttgagatgggtattccagttcaggcaggaacttcgagtatctcagttactccgtagcagtgcggcatgtatagatcagaaggcaagacggccattcttgcgcccctcttggcagacctcgatagaaccaccagtaattcgtaaggataacttactgtgaagatgatgacttgcatatagttgggttcagcctcacggatctgcaggtaaacagcaaccgagatttcaactggttgctatgggagagaaaatactgtttttggttggtcacgggattcgccactccacccaacaatctgagaatttaataagatctacttcaacttctgagaaatcgtgggttaagcacaccgtttgtgaatgagtgctatttgttgcttttacaatcagtgtgttatnggtagccgttattatctatctttttatagtgccttta

SEQ ID NO: 36264 - DNA, 926 bp, Triticum aestivum
  Clone ID: PAT_TA_36264
tcggcacgagggtaagcggagagggactcccggcggcggcgcgaagcggagagagggagagagatgtcgaagcgagctggtcccccgaagcaccagaacacctacgcatggaagcccaacctcggccggaagatcaacgagaccgagcccgggggcaggttccggcctctgtcggagatcaccggcgtctgccagcgctgccgggaccaaatcgactggaagcgcaaatacggcaagtacaagccgattgttgagcctgcaaaatgccagaagtgcagtaaacgaaacgtccggcaggcataccacaacgtctgcacaggttgctccaaggagcttgggatttgtgccaagtgctgcacctctgttaagcagcttgttggaagggatgctgaggaagcaaacagtgagcgcaaagaactagaggaggccatcagatatgctagggagagggaacgacggacacttcttcgccttatgaacaaaaacaaggacgaggagagcggcacatcagtcccgaagatcgcagaccgagatcgggagggcgaccttttccctgttgcatcccttgacgaatatgctgaacaggctgtacagaaggatgagtctgatgaagaagatgccagggattttgtgaaagattaacttggcaaggtttggtactgtaaaaggatatttagttttgtgcgcggacgctccttcggggtgttctaactcagcggagaaatgccaacacttgttttagcagagatatatatttctgtttatcagatcttattttgaccagtgagcttacgacaccttcccagttatgttatgcttcttcctaataagtgtaggattctgaagctgtattattattacatgagtggtaaaaattgctgttgctggtttacctcccagagacaagtcaaaaaaaaaaaaaaaaa

SEQ ID NO: 36265 - DNA, 1331 bp, Triticum aestivum
  Clone ID: PAT_TA_36265
cccacgcgtccgggcgcccctcaccctcggaattgagactgttggaggagtcatgaccaagctgatccccaggaacacagttatccccaccaagaagtccatggatgatgctggtctcgagaagacccagatccatgagattgttcttgttggtggcagcaccaggattcccaaggtccagcagctcctcagggactactttgacggcaaggagccaaacaagggtgtgaaccctgatgaggctgttgccttcggagctgcagtgcagggaagcatcttgagcggcgagggcggtgacgagaccaaggatatcctcctcctcgatgtggcgcccctcaccctcggaattgagactgttggaggagtcatgaccaagctgatccccaggaacacagttatccccaccaagaagtcgcaggttttcaccacctaccaggaccagcagaccaccgtctctatccaggtctttgagggtgagcgcagcatgaccaaggactgccgtcttctcggcaagttcgacctttctggcattcccccagctccaaggggcactcctcagattgaagtcaccttcgaggttgacgccaacggtatcctgaacgtgaaggctgaggacaagggcacgggcaagtctgagaagatcaccatcaccaacgagaagggccgtctgagccaggaggagatcgaccggatggtcaaggaggcggaggagttcgccgaggaggacaagaaggtgaaggagcgcatcgatgcccggaaccagcttgagacctatgtctacaacatgaagaacaccgtcggcgacaaggacaagctggctgacaagctggagagcgaggagaaggagaaggtggaggaggccctcaaggaggcgctggagtggctggacgagaaccagacggccgagaaggaggactacgaggagaagctcaaggaggtggaggccgtgtgcaaccccatcgtgtcggcggtgtaccagaggtccggcggagctccgggcggcgagggcgccgacggcggcgtcgatgacgaggaccatgacgagctgtagatggtttggaaaggaaccaatttttgtaatgggttagtaggggcgaggagacatggataattggtgctctacttactttgtgttgtggtcgggggtggtcgggtttgttcgcggagactgctgttattagtctgttggccgagttgtagagaactctctttgctgctgctgttacttccttctgatgttttttcgttttgttattatatagccggatgaagaaaagatgatgcagttttatctaaaaaaaaacccacgcgtccgcggacgcgtcgctccc

SEQ ID NO: 36266 - DNA, 852 bp, Triticum aestivum
  Clone ID: PAT_TA_36266
gaaaggccaagaagttaatgtagagcaagagaaggcacacataacttcaggatgtttattacggtacaacactcgacgaaatatacacgcacatgggtccatcgcatcccaactagggtaataatatacatcacactcggtacacgcgatgcaaggaggaaacttcacatttcactagttcatcagttggacctccattttaaaccacttgatagtcgatttcacctcacctttccaagactactgagcaatcagtcatagcatgcagagctcatgcatcattagcatagacacgggtccactctttggctgtttccacagcttctgtttcgttggccttccagtgctttgccacattgtcagcaagcggatcgtcaggatttggagcgctgaggagtgcttgaatactcaaaagaactgttcggatctgaagggcaggactccacttgtcctttaagatatcaagacatatcctcccaagcttgtcaatgtttggatggtaaatttttgtgagaaagcgaacctttggcggagccattggatattcttcaggtaaaaacaactcaagtttgaatactcctccttcatatggcgactgagttgggccaaggatcatgacattgaagtagcgcatgttctcctctgatggtgaagcactgatcccaggagctggctcgctgagcagccgctgcgtctccttgatgatacggcgggggaggttgctgttggccatggagaagatgggtggggctagggctagggctagggtttcgtgctcttgggatcgatcgcggcggaggggaagggaggagaggaaggaccaaaggaggcggcgtcagcgaacaatgatcc

SEQ ID NO: 36267 - DNA, 1216 bp, Triticum aestivum
  Clone ID: PAT_TA_36267
agaccacaagcatcaaaggcaagcaagcagtagtaaccacaaatccaagatgaagaccttcctcatctttgtcctccttgccatggcgatgaagatcgccactgccgctagggagttaaaccctagcaacaaagagttacaatcacctcaacaatcattttcccatcaacaacaaccatttccacagcagccatatccacaacaaccatatccatcacagcaaccatatccatcgcaacaaccatttcccacaccccaacaacaatttccccagcaatcacaacaaccatttacccagccccaacaaccgacccccttacaaccacaacaagtctgacatgcgtgcgagtcgacgggttctgaaacctgggatgcgcaaggaagctgacgagcgggaggccctcacgggccgcaccgctggccgaccctgatcttttgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatggcgcggctgcttcggtgagccgtgccatggaatcgggtgctccaagtgggccatttttggtaagcagaactggcgatgcgggatgaaccggaagccgggttacggtgccggatcatcgagttcggcaacttccacaccagcgccgtgtccatcatcgtccacgccatcatcttcttcagcttcgccgccatcttcctcatcgccgtcggggtgcacatcgacctcggcccctaaaccgaacccggtgttccgtgttttcgccatccatccatcagctgaacatgtagctgggctgggttctctgaaagtttagggtattgtttctgtgggttcatgcataatagtgtccctcgctcgctcgccgtgtcgatcggcgatgttgcccgtggcgactgcaggatgaaactggttctttgcttgtaggctagattcacttaccacaagataaataaagctctgtttctgtgaaaaaaaaaaaa

SEQ ID NO: 36268 - DNA, 1550 bp, Triticum aestivum
  Clone ID: PAT_TA_36268
ccctctcccacctgctccgtccccatcccctcgccgccgccgccgccatctgagcctcagactcgcgcgaatcctccccgggccgagcgatggcgatgcagaagtccggcaggagagactggtagcgagaagggcagttccccggtcaccccacacacaaatcccggcgagcgagcgcagagtgacccgactttttccgccgtccatggcgaccatgaacccctttgacctcctcggcgacgacgagggcgacgaccccacgcagctcctggccaaggcggccgccctggcgcagaaggccgaggccaagaaggccgccgcgccgcccgccgccggcaaggggcggcgcgaagacggtcgccaatctgcccaccaagccgcctccgcctggtcaggctggcaatgactcccgaggtggtggtccaccctctcgtggaggatatggtcgcggtgaacgtggctcaggcagaggtggccgaggagggtacggtcagaatcgcgactacggcagtgaagacacaaatggctacaggggaggttatggtgccagaactggaggtgaggaaggcgcccaggacagagagagggcccctcggcaaccctaccaggggggaggccgtcgtggtgggtatcgtgaaggcgagtttggtgatgattctgagaggccacctcgaaggaactatgagcgccatagcggcacaggccgtgggtatgagataaaacgcgagggtgctggccgtgggaactggggaactacctctgatgaatttgtcgcccgggaaactgaggccctgaagcaggatgagaaggcccctgcacctgagaagcagggcgcaccggaggatgcaccacaggcagatgagaacaagcccaccaaagatggcgccacagttgtggaagaagaaaaggaagaggataatgagatgactcttgatgaatttgagaaagtaatggaggagaagaggaaagcacttgctgctttgaagaagtctgaagagaggaaggttgaaattgataaggatctgcaggctatgcaactactttccaccaagaaaggaaatgatgaagttttcatcaaactgggtgctgataaggaggctttgaagaagaaagagaatgctgaacgtgaagagcgtgctaagaagtctgtgagcatcaatgagttcctgaagcctgctgaaggagagaggttctatggtggccgtggccgtggcggcaggggccgtggagaccgcggaggcttcagaggcggatttggtggtgggggctatcacggcccaccccctgctccggcaattcaggaccagaaccagttcccaaccctcggtgggaagtgagattgctgtaccatctcaagtaccacctttaccagtatcgtcgacgctgtcaagttaaaattttcctttcaccatatatttctgcgcggatcctatattgaaacaaataactctgctgcatgtggaccattcatccctgtgtctgtcgactttgtaaatccgacggttgtcgcttatcagaattttgtaggctatgaattgctcgttcctttg

SEQ ID NO: 36269 - DNA, 1509 bp, Triticum aestivum
  Clone ID: PAT_TA_36269
gccggccgggttccggcccactcccacccccacccgtgtgccgttgcctcgtctcgtcttctcgaccaagtttctccctctcccctctctctttctctcctctcgtggctgtggcctgcggggcgcgggccagcggcggttgctcgttcttcttggcgtatggtcggccggatggagcggcagacggtgtcgacgtcctccgcgtcctgctccccctccgccgcctcctcctcctcctcctcctgcggcggacgtaagcggcccgacatactcaacatgatccggagtgcagcatgtcttaattcatcatctactgatactggcaaggggcggagtaagcaatcgagcaccaaggtgacgcatggattccacttggttgaagggaaatctggccatgacatggaggactaccatgtagcagagtacaagtgcgataagaaccatgagcttggcctcttcgccattttcgacggccatctgggtgatcgtgtgcccagttacttgagagctaaccttttctccaacatactcaaagagcctctcttctggaccgaccctcaagaagcgattaaaaatgcatatggctctacaaacaaatatattctggaaaatgccaagcaacttggaccaggcggctcaacagcagttactgctattgtagttgatggcaaggatatgtggatagcaaacgtaggtgactcgagggccgttttatgtgaacggggtgctgctaatcagatcaccgtggaccatgaaccccatatatctaatgaaaggcagaggattgaacagcagggtggctttgtcacaacatttcctggtgatgtccctcgcgtaaatggccaactcgctgtcgcaagggcgttcggtgaccatagcctcaagacacacttgagttcggaacctgacattaggcatgtacccataaactcaagtatagagttcgtcatacttgccagcgatggattatggaaggtgatgaaagaaccaaggaagctgtggacctccgtgaagtcgacaaaggaccctcaggcagcagcaaagcggctgacgaccgaggcgctcgccgaggaagagcaaggacgacatctcctgcatcgtcatccgcttccgctgctgaatcgaccccattctccgatcatttcaatttctcgatccatgactgatgtggcgtcgtgacctgattctcgctgctccagattgaaattatgtagtgtctgttattgtttgtacttatagtagctgtgaacaggcttgagcttagaacattgcatgggaagacggtggagagtctgaggcttggggctagtagtgagtagtggctagtgtgtgcagggtgtgtcattcatctgtgcatatgttacaccgccataagttccccgccaatctgtggaacatctcgtttgtgtacctggttgattgtgatggtaaattggtaatggaccaaccatgttaaggttgcgctttgaactactttaaaaaaaaaaaaaaaaaaactcgagactatct

SEQ ID NO: 36270 - DNA, 602 bp, Triticum aestivum
  Clone ID: PAT_TA_36270
attcggcacgaggcaagaagcgaacaaccgagttcagtttcccgcgggcacaacctccaccgaaagcacaagacagagatgagctcgtcggcggccaagaagggagtgtcgatggtggtggctacgagcatggcggcggtggaggcgctcaaggaccaggcggggctgtgccgctgggactacgcgctccgctcactctaccaccgcgccgtcgtcaccggccgccgcgccgtcccggcgtccctctcctcctcctcctcctcccaggccgccgtaggcagggctgcccggccaaggcggtccgaggaggagaagctgcacaaggcgtaccacatcgtttgctgggggccaaactgattgtctaacagcacattttttttctgcttctccatttttattccttcccatcttggctatccgtgaatgaatggtgtgtaaatcgagatataagtatccacggtttgtaaatcgagatatatgtttcaaggtcagtcatgcactcggccctctgatctgaggcgagctgccaagtgattgatgaggcaaatataagaaaatggcattgttcttgttctgcacaaggaacaactaaaaaaaaaaaa

SEQ ID NO: 36271 - DNA, 1529 bp, Triticum aestivum
  Clone ID: PAT_TA_36271
gagtacagtacatcagcagtacactactcgcggcgcacgctcgagctcgctagcgacagtcgtccgtcagagctcaccgtcatccatggctctccagctcctcccctccaccctctccgtccccaagaagggtagcagcatgggcgcggtggcagtgaaggacacggcggcgttcctgggcgtgagcagcaaggcgaagaaggcgtcgctagcggtgaggacgcaggtggccacggcgccttcgtcggtgacgacgagcccgtgctcggcgacggcgaagccgagcggcaagaagacgctgcggcagggcgtggtggtgatcacgggcgcgtcgtccgggctgggtctggcggcggccaaggcgctggcagagacgggcaagtggcacgtggtcatggcgtgccgcgacttcctcaaggcatccaaggcggccaaggcggcaggcatggcggacggcagctacaccgtcatgcacctcgacctcgcctcgctcgacagcgtccgccagtttgtcgacgcgttccgccgcgccgagatgccgctggacgtgctggtgtgcaacgccgccatctaccgccccacggcgcgcacgccgaccttcaccgccgacgggcacgagatgagcgtgggcgtcaaccacctcggccacttcctgctcgcccgcctcctcatggaggacctccagaagtccgactacccgtcccgccgcatggtcatcgtcggctccatcaccggcaacagcaacacgctggcgggcaacgtgccgcccaaggccagcctcggcgacctccgcgggctcgccggcggcctcagcggcgcgtcgggctccgccatgatcgacggcgacgagagcttcgacggcgccaaggcgtacaaggacagcaaggtgtgcaacatgctgaccatgcaggagttccaccggcggtaccacgaggagaccggcatcaccttctcgtcgctctaccccggctgcatcgccaccacggggctgttccgcgagcacatcccgctgttccggaccctgttcccgccgttccagaagttcatcaccaaggggttcgtgtccgaggcggagtccggcaagaggctggcgcaggtggtggcggagcccagcctgaccaagtccggcgtgtactggagctggaacaaggactcggcgtcgttcgagaaccagctctcgcaggaggccagcgaccccgagaaggcccgcaaggtctgggagctcagcgagaagctcgtcggactcgcctgatctccggccacgtccgggcaatgcatgcatctaggatgggacgccgatcgatgctgaacttgtcgcatttttaacgttggtaattatcatttttacgccttttttagaaactcaattacgcgggagaggccttgcgagtgtcggcgagagtgcatagatctcgtgtggaagatgtacaattttcggccaaccatgaataataaaaccgcaggcctaattgaggatgacatatgttgtgctctgggggggggcccggtacccaattcgccctatagtg

SEQ ID NO: 36272 - DNA, 731 bp, Triticum aestivum
  Clone ID: PAT_TA_36272
gcacgaggaaggcttcttccacatttccactgagcaaagagaagcaaatcggcagagaacgaagcaaaccggccgacggttcctggcccctcgccatggccggcaaagctagggtgttcatgtgcgtggcgctcgtcgtcctcctgctccttgtcgagaccaccgccccgactggacaagctcacgccgtcgattgcggcggcgcgtgctcgtaccggtgcagcaagtcgagtcgaccgaatctgtgcaacagggcgtgcaacacgtgctgccggcgatgcaactgcgtgccgcccggcaccgccggcaacgaggacgtctgcccctgctacgcccacatgaccacgcacgacggccgccacaagtgcccatgatacaaccgccatctccacggtcaatcaagactactacatagtcgatcgtcatggcctctcaattaatatcacatctacgatcagcgacagctagactaccagaggcacgatctatatgatacatgtactactcaagctagtgctgctacctatgtaccttgtgctcatccatacgtgatcgacccatcgtgtaagcatgtttgctatctcattctcacgcagtggtaattgcgtcgattgcactaaaacaattagtgcgtgtgttattggattcatgcttcaatcaactcatccaaaagtctgaactattggagagagacggacaatatattgcaacactctccctcaaaaaaaaaa

SEQ ID NO: 36273 - DNA, 604 bp, Triticum aestivum
  Clone ID: PAT_TA_36273
tcggcacgaggggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttccccttgtccgtccgatgagatctccgtggttggtttaggagggttttaggtggactcttttggccgctggatctgtgtccggcggccatggttatcttcctgtgtctgctgctatcttactgtttgaatgagatgaactccgctatgaattatccataatttgtgctcgttggcttcaaaaaaaaaa

SEQ ID NO: 36274 - DNA, 967 bp, Triticum aestivum
  unsure (1)..(967): unsure at all n locations
  Clone ID: PAT_TA_36274
aataaacagagcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgcctttcgccgtcgtcgccgtcgccccgtgtgtcccgtgtcgtgtcgtcgatctaaataagagagtcgtgtgtcgtgtgtcgtgtcttcccctggtccgtccggtgagatctccgtggttggtttaggagggttttaggtggactctttgggccgctggatctgcgtccggcggccttggttatcttcctgtgtctgctgctatcttaccgtttgaatgagatgaactccgctatgaattatccgtaatttgtgctcgttggattgggtaaaaaaaaaaaaaaaaaaaaaaaaaaaaaaagggggggcccggtacccanttcgccctatagtggctcgta

SEQ ID NO: 36275 - DNA, 1429 bp, Triticum aestivum
  Clone ID: PAT_TA_36275
ttacaaagtccatctgaattctcaagtacttagtatatatagtacagtagtagctgttataacattgttaaaacattaaaggagatattgaaaattataccataataaaaataattacatgcatatgtgtagttattactctatcatacatacacatggagattacatgtacaaaagcataaatcccaaggcaggcatgcactgatcacatggagagtacatatcaagtctcgtctcagctaggatatgccttggacgcatgcacgtaagcatcttcagctagttggcagctagtaattggctaagcaaagatcgattgtgtatgaaaaagatcatgaggcaccggcgacggcgagcatcttcttgtactcgacctcgtcgtcgcctatcccccaaagcgaatccgagcagcagtagtcccacaccggcgatgaaggcggcggcactatcatcgacggcacggcggctccccatgcgtaggagtccatgatggcgtcgttccaaaggaggtggctgtccatgccgatgccggcggtgtagagcagctggttatccgcttgttcctggctggccgccgtctcttggtcgcggtggccgtgatgcgagttgttgtcgttgtcgatcgttgaagaggaggagctggacgtggtggccggagacgccgccgacatggacgtggacgtggtcgtggtcgtggaggccgaagcagcagaggcggcgcgcgtgtccttgtggagcttgcgggtgtgggtgcgccagtagttcttgatctcgttgtcggtgcgccccggcatggccttggcgatgcgggaccagcggttgccccagcgggcgtggaggtcgacgacgaggcgctcctcgtcggggctcatccggccgcgcttcaggtccgggtgcaggtagttgacccaccggagccggcagctcttccccgtccggttaagacctgtcgccaagacaaacacaagagcaagaggtgccggcggagaccgagagcgttagcacacaaaggaccatggctacatcatattttggtcccagacatgcatgcatgcatggcgcatgcatggcacggcatgggtcacccgccaccttgcaaacctgacaccttagctaagaaatcccagcggcgctcgccgaagagccgcacgaaccacgccagcttcatgtcctcctgctccgtccatggccccttgcggaaaccacccggtgcaactgcttcctcctccttccccggcgacggcgccgccttggccttggaagcctgcttcgtcttcatcgatggagatgtgatgtgaacacagcagctaggcaccaaggagctacggacagaagacgttggtggtgcggctggtggtgggatcaatcaagagccacttgactcgaggaagaaacgtatggaaatggaacggaatggaatggaatgaag

SEQ ID NO: 36276 - DNA, 2477 bp, Triticum aestivum
  Clone ID: PAT_TA_36276
gccgcgtcgaagcgggaggaaggcggccagggcggcgtcagcctggaggagatcggcaagttccgcgcggaggcgcagcagaactcggcggacgccatccgcgccgcgcaggagcggtacaaccagaacctgcagcacggcggcggcgccaggggggcggtgaccgtcacccaggcgcccggcgccacggtggtctcctaccaggagcacaaggcccttcccgagggcgcccagcagggccgcacggcgcacgggcacggcgccaacgcgccggcagggggcacgacggcgtcgtctcggagtaccgagaagcagaacgcggcgaagcacgaggagggccgtgggcatggcacggcccacaaggagcagaagggctcggcagcggtcacccgcgccgccgagggcggccacgacaagcagggcaaagagagcgccgcgcgcggcaccgtggcgtcatctcggggggctgagaagcagcaccacacgaagcaggaggagggccgtgggcatggcacgggccacaaggagcagaagggctcggcggcggtgacccacgccaccgaggacaggggcaaagagggcgactccgcgcgcagcgccaaggacgcggccatgcaagcgctcggaatcacgggagaccaaactgtggccaagggcgccggaaccaaggacgccggtgcgcatggcgcgcaggtccgtgggcatgacacgggccacaaggatcagaagggctcagacacggccgcgcgcaagctcgtctccactggagactacgctgcgcccaagggagcccaggccaaggacgccggcgcgcatggcgcgcaggtcaccgcggaaggcacggaggaggccacggctaccgccgccgagtacgccaaacaggctgcagcaaaggcgaaggaggtcacgctcaccacgggcgagatgacggcggagtacgcgaagcaggccgccgtgaaggccaaggacgtcacggtgagcaccggcgggacggcagcggagtacgctaagacggccgccgagaaggcgagggaggcggcgctggcggctggcaagacgacggccgagtacacgcagcaggcggcggtgaagggcaaggacgtcacggtctccaccggcgggacggccgcggagtacgccaagacagccgccgagaaggccaaggacaccgcgctggcggccggcaagacgacggcagattacactcagcaggcggcggtgaaaaccaaggacgtgacgctgtcgaccgccgcgcaagcggcgcagaaggccaaggaggtgaccgcggtcacggcgcagaaggtggcggagtacacgaaggagatggcggagcaagggaagaacgctgccgcccaggccgaggagaaggcgaaggaggccgcagcccgcgccgccgacaaggcggaggagccgagcttcgacacgagcacgcagaccaagcgctcggccgcaggggcagcggacaagacccgcgacatgaccgaacaaaccatgaacaaggccaaggacacgaccggagccatggcgcagaaggccactgacacggctgcgtacgtcaaggactcggtgatgggcgcagcaggaggcacggcggacaagacccgcgacaccactgaacaaacaatgggcagggccaaggaggctaccggagacgcagggaataggaccgggagcatggccgcccaggtgaaggacgcgaccggagccatggcgcagaaggccggccacacggccgcgtacatcaaggactcggtgatgggcgcggccggaggcgccgtggacaagacccgggacgccacgtcgcaggtcgcgcagaagacaggggaggcgacgaacagagtggtggagaccggcaaaagcgccaccggcggcggcatgaccgggacggccaaggcgaagggtgaaggcacagaagacaccaagatcgtggaagacgtgctggaggtggtgggcgcgggcatggaggcggtgggcgcgacggtgtacgggatagcgcagcacaccaaggggatcgtcgccggcgaagaggagctcatcccggtcgaaggggaggccgggaaggtcgccggagccggcgagggcaggaagaaatccgagtgagcagacccacacgtacgtcgcaccaaaaatgttaagagaatgttggttgtgcagtcactttgatcggacacgtttaaagcggtgttgtatatagttgtagtaataataagtagtgcactatatggagtgctcaggtgagctgaataatggtcgtttatagttaagagggactatatgtccagatgttgaatctgctgctactagtacgtttggaagcgctcagctagtagaatgctcaaatcttatggaatgaaatggctatgtagtgtgatacatcgtgtacttagccaagtgaactaggtaaatgttcgtgtaaatctgaagtgatacttgtccacttcaatattagaatcatcaagctctatagggggaaacat

SEQ ID NO: 36277 - DNA, 2025 bp, Triticum aestivum
  Clone ID: PAT_TA_36277
gtgattggcgggtgcgtctcttctctttctttcttgcttctccctttccccctcctcctcctccttgacttcgccgccgtctcactcgcaacgccccccgtctgctatcccttccctggaagttgggagtggaggagcttgccgacgcgccgacgcaggcgaggttcttttgagtttctgagaccatggggcagaggctcctattactggtgaccacctgtctgtgggctctttcatgcgccgtgccgcaccacgcttcctcgcgtgatggactgcttaggatcaacctcaacaagaagagcttgacccatgaatctctgggccgcagcaaaggccgccgaggcagcacgatgccctccgactgaagagcggcaattcaagacagcgacatcgtgcctcttgtcgactacctcaacacacagtactatggggtcatcggcctcggcacgccgccgcagaatttcacagtgatatttgacaccgggagctccaacctctgggttccctcggcgaaatgctatttttcgatagcatgctacctccatcccaaatacaagtcgagcaagtcaagcacttacaaagcagatggtgagacttgcaaaattacatatggttctggagcaatctctggatttttcagcaatgataatgtgttggttggggaccttgttgtgaaaaatcagaaattcatcgagacaacacgtgaaacaagttttagttttatcgtcgggaagtttgatggcatccttggccttggctaccctgacatctccgttggaaaagcccctccagtatggctgagcatgcaagatcagaagttgctcgctgacgacgtattctcattttggcttaaccgggattctgatgcactttctggcggtgagctcgtcttcggtggcatggacccggatcactataagggaaaccacacctatgtccctgtgagccgcaaaggttactggcagtttaacatgggtgatctcttgattgatggccactctactggcttctgtgcaaaaggctgtgctgctattgtggactccgggacttccctgctggctggcccaacagctatagttgcgcaggtgaaccatgcaattggagctgagggaattatcagcaccgaatgtaaagaggtggtgagccagtacggagagatgatcctccgaattgttaatagcacagacacagccacagaaagtttgcagtcagattggtctgtgtttgtttgatggtactcactctgtcagcaacgggattgaatccgttgtcggtaaagaaaatgttggctcggatgttatgtgcacagcctgtgagatggctgttgtgtggatagagaaccagctccgtgaaaacaaaacaaaggagctgatattgcaatatgctaaccagctgtgtgagcgtctaccgagcccaaatggagagtcaacagtcagctgccatgagatgtcaaagatgccgaatcttgctttcaccatcgcaagcaagactttcgtgctaacaccagagcagtacgttgtgaaactggagcaatcagggcaaaccgtctgcatcagtgggttcatggcattcgacataccgcccccacgtggtcctctctggattcttggggatgtcttcatgggcgcttacccacaccgtgttcgacttcggcaaggacagaatcgggtttgcggaatcggcttgaggagtcgagagcactgtgatgtttccgaaggtttccacgcacgtatcctagaatagtttgggtatcttggacatgggagccctgctgtaaaggaattgataggtaaaaagctgaaacaaaagagagagccttttatttctttcttaaacaaagaataaatggatgcttgaactctgaagaaaaaaagtacatttgtatccattatggcccttcgtgtgtaatgaagaatggagtgcttgcacgatgagaaccgagagtaaataggcaacacatggtttgtaaaaaggtttattgtatttgtgaacacgtaacaaacaattcaatatacacttctttca

SEQ ID NO: 36278 - DNA, 658 bp, Triticum aestivum
  Clone ID: PAT_TA_36278
gccggccggttcgaaacagcgtccaagccgccacccccgctcgcctctccctcccacctcccaagccgccactctcaagcctcttgctcatccgcgtgcagcatctctctagcttccccctagagagatctcacagccgaataagcagcagcaagaacccctccggccctcctcccagcaccaccaggaaccaagtcaagtcgccaatggccggtctcaggatgaagttcgtcgccgtcgccgccatggccgccgcgctcgtcgcctccgcggccgccgccgaggccccggccccggcgcccgcctccgacgccgcggccgccgtgcccctcgcagcggcctccttcgccgccgccgccttcggttacctcttctgctagatccgtcgcggtggcgtgtgatgagatgagatgacccttcttcgtctgtccggcttggtttactcgtcgtcttggtgtgtgtgcgtgtgttcgtgttggggcgtgaggtgtgggcgcgtgcgtgtgtgtatgtatgggtcgcggtggtgtgggaggtgtgtccagtacgtgcgccggcgtgccattctttgtgttggtgatcatgtacttactctcttgttcttgcaatgaatgagaccatttatttgatccaaaaaaaaaaaaaaaaaagggcccta

SEQ ID NO: 36279 - DNA, 910 bp, Triticum aestivum
  Clone ID: PAT_TA_36279
aggagaagtgggtgcccgtcaccaagctcggccgcctcgtcaaggagggccgcttcaccaagatggaggagatctacctccactcgctccccgtcaaggagcaccagatcgtggagacgctctgcccggggctcaaggacgaggtgatgaagatcaccccggtccagaagcagacccgcgccggacaacgcacccgcttcaaggccttcgtcgtcgtcggcgacagcaacggccacgtcggcctcggcgtcaagtgcgccaaggaggtggccacggccatccgtggcgccatcatcctcgccaagctctctatcgtgcccgtcaggaggggctactgggggaacaagatcggcctgccccacaccgtgccctgcaaggtcaccggcaagtgcggttccgtcaccgtgcgcatggtgcccgcccccaggggttccggaatcgttgccgcccgcgtccccaagaaggtcctgcagttcgccgggattgatgatgtcttcacttcctcgcgtggatccaccaagacccttggcaacttcgtcaaggcaaccttcgactgcctgatgaagacctatggattcctcacccctgacttctggagggagacaaccttcaccaaggcgccgtaccaggagttcaccgacatcttggcgaagccgaccaaggccctgatgcttgatgcaccagccgagaaggtagaagcttaggatgttgccataaaagggtttttactagctgggagctgtctgttgcacttccctttattatagtcgagaaccaggtgtctttgaattgtgctacttgtggaagtctctgtttgctgtcaagttttggattatggtgcaatgctactctctgttatcggcaacatttttggtctgtgctttgtgttgatcgtatcaaaaaaaaaaaa

SEQ ID NO: 36280 - DNA, 801 bp, Triticum aestivum
  Clone ID: PAT_TA_36280
ccctattcgtcgcctcccagttcgagttccaccgcccgcagcaaccaaagccaagtttcgaagccgccgccgccgaggagcaggagaaggcgagaagccatggcccgtacgaagcagaccgcccgcaagtccaccggtggcaaggccccccgcaaacagctcgccaccaaggcggcgaggaagtcggcgccgacgaccggcggagtgaagaagccccaccgctacaggcccggtaccgtggcgctccgggagatccgcaagtaccagaagagcacggagctgctgatccgcaagctgccgttccagcgcctggtgagggagatcgcgcaggacttcaagacggacctccgcttccagtcccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgcggggagcgcgcctaagcgagcgaggcaagtccagccccccgtcaccaccgtggcgacgttcgccggcattactagtactagttgattagcttcccctgtcgagataatgcatcttgtggtccgttgtagaaaacctggtgtgattagttatcctagttacggagactcttgtctgcttaattggttttagtttgcggtactattgcaaaagggatgcttactactgtgatgaaactgttggttaatatagtcttgattaacattgctatcgatgtatatgcagacctgtggtgctgtgctagttgc

SEQ ID NO: 36281 - DNA, 627 bp, Triticum aestivum
  unsure (1)..(627): unsure at all n locations
  Clone ID: PAT_TA_36281
actattcgcctttccgacccacactaggtcgccttccgattcgaacctcccccaaatccgcagcagtccacaggaggcgaagccaccgcgatggcccgtacgaagcagaccgcccgcaagtccaccggcggcaaggcgccccgcaagcagctccgccaccaaggcggcgaggaagtcggcgccgaccacccggcgggagtgaaagaagccccaccgctacaggcccgggaccgtcgccctccggggagattccgcaagtaccaagaagagcacggagctgctgattccgcaaagctgccgttccaagcgcctgggtccgcgagattcgcgcaggacttcaagaaccgaccttccggctttccaagtcccaacgcccgtgctgggccctccaaggagggcgggccgaaggcgtacctcgtcggggctgttccgaggacaccaaccttgtggcgccatccaacgcccaaagcggcgtcaccaatcatgcccaaggacatcaactcgcccgccgcatccgtggcgaaaaggcctaagccgtctccccgtcaacgccgttagtggatcgnaatggattttgctcccggttgtagttgttccaattgcgtcnagtcaacttctttgtgtaaa

SEQ ID NO: 36282 - DNA, 1686 bp, Triticum aestivum
  Clone ID: PAT_TA_36282
ttcgcctgctcgaaattaaccctactaaagggaacaaaagctggagctccaccgcggtggcggccgctctagaactagtggatcccccgggctgcaggaattcggcaccagcacaccccctctcccccaacctgctccgtccccatcccctcgccgccgccgccgccgccgccgtctgagccctagactcgcgcgaatcctccccgggccgagcgatggcgatgcagaagtccggcgggagagactggtagcgagtagggcagttccccggtcaccccacacacaaatcccggcgagcgagcgcagagtgacctgactttttctgccatccatggcgaccgtgaaccccttccgacctcctcggcgacgacgagggcgacgaccccacgcagctcctggccaaggcggccgccctggcgcagaaggccgaggccaagaaggccgccgcgcccgcccgccgccggcaagggcggcgcgcggacggtcgccaatctgcccaccaagccgcctccgcctggtcaggctgccaatgagtctcgtggtggtggtccactctcccgtggaggatatggtcgcggtgaacgtggctcaggcagaggtggccgaggagggtacggtcagaatcgcgactacgccagtgaagacacaaatggctacaggggaggttatggtgccagaactggaggtgaggaaggcgcccaggatagagagagggcccctcggcaaccctaccaggggggaggccgtcgtggtgggtatcgtgaaggcgagtttggtgatgattctgagaggccacctcgaaggaactatgagcgccaaagcggcacaggccgtgggtatgagataaaacgcgagggtgctggccgtgggaactggggaactacctctgatgaaattgttgcccaggaaactgaggccctgaagcaggatgagaaggcccctgcacctgagaagcagggcgcaccagaggatgcaccacaggcagatgagaacaaggccaccaaagatggcgctgcagttgtggaagaagaaaaggaagaggataatgagatgactcttgatgaatttgagaaagtaatggaggagaagaggaaagcacttgctgctttgaagaagtctgaagagaggaaggttgaaattgataaggatctgcaggctatgcaactactttccaccaagaaaggaaatgatgaagttttcatcaaactgggtgctgataaggaggctttgaagaagaaagagaatgctgaacgtgaagagcgtgctaagaagtctgtgagcatcaacgagttcctgaagcctgctgaaggagaaaggttctatggcggccgtggccgtggcggcaggggccgtggagaccgcggaggcttcagaggcggatttggtggtgggggttatcacggcccaccggcccgcaccggcaattcaggaccagaaccagttcccaaccctcggtgggaagtgagattgctgtaccatctcaagtgccacctttaccaatatcatcgacgctgtcaagtttagattttcctatcaccatatatttctgcacggatcctatattgaaacaaataactctgctgcatgtggaccattcatccctgtgtctgtcatgactttgtaaatccgatggttgtcgcttatcagaattttgtaggctatgaactgctccttcctttgtccgtc

SEQ ID NO: 36283 - DNA, 1566 bp, Triticum aestivum
  Clone ID: PAT_TA_36283
cgtccgcccacgcgtccgctcactgccatccgcactatctcatacactcgtcgctgcgttgctcgccggctcaaatggctcttcaggcggccacttccttcctcccgtcggccctctccgcgcgcaaggagggagcggccaaggactctgccttcttccgcgtttgtctcgccgatggcctcaaattcgacaccacctccctcggcctgcgcaccaagagggtgaacacgtcgtcggtggccatccgcgcgcaggccgcggcggtgtccgcgccgaccgcgaccccggcgtcgccgtccggcaagaagaccgtccgcacgggcaacgcgatcatcacgggcgcgtcgtcgggcctcggcctcgccacggccaaggccctggcggagtcaggcaagtggcacgtcatcatggcgtgccgcgactacctcaagaccgcgcgcgcggccagggcggccggcatgcccaagggcagctacaccatcgtgcacctggacctggcctccctcgacagcgtccgccagttcgtcaagaacgtgcgccagctcgacatgcccatcgacgtcgtcgtctgcaacgccgccgtgtaccagcccaccgccaaggagccttccttcaccgcggacggcttcgagatgagcgtcggcgtcaaccacctcggccacttcctcctcgcccgcgagctcctcgaggacctcaaggcctccgactacccctccaagcgcctcatcatcgtcggctccatcaccgggaacacgaacacgctcgcggggaacgtgccgcccaaggccaacctcggggacctgaggggcctggcggccgggctgaacggcgtgggcagtgctgccatgattgacggcgcggagttcgacggcgccaaggcgtacaaggacagcaaggtgtgcaatatgctgaccatgcaggagttccaccggcggtaccacgaggagaccggcgtgaccttcgcgtcgctctacccggggtgcatcgccaccacgggcctcttccgtgagcacgtcccgttgttccgcttcctcttcccgccgttccagaagtacatcaccaaggggtacgtgtccgaggaggaggccggcaagaggctggcgcaggtcgtcagcgagcccagcctcaccaagtccggcgtctactggagctggaacaagaactcggcgtccttcgagaaccagctctccgaggaggccagcgacaccgagaaggccaggaaggtctgggagctcagcgagaagctcgtcggactcgcatgatcaccaaatggccggccctccggcgaggtcgcaaaccctgatcgatcgtcatccgcaccaagtggcgaaattttgtgcttcttttctcaagccaaaaaaaagaaaaaataattgtaggacacgtttcgcacaaactgctagattaagtacgtggcgcgcccgattaagtccgaagtggttacagttcgcaaggagtttaagcctgtaaaactagttctttttctttgatttggtaatagtgacaataaagtgtcttgggcggccaaatagtggaagtacagttcgactttttgagtttcaaaaa

SEQ ID NO: 36284 - DNA, 1521 bp, Triticum aestivum
  Clone ID: PAT_TA_36284
gcacgaggacagtacatcagcacagtacactcgcggcgcacgctcgagcttgctagcgacagtcagtccgtccgagctcaccgtcatccatggctctccagctcctcccctccaccctctccgtccccaagaaggggagccgccttgggcgcggtggccggtgaaggacacggcggcgttcctgggcgtgagcagcaaggcgaagaaggcgtcgctagcggtgaggacgcaggtggccacggcgccttcgccgggtgacgacgagcccgggctcgggcccgcggcgaagccgagcgggcaagaagactcctgcggcagggcgtggtggtgatcacgggcgcgtcctccgggcttggcctcgcgtcggccaaggcgctggcagagacgggcaagtggcacgtggtcatggcgtgccgcgacttcctcaaggcctccaaggcggccaaggctgccggcatggctgacgggagctacaccatcatgcacctcgacctcgcctcgctcgacagcgtccggcagttcgtcgacgcgttccgccgcgccgagatgccgctggacgtgctcgtgtgcaacgccgccatctaccgccccacggcgcgcacgccgacattcaccgccgacgggcacgagatgagcgtgggcgtgaaccacctcggccacttcctgctcgcccgcctcctcatggaggaccttcagaagtccgactacccgtcccgccgcatggtcatcgtcggctccatcaccggcaacagcaacacgctggcgggcaacgtgccgcccaaggccagcctcggtgacctccgcgggctcgctggcggcctcagcggcacgtcgggctcggccatgatcgacggggacgagagcttcgacggcgccaaggcgtacaaggacagcaaggtgtgcaacatgctgaccatgcaggagttccaccggcggtaccacgaggagaccggcatcaccttctcctcgctctaccccggctgcatcgccaccacggggctgttccgggagcacatcccgctgttccgcacgctcttcccgccgttccagaagttcatcacgaaggggttcgtctcggaggcggagtccggcaagaggctggcgcaggtggtggcggagcccagcctgaccaagtccggcgtgtactggagctggaacaaggactcggcgtccttcgagaaccagctctcgcaggaggccagcgaccccgagaaggcccgcaaggtctgggagctcagcgagaagctcgtcggactcgcctgatctcccacccacctccggctccggccacgtccaggcaatgcatgcatctaggacgccgatgctgaacttgtcgcattttttaacgttggtaattaccatttttacgtctttttagaaactcaattacccgggagaggccttgcgagtgtcggcgagagtgcatagatctcgtgtggaagatgtacaattttcggcgaaccatgaataataaaactgcaggcctgattgaggatggcaaaaaacccccacccccccagc

SEQ ID NO: 36285 - DNA, 797 bp, Triticum aestivum
  Clone ID: PAT_TA_36285
aggcgcccctctatcccgtcatctctttcctcccccctcggcgcagcaacagagagatggcggcggtggcgacgacgacggcggtccacgggagccaggcggccggcgcgcagaggctgctgcttctcctcgctctcgtgattgaagctgtaaacaatggagcagatatcttcactgaagaccagcaagaaattatcaagcaatttggcagaatcaaatccgagactgttcctgagaacaaggatgcagggtctgatgacgatgatgacgatgatgaagatgaggatgatgaaactggtgatgctgatgatgatgatgccgatgctggagaggacttctcgggtgaagaaggcgaggacgatgacgaggatgatgaccctgaggcgaacggcgatgatgctggcgcggggagcgatgatgatgatggtgacgacgacgatgatgatggtgaagacggcgaggacgacgatgatgatgacgaggatgaggatgaggaggacgaggaagatgaggaccagccaccggccaagaagaagaaatgatctgccttcctgctgtcagtgtttcagtccgttagtttatctgctgtctagatgttgattgagcgggtctggtacacaccgacctatgtagcttctgtgtcttggtggtttggtgtctcatagggtagaacattgaacttctaatgttgtttcctgcgttgtgcaagtagtcttaacatttcggtcttgatatgctgtgtttattggagctgtgataccattcaatctaattcttgttactccaaaaaaaaaaaa

SEQ ID NO: 36286 - DNA, 767 bp, Triticum aestivum
  Clone ID: PAT_TA_36286
agaggttaggataggtgttcattcgcaacttgtagctgcatgccagcaatggtccaagcaaactaacgcaaccacgcaattggtttacagtagtagcacaacacaatgggcagacatagcccacacatgttacgatagcataacattgtcacagcagttcagtgctaaacattgcatatagctactagggcaaggttttgttgcagcacagagtcttccattcaaacagtctaccagctttagtccccgccaacctgacgcttccacgagtcctccacaatgagctcgtcaactccccagtcctcgtagcttccatcaggtaagtaccgcctaatcgtgaaggggatcttgcgtgctctcagttctttcatggcaatctcaagaggatcagtttcgccctcaagctcaaccataactggggcattcatgcttatctgcaaagcacgtgtgccaaggatgcgtgcccgctcatacttggtcatatattttgttgtattgcgtggacgggcagtcttttcctgttccttttcttcaccttcaccccctaccacgtcatcaggggcatcctcgttgttctcaggatcttcttcaaccccttcctcaatatcagcctctggaggctcatcctcgtaccccatgtcaacttcattgtagtcgtcgtccgccatggctgccgccgccgagcgctccggtcgctagggtttcgccgcgggaggaagcctcgggcgtggggattgtggtgggtgttcgccgacaatgcctcgtgc

SEQ ID NO: 36287 - DNA, 1369 bp, Triticum aestivum
  Clone ID: PAT_TA_36287
gttttttttttttttttttttttttttttatcccaaatttgagcagcccttgcctgtttctctaccgtaaaaagagcaacaatacactcagaatatattgtctacagctagatacatcttacatggaagaatgttaaccctgtctcattcaactatgagcagaacatacttacaagatagccgaccaccacagagaaaggaaataagaactgaattacttatttacttataaaacataaaatagttataggatgtacatctgatgtgagggcataagttgaagtacaccggggaatgacacatgtttacactgccagacacgtaaaaaggccctttgacaacatactcgccgcactgtactgttctcaacccattagcttcagacaagttcaattttctgctctgccacccaagattcttttggacccagctgtactgtttcaatctttgcattttcaacacaaacaaagtctttgtagcatgcctccatctgcaagtgaggattccacaacactgcatctgaccagtttgtgtttgagattacaattttgtcacccaatccattgtccagggtaagctcactcggtgcaccaaggtaaacacagtcgacaaatcctggaaaggtcacctcgtccctttcttctttgccctccagaggatttttagggtcaggatccttattgagggtcttgctaccttcgagacctttcactgaaacaccagcaattgaagcactgaaataagtgtggagggctgagttgaatgagaaaggtttatcgtctgtatttattattttcagggtagttgacaggcttgtagagtgcagcacaaccttgtataaagcttggaaactaaaatcccacattgaacggctgtacgagtcgtcttttagttccaaagttacagttggatctccttctgtgacttctgaatcagtaatagaccaattcacattccttgcgaatccatgctgctgcatggggccggggccaaactggggaaaacaatgtggaattccaccgctgatgggtttctggccgttgaacacagcatctggtctgacaaagagcaggtcctttccactgggaaccttccaagatgtgacgcatgctccaaatagataaatctcagcctcactcccgtgcggggatttgaggctgatcttcggcaggccgccgttgccctcggagacggccacgccgggcgcgtacaccttctgccccgcgctggccatggcaaccaccccgaatcgcctgtagcgacgggctgaagtggaggaggaggaggaggaggcggcgaagagggcagggacggtgagcgtgcaggaagccgccatttctgcttggcctcgtgccgaattcggcacgag

SEQ ID NO: 36288 - DNA, 1185 bp, Triticum aestivum
  Clone ID: PAT_TA_36288
ctcgtgccgaattcggcacgagacccattcccctcaccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccacgctctccgtcggcaacgtcctcccgctccgctccgtgcctgagggaggcgtcatctgcaacgtcgagcaccacgtcggcgaccgtggtgttttcgccagggcctccggtgactacgccatcgtcatcagccacaaccccgacaacggtacctcaaggatcaagctcccctctggcgccaagaagatcgtcccaagcagctgccgtgccatgattggtcaggttgctggtggtggcaggactgagaagccaatgctgaaggctggtaacgcctaccacaagtaccgcgtgaagaggaactcctggcctaaggtgcgtggtgtggccatgaaccctgttgagcatccccacggaggaggtaaccaccagcatattggtcacgcctccactgtccgccgtgatgcaccacctggccagaaggttggtctcatcgctgccaggaggactggtcgtctcagaggccaggccgccgcctctgctgccaaggccgacaaggccacttagagttatcgttgctgtttatcaatgtttgctagctctagattacccgtcaaggacatgtattgcagtaaggatgttgtttttgctcggtactttggtaacctggtgatatttgttgtcagtttttgctgtcgtggtctggattcttcagtccacataaagaagattattatgcttgggtatttgtctgtcgattttcttgagtttactgtttctgtttcagataagctctattgctaatctactacaaatgcctcctctcatgaatgacgtcttgtcggaatacaaaatggtttgtctcctaccaggcggcttttgcatgatgtcttcct

SEQ ID NO: 36289 - DNA, 1166 bp, Triticum aestivum
  Clone ID: PAT_TA_36289
ttcggcacgaggagcctcagctccaaaccctcatctcccccatccaagctcactgcccccaaccccccacccccacccagccatggcggaccgcggcggcgagcgtggtgtcggcgagcgcggcggcgaccgcggcggcttcgggcgcggcttcggccgcggcgggcgcggggaccgtggcgggcgccgcggcggccgccgtggcccccgccaggaggaggagaagtgggtgcccgtcaccaagctcggccgcctcgtcaaggagggccgcttcaccaagatggaggagatctacctccactcgctccccgtcaaggagcaccagatcgtggagacgctctgcccggggctcaaggacgaggtgatgaagatcaccccggtccagaagcagacccgcgccggacagcgcacccgcttcaaggccttcgtcgtcgtcggcgacagcaacggccacgtcggcctcggcgtcaagtgcgccaaggaggtggccacggccatccgcggcgccatcatcctcgccaagctctcaatcgtgcccgtcaggcggggctactgggggaacaagatcggccagccccacaccgtgccctgcaaggtcaccggcaagtgcggctccgtcaccgtgcgcatggtgcccgcccccaggggttctggaatcgtcgccgcccgcgtccccaagaaggtgctgcagttcgccgggatcgatgatgtcttcacttcctcgcgtggatccaccaagacccttggcaacttcgtcaaggcaaccttcgactgcctgatgaagacctatggattcctcacccctgacttctggagggagacaaccttcaccaaggcgccgtaccaggagttcaccgacatcttggcgaagccgaccaaggccctgatgcttgatgcaccagccgagaagatagaagcttaggatgtttgccatgaaagggtttttactagctgggagctgtctgttgcactttgctttattatagtcgagaacaaggtgtctttgaattgtgctacttgtggaagtctctgtttgctgtcaaagttttggattatggtgcaatgctactctctgttatcggcaaaggatgctacataattatgccaatcccagtgttatttgtctaaaaaaaaaaaaaaaaaaaaaaaaaaaacccacgcgtccg

SEQ ID NO: 36290 - DNA, 1172 bp, Triticum aestivum
  unsure (1)..(1172): unsure at all n locations
  Clone ID: PAT_TA_36290
ctcccctgcccccaaccccccacccccacccagccatggcggaccgcggcggcgagcgtggtgtcggcgagcgcggcggcgagcgcggcggcttcgggcgcggcttcggtcgcggcgggcgcggggaccgtggcgggcgccgcggcggccgccgtggccctcgccaggaggaggagaagtgggtgcccgtcaccaagctcggccgcctcgtcaaggagggccgcttcaccaagatggaggagatctacctacactcgctccccgtcaaggagcaccagatcgtggagacgctctgcccggggctcaaggacgaggtgatgaagatcaccccggtgcagaagcagacccgcgccgggcagcgcacccgcttcaaggccttcgtcgtcgtcggcgacagcaacggccacgtcggcctcggcgtcaagtgcgccaaggaggtggccacggccatccgcggcgccatcatcctcgccaagctctcgatcgtgcccgtcaggaggggctactgggggaacaagatcggcctgccccacaccgtgccctgcaaggtcaccggcaagtgcggctccgtcaccgtgcgcatggtgcccgcccccaggggttccggaatcgtcgccgcccgcgtccccaagaaggtgctgcagttcgccgggatcgatgatgtcttcacttcctcgcgtggatccaccaagacccttggcaacttcgtcaaggctacctttgactgcctgatgaagacctatggattcctcactcctgacttctggagggagacaaccttcaccaaggcgccgtaccaggagttcaccgacatcttggcgaagccgaccaaggccctgatgcttgatgcaccagctgagaagatagaagcttaggatgaagggtttttactagctgggagctgtctgttgcactttgctttattatagtcgagaaccaggtgtctttgaattgtgctacttgtggaagtctctgtttgctgtcaaagttttggattatggtgcaatgctactctgttattggcaatggatgctacataattatgccaattgcagtgttatttgtctagatgtttgatttttggtctgagctttgtgttgattttctccattgcctcctgctttgtttgtgttgttttctaaactgnccattcttggtgcagtgtgtttgag

SEQ ID NO: 36291 - DNA, 659 bp, Triticum aestivum
  Clone ID: PAT_TA_36291
ctttctccccttccccaaacctgctgcggtctctgctccgatctcccccgaatccaaatccaaatccaaatccaaatccaatccgccgcggaagaagcgaggatgatctaccgcaactggtccctgctctcctccacggtcgtcatctggggcagcgtcggcgccgccggcctcgccgggatcttcctcttcggcggcaaggagaaattccagggctatctttctcgcgaaggcgagaggctgaggcagcaggacagagccatgatgggcaagaactagtgcagaccacggctcactttcgacgtgtcaacatgtgaactagacatggaacgaagtatctctatgatatagaacatacaaattatctctgccttccaatgccaccttttgcttctgccccccatgaataatactgacgcggatgttcattctgttcccccatgaatgttctcgacgccatgtttgctctgttccctttggtagcctgctgtttgtcgactttgttctggcgctctgaataagttttgatactgatataccatcgctgttgagtcgcaatacttttttgtcactggatatgttatagagtcggtgtacattcggccggtgcttgggcggatgaattataaaagaaaaaaaaaaaaaaaaaaggcccccta

SEQ ID NO: 36292 - DNA, 1145 bp, Triticum aestivum
  Clone ID: PAT_TA_36292
cgccgccacagcctccagaccctatctcccccgtcggagctccctgcccccaaccccccacccccaaacaaccatggcggaccgcggcggcgagcgtggtggcgaccgcggaggcgaacgcggcgggttcggccgcggcttcgggcgcggcgggcgcggggaccgtggcgggcgccgcggcggccgtcgtggccctcgccaggaggaggagaagtgggtgcccgtcaccaagctcggccgcctcgtcaaggagggccggttcaccaagatggaggagatctacctccactcgctccccgtcaaggagcaccagatcgtggagcagctctgcccggggctcaaggacgaggtgatgaagatcactcccgtgcagaagcagacccgcgccggccagcggacccgcttcaaggcgttcgtcgtcgtcggcgacagcaacggccacgtcgggctcggcgtcaagtgcgccaaggaggtggcaacggccatccgcggcgccatcatcctcgccaagctctccatcgtgcccgtcaggaggggctactgggggaacaagatcggcctgccccacaccgtgccctgcaaggtcaccggcaagtgcggctctgtcaccgtgcgcatggtgcctgccccgaggggttctggaatcgtcgccgctcgtgtccccaagaaggtgctccagttcgctggtattgatgatgtcttcacttcctcgcgtggatccaccaagacacttggcaacttcgtcaaggcaaccttcgactgcctgatgaagacctatggattcctcacccctgacttctggagggagacgaccttcaccaaggggccgtaccaggagttcaccgacatcttggcgaagccgacaaaggccttgatgcttgatgcaccagttgagaagatagaagcttaggatgttggcgtaaatggtttttgctagctgggagctgtgtaatgcactatgctttatttagttattaagactttgaatcgtgctgcttcaggatgtctctctgccgtcaagtgttggtttgtggaactatgctactctcttttatcgtcaatggatgctacataattatagataaaaaatgactgattgccataattatggcttctatctatgctgctttgtgttaaaaaaaaaa

SEQ ID NO: 36293 - DNA, 1266 bp, Triticum aestivum
  Clone ID: PAT_TA_36293
agcgtggtcgcggccgaggtttttttttttttttttttggtaacatgatcagagaacttccattgaacaccttgaagagtgatttttcagataaaattacatttggtattgattggaaccagcactgactgaaacagcggtaggaaatggaacacaatcacacatctaaatctagaacaccacgtacaagatttatcccggaggatattattatcaagcactgactggctatctacatgtagggcccaggaagaagctaaatcttaattacacaaagcctcatttttgttcgcgggagctaaaacccatggacaggaaccgatgttttgcagagtttttggcaccgtgtttataccgaatcaacctcttcaacctgctgacgagcaagatatctctctcttcgttccttccattcatcgatcacaagcccttcaccaacgatagggggactagtgtcttctggaggcttcttgcgtgcctcaagagctgcttcagcttcagcgagctgacgcttgagcctgtccagttgtgcgctaggacgctcagcatccaagaaaataacccgcagaatttgctcaactgcaacctggtctttctgctcatcgaacaattctggaacatactccacaggccctttaactttcaggctaacaatcttgaacttgaccttgcacttctgatctaaaggcttctcgttgttctcaggatgctccacaaacttgaacactgtagctatgatggtttctcctggagcaagtatgccgccgggaggcctcatgaagcagctctttggtgctgttgtttggaacttgaacgccacatgggacttgctgacgttcttgatcctcaccgcgctccggacttgcttgccaggctcatatgggaagtagagctttgatggcgggtcgagccgcagtcgccgcctggtaggcagcagcgaccgtatcgccgcggcacccgacgacccgcccgacccctcggcgcctcctccctccgccagaggcggcggtgggccggacgcggtcccccacagaggcatgtgtcacagctcccgccgcgtcgtcgcccccctcttgctgctggtcgtgcccctccgccgcggcgcggagccccctgcagcaccagcaccagcagaggatcgtcgctcttcgtcggaagccgtcgagcgtgtgatggtgcggggagccttggttggagtggttgggcggctagtggaggtcgaggaagaagaatattattggggcggggtgcggtggggtggacgag

SEQ ID NO: 36294 - DNA, 1498 bp, Triticum aestivum
  unsure (1)..(1498): unsure at all n locations
  Clone ID: PAT_TA_36294
cccacgcgtccggtacagtacatcagcacagtacactcgcggcgcacgctccagctcgctagcgacagtcgtccgtccgagctcaccgtcatccatggctctccagctcctcccctccaccctctccgtccccaagaagggcagcagcatgggcgcggtggcggtgaaggacacggcggcgttcctgggcgtgagcagcaaggcgaagaaggcgtcgctagctgtgaggacgcaggtggccacggcgccttcgtccgtgaccacgagcccgggctcggcggtagctaagccgggcggcaagaagacgctgcggcagggcgtggtggtgatcacgggcgcgtcctccgggctgggcctggcggcggccaaggcgctggcggagaccggcaagtggcacgtggtcatggcgtgccgcgacttcctcaaggcctccaaggcggccaaggccgcgggcatggcggacggcagctacaccgtcatgcacctcgacctcgcctcgctcgacagcgtccggcagttcgtggacgcgttccgccgcgccgagatgccgctggacgtgctcgtgtgcaacgccgccatctaccgcccaacggcgcgcacgccgaccttcaccgccgacgggcacgagatgagcgtgggctgtgaaccacctcggccacttcctgctcgcccgnctcctcatggaggacctccagaagtccgactacccgtcccgccgcatggtcatcgtcggctccatcaccggcaacagcaacacgctggccggcaacgtgccgcccaaggccagcctcggcgacctccgggggctcgccggcgggctcagcggcgcgtccggctccgccatgatcgacggcgacgagagcttcgacggcgccaaggcgtacaaggacagcaaggtgtgcaacatgctgaccatgcaggagttccaccggcggtaccacgaggagaccggcatcaccttctcctcgctttacccgggctgcatcgccacaacggggttgttccgcgagcacatcccgctgttccgcaccctcttcccgccgttccagaagttcgtcaccaaggggttcgtgtccgaggccgagtccggcaagaggctggcgcaggtggtggcggaacccagcctgaccaagtccggcgtgtactggagctggaacaaggactcggcgtcgttcgagaaccagctctcgcaggaggccagcgaccccgagaaggcccgcaaggtctgggagctcagcgagaagctcgtcggactcgcctgatctccggccaggtccgggcaatgcatgcatctaggactccgatgccgaacttgtcgcattatttaacgttggtaattatcacttttactcctttttagaaactcaattacgcgggaaaggccttgcagtgtcggcgagagtgcatagatctcgtgtggaagatgtacaattttcggccaaccatgaataataaaaccgcaggcctaattgaggatgacaaaaaaaaaaaaaaaaaa

SEQ ID NO: 36295 - DNA, 779 bp, Triticum aestivum
  Clone ID: PAT_TA_36295
gccggccgggttcggcccctctattgccgccgccgccgctccgagctcgcgccccctagcccagccgccgccgccgccgccgcctcgtcggagttcttcccacccctttcgccaacatgggtaagacacgtggtatgggagctgggcgcaagctcaagacccaccgcaggaaccagaggtgggctgacaaggcatacaagaagagccacttgggtaacgagtggaagaaacccttcgccgggtcatctcacgccaagggcattgttttggagaagattggtattgaggccaagcagcctaactctgccatccgtaagtgtgctcgtgtgcagcttgtgaagaatggaaagaagattgccgccttcgttcccaatgatggttgcctgaacttcatcgaggagaatgacgaggtgctgatcgctggattcggtcgtaagggacatgctgtgggagatattcccggtgtccggttcaaggtcgtcaaggtgtcaggtgtttctctgcttgccctcttcaaagagaagaaggagaagcccaggtcttagattgccgttgcatggagtagacagtatgtcgggcctttagatgttgaaggaggatggtacctttgtgtttacagcacttttaagttgataacttatgatcgtgttggtgaaaactatgccttgtcacattttgctcctgttatgggaaagtgctactgttatgagttttgttccccagtttgagatgaatttcccttgtcctgaaattgccctgggcattggttgtgtatgtag

SEQ ID NO: 36296 - DNA, 1375 bp, Triticum aestivum
  Clone ID: PAT_TA_36296
aaaaaaagtgattactgttctttgaatcagggagattactatgaacaaatctgatttatcccaaatttgagcagcccttgcttgtttctctactgtaaaaagagcaacaatacattcagaatatattgtctagagctagatacatcttacatggaaaaatgttaaccctgtctcattcaactatgagcagaacatacaagatagccgaccaccacagagaagggaaataagaactgaattactttatttacttataaaacataaaatagttataagatgtacatctgatgtgagggcataagttgaagtacaccggggaatgacacatgtttacactgccagacacgtaaaagggccctttgacgtcgccgcactgtactgttctcaacccattagcttcagacaagttcaattttctgctctgccacccaagattcttttggacccagttgtactgtttcaatctttgcattttcaacacaaacaaagtctttgtagcatgcctccatctgcaaatgaggattccacaacactgcatctgaccagtttgtgtttgagattacaattttgtcacccaatccattgtccagtgtaagctcagtcggtgcgccaaggtaaacacagtccacaaatcctggaaaggtcacctcgtccctttcttctttgccctccagaggatttttaggatcaggatccttattgagagtcttgctacctttgagacctttcactgaaacaccagcgatggaagcactgaaataagtgtggagggctgagttgaacgagaaaggtttatcgtctgtatttattattttcagggtcgttgacaggcttgtagagtgcagcacaaccttgtataaagcttggaaactaaaatcccacattgaacggctgtacgagtcgtcttttagttccaaagttacagttggatctccttctgtgacttctgaatcagtaatagaccaattcacattcctggcaaatccatgctgctgcatgggaccggggccaaactgggggaaacaatgtggaattccaccgctgatgggtttctggccattgaacacggcatctggtctgacaaagagcaggtcctttccactgggaaccttccaagatgtgacacatgctccaaatagataaatctcagcctcactcccgtgcggggatttgaggctgatcttgggcaggccgccgttgccgtcggagacggccacgccgggcgcgtacaccttctgccccacgctggccatggcaaccaccccgaatcgcctgtaccgacgggctgtggaggaggaggaggaggcggcggcgaagggggcggggacggtgagcgtgcaggaagccgccatttctgcttggccggacgcgtggg

SEQ ID NO: 36297 - DNA, 992 bp, Triticum aestivum
  Clone ID: PAT_TA_36297
cggccgcgtgggcggccgcggtggtttttggatttgctttccccttccccaaagctggtgcggtctctccgtctcgtgtgcgatcttccccaatccaattccaatccgccgcggaagaagcgatcgacaggcgctcgcgaggatgatctaccgcaactggtccctgctctcctccacggtggtcatctggggcagcgtcggcgccgccggcctcgccgggatcttcctcttcggcggcaaggagaaattccagggctatctttctcgcgaaggtgagaggctgaggcagcaggacagagccatgatgggcaagaactagtgcagagcacggctcactttcgacgtgtcaacatgtgaactagacatgaaacgacgtatctctgtgctgtagaacaaactttctctgcctgccaatggcaccttttgcttccggcccccatgaataatcttgacgcggatgttcattctgttccccatgaatattctcgacgccgatgtttgctctgttccctttggtagcctgctgtttgtcgactttgttctggcgctctgaataagatttgatactgatataccatcgctgttgagtcgcaaaaaaaaaaaaaaaaaaactcgagggggggcccggtacccaattcgccctatagtgagtcgtattacaattcactggccgtcgttttacaacgtccgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaaga

SEQ ID NO: 36298 - DNA, 833 bp, Triticum aestivum
  Clone ID: PAT_TA_36298
gccggccgggtccgccacctgcgtctctctcgcctccaccgcctcctgtcccctcgcgcgttccgcctcccagttgcggctcccgtcgttcccctcctcggttgctgagatggccggtcgtgggaaggcaatcggcgccggcgcggccaagaaggcgacgtccaggagctccaaggctgggctgcagttccccgtgggaaggatcgcaaggttcctcaaggccggcaagtacgccgagcgcgtcggcgccggcgcccccgtctacctcgccgccgtccttgagtacctcgccgctgaggtcttggagctggccggaaacgccgccagggacaacaagaagacacgtatcgtgccccgccacatccagctcgccgtgcgcaatgacgaggagctgaccaagttgcttggcggcgccaccatcgccagcggcggtgtgatgcccaacatccaccagcacctcctccccaagaaggcctcttcctccaaggcgtccaccgtcgatgacgacgacaactgaggccctgacctgttcctcgctgccaccgcctgcaccatggattaaatttgcatcacaaaagacgaagcagtttcttgttcgtactcgtaggatttagtgtcttggttttcaggagagtcccggatggcttggtattaggaaaatttctagtttggtggtcggattagttgctttcatcccatggctgtgaatatggcaaacaaattttcgggtgtttaaactcagatgtaaggctgcttgatcttgtccggtttctatggctgaagaaattgaaaggaactcaactttaagcttactaccaaatttgtagctcctc

SEQ ID NO: 36299 - DNA, 891 bp, Triticum aestivum
  Clone ID: PAT_TA_36299
aaccctactaaagggaacaaaagctggagctccaccgcggtggcggccgctctagaactagtggatcccccgggctgcaggaattcggcaccagctccaccgcctcctgtcccctcgcgcgttccgcctcccagttgcggctccggtcgttcccctcctcctcggttgctgagatggccggtcgtgggaaggcaatcggcgccggcgcggccaagaaggcgacgtcaaggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacacgtatcgtgccccgccacatccagctcgccgtgcgcaatgacgaggagctgaccaagttgctcggcggcgccaccatcgccagcggcggtgtgatgcccaacatccaccagcacctcctccccaagaaggcctcttcctccaaggcgtccaccgtcgatgacgacgacaactgaggccctgacctttccctcgctgccaccgcccgcaccttggaatacatttgcatcacaaagacgagtttcttgtttcgtaggatttagtgtcttcgttttcaggagagtcctggatggcttggtattaggagaatttctagttggtggtcggattagttgctttcatcccatggctgtgaatatggcaaacaaattttcgggtgtttaaactcagatgtaaggctgcttgatcttatccggtttccatggttgaagaaattgaaaggaactcaactttaagcttattaccaattttgtcgctccttgttct

SEQ ID NO: 36300 - DNA, 915 bp, Triticum aestivum
  Clone ID: PAT_TA_36300
agccattctccttggtgccgagactctccgtgggttgtatccagttgagactatttcaacagtgggcagaatttgtgctgaggctgagaaggtcttcaaccaagatttgtactttaagcgaactgtgaaatatgtgggagaacccatgacccacttggagtctattgcttcctctgcagtgcgggctgctattaaagttaaggcttcggtcatcatttgcttcacctcatctggacgggctgcaaggctaattgccaagtacaggcccaccatgcctgtcctctctgttgtcattcctcgtctgaaaacaaatcaattgaagtggagcttcacaggtgcatttgaggcaagacaatcactcatagttagaggtctctttcccatgcttgccgatccacgtcatccggctgaatctactagcactacaaatgaatcagtgttgaaggttgctcttgaccacggcaaagcatctggtgtgatcaagtcgcatgaccgcgtcgtcgtgtgccagaaagtgggagattcctctgtcgtgaagatcattgagctggacgactaggcaaaattagcctttgctcagggcttgccagatttttgactaggccaaaacgttgcttggtggctatgtataattctatctatagttttgcaaaacgagcagtttttcctatggtgtcatcataggatccgcggttaccattctaaaacctacgctagttattatggatatgtcctcagattttactgcagtgtagcgagtaaattatctgatggaataatgatatcaaaactttgtgacccttgctattgttgtcgctaagcctatgttcccatttacagatcctgaggttttaggatgttatcatcttatgactgtcagttggagaattctggtatatagatttttttttgcgg

SEQ ID NO: 36301 - DNA, 855 bp, Triticum aestivum
  Clone ID: PAT_TA_36301
tttgttatttaatttttttttcttttacaaaatgtgaacacgaaataatcggcagaatgtcctgcaccacgctcacaaaaggaggttagagtagggtattcattagcaacttgtagctgcatgcaagcaatggtccaagcaaactaacgcaaccacgcaattggtttacagtagtagcacaacacaatgggcagacatagcccacacatgttacggtaacataacattgtcacagcagttcagtgctaagcattgcatatagctactagggcaaggttttgttgcagcacagagccttccattcaaacagtctaccagctttagtccccgccaacctgacgcttccacgagtcctccacaatgagctcgtcgactccccagtcctcgtagcttccatcaggtaagtaccgcctaatcgtgaaggggatcttgcgtgctctcagttctttcatggcaatctcaagaggatcagtttcgccctcaagctcaaccataactggggcattcatgcttatctgcaaagcacgtgtgccaaggatgcgtgcccgctcatacttggtcatatattttgttgtattgcgtggacgggcagtcttttcctgttccttttcttcaccctcaccccctaccacatcatcaggggcatcctcattgttctcaggatcttcttcaaccccttcctcaatatcagcttctggaggctcatcctcataccccatgtcaacttcattgtaatcgtcgtccgccatggctgccgccgccgagcgctccggtcgctagggtttcggcgcgggaggaagcctcgggcgtggggattatggtggggttcccggcccaggccggcctcgagccggc

SEQ ID NO: 36302 - DNA, 1237 bp, Triticum aestivum
  Clone ID: PAT_TA_36302
tttttttttttttttttttagataacttgctgtcgctggacatcgcgatttattatttggtatcgacagagtacagcattacgagtcattacagtagacacgagcacaatacattacagtagacacgagcaagtatgccactactcgcggacgtggctcccaaggcgcacggtgatcccgtcacagtccctgatgtagccgaccttctgcccccagttcttctgctccggcgcgctcaccggcaccgccccgttctccacggcccgccggtacgcagcgtcgacgtcgtcgtagtcgaagcagatctccacgggccctcgctcacggggcgacttgggcagctgcacctcgcccatgagcgcgtccgtctccctctggtgccgcggcgtgaacgcgatggtcgtcgagccggtgtccagctccgcccacttgtgcgagtcgtcgacccggcggacgctgtagttgaaggccttggcgtagaaggcggccgacttgcccacatcttcgacgtaacacacgatgtacgcgagcttaggtctcaccgccccagacgccatggctcgtcccttccgtgcgtacgggtgctactgctaaccactttgagatggctcggtgtttgccttgagctgttgtgtcttctgtatcgacagagtacagcattacgagtcattacagtagacacgagcacaatacattacagtagacacgagcaaggatgccactactcgcggacgtggctcccaaggcgcacggtgatcccgtcacagtccctgacgtagccgaccttctgcccccagtttttctgctccggcgcgctcaccggcaccgcccccgttctccacggcccgccggtacgcggcgtcgaccgtcgtcgtagtcgaagcagatctccacgggccctcgctcgcggggcgacttgggcagctgcacctcgcccgtgagtgcgtccgtctccctctggtgcagcggcgtgaacgcgatggtcgtcgagccggtgtccagctccgcccacttgtgagagtcgtcaacgcggcggacgctgtagccgaaggcgtcggcgtagaaggcggccgacttgggcacgtctttgacgtaacacacgatgtacgcgagcttaggtctcaccgccccagacgccatggctcgtcccttccgtgggtacgggtgctactgctaaccactttgagatggctcggtgtttgccttaagccgtgttgcgtcttccttggctctctcc

SEQ ID NO: 36303 - DNA, 1104 bp, Triticum aestivum
  Clone ID: PAT_TA_36303
tcgagcggccgcccgggcaggtactggagctggaacaaggactcggcgtcgttcgagaaccagctctcacaggaggccagcgaccccgagaaggcccgcaaggtgtgggagctcagcgagaagctcgtcggactcgcctgatctcccaccaacctccggctccggccacgtccgggcatgcatctaggatgggacgccgatgctgaacttgtcgcatttttaacgttggtaattatcattttcacgcctttttagaaactcaattacgcgggagaggccttgcgagtgtcggcgagagtgcgtagatctcgtgtggaagatgtgcgcgttccgtctcccagtagcggctcccgtcgttcccctcctcggttgctgagatggccggtcgtgggaaggcaatcggcgccggcgcggccaagaaggcgacgtcccggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacccgtatcgtgccgcgccacatccagctcgccgtgcgcaatgacgaggagctgaccaagttgctcggcggcgccaccatcgccagcggcggtgtgatgcccaacatccaccagcacctcctccccaagaaggcctcttcctccaaggcgtccaccgtcgatgacgacgacaactgaggccctgtcctttccctcgctgccaccgcccgcaccatggattacatttgcatcacaaagacgaaggagtttcttgtttcgtaggatttagtgtcttggttttcaggagagtcccggatggtatggtattagaagaatttctagttggtggtcggattggttgctttcatcccatggctgtgaatatggcaaacaaattttcgggtgttcaaactcagatgtaaggctgcttgatcttgtccggtttccatggttgaagaaattgaaaggaactcaactttaagctattaccaaaaaaaaaaaaaaaaaaaaaaaaaaa

SEQ ID NO: 36304 - DNA, 874 bp, Triticum aestivum
  Clone ID: PAT_TA_36304
aggaattcggcacgagggtccgccccccgtacagcgaacccgcacccctctcgctctccgctccatctggtccgattcgattcgattcgatctcggcttcctctccaagccacgcgagaccagccatggcggcgacgatccagtccgtgaaggcccgccagatcttcgacagccgcggcaaccccaccgtcgaggttgatgtgtgctgctcagatggaaccttcgccagggccgccgttcccagcggtgcatcaactggtgtctatgaagctttggagctgagggacggtggatctgactacttgggcaagggtgtttccaaggctgttaacaatgtgaactccattattgcacccgctttggtcggcaaggaccctaccgctcaaactgagctcgacaactttatggttcagcagcttgatggaaccaagaatgagtggggttggtgcaagcaaaagcttgggtgctaatgcaatcctggctgtatcactagctgtttgcaaagctggagccagcgtcaagaagattccactgtaccagcacattgccaaccttgctggcaacaagcaattggttttgcccgttcctgcgttcaatgtcatcaatggtggatcccatgctggaaacaagcttgctatgcaggagttcatgatccttcctactggagctacctcattcaaggaggcaatgaagatgggcgttgaagtgtaccaacaacttgaagtctgttattaaagaagaagtacgggcaggatgccaccaatgttcgaaaatgaagtggttttgcttcttaaccttcgggagaccaaggagggccttgaactcttgaacacctgaatggaaaaggtggatccaacggcaaggttgtctttgg

SEQ ID NO: 36305 - DNA, 919 bp, Triticum aestivum
  Clone ID: PAT_TA_36305
gccggccggtccgaactccttcgccgccgccacccacgttcaccaccggagccggaggaagagaggaagggagaagccaacaacaggtaacgatggtgtctggctccggtgtgtccgcgcgtcgcgtggtggtggatgcgcgccaccacatgctgggtcgccttgcgtcgatcgtggccaaggagctgctcaacgggcagcgcgtggtggtggtccggtgcgaggagatgtgcatctccggcgggctggtccgtcagaagatgaagtacctccgcttcctccgcaagcggatgaacaccaagccctcgcacggccccatccacttccgcgctccctcgcgcattttctggcgcaccgtgcgcggcatgatcccgcacaagacgccccgcggcgaggccgcactcgccaggctcaaggctttcgagggcgtcccgccgccttacgatcgcaccaagcgtatggtcattcccgacgcgctaaaggttctgaggctgcagccggggcacaggttctgtctgctcggcgagctttccaaggaggtcggatggaactaccatgaaactatcaaggaactggaggagaagaggaaggagaaggcaaaggtgtcgtatgacaggaggaagcaactggccaagctgcgcttcaaggctgagaaggctgccgaggagaagctgggttctcagttggatatcctggcaccaatcaaatactagtgtgccgcccagtcatgcatggtctgttttgctggataatggtggttattgcttacgttagtagcctgagagtgtcgttgagatttgaaacctctgagtatctatactattccaatctttgtagcaaatggattgtttggtattgttgttttcgccccatgagatttcaaagatgtgttttctcccatcaaaaaaaaaaaaaaaaa

SEQ ID NO: 36306 - DNA, 907 bp, Triticum aestivum
  Clone ID: PAT_TA_36306
gctcgaacttaaccctcactaaagggaacaaaagctggagctccaccgcggtggcggccgctctagaactagtggatcccccgggctgcaggaattcggcacgaggccgccgccgtcgcccgcgaagaagcccctgccaccggagatctcccgacctctcccctcgccgcccgcccggagatctcccggcctctccctccgccatcatgggtaagacacgtggtatgggagccgggcgcaagctcaagacccaccgcaggaaccagaggtgggctgacaaggcatacaagaagagccacttgggcaatgagtggaagaaacccttcgctggatcgtctcacgccaagggcattgttttggagaagatcggtattgaggccaagcagcctaactctgccatccgtaagtgtgctcgtgtccagctggtgaagaacgggaagaagatcgctgcctttgtgcccaatgatggttgcctgaacttcatcgaggaaaacgacgaggtgctgattgctggattcggtcgtaagggtcatgctgtgggagatattcctggtgtcaggttcaaggttgtcaaggtatctggtgtgtcgctgctcgctctcttcaaggagaagaaagagaagcccagatcttagattgcagttttgataggcaaggatggaatggactgtaaggctctggtcgtttggggaggaaagttgcctgctatgtttacaaagtcctatataacctgaagttgtactagcgagatttgttccttctctgctgctgctttctcttaacagttgctattaagagtattgtttccatgatctggatatatattattgcttgttaccctgctggctagttggatgtttgtttagaaaccttctcataatttgcagtagtaggtactaaaagaaat

SEQ ID NO: 36307 - DNA, 1212 bp, Triticum aestivum
  Clone ID: PAT_TA_36307
aaggtttgaacggtcgcttgtatttatctgttcccaaaaacttctcacagatccaaccctagcactctggttgatctattcaagtcatctactagtaaacaattgatccattactactacaaaacaatctctaaggctacactgagatagaaatgcgaacactgaataatcagcagaacgtcctgcaccacgctcacaaaaggaggttagagtagggtattcattcgcaacttgtagctgcatgcaagcaatggtccaagcaaactaacgcaaccacgcaattggtttacagtagtagcacaacacaatgggcagacatagcccacacatgttacggtaacataacattgtcgcggcagttcagtgccaaagattgcatatagctactagggcaaagtttagttgcagcacggagcctcccattcgaacagtctaccagctctagtccccgccaacctgacgcttccacgagtcctccacaatgagctcgtcaactccccagtcctcgtagcttccatcaggtaagtagcgcctaatcgtgaaggggatcttacgtgctctcagttctttcatggcaatctcaagaggatcagtttcaccctcaagctcaaccataactggggcattcatgcttatctgcaaagcacgtgtgccaaggatgcgtgcccgctcatacttggtcatatattttgttgtattgcgtggacgggcagtcttttcctgttccttttcttcaccttcaccccctaccacgtcatcaggggcatcctcgttgttctcaggatcttcttcaaccccttcctcaatatcagcctctggaggctcatcctcgtaccccatgtcaacttcattatagtcgtcgtccgccatggctgccgccgccgagcgctccggtcgctagggtttcgccgcgggaggaagcctcgggcgtggggattgtggctcgtgccgaattcggcacgaggacgttctctgcatcatagggggaaaagactctggtgatactaatgggagatgttttatgtattgggggtgcaaagccggtgttgatagtggtccaatatgtttgactgtgtcgttagaaagtattgtaggtgtatcatttagttagatgtgtcttcaaagttgatctgattcgttacatggttgggatcattcgacttttgcattcaggcattgttccatttgaattgattgcggatatggaatttt

SEQ ID NO: 36308 - DNA, 1057 bp, Triticum aestivum
  Clone ID: PAT_TA_36308
tcccccgggctgaggaattcggacgaggccattcccctcacggccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcacagatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccacgctctccgtcggcaacgtcctcccgctccgctccgtgcctgagggaggcgtcatctgcaacgtcgagcaccacgtcggcgaccgtggtgtcttcgccagggcctccggtgactacgccatcgtcatcagccacaaccccgacaacggcacctcaaggatcaagctcccctccggcgccaagaagatcgtcccaagcagctgccgtgccatgattggtcaggttgctggtggtggcaggactgagaagccaatgctgaaggctggtaacgcctaccacaagtaccgcgtgaagaggaactcctggcctaaggtgcgtggtgtggccatgaaccctgttgagcatccccacggaggaggtaaccaccagcatattggtcacgcctccactgtccgccgtgatgcaccacctggccagaaggttggtctcatcgctgccaggaggactggtcgtctcagaggccaggccgccgcctctgctgccaaggccgacaaggccacttagagttatcgttgctgtttatctatgtttgctagctctagattacccgtcaaggacatgtattgcagtaaggatgttgtttttgctcggtactttggtaacctggtgatatttcttatcagtttttgctgtcgtggtctggattcttcagtccacataaggaagattattatgcttggatatttgtatgtcgattttct

SEQ ID NO: 36309 - DNA, 1759 bp, Triticum aestivum
  Clone ID: PAT_TA_36309
gatccccgctccgctaaacctcgcaacaacccccgtgggcgaccaaccagccgtccccctcaccattcaccaaccccgccgagagtcggaagcagagccgcgatcgatggccggcaccgtgcccaagctcgccgccccgaggccggcggccgcggggccgctcccctcgcagcccctccgctccgccgcgctcgcctccgccccctccgcccgccgcttccgcgtctccctcgccgcccgcgccaggagccccgtcattgcgatggcttccgccaaggaggggaacggcgccgtgacgaaagaggaccacgctccatgacctctatgagcaacagggtcagtccccgtggtacgacaacctctgccgggtctgtcaccgatttgctgccctacatcgccaacggtgtccgttggagtcaccagcaacccaacgattttccagaaagccatctcttcatcaaacgcgtatgacggtcagttcaaggagcttatatcggctgggaaggatgcagagagcgcttactgggaactcgtcataaaggacatccaagacgcgtgcaaactgtttgagcccatctacgacgagaccgatggggctgatggttacgtttcagtggaggtgtctcctaggctggcaaatgacacccaaggaaccgtcgaagctgcgaagtggttacacaaagtggtcaaccgccccaatgtgtacatcaagatcccagctactgcagaatgcgttccttctatcaaggaagtcattgctaatggcatcagcgtcaatgtcactcttatcttctccgttgcaagatacgaggctgtgattgatgcttaccttgacgggcttgaggcttctggtttgagtgacttatcccgagtgaccagtgtagcatccttctttgtcagccgagttgacagtctgatcgacaaaatgcttgagaagattggaacacctgaggctcttgccctgaggggaaaggctgctgtagcacaagcaaagatagcaaaccagctttacctcaagaaattctctggcccaaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgctaacgtgtcagaagctgagggcatatacagtgccctggagaagctgggcatcgactgggaagaggttggcaagcagctggagcacgagggtgtgagctccttcaaggggagcttcgacagtctgctcacgagcttggaggagaagggcaacgccctcaagaccgctgccaacctgtaggcgctaaaattatcggatataatggtttggtaccggcgctggccatcaaacgagacccaataaaaatgccagcttgctggctctctccttccatttggaaatgaaatgctaccagttttctggttgagcttctcctgtattctaggtgcacctggctgtcattgtgtaactgaggcttgttgcttgcaactgctattcgttttctgatcaattgtttttgagcaagtgagccatatttgtgtatctttgggaaatgcatttctccttgctgttgttattcgtactttctacaagattatgagaattttggcaacttagctcagtaatgttttggaaaaaaaaaaaaaaaaaaaa

SEQ ID NO: 36310 - DNA, 1634 bp, Triticum aestivum
  Clone ID: PAT_TA_36310
cccactgctgctgctattgcctatggtttggacaagaggggtggcgagaagaacatcctggtgtttgacctgggtggtggtacttttgatgtcagtatcttgaccattgacaatggcgtctttgaggtgttggccaccaacggtgacacccatcttggaggtgaggactttgaccacagaatcatggattacttcatcaagttgatcaagaagaagcacggcaaggacatcagcaaggacaaccgtgctcttggaaagctgaggagggaagctgagcgtgccaagagagccctcagcaaccagcaccaggtccgcgttgagatcgagtccctctttgacgggactgatttctcggagccactgacccgtgcgaggttcgaggagctgaacaacgatctgttccgcaagaccatgggaccagtgaagaaggccatggatgatgctggtctcgagaagacccagatccatgagattgttcttgttggtggcagcaccaggattcccaaggtccagcagctcctcagggactactttgacggcaaggagccaaacaagggtgtgaaccctgatgaggctgttgccttcggagctgcagtgcagggaagcatcttgagcggcgagggcggtgacgagaccaaggatatcctcctcctcgatgtggcgcccctcaccctcggaattgagactgttggaggagtcatgaccaagctgatccccaggaacacagttatccccaccaagaagtcgcaggttttcaccacctaccaggaccagcagaccaccgtctctatccaggtctttgagggtgagcgcagcatgactaaggactgccgtcttctcggcaagtttgacctttctggcattcccccagctccaaggggcactcctcagatcgaagtcacctttgaggttgacgccaacggtatcctgaacgtgaaggccgaggacaagggcacgggcaagtcggagaagatcaccatcaccaacgagaagggccgcctgagccaggaggagatcgaccggatggtcaaggaggcggaggagttcgccgaggaggacaagaaggtgaaggagcgcatcgacgcccggaaccagctcgagacctatgtctacaacatgaagaacaccgtcggcgacaaggacaagctggcagacaagctggagagcgaggagaaggagaaggtggaggaggccctcaaggaggcgctcgagtggctggatgagaaccagacggccgagaaggaggactacgaggagaagctcaaggaggtggaggccgtgtgcaaccccatcgtgtcggcggtgtaccagaggtccggcggagctcccggcggcgagggcgccgacggcggcgtcgacgacgaggaccatgatgagctgtagatggtttaaaaggggaaccaatttttgtaatgggttagtaggggggaggagacatggataattggtgctctacttactttgtgttgtggtcgggggtggtcgggtttgttcgcggagactgctgttattagtctgttggccgagttgtagagaactctctttgctgctgctgctgttacttccttctgatgttttttcgttttgttattatatagccggatgaagaaaagatgatgcagttttatcaaaaa

SEQ ID NO: 36311 - DNA, 915 bp, Triticum aestivum
  Clone ID: PAT_TA_36311
taccggtccggaatttccgggtcgacccacgcgtccggccacgaccaccaccggagccggaggaagagaggaagggagaagccaacaggtaacgatggtgtccggctccggtgtgtccgcgcgtcgcgtggtggtggatgcgcgccaccacatgctgggtcgccttgcgtcgatcgtggccaaggagctgctcaacgggcagcgcgtagtggttgtccggtgcgaggagatgtgcatctccggcggactggtccgtcagaagatgaagtacctccgcttcctccgcaagcggatgaacaccaagccctcgcacggccccatccacttccgcgccccctcgcgcattttctggcgcaccgtgcgcggcatgatcccgcacaagacgccccgcggcgaggccgcgctcgccaggctcaaggctttcgagggcgtcccgccgccttacgatcgcaccaagcgtatggtcatccccgacgcgctcaaggttctgaggctgcagccggggcacaggttctgtctgctcggcgagctttccaaggaggtcggatggaactaccatgaaactatcaaggaactggaggagaagaggaaggagaaggccaagctgtcgtacgacaggaagaagcaactggccaagctgcgcatcaaggctgagaatgctgccgaggagaagctgggttctcagttggacatcctggcaccaatcaaatactagtgtgccgcgcagtcatgcatcatctgttttgctggataatggtggttattgtttacgttagtagcctgagagtgtcgttgagatttgaaacctctgagtatctatactattccaatctttgtagcaaatggattgtttggtattgttgttttcgccccatgagatttcaaagatgttgctgttttctccaaaacaaaaaa

SEQ ID NO: 36312 - DNA, 1976 bp, Triticum aestivum
  unsure (1)..(1976): unsure at all n locations
  Clone ID: PAT_TA_36312
gaaaaatgttaactctgtctcattcaactatcagcagaacatacaagatagccgaccaacccagagaagggaaataagaactgaaatacttatttactcataaaacataaaatagttataagatgtacatctcatgtgagggcataagttgaagtacattggggaatggcacatgtttacattggcagacacataaaaaggtcctttgacaacatactcgccgcactgtactgttctcaacccattagcttcagataagttcaattttctgctctgccacccaagattcttttggacccagttgtactgtttcaatctttgcattttcaacacaaacaaaatctttgtagcatgcctccatctgcaaatgaggattccacaacactgcatctgaccagtttgtgtttgagattacaattttgtcacccaatccattgtcgagggtaagctcactcggtgcgccaaggtaaacacagtccacaaatcctggaaaggtcacctcgtccctttcttctttgccctccagaggatttttagggtcaggatccttattgagagtcttgctacctttgagacctttcactgaaacaccagcaatggaagcactgaaataagtgtggagggctgaggtgaatgagaaaggtttatcgtctgtatttattattttgagggtcgttgacaggcttgtagagtgcagcacaaccttgtataaagcttggaaactaaaatcccacattgaacggctgtatgagtcgtcttttagttccaaagttacagttggatctccttctgtgacttctgaatcagtaatagaccaattcacattccttgcgaatccatgctgctgcatggggccagggccaaactggggaaaacaatgtggaattccaccgctgatgggtttctggccgttgaacacagcatctggtctgacaaagagcagatcctttccattgggaaccttccaagacgtgacgcatgctccaaacagataaatctcagcctcactcccgtgcggggatttgaggctgatcttgggcaggccgccgttgccctcggagacggccacgccgggagcgtacaccttctgccccgcgctcgccatggcaaccaccccgaatcgcctgtagcgacgggctgaagtggaggaggaggaggaggcggcggcgaagggggcggggacggtgagcgtgcaggaagccgccatttctgcttgggtgccgaattcggcacgagctcgtgccgaattcggcacgagtccccatctccttaggttaggttaggctaggggcttcacagagctcgcggaaatggtggccttcaggttccatcagtaccaggtggtgggtcgtgcgctgccgacgcccggcgatgagcagccgaagatctaccgcatgaagctctggggccaccaatgaggtccgcgccaagagcaagttctggtatttcctgaggaagctgaagaaggtgaagaaagagcaacggccaagatgctccccatcaacgagatctttgagaagaacccaaccacaacatgtacaaggagtaccgtgacaccacactaaatggtgccgtggagcagatgtacactgagatggcctctcgccaccgtgtgagatccccctgcattcagatcatcaagaccgcgactgtcaacttcaagctatgcaagagagacaacaccaagcagttccacaactccaagatcaagttcccccttgtgtaccaaaaggtcaggccaccaaccaggaagctgaagaccacctacaaggcaacgaggccgaacttgttcatgtgattggccctgtggtggatgctgttaagagttgaaatgttttcttcgtatgttggatcttgctgatgcatgaagacaagcgttttgttgcttatttatcggttaaagacatggttggtggaccttcgattgtgttcttatcagtaatctgcatacaatctatggtaccnatatagatatc

SEQ ID NO: 36313 - DNA, 2079 bp, Triticum aestivum
  Clone ID: PAT_TA_36313
aggaattcggcacgagggcatcgcactaggtctcggtcattcctctctctctctcccttgcttggggaagaagaagaagaagaagagagggcaagcgcccccgcctcccgacgccgtcgtccctcgccgccgatctgatctcaggagccagcgaagatgcattccaccaatctgctcctcgaggagcccatccggatggtctccatcctcgagccatccaagccgaacttcttcccggcgatgacgaagatcgtggggacgctgggtcccaagtcccggtccgttgaggccatctccgcctgtctaaaggccggcatgtctgtggcccgtttcgatttctcgtggggggatgccgcgtaccaccaggagacactcgagaacctcaagctcgccatcaaggccaccaagaagctatgtgctgttatgctcgacactgttggccctgagttgcaagtggtgaacaagagtgaagtcacaatctcgcttgaagagaacgagtctgttgttctcacccctcaccagggccaggaggcctcttccaagttgctccctatcaacttcgctggactcgccaaggctgtgaagcccggagccacaatattcgttgggcaatatttgttcacgggcagtgagactacatcagtttggctggaggtttctgaagttcaaggggatgacgtggtttgcgtgatcaagaactcagctaccctggctgggtcactcttcacattgcactgctcccagatccatatcgacatgcccacgctgtctgatgaggataaagatgttatgaaaaaatggggtgctccaaacaagattgacttcctctctctttcttatacaaggcatgcagaagatgtgcggcaagcacgggagttcctctctaagttaggtgatcttagccaaactctgatttttgccaaaattgagaatgtggagggcttgaaccattttgatgagatcctggaggaagcggatggtatcattctgtcaagagggaaccttggaattgatcttccacctgaaaaggtgttcttatttcagaagtctgctctgcacaagtgcaacatggctggaaagcctgctgttgttactcgtgttgtggacagtatgacggacaacctaaggcctactcgtgcggaggcaactgatgtggcaaatgcggtgctggacggtagtgatgccattctccttggtgctgagactctccgtgggttgtatccagtcgagactatttcaacagtgggcagaatttgtgctgaggctgagaaggtcttcaaccaagatttgtatttcaagcgaaccgtgaaatatgtgggagaacccatgacccacttggagtctattgcttcctctgcagtgcgggctgctattaaagttaaggcttcggtcatcatttgcttcacttcatctggacgggctgcaaggctaattgccaagtacaggcccaccatgcctgtcctgtccgttgtcattcctcgtctgaaaacaaatcaattgaagtggagcttcacaggtgcatttgaggcaagacaatcactcatagttagaggcctctttcccatgcttgctgatccacgtcatccggctgaatctactagcactacaaatgaatcagtgttgaaggttgctcttgaccacggcaaagcatctggtgtgatcaagtcgcatgaccgtgtcgtcgtgtgccagaaagtgggagattcctctgtcgtgaagatcattgagctagacgactaggcaaaattagcctttgctcagggcttgccagatttttgactaggccaaaacgttgcttggtggctatgtataattctatctatagttttgcaaaacgagcagtttttcctatggtgtcatcataggatccgcggttatcattctgaaacctacgctagttattatggatatgtcctcagattttactgcagtgtagcgagtaaatgatctgatggaataatgatatcaaaactttgtgacccttattgttgtcgctaagcctatgtccccattcacagatttgggtgtgctcctgaggttttaggatgtctcttctcctcttatcactctcagttggag

SEQ ID NO: 36314 - DNA, 784 bp, Triticum aestivum
  Clone ID: PAT_TA_36314
aaccctacccgccgccgccgccccctccgcatcttcgtcctgcaagcagcgccgccgccttccaccggctcgagctccagccttcccttcaaccatggcggacgtcgatgtcgatcccgaggtggcggccgccggtcccaagaagaggacgttccgcaagttcagctaccgtggcgtggacctcgacgctctcctggacatgtccaccgaggacctcgtccagctcttccccgcgcgcccccgcagaaggttctcgaggggtctgaagaggaagccgatggcgctcgtcaagaagctgcgcaaggcgaaaagcgaagctcctgctggtgagaagcctgagcaagtgaggacccacctccgcaacatgatcatcatgcctgagatgatcggaagcgtcgtgggcatctacaatggcaagtgcttcaaccaggtggagatcaagccggagatgatcgggcactacctggcagagttctccctgtcgtacaagccggtgaagcacgggaggcctggtatcggtgctacccactcatcgaggttcattcctctcaagtgagaatatggtcagggaaattgtctgtggtgtctggaatccagtgttcttatcgtagtcaaatgtagtgcctgatataccgactgtcagtctagtggtggagcagcaccctttgaaccctgaacttaatcctgttccagattttgaagttatcgtaaggaagatcaaacatgtttatctccaaaaaaaaaaaaaaaaaaaaaaaaaaaaaaaaaaaaaaaagggcggccg

SEQ ID NO: 36315 - DNA, 890 bp, Triticum aestivum
  Clone ID: PAT_TA_36315
gccgccgccacccacgaccaccaccggagccggaggaagagaggaagggagaagccaacaggtaacgatggtgtccggctccggtgtgtccgcgcgtcgcgtggtggtggatgcgcgccaccacatgctgggtcgccttgcgtcgatcgtggccaaggagctgctcaacgggcagcgcgtggtggtggtccggtgcgaggagatgtgcatctccggcgggctggtccgtcagaagatgaagtacctccgcttcctccgcaagcggatgaacaccaagccctcgcacggccccatccacttccgcgccccctcgcgcattttctggcgcaccgtgcgcggcatgatcccgcacaagacgccccgcggcgaggctgcgctcgccaggctcaaggcgttcgagggcgtcccgccgccttacgatcgcaccaagcgtatggtcatccccgacgcgctcaaggttctgaggctgcagccggggcacaggtactgtctgctcggcgagctttccaaggaggtcggatggaactaccatgaaactatcaaggaactggaggagaagagaaaggagaaggctaaggtgtcgtacgacaggaggaagcaactggccaagctgcgcgtcaaggctgagaaggctgccgaggagaagctgggttctcagttggacatcctggcaccaatcaaatactagtgtgccccgcagtcatgcatcgtctgttttgctggataatggtggttattgtttacgttattagtagcctgagagtgtcgttgagatttgaaacctctgaatatctatactcttccaatctttgtagcaaatggattgtttggtattgttgttttcgccccatgagatttcctagatgttgctgttttctccaaaaaaaaaa

SEQ ID NO: 36316 - DNA, 978 bp, Triticum aestivum
  unsure (1)..(978): unsure at all n locations
  Clone ID: PAT_TA_36316
agccagaggaaactcttgtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatggcgcggctgcttcggtgagccgtgccatgaaatcgggtgctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgccatgccccgatgagtaggagggcgcggcggccgctgcaaaacccggggcgcgagcccgggcggagcggccgtccggtgcagatcttggtggtagtagcaaatattcaaatgagaactttgaaggccgaagaggagaaaggttccatgtgaacggcacttgcacatgggtaagccgtctaaaggaacggggnaaaccggaaatacgcttaacccgcgtacccgaaaggaatcgggttaaattcccganccgggacgtggcggnaacgggacttangaatccggagacccggngggggctccggaaaatttctttcgctaaaggccgcaacctggaancgttaaccggnggaaggtcaacggccgaanacacgaaatncncgggtcgggcnccaagctgnaanaaaatttccnttaangcacatcgtccaagaggaatcttcncccgttannaacggccagg

SEQ ID NO: 36317 - DNA, 835 bp, Triticum aestivum
  Clone ID: PAT_TA_36317
atcttctcccctcctcactcctctagcagccgccgccgccgtcgcccgcgaagaagccgctgccaccggagatctccagacctctccctccgtcgcccgcccggagatctcccggcctctccctccgccatcatgggtaagacacgtggtatgggagccgggcgcaagctcaagacccaccgcaggaaccagaggtgggctgacaaggcatacaagaagagccacttgggcaatgagtggaagaaaccctttgctggatcgtctcacgccaagggcattgtcctggagaagattggtattgaggccaagcagcctaactctgccatccgtaagtgtgctcgtgtccagctggtgaagaacgggaagaagatcgctgcctttgtgcccaatgatggttgcctgaacttcatcgaggagaacgacgaggtgctgattgctggattcggtcgtaagggtcatgccgtgggagatattcccggtgtcaggttcaaggttgtcaaggtatctggtgtgtcgcttctcgctctcttcaaggagaagaaggagaagcccaggtcttaggttgcatttttgttaggcaaggatggaatggactgtaaggctctggtcgtttgaggaggaaagttgcctgctatgtttacaatgtcctatataacctgaagttgtactagcgagatttgttccttctctgctgttgctttctcttaacagttgctattaagagtattgtttccatgatctggatatatattgttgctgtgttactctgctggctagtgggttttatctcatgtgctatgattgtctgtgttatgttgttgatgtttgtttaaaa

SEQ ID NO: 36318 - DNA, 920 bp, Triticum aestivum
  Clone ID: PAT_TA_36318
cggcacgagcctgccctccccatctgcttaggttaggttaggctaggggcttcgcagagctcgcggaaatggtggccttcagggtaagttccagtgctgcctcccggccgttgctatccttgacccctccgtgtccgcgctttatccgtgtttttgattcgtctcgatgcgtccgtgcgtgtgcagttccatcagtaccaggtggtgggtcgcgcgctgccgacgcccggcgatgagcagcctaagatctaccgcatgaagctctgggccaccaatgaggtgcgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcagaaccggctaccacaacatgtacaaggagtaccgtgacaccacactgaatggtgccgtggagcagatgtacactgagatggcctctcgccaccgtgtgagatccccctgcattcagatcatcaagaccgcgactgtcaacttcaagctatgcaagagagacaacaccaagcagttccacaactccaagatcaagttcccccttgtgtaccaaaaggtcaggccaccaaccaggaagctgaagaccacctacaaggcgacgaggccgaacctgttcatgtgattgggctgtggtggatgctggtatttttgttgggcagaagcacaaaagttgaaatgttctcttagtatgttggatcttctaatgcatgaagactagtgttttgttgcttatttatcatttaaagacatggtcggtgaaccttgtgattgtgttcttatcagtaatctgcatacaatctattggtatctgatatagatctgtttggaggcggt

SEQ ID NO: 36319 - DNA, 753 bp, Triticum aestivum
  Clone ID: PAT_TA_36319
attcggcacgaggcgcagcttcccattcctcgccgccgccgccgctccgtacccgctcgaagccgacccgaccatggcggacgtcgacgttgacacggaggtggccgcgggcgcgcagccgaagaagaggacgttccgcaagttcagctaccgtggcgtggatctcgatgccctcctcgacatgtccactgacgaccttgtccagatgttccccgctcgcgcccgcagaaggttcaagaggggtctcaagaggaagcccatggcgctcgtcaagaagctgcgcaaggcgaaaaaggatgctcctgctggtgagaagcctgagccagtgaggacacatctccgcaacatgatcattgtccctgagatgattggcagccttatcggtgtctacaatggcaagaccttcaaccaggttgagattaagcctgagatgattggccattaccttgcagagttctctatctcctacaagccagtgaagcacggtaggcccggtatcggtgccacacactcttcccggttcatccctcttaaatgagttgtgccgctttctactttgaaagaaatcagtacggaccatctgatggcatgtccatcgagctgtctcccttgttttgaaccagttatatatctagtatttggttctgtttagctatataatttcgttatgcacaatgagctgttctatctaaatgctgtgagaatcttatttccgttgtgaaggttgaaaaaaaaaaaaaaaaaaggccccta

SEQ ID NO: 36320 - DNA, 1126 bp, Triticum aestivum
  Clone ID: PAT_TA_36320
catccattcccctcgccgccgccgccactccgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgagccaccctctccgtcggcaacgtcctcccgctccgctccgtccctgagggaggcgtcatctgcaacgtcgagcaccacgtcggcgaccgtggtgtcttcgccagggcctccggtgactacgccatcgtcatcagccacaaccccgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgtgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcattgctgccaggaggactggtcgtctcagaggccaggctgctgcctctgctgccaaggccgacaaggccacttagagctatcgttgctgtttatctatgtttgctgcctctagattacccgtcaaggacatgtattgcagtatggatgtcgtttttgctcactttggtaacctggtgatgtttgttatcagttttcgctgtcgtggtctggattcttcggtccacataaagaagattatgcatggatatttgtttgtcgagttgcttgagttagcccctggcgcttatttttgtttactgttttagtttagctatattgctggatctctaaacgtagttttgttagagtcgaatcaaacagttgta

SEQ ID NO: 36321 - DNA, 2377 bp, Triticum aestivum
  Clone ID: PAT_TA_36321
gccgcagacgggatcgagacaaggccgagaggaggaggaggaaggctccgggaagctcgagaagaggcgcgtcgtcgtggcgatggatcggctccgcggctccgcgctgctgctcggcgtcctgctcgcaggatcactgtttgcactttgtgctgcgaaggaggaggccaagaagcttggtaccgtgatcggtattgatctgggtaccacatactcatgtgttggcgtgtacaagaacggtcatgttgagatcatcgccaatgaccagggtaaccgtatcacgccctcatgggttgggttcaccgatggggagaggctcatcggtgaggctgccaagaaccaggcggctgtcaaccctgagaggaccgtctttgacgtcaagcgtctcattgggagaaagtttgaggacaaggaggtccagagggacatgaaacttgtcccctacaagattgtgaacaaggaggggaagccttacattcaggtcaagatcaaggatggagagaccaaggtcttcagccctgaggagatcagtgctatgattcttggaaagatgaaggagactgctgaggcataccttggcaagaagatcaatgacgcccgtcgtcactgttcctgcgtacttcaatgatgcacagagacaggcgaccaaggatgctggagtgattgctgggcctcaatgtggctaggatcatcaatgagcccactgctgctgctattgcctatggtttggacaagaggggtggcgagaagaacatcctggtgtttgacctgggtggtgggtacttttgatgtcagtatcttgaccattgacaatggtgtctttgaggtgctggccaccaacggtgacacccatcttggaggtgaggactttgaccacagaatcatggattacttcatcaagttgatcaagaagaagcatggcaaggacatcagcaaggacaaccgtgctcttggaaagctgaggagggaagctgagcgtgccaagagagccctcagcaaccagcaccaggtccgcgttgagatcgagtccctctttgacgggactgatttctcggagccactgacccgtgccaggttcgaggagctgaacaacgatttgttccgcaagaccatgggacccgtgaagaaggccatggatgatgctggcctcgagaagacccagatccacgagattgttcttgttggaggcagcaccaggattcccaaggtccagcagctcctcagggactactttgacggcaaggagccaaacaagggtgtgaaccctgatgaggctgttgccttcggagctgcagtgcagggaagcatcttgagcggcgagggcggtgacgagaccaaggatatcctcctcctcgatgtggcgcccctcaccctcggtatcgagactgttggaggagtcatgaccaagctgatccccaggaacactgtcatccccaccaagaagtcgcaggttttcaccacctaccaggaccagcagaccaccgtctctatccaggtctttgagggggagcgcagcatgaccaaggactgccgtcttctcggcaagttcgacctttctggcattcccccagctccaaggggcactcctcagatcgaagtcaccttcgaggttgatgccaacggtatcctgaacgtgaaggcggaggacaagggcaccggcaagtctgagaagatcaccatcaccaacgagaagggccgcctgagccaggaggagatcgaccggatggtcaaggaggcggaggagtttgccgaggaggacaagaaggtgaaggagcgcatcgacgcccggaaccagcttgagacctatgtctacaacatgaagaacaccgtcggcgacaaggacaagctggcggacaagctggagagcgaggagaaggagaaggtggaggaggccctcaaggaggctttggagtggctggacgagaaccagacggccgagaaggaggactacgaggagaagctcaaggaggtggaggccgtgtgcaaccccatcgtgtcggccgtgtaccagaggtccggcggagctccgggcggcgagggcgccgacggcggcgtcgacgacgaggaccatgacgagctgtagatgggtttaaaggggaaccaatttttgtaatgggttagtagggagaggagacatggataattggtgctacttactttgtgttggggttgggggtggtcgggtttattcgcagacaccggagacttgctgttattagtctgttggccgagttgtagagaactctctttgctgctgctgttacttccttctgatgttttttcgttttgttattatatagccggatggattcgcatcggaactttatgtgaagaatagatgatgcagttttaaaaaaaaaaaaaaaaaacacctcgg

SEQ ID NO: 36322 - DNA, 800 bp, Triticum aestivum
  Clone ID: PAT_TA_36322
cccccgggctgaggaattcggacgaggcgccgtcgcccgcgaagcccctgccaccggagatctcccgacctctcccgtcgccgcccccccggagatctcccggcctctccctccgccatcatgggtaagacacgtggtatgggagccgggcgcaagctcaagacccaccgcaggaaccagaggtgggctgacaaggcgtacaagaagagccacttgggcaatgagtggaagaaaccctttgctggatcgtctcacgccaagggcattgtcttggagaagattggtattgaggccaagcagcctaactctgccatccgtaagtgtgctcgtgtccagctggtgaagaacgggaagaagatcgctgcctttgtgcccaatgatggttgcctgaacttcatcgaggaaaatgacgaggtactgattgctggattcggtcgtaagggtcatgccgtgggagatattcccggtgtcaggttcaaggttgtcaaggtatctggtgtgtcgcttctcgctctcttcaaggagaaaaaggagaagcccaggtcttagattgcatttttgttaggcaaggatggaatggactgtaaggctctggtcgtttgaggaggaaagttgcctgctatgtttacaatgtcctatataacctgaagttgtactagcgagatttgttccttctctgctgttgctttctcttaacagttgctattaagagtattgtttccatgatctggatatatattgttgcttttatctcaaaaaaaaaaaaaaaaaaaaaaaaaaaaaaaaaaaaaaaactcgag

SEQ ID NO: 36323 - DNA, 1792 bp, Triticum aestivum
  unsure (1)..(1792): unsure at all n locations
  Clone ID: PAT_TA_36323
gcacgagggatcggtgcgtgtgaggcagccccgctccgctaaacctcgcaacaacccccgtgggcgaccaacccagcccagccgcccccctctcctcaccaacccccgagccggaagcagagccgcgatggccggcaccgtgcccaagctcgccgctccgaggccggcggccgcggggccgctcccctcgcagcccctccgcgccgccgcgctcgccttcgccccctccgcccgacgcttccgcgtctccctcgccggccgcgccaggagccccgtcattgcgatggcttccgccaaggaagggaacggtgcggtgacgaagaggaccacgctccatgacctctatgagcaacagggtcagtccccgtggtacgacaacctttgccggcctgtcaccgatttgctgccctacatcgccaacggtgtccgtggagtcaccagcaacccaacgattttccagaaagccatctcttcatcaaacgcctatgacggtcagttcaaggagcttatatcagctgggaaggatgcggagagcgcttactgggaactcgtcataaaggacatccaagacgcgtgcaagctgtttgagcccatctacgacgagactgatggggctgatggttacgtttcagtggaggtgtctcctaggctggcaaatgacacccaaggaaccgtcgaagctgcgaagtggttacacaaagtggtcaaccgccccaatgtgtacataaagatcccagctacagcagaatgtgttccttctatcaaggaagtcattgctaatggcatcagcgtcaatgtcactcttatcttctctgttgcaagatacgaggctgtgattgatgcttacctcgacgggcttgaggcttctggtttgagcgacttatcccgagtaaccagtgtagcatccttctttgtcagccgagttgacagtctgatcgacaaaatgcttgagaagattggaacaccggaagctcttgccctgaggggaaaggctgccgtagcacaagcaaagatagcaaatcagctttacctgaagaaattctctggcccgaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgcgaacgtatcagaagccgagggcatatacagtgccctggagaagctgggcatcgactgggaagaggttggcaagcagctggagcacgagggcgtgagctccttcaaggggagcttcgacagcctgctcacgagcttggaggagaagggcaatgccctcaagaccgccgccaacctgtaggcgctaaaattgttggatagaatggtttggtaccggcgctggccatcaaacgattacccaataaaaatgccagcttgctggctctccccttccattcggaaatgaaatgctcccagttatctgggtgagcttctttgtattctaggcgtgcctggctgtcattgtgtaactgaggtttgttgctcgcaactgctatcgttttctgatcaattgtttttgagcaagtgagccatatttgtgtatctttgggaaatgcatttctccttactgttgttatctgtatgttcgcaagattacaggaatgttggcaactttagctcagtaatgtttggaatatatcagacccatgttcgttttcatnacggacac

SEQ ID NO: 36324 - DNA, 1202 bp, Triticum aestivum
  unsure (1)..(1202): unsure at all n locations
  Clone ID: PAT_TA_36324
ttcgttgctccaattaccctactaaagggaacaaaagctggagctccaccgcggtggcggccgctctagaactagtggatcccccgggctgcaggaattcggcaccagccacccccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaaggtctcctacgacaggagaaagcaactggccaagctccgcgtcaaggccgagaaggcagccgaggagaagttgggaactcagctggagatcctggctccgatcaaatactaagagatatcagagctttcgtgcgccatcagttttgggaaacctctgtcgtattttaagtagtttggtaactctgatagtacaatctggttggtaaacctttgttatgcatgcagttctgctaccctcatttgaaattttctacctggtgaactgttccgtttatcaaatgtgtgcatttggagattctagtgaatgtctatcaggtgattatatgttgctgaagcccgggttttttaatttagtacagcattagcagtccaaaaaaaaaaaaaaaaaactcgagggggggcccggtacccaattcgccctatagtgagtcgtattacaattcactggcccgcgttttacaacgtcgtgactgggaaaaccctgcgttacccaacttaatcgccttgcagcacatncccctttcgncagct

SEQ ID NO: 36325 - DNA, 1706 bp, Triticum aestivum
  Clone ID: PAT_TA_36325
tcggcacgagggagagatccgtcgtgcgtgtgaggcagccccgctaaacctcgcaacagcccccgtgggcgaccaacccagcccagccgcccccctcaccaaccccggagtcggaagcagagccgcgatggccggcaccgtgcccaagctcgccgccccgaggccggcggccgcggggccgctcccctcgcagtccctccgctccgccgcgctcgccttcgccccctccgcccgccgcttccgcgtctccctcgccgcccgcgccaggagccccttcattgcgatggcttccgccaaggaagggaacggcgccgtgacgaagaggaccacgctccatgacctctacgagcaacagggtcagtccccgtggtacgacaacctctgccggcctgtcaccgatttgctgccctacatcgccaacggtgtccgttggagtcaccagcaacccaacgattttccagaaagccatctcttcatcaaacgcgtatgacggtcagttcaaggagcttatatcagctgggaaggatgcggagagcgcttactgggaactcgtcataaaggatatccaagacgcgtgcaaactgtttgagcccatctatgacgagaccgatggagctgatggttacgtttcagtggaggtgtctcctaggttggcaaatgacacccaaggaaccgttgaagctgcgaagtggttacacaaagtggtcaaccgccccaatgtgtatatcaagatcccagctactgcagaatgcgttccttctatcaaggaagtcattgctaatggcatcagcgtcaatgttactcttatcttctccgttgcaagatacgaggctgtgattgatgcttacctcgacgggcttgaggcttctggtttgagcgacttgtcccgagtgaccagcgtggcatccttctttgtcagccgagttgacagtctgatcgacaaaatgcttgagaagattggaacaccggaggctcttgccctgaggggaaaggctgccgtagcacaagcaaagatagcaaaccagctttacctgaagaaattctctggcccgaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgctaacgtgtcagaagctgagggcatatacagtgccctggagaagctgggcatcgactgggaagaggttggcaagcagctggagcacgagggggtgagctccttcaaggggagcttcgacagcctgctcacgagcttggaggagaagggcaacgccctcaagactgccgccaacctgtaggcgctaaaattatcggatagaatggtttggtaccggcgctggccatcaaacgattaccgaataaaaatgccagcttgctggctctctccttccatttggaaatgaaatgctcccagttatctgggtgagcttgcttcttgtattctaggcgtgcctggctgtcattgtgtaactgaggcctgttgcttgcaactgctattcgttctctgatcaattgtttttgagcaagtgagccatatttgtgtatctttggcaaatgcatttctccttactgttgttatc

SEQ ID NO: 36326 - DNA, 887 bp, Triticum aestivum
  Clone ID: PAT_TA_36326
ctctctctctctctctctctctctctctctctctctctctctctctctctctctctctctctctctctctctctctcccagctcgcgctccctcgcccagctgccgccgccgccgcctcgtcggagttcttcctacccctttcgccaacatgggtaagacacgtggtatgggagctgggcgcaagctcaagacccaccgcaggaaccagaggtgggctgacaaggcatacaagaagagccacttgggtaacgagtggaagaaacccttcgccgggtcatctcacgccaagggcattgttttggagaagatcggtattgaggccaagcagcctaactctgccatccgtaagtgtgctcgtgtgcagcttgtgaagaacggaaagaagattgctgccttcgttcccaatgatggttgcctgaacttcatcgaggagaatgacgaggtgctgattgctggattcggtcgtaaggggcatgccgtgggagatattcccggtgtccggttcaaggtcgtcaaggtgtctggtgtgtctctgcttgccctcttcaaagagaagaaggagaagcccaggtcttagattgccgttgcatggagtagacagtatgtcggcctttagatgttgaaggaggagggtggttcctttgtgtttacagcacttttaagttgataacttatgatcgtgttggtgaaaactatgcctttgtcacattttgctcctgttaagggaaagtgctactgttgtgagttttgttccccagtttgagatgaatttcccttgtcctgaaattgccttgggcattggtggtgtatttagaatttggtgttgtttgtttcaggtgtagggaccggattcaagctgaatctgaaacaaacagtttttttgaat

SEQ ID NO: 36327 - DNA, 790 bp, Triticum aestivum
  Clone ID: PAT_TA_36327
atccctagccgccgccgccccctcctcttcgtcctgcaagcagcgccgccgccttccaccggcccgagctccagccttcccttcaaccatggctgacgttgatgtcgaccccgaggtggcggccgccggccccaagaagaggacgttccgcaagttcagctaccgcggcgtggacctcgacgctctcctcgacatgtccagcgaggacctcgtcggcctcttccctgcccgcgcccgcagaaggttctcgaggggtctgaagaggaagccgatggcgctcgtcaagaagctgcgcaaggcgaaaagcgaagcccctgctggtgagaagcctgagcaagtgaggacccacctccgcaacatgattatcatgcctgagatgatcggaagcgtcgtgggcatctacaatggcaagtgcttcaaccaggtggagatcaagccggagatgattgggcactacctggcagagttctccctgtcgtacaagccggtgaagcacgggaggcctggtatcggtgccacccactcgtcgaggttcattcctctcaagtgagaatatggtcaggaaaattgtctgagatgtctggaatccagtgttcttatcctagtcaaatgtagcacctgatataccgtctgtcagtctagtggtggagcagctccctttgaaccttgaactaatccagttccagattttgaagttatcatgaggaggatcgaacatgtttctctccttaaagttgtcatctgttgcgatttgtgtgctcttctaaattttgatcagatttatcgtttt

SEQ ID NO: 36328 - DNA, 1027 bp, Triticum aestivum
  Clone ID: PAT_TA_36328
ttcgagcggccgcccgggcaggtacgggcaggatgccaccaatgtcggagatgaaggtggttttgctcctaacattcaggagaataaggagggccttgagctcttgaagactgcaattgaaaaggctggatacaccggcaaggttgtcattggaatggatgttgctgcttcagagttctacaatgacaaggacaaaacctatgacctcaacttcaaggaggagaacaatgatggttctcagaagatatctggagatagcctgaagaacgtatacaagtcatttgtgagtgagtaccccattgtgtcgattgaggacccatttgaccaggatgactgggtgcactatgctaagatgactgaagaatgtggagtggaagttcagattgttggtgatgaccttctagtcaccaacccaaccagagttgcgaaggcaatccaggagaagtcatgcaatgctcttctgctgaaggttaaccaaattggatccgtcactgagagtatcgaggccgtgaagatgtcaaaacatgctggctggggtgtcatgaccagccacaggagtggtgagaccgaggacacattcattgctgatttggctgttggtctgtccacgggtcagatcaagaccggggctccctgccggtcagagcgtcttgccaagtacaaccagcttctgaggatcgaggaggagctgggcgacgctgcagtgtatgctggcctcaagttccgcgcaccggtggagccctactagacggtatcttcgcgagtttttgtgaaaatgggtgtgtttaacctccggaatgaactctggttgaagctcttaggattgagcaataatgccgcgcatgtttatgtgaacggaacggatatgtacccccaaacttgctccaattttggtccttgtggatatgtacctgattcggccccgaaccttttgggtgtgtaatactagtttttggcgcatcatcttcactgttattgtgttaaaaaaaaaaaaaaaaaaactcgagacctcggccgcgaccacgct

SEQ ID NO: 36329 - DNA, 951 bp, Triticum aestivum
  Clone ID: PAT_TA_36329
tgattcgccaagctcgttattaaccctactaaagggaacaaaagctggagctccaccgcggtggcggccgctctagaactagtggatcccccgggctgcaggaattcggcaccaggccgccgccgctcccagctcgcgctccctcgcccagccgccgccgccgcctcctcgtcggagttcttcccacccctttcgccaacatgggtaagacacgtggtatgggagctgggcgcaagctcaagacccaccgcaggaaccagaggtgggctgacaaggcatacaagaagagccacttgggtaacgagtggaagaaacccttcgccgggtcatctcatgccaagggcattgttttggagaagattggtattgaggccaagcagcctaactctgccatccgtaagtgtgctcgtgtgcagcttgtgaagaacggaaagaagatcgctgccttcgttcccaatgatggttgcctgaacttcatcgaggagaatgacgaggtgctgattgctggattcggtcgtaagggacatgctgtgggagatattcccggtgttcggttcaaggtcgtcaaggtgtctggtgtgtctctgcttgccctcttcaaggaaaagaaggagaagcccaggtcttagattgccgttgcatggaatagacagtatgtcgggcctttagatgttgaaggaggatggttcctttgtgtttacagcacttttaagttgataacttatgatcgtgttggtgaaaactttgccttgtcacattttgctcctgttaagggaaagtgctactgttaaaaaaaaataggattgagcaataatgccgcgcatgtttatgtgaacggaacggatatgtacccccaaacttgctccaattttggtccttgtggatatgtacctgattcggccccgaaccttttgggtgtgtaatactagtttttggcgcaaaaaaaaaaaa

SEQ ID NO: 36330 - DNA, 870 bp, Triticum aestivum
  Clone ID: PAT_TA_36330
gccggccgggttccgcttcgcccgccgcctcctgctctccccatctccttaggttaggttaggctaggggcttcacagagctcgcggaaatggtggccttcaggttccatcagtaccaggtggtgggtcgtgcgctgccgacgcccggcgatgagcagccgaagatctaccgcatgaagctctgggccaccaatgaggtccgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcaggactggctaccacaacatgtacaaggagtaccgtgacaccacactaaatggtgccgtggagcagatgtacactgagatggcctctcgccaccgtgtgagatccccctgcattcagatcatcaagaccgcgactgtcaacttcaagctatgcaagagagacaacaccaagcagttccacaactccaagatcaagttcccccttgtgtaccaaaaggtcaggccaccaaccaggaagctgaagaccacctacaaggcaacgaggccgaacttgttcatgtgattgggctgtggtggatgctgttaagagttgaaatgttttcttcgtatgttggatcttctgatgcatgaagacaagcgttttgttgcttatttatcggttaaagacatggttggtggaccttctgattgtgttcttatcagtaatctgcatacaatctattggtacctgatatagatatctgtttgaagtctgttccaaaaaaaaaaaaaaaaagtcgacgcggccgcggtcgacgcggccgcga

SEQ ID NO: 36331 - DNA, 962 bp, Triticum aestivum
  Clone ID: PAT_TA_36331
gccggccggtccgggccttcgcccgccgcctcctgccctccccttctccttaggttaggttaggctaggggcttcgcagagctcgcggaaatggtggccttcaggttccatcagtaccaggtggtgggtcgcgcgctgccgacgcccggcgatgagcagccgaagatctaccgcatgaagctctgggcgaccaacgaggtgcgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcagaaccggctaccacaacatgtacaaggagtaccgtgacaccacactgaatggtgccgtggagcagatgtacactgaaatggcctctcgccaccgtgtgagatccccctgcattcagatcatcaagaccgcgactgtcaacttcaagctatgcaagagagacaacaccaagcagttccacaactccaagatcaagttcccccttgtgtaccaaaaggtcaggccaccaaccaggaagctgaagaccacctacaaggcgacgaggccgaacctgttcatgtgattgggctgtggtggatgctggtattttggttgggcagaagcacaaaagttgaaatgttctcttagtatgttggatcttctaatgcattaagacgagtgttttgttgcttatttatcgtttaaagacatggtcggtgaaccttgtgattgtgttcttatcagtaatctgcatacaatctattggtatctgatatagatctgtttggaggcggttctgttttgtatcatttgctaattgtgaagtgtagttcctcttacgattgccttcactgtttttaggatataatcatatcactatggtaaccacaaaaaagaagaagaagtgaaacacataaa

SEQ ID NO: 36332 - DNA, 2554 bp, Triticum aestivum
  Clone ID: PAT_TA_36332
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaagggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgccaagaagattgtcccaagcagctgccgtgccatgattggtcaggttgctggtggtggcaggactgagaagccaatgctcaaggctggtaacgcctaccacaagtaccgtgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcattgctgccaggaggactggtcgtctcagaggccaggctgctgcctctgctgccaaggccgacaaggccacttagagctatcgttgctgtttatctatgtttgctgcctctagattacccgtcaaggacatgtattgcagtatggatgtcgtttttgctcactttggtaacctgggtgatgtttgttaaaaaaaaaagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatggcgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagacagcaagacgacggccggttacactcagcaggcggcggtgaaaaccaaggacgtgacgctgtcgaccgccgcgcaagcggcgcagaaggccaaggaggtgaccgcggtcacggcgcagaaggtggcggagtataccaaggagatggcggagcaagggaagaacgctgccgcccaggccgaggagaaggcgaaggaggccgcagcccgcgccgccgacaaggcggaggagccgagcttcgacacgggcacgcaggccaaggacaaggccaagggctcagccgcaggtgcggtggacaagacccgcgacacggccgcgcaaaccatggacaaggccaaggacgtaactggagacacggggaacaggaccggaagcatggctgcgcaggtgaaggacacgaccggagccatggcgcataaggcgagtggcacggccgcgtacatcaaggactcggtgatgggcgcagcaggaggcacggcggacaagacccgcgacaccaccgagcaaacaatgggcagggccaagggcgcgacgggagacacgggggataggaccggaagcatggccgcccaggtgaaggacgcgaccggagccatggcgcagaaggccggcgacacggccgcctacatcaaggactcggtgacgggggcggtgggaggcgccgtggacaagacccgggatgccacgtcgcaggtcgcgcagaagacaggggaggcgacgaacagggcggtggagaccggcaaaagcgccaccggcggcggcacgaccaaggcgaagggtgaaggcaccgaagacaccaagatcgtggaagacgtgctggaggtggtgggcgcgaccgtggaggcggtgggcgcgaccgtgaccgggctagcgcagcacaccaagggcatcgtcgccggcgaagaggagctcatcccggtcgagggggaggccgggaaggtcgccggagccggtgaaggcagggagaaatccgagtgagcagatccacacgtacgtcgcagcaaaaatgttaaaagaatgttggttgtgtagtcactttgatcagacacgtttaaaaggatattgtatatagttgtaatagtaagtagtgcactatatggagtgctcaggtgagccgaataatggtcgtttatatgtaagcggactatgtccacatgttgaagctgctgctactagtacgtttggaagcgctcagctagtacaatactcaaatcttatggaatgaaatggctatgtagtgtgatgcatcgttatttagccaagtgaactagataaatgttcgtgtaaatctgaagtgatacttgtccacttcaatattagaatcatcaagctct

SEQ ID NO: 36333 - DNA, 794 bp, Triticum aestivum
  Clone ID: PAT_TA_36333
ctactattcgcctttccgcaccctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagctgtcctctccgtgaacgacggtagtggatcgggatgagttgattccggttgtagtttgttcctaattgctgttctaggtcttaagcttttgtgtagaagaaatatggttgttaggtatgagtaagacgaaccaacttgatatgtgatgttccttttggtttgcgatgaagcaaacgtatgtctatgttgaagacctcagaaccattgttgttcgctgcaactctgttgttgtcgtgcccttgatcccatcgtggtattgtatcttgatttgtggtgcgactaattgctgtttttct

SEQ ID NO: 36334 - DNA, 894 bp, Triticum aestivum
  Clone ID: PAT_TA_36334
attcggcacgaggcatctccttaggtttcagttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaacgaggtccgcgccaagtccaagttctggtacttcctgaggaagctcaagaaggtgaagaaggccaacggccagatgctcgccatcaacgagatctttgagaagaaccccaccaccatcaagaactacggcatctggctgcgctaccagagcaggaccggttaccacaacatgtacaaggagtaccgcgacacgaccctgaacggcggcgtggagcagatgtacacggagatggcgtcacggcaccgcgtgcgtgccccctgcatccagatcatcaagactgcgacggtggacttcaagctgtgcaagagggacaacacgaagcagttccacaactccaagatcaagttcccgctggtgtaccagaaggttcgcccacccacccgcaagctcaagaccacctacaaggcgacgaggcccaacctgttcatgtgagcgggtccctactctactctactggtctgtgtgttttagcgtgtaagagtttgaagatttttgcatgtggaagttttggttaagcactttgatgttttcagtcactaaggatgctgctgctttgatgcaactcttgactttgtttcgtattagtaatgcgcagcagatccatcaactgctagccctcagctgctttttttttggtttggtctgctttcatatgcagatgagaagtctgatgcctgaaattattccgtgcgcccacccttttcgggcggttgttagcgaatg

SEQ ID NO: 36335 - DNA, 1752 bp, Triticum aestivum
  unsure (1)..(1752): unsure at all n locations
  Clone ID: PAT_TA_36335
gcctgcggtaccggtccggattctccggtcgacccacgcgtccgattcgtttcgatctatttcggcttcctctcctccaagcttcggccatggccgccacgatccagtccgtgaaggcccgccagatcttcgacagccgcggcaaccccaccgtcgaggttgatgtgtgctgctcagatggaacctttgccagggccgctgttcccagcggtgcatcaactggtgtttatgaagctttggaactgagggatggtggatctgactacttgggaaagggtgtatccaaggctgttgacaatgtgaactcgattatcgcgccagctttgattggcaaggaccctacagctcaaactgagctcgacaactatatggttcagcagcttgatggaaccaaaaacgaatggggttggtgcaagcagaagcttggtgctaatgcaatcctggctgtgtcactagctgtttgcaaagctggagccagcgtcaagaagattccgctgtaccagcacattgccaaccttgctggcaacaagcaattggttttgcctgttcctgcattcaatgtcatcaatggtggatcccatgctggaaacaagcttgctatgcaggagttcatgatccttcctactggagctgcctcattcaaggaggcaatgaagatgggcgttgaagtgtaccacaacttgaagtctgttatcaagaagaagtatgggcaagatgccaccaatgttggagatgaaggtggttttgctcctaacattcaggagaacaaggagggccttgagctcttgaagactgcaattgaaaaggctggatacaccggcaaggttgtcattggaatggatgttgctgcttcagagttctacaatgacaaggacaaaacctatgacctcaacttcaaggaagagaacaacgatggttcccagaagatatctggagatagcctgaagaatgtatacaagtcattcgtgagtgagtaccccattgtgtcgattgaggacccatttgaccaggatgactgggtgcactatgctaagatgactgaggaatgtggagtggaagttcagattgttggtgatgaccttctagtcaccaacccaaccagagttgctaaggcaatcaaggagaagtcatgcaatgctcttctgctgaaggttaaccaaattggatccgtcactgagagtattgaggccgtgaagatgtcaaaacatgctggttggggtgtgatgaccagtcacaggagtggtgagactgaggacacattcattgctgatttggctgtcggtttgtccacgggccagatcaagactggggctccctgccgctcagagcggcttgccaagtacaaccagcttctgaggatcgaggaggagctgggcgctgccgctgtgtatgccggcctcaagttccgtgcaccggtggagccatactagatgggatctgcatccgagacatgatcaccactctgcacttgtttttgtgaaagtgggcgtgtgttaacttgtggaatgaactatggttgaagctcttaggacttgtcgagcaataatgtaccgcatgttgctgtgaacgggacggatatgtacctacgtactccaaacttgctccaattttggtctttgtggtgagcgagcaagtacgcctgattaccttttggatctgtagtaaactgtttggctgttggcatcatcatatttggcgtcagtttaatcttgcagaaagcatgcttttcgttcgccattcctaanaaaaaaa
